United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 3

SEQ ID NO: 8230 - DNA, 813 bp, Glycine max
  Peptide Sequence Number=SeqID_125008
atgtcagcctcttcatggaacaacaaattccacaaccatgctcgttctaatagtttgccctctaagccacaccctctcatcctacaatgcaatgaacacttagctagattaggggccaacgataccatctcttcttcattgttaaggcaaaatctaagtagccttcttgatttgcaagagtgcattgaaaagttggttcaactacccttaactcaagaagcacttcttcaagaacgccaagagaaatgggtggatgatctcttggatggatctctaaggctccttgatgcttgtaccgcaaccaaagatgccttacttcacaccaaggagtgcactcgtgagcttcaatcaactattagaagaagaagaggtggtgaagtggaactcgcggtagaggttaagaaattcttgacctcaaggaaggtggtgcgaaaggccatattcaaagccttggagaatctgaagggtaataataatgcaaataagggaaaccttgccatcactaattacaaagactaccaaaccatggcattggtaaacttgttaaaagaagctgaagtgctgatgcacaacaaaagggtagctacaggctacgcacaaggagcagatgagaatgagtttgcaaaagtggatgctgcattgcagttatttgcctttaacatgtcaaccaagtcaaatgatgatatcagtgatttgcaaaagaagctagagaacttggggacttgcatacaagatcttgaagaaggacttgagtcactgtttaggcgtttgattaaaatcagagttgcacttctcaacatccttaatcactag

SEQ ID NO: 8231 - DNA, 213 bp, Glycine max
  Peptide Sequence Number=SeqID_125009
atgctggcatcttcgaaaaaggtgcagatgaccacattggcctctgcttgtcaatcgaacttggggtctccgaatgacgaggtgcggataaccgaaaggtgtctccgcatgctaccagactcttgggtcatgagagcaaaaggtggggtggtcgacaaaagcgaggcttttgctcctacgtatcctccatttgtgatgaagaactcagactaa

SEQ ID NO: 8232 - DNA, 180 bp, Glycine max
  Peptide Sequence Number=SeqID_125010
tgaggaccctctagtgcaatcctccattctccagggtttttcatcgtcaagtgcggatcctcttaactgggaaataaaaagaaggagtagagacgagagtcgtcatagactaatcacagaaagggcaagacggatgaaatcagtgtcttatctttgctttcctcttatctccgataaaag

SEQ ID NO: 8233 - DNA, 892 bp, Glycine max
  Peptide Sequence Number=SeqID_125011
ggattggctcccaagtctgagaaccgctaaaagggaggaagttgaggcaccggaggaagacgaagaggtgcaggctcttaggacagaactcgagcaagctcaaacagtcaaagaaaggttcaaatcagtggctcttaggatccgaaaggagaatgccgaactgagggatgtaaatgtagctaccaccaaggccttggaacaagagaccaagagggctcgtagggaagagcatggccggaacaagtttcgaggggctctgtggggtagtaacaacgagcttaaactccggagggaggaaagggaccaatcgcgggtagacagtttgatcttgaaggatgagttgaaggcttgctcgaggtccaagagaagtttgtctcagcgtttatgcgagacagagaccaacatgttagccatcatcagcaagtaccaagaggaactaagtctagccatgacccacgagcatagggtggtggacaagtatgcccaagtgtacgcggaaaaggaggctagaggaagggtgatcgactcgttacaccaagaggcaaccatgtggatggaccgatttgctcttaccttgaacgggagtcaagatcttccccgattgctagccaaggccaaagcaaatggcggacacctactccgcccccgaggagatccacagacttctcggctattgaaaaatgccataactaaacgcgccccaaggcatccctatcgcactagatccaaatctaagacgatgggtgaccaagaggagatacaggaacagatgaaagtcgacatgtcggctttgaaagagcaaatggcttccatgatagatgccatgttaggaatgagacaacttatggagaataacgtggccaccgctgccgctgttagttcggctaccgaa

SEQ ID NO: 8234 - DNA, 249 bp, Glycine max
  Peptide Sequence Number=SeqID_125012
atgcattgggaatgcaaaaattttccaacatgcttctgggggagatacatatctaatgattcaagcagcacacatatattgttgaagatagaatcagatgttggtgagaatagaaggatacctgcaatcaagatattgcttaatttcatcttgatttccaagagaagttgtgatacggtcagaacctttgttgatgtatttgaacagatatttaatggatgtactttgattacaccattccacgtttaa

SEQ ID NO: 8235 - DNA, 367 bp, Glycine max
  Peptide Sequence Number=SeqID_125013
atggggtatttcatgtgtctcccccatgggttgagagacatgtgcatgatcagattgaggcaagccatattgcaggaaggcgtacttgttttgaatttgcacataatgggggtcgcccatgggggtgtcgggtgtggaagcaatgacttccaagattattttgatgatgccaaagaatcaagagttaagcaagttccaaagaatcaggagtcaaaaagcttcaagaatcaagtttcaaagaatcaagattcaagaacaatcaagtttcaagattcaatcaagtttcaagaatcaagattcaagaacaatcaagatcaagattcaagactcaagattcaagaatcaagagaagactcaatcaagataa

SEQ ID NO: 8236 - DNA, 1117 bp, Glycine max
  Peptide Sequence Number=SeqID_125014
cgcgcagttgggcaccgtaacccagcttccggttcatcccgcatcgccagttctgcttaccaaaaatggcccacttggagctctcgattccatggcgcggctcaacagagcagccgcaccgtcctacctatttaaatctttcgcccctatacccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaaagcactctttgactctcttttcaaagtacttttcatctttccctcgcgggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcatt

SEQ ID NO: 8237 - DNA, 399 bp, Glycine max
  Peptide Sequence Number=SeqID_125015
atgcagagtttgattgaagaggctaagttggagtgtgttaatatgccaagatatggtcttactgctaagaaagttaagcaattgattggtgcagaagggtctttcactcttgagaagttggagacattcaagtcgcgttgggatgacggtttgaaggagaatggtaatggtgatttcgtattagatactaatgtcagagccaaattcatcgccaaatatgtgagagctactactgaaccttttatgacggcacggtttggagaaggaataattgatgaattatttcctaaatacagaaacaaggttgcggaactgttggaagaagtgatattagagcatgcttacctggtcatgggtctacctactgtaaagaatgatgaggatgaggaagaagaataa

SEQ ID NO: 8238 - DNA, 1710 bp, Glycine max
  Peptide Sequence Number=SeqID_125016
atgactgacatcatgtccgcacctgttgacccacccatgaaacttggtcatgaaattgaatattccgaggatgaaaggaagaaaaagcttggatcgttcaagaaggtggcaatcagcgcctcatctaagttcaagcattcctttgctaagagggggaggaagcacagcagggttatgtctctttctatcgaggatgatcttgatgcagaagagttgcaagcagttgatgcttttcgccaagcactcatcttggaagagctattgccctcaaaacatgatgatcatcatatgatgctaagattcttgagagcaaggaagtttgacattgagaaaacaaaacaaatgtggacagatatgctcaagtggaggcaggaatttggtgctgacactatcatggaggattttgaattcaatgaactagaggaagttctaaaatactacccacaagggcatcatgggattgacaaggatggccgacctgtttacattgaaaagttgggccaggttgactctaccaagctgatgcaagtaacaacaatggaacgctatctcaagtaccatgtaaaagagtttgaaaggaccttcgctgttaagttgcctgcatgttctatcgcggcaaagaagcacattgaccaaagcacaactattttggatgttcaaggagtgggtcttaaaagtttgaacaaagctgcaagggatctcctccagaggcttcagaaaattgacggtgacaactaccctgagtcactgaaccgtatgttcatcatcaatgctggttctggatttaggctcttgtggaacaccattaagtcattcctagatcccaagaccacctcaaaaatccatgtcctaggtaacaaataccagagcaagttgcttgaaatcattgatgccagtgaacttccagagttcttgggtggtacttgtacttgtgcagataaaggtggttgtatgctttctgacaagggtccatggaatgacccagatatcttgaagatggttcacaatggcgagggcaaatgcaagagaaaaaccttatctgggattgaggagaaaagaatcatagaagatggtactgcaaatcaaaatctaggaaacaaagaatcatttccagagagatacgatgttgatgtacaatgtttatctccaaaaaagcaatgtactgtgtataaatatgacgcatttgtccctgtgcttggcaagccagtcgattcatcttggaatacattaacacagaaagataaagatgctctttctaaaggtgcagattgttttcctagcaagacttgtgatgggtatagcaatcactttgttggaggaatcatggccattgttatgggaattgtaacaatgatccgcatgacaaggaacatgccaaggaaaatcacagaagcagcactgtatggcagctcagggtattatgatggcactatgatgaaagcagccaccttttcatgcaatgattacatggccatgatgaagcgcatggctgaactagaagagaaagtcactatccttagcatgaaacctgtcattccacccgaaaaggaggaagtgctgaataatgctctaggcagagtcaccactatcgaacaagacttggttgcaacaaaaaaggcacttgatgatgcccttgctcgacaagtagaactccaagctcaaattgacaagaagaagaaaaagaagaacaagttgattatcttgctttga

SEQ ID NO: 8239 - DNA, 1596 bp, Glycine max
  Peptide Sequence Number=SeqID_125017
atgcccagtgattcttctgtaatctccaatggacacagcaatggcagtgtcaatccactacctaacctgcaaaggacttaccaagtggtagtggctgccactcaagattggggcatcggtaaggatgggaaattaccctggagattgcctactgatctcaagttttttaaggagatcactatgaaaacatctgatcctgggaagaagaatgccattgtaatgggaaggaaaacatgggagagcatccctcttgagtacaggcctctttctggtcgccttaatgttgttcttactcgctcaggaagttttgatattgcaacagcagagaatgttgttatatgtggaagcatgtcttctgcattggaactgttagctgcttctccttactctctgtcaattgagaaagtttttgttatagggggtggtcagatatttagagaggctctcaatgtgcctggatgtgaagctatccacttaacggaaattcagtcaagcattgagtgtgacacttttatgcctccagttgatttcactatatttcggccatggtactcatcctttcctaaagtggaaaacaacatccgctattctttcaccacttatgtgcgtgtacggagttctgctgcagagtccgcgggtcagaacattgatccacttcttgataataattctgagtccatgaaatttgaggtcaaggatttttcttttcttcctaaaatgatttctgagagacatgaggagtatctgtatcttaagctggttcaggacatcattgctgaaggtacaactaagggtgataggacagggactggtaccttgtcaaaatttggttgccagatgaggttcaatctgcgtggaaactttcctcttctaacaactaaggcatgggaatatctatttgtaaattttgatagagaatttgacttgatttcttcgattgattgtagaaagtattttggcgaggggttgttgaagagcttctttggtttatcagtggctcaacaaatgccaagtgttggtttgacagagcgggaggagggtgacttgggacctgtttatgggtttcaatggaggcactttggtgccagatatactgacatgcatcatgactactccggccaagggtttgatcaacttttagatgttattaacaagataaagcgtaatcctgatgatcggcgaatcattctctctgcatggaatccagtggatcttaaattaatggcacttccaccctgccacatgtttgcacagttttatgtagcacacggggagttatcatgtcaaatgtatcagcgatctgctgatatgggcctgggcattccatttaatattgcatcttatgcccttttgacatgcatgattgctcatgtttgtgatctcattcctggtgattttattcatgttattggggatgctcatatttaccgcaatcacgtgaggcctttgcaggagcagctccataaccagccaaagccttttccaactttgaagataaatccaaagaagaaagatatagattcttttgtggctgctgatttcaagctcataggctatgatcctcaccagaagattgatatgaagctgtctgtctaa

SEQ ID NO: 8240 - DNA, 752 bp, Glycine max
  Peptide Sequence Number=SeqID_125018
atggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccagcatacctgtcggggacccgaaagatggtgaactatgcctgagcggggcgaagccagaggaaactctggtggaggcccgcagcgatactgacgtgcaaatcggttcgtctggactggggtataggggcgaaagactaatcgaaccgtctagtagctggttcccctctgaagtttctctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccg

SEQ ID NO: 8241 - DNA, 378 bp, Glycine max
  Peptide Sequence Number=SeqID_125019
atgagttcttcttctggtcagagcagtggctatgatctttccttcaagatcttgttgatcggtgactctgctgtgggaaaaagtagcctccttgttagcttcatctccaactctgctgaagatattgctcccacaattggtgttgattttaagatcaagatgctcacagtaggtgggaagagattgaaactaactatttgggacactgctgggcaggaaaggttcagaacgctaactagttcttactatagaggagcacagggaattattcttggtatgcaaaatggtttatgtgcattttttttttcctgcattagaggcctcaccgttgtggttccagctcagattgaactctattttaattctttaatttcatag

SEQ ID NO: 8242 - DNA, 321 bp, Glycine max
  Peptide Sequence Number=SeqID_125020
atgatgcatggatgcactttagacaaaagaaaagtgtcatctggaacctttaatgaaagcaacccaaacctgctgttaacagattctgaaagggttgtgagcaaagaagagggtttagcacttgccgaggagttgggatgtctgttttttgaatgtagtgccaaaactcgagaaaatgtggagcggtgcttcgaggaacttgcactaaagataatggaagttcctagtcttttggaagaaggatctacagcagttaaaaggaatattctaaagcaacaacaacaaccccaagcatccgaatttggtggttgttgctcttaa

SEQ ID NO: 8243 - DNA, 240 bp, Glycine max
  Peptide Sequence Number=SeqID_125021
atgaagctcggattgggcctcctcctacccacgagggttcatgtcccagtttataatggatcgaccttcttgagcccgatccaatccaggatcctgatcgtcgtcactgttgccgtcgtcgtcgccaacgacaatggtggtggttgcaacagtgatcatggtggtgacaacaacgatgatgaatgtcataacgacaaagataatggtggtgatgacgatgacaattatagtagtggttga

SEQ ID NO: 8244 - DNA, 359 bp, Glycine max
  Peptide Sequence Number=SeqID_125022
gttcaaaccagaggtttgggtcagacattaggaagggttataggaaaagtcctaaggagacaagtgatgaggtccacgaacaacctaaaaaagtagttgttgatgatgtagtgactgatgccgaggaatgtccggagctgaagttatcatcccatggaaggaatgttttgaaatttgacaggtctgttccagagattgaaggcttaatgattgccataggattaaatcctttgatcgcatgttcgttgaacactagtgatcgggaacttatattggcatttgcgaaaaggagaggtaactatcaccctcaacaatgtggcatcgttgctacatctaccgattacagaggccttccatag

SEQ ID NO: 8245 - DNA, 186 bp, Glycine max
  Peptide Sequence Number=SeqID_125023
atgagtgcgctcttattgtgtaccagggaacaagttccacgtgctagggccaaggttttcagagcaagtatcactagacttggtactgaaaattcagaactgaaagtcatgagaaaaggaggatggagagcttcttgcaatagcaaaggctgcttgctcctagatattggaattaatgcctcataa

SEQ ID NO: 8246 - DNA, 174 bp, Glycine max
  Peptide Sequence Number=SeqID_125024
atggcatcagaaattcagaatggaccctctcagacgggaaggattgctactctaaagttaaaccccatgttagaggaaagtgtgagagtgatcttcaccttgtctcgggttttcccttctgcagttcattacctgacctggagaattcttgctaacttcatcaattctaattag

SEQ ID NO: 8247 - DNA, 303 bp, Glycine max
  Peptide Sequence Number=SeqID_125025
atggagcgcatgcttaccaagaagttcaagtttcttcttatttatgtaacacttttgtcaacttcttttataattggagaatcaaagttaatcaataatttgcttgaggatggaaattcaattaaaaaagagccacttaatgaggaagaggtatccaccatggaagagatgcttctaagagctaatgtaagagattatggaagatttgatcctccaccacgtctcgttcgaccccctggtaaaggggtaccagcagctcccggcctaaatccaccccctcctagtatcagtgaatccaagtaa

SEQ ID NO: 8248 - DNA, 1965 bp, Glycine max
  Peptide Sequence Number=SeqID_125026
atgggtcaggtaaccgtagaggaagtcagacaagctctcttctctatgaacccttataaagctccaggtcccgacagctttcaacccattttctatcgcaactactgggacattatctctgctgatctttgggagctagtagctcatgccttcgattcaggatccattattccaggtttggctgaaacattgattgtgcctattcccaaggtggattctcctctttcccttagagatttcaggccaattagtttgtgtaatgtgaccttgaaagtcatttttaagagaagtttcattcctaaaaggggaccatctgataatgcaattattgcacaggagattgctcatcacatgcgtaacaagaaagggaaaattagatatcttacgttgaaaattgatttcgaaaagacatatgatagagttaattggaaattttttaaattaactctaaatgattttggattcccgcagaagattatcgatctgatcatgagcagtactactgagacaaacttatccctgaagtggaataataaagtcatggagcagtttcatcctttgaggggccttagacaaggtgaccctacgcgctcccttgaaaggtggatgctcagatttgagaaccagtttctgtatcaccgtctggacctaaggattgatagataccttggtttcccaattctcattggtagtatccaaaagccatattttagctttatcattgataaaatccaagggaaactggcaggttggaaacaaaagctcttaaaccgagctgggcgagtaactttagctaactcggttatctcggccattcctacttatgttatgcataattgctggcggcctgaaggaatatgtgaccaaattgatcaaacagttcgtggcttcatctgggggagctccacatctcattgggtaccttgggaaaccataactcaatctcgagccaggggagggttaggagttcgaaaagctagagaggctaacatttctctcctagggaaacatatttgggaagtgattcataatccggataaattatgggttaagctaatgaccaacaaatacctgaatcataactctatcgtccaatccatgtctccgagaggagcgactttcacttggagttccattctaaaagcaactgatttcttaaaagatggcttcttcataagaattggtcgtggggacgtttcgctttggtatggtaaatggctcttagagggttatctgtgctctaaagttctatatgtgaattaccaggatactcatttacgtgtaaaggatctgtggaataatggtagttggaacttcagcatgttagctactatattgcctaatgacatgaagcagcatatcagaagcattcgtatcaatgacattgtagatgatatcattatatgggcaccctcggctgatggaatctattctgctagttcagtgtacaagtggctcacttccacaccttccaccattgatacctccgaagtttcttggacctggctctggtctctaaatattcctgaaaatatcagatttttcttgtggctctctcttcatgagagcctccccactaacatgtttcgtgtttatagacatctatccctagatgtcaattgttgcaggtgtggcttattccaggaggatattcttcatcttctacattggattcagaacaacatccaaggagataaaggccttctcttttccataaattgctggtttatctggaggtctaggaataaagatattttcaatgataaagttcaaccggtgtggcactttgctaaccagatttacactctcaatgacattatcggtaaggacgttactcaatcgttgcaacagccttctcctatgcaagtgtgttggattgctcctcccggtgaggtcatgaagcttaatactgatgggagcgcttttggaaatccccgggacaagcaagatttggcggaatcataa

SEQ ID NO: 8249 - DNA, 372 bp, Glycine max
  Peptide Sequence Number=SeqID_125027
atgcctattgagcccgacgcagtcctttggaggaccctcatatgggcctgcaaggttcatggggatatcaatagggccgagcggctgatgaagcgccttgagatacaagacacgagggctgatgatagtggaagttacatacttgctagcaatgtttatgcgtccgcggggaagtggtgtaacaaggcagaagtgacggagttgatgaataagaagggactggtgaagccaccgggatctagtaggattgaggttgatggtggtgtgcatgagtttgtgatgggagattacaatcaccctgaggcggaagaaatatttgtcaaactggctgaggtggtgaatatgataagaaaagaagggttatgcttatga

SEQ ID NO: 8250 - DNA, 366 bp, Glycine max
  Peptide Sequence Number=SeqID_125028
atgggcgctgcttgttgtgttgctgccagagacaaaaccatacaaagtggatcaaccagtgacaatttgcatcggaatgttcgatgttctccaacatggagctttcgttgggatcatcgagggcgtgtagctggtgaagatacttctataaattggttttctgacggtattagcaggaatgatggatcagagaataaaaatgaatcaacatatatgtcagaggacggaagtccactgcagaatgatcaacggaaaagatgccaaaaaccatcaatttcgcaagtaactgctgcacataggagaaattcaacttcaggcctagaggaattatatggttattttaaatatgatggcaccattgattga

SEQ ID NO: 8251 - DNA, 2328 bp, Glycine max
  Peptide Sequence Number=SeqID_125029
atgcgccctctgttccgtttcgctcaattggctcggcgccactacaaggcgtcgccaccaccaccaccgccgaccccaccgaagcccccgaagaagccacagaagttcagcttccacggcgcaacgtgggaggatccatacagctggatgtcgcagctgaacgacaaggtggcgatgcggcacatggacgtgtgcatggagcaggaggagaagtacacggaggccgtcatgtcggactccgataacctcctgaacaagctccacttcgagatggcctcccgcatgcccttcgacctctccacccctcccctccgctggggcccctggctctactaccgccgcgccgaagaagccaaaccctaccccgttctctgccgccggttggccgccttgtacgacgacttcatttcgcataagtatccccccgccgggttcgatttcactacggggaagaccattgagcagaagctcatcgactataatcaagaagccgagaggttcggaggctatgcttacgaggagctgtctgaggtttcaccgaatcatcagtttcttgcatacactatgtatgataaagaaaatgactacttcaagttatctgtgagaaatttaaattcgggctccttgtgcagtaagcctcaggcggatcgagtttccaacctggcgtgggccaaggatggacaggctttgctttatgttgtgacggataagaaaatgaggccttaccgtatctactacagtctgattggatcaactgatgaagatgttttgcttttggaagagtcagatgaaagtgttcatgttaatattaggcacacaaaagactttcaattcgtgactgtaaatacattctctaccacatcatcaaaggtctttctaataaatgcagctgacccattgtctggcttgaaactagtttgggagtgtgatgttctagctcactgcataattgaacatcaccgaggttacctttatttatttacagatgctcccaaaggtggtcgatcagttgaatgtcattatcttctttgtagtccagtggatctttcaagtactagaaaatgggaggaggtattagttgatgacccaggtttgattattgaggatattgattttagtgataaatacttagcactcattgtaagggaaggtcgaaaagttcagctttgttcagttggactgccattgccctttgggaagggagcagttaaactgaggaagctggacctacagtacttgtctattccaaaacatgtttgccaaattatgcctggaccaaactatgacttttactcatctgtcatgcgctttataatatcatcacctgtgatgccagatgctgtggttgattatgacctggccacaggtaagtggaacatcattcaacagcaaaatatgcttcatgaccggacaagaatactgtatggtaaaaattctgcaagtattagtatggagccctcaaattccaaacactctagtcctgtgagtgttaacttggaagatgaccacttatggaatgacctgtctgagttttatgcctgtgaacaatatgaggtcccttcatttgatggagttttgattcctttgactattgtttttgcacgtaacaataagacagaagctaaaaaacctggcatattgcatggacatggagcttatggtgaattacttgacaaacggtggcacagtgaactaaaaagcctcctagatcgaggttgggttgttgcctatgccgatgttagaggtggaggtggttttggtaagaaatggcataacgatggaagacgtgcaaagaaacataattcaattaatgattacatctcttgtgccaaattcctcattgaaaaagatattgtgcatgaaaacaaattggctggttggggatatagtgctggaggacttttggttgcttctgccattaatcgttctccagatttatttcgtgctgcagtcttaaaggttccctttttagatgcaacaaacactcttctgtatcccatcttgccacttatagctgctgactacgaagagtttggctaccctggggacctcaatgattttcttgcaattcgagaatattctccatatgacaatatacaaaaggatgctctttatccagctgtattagtaacctcatctttcaatacacgatttggggtatgggaagctgcaaaatgggttgcacgagttcgtgatctctcaatttacgacccaaagcggccaatattgctgaacttgaccacagatttagtagaggaaaaccgttatttgcagtccaaggaatcagcattagaggctacatttctcatgaagatgatggaatcttag

SEQ ID NO: 8252 - DNA, 2688 bp, Glycine max
  Peptide Sequence Number=SeqID_125030
atgtcgccggtgaggacaatgacggtggctgcggccgacgtcgcagtgtcatccgacggggaagccgagtactcgtttgccgtggcgtacaacggacctcccccggcctacgatctcccccgggcggtccctatcgccgccggaaagattccggcagcggttactttggcgcaggttccgttctccgacgcgctgtctctgccgatggtgcaaccactctcgaaggagctgaaaacgccgagttccgagcccgcggtttctccgacgtcggtgatcgccttcgaccggagccacggaggcggctccgggagagtcacggtgtcgccgacctccgtgatcgcgttcgaagacgccgccgccgccgctgcagcggaagccaacgacgcgagcagcgaaaactcgttctcggacaatttaacaacacgaaggcactcgaattgcgagaaagagagttcgagtttcgatttcaacgattcgagccaacgcgactacgcttccacgctgagttccgattatccatcgtctcataacatttctcctctgaaaacaaacgaaaccgaaccagaacacgacgtcaaacgcgcacctgtgctgcgtttcgaggaggaacaagaacaacacgaagcaaaagagagggttaagagagaaaatgtgaagaaagtgaagaaaggttcgtgctatcgctgcttaaagggaaataggttaacggagaaagaagcgtgtctggcttgtgacgctaagtattgcgggaactgcgtgttgagagcgatgggttcgatgccggaaggtcgcaaatgcgttggctgcatagggcttccgattgacgaggctaagaggggcagtttggggaaatgctcgcggcttttgaagagattgctcaatcatttagaggttaggcaagtgatgaaggcggagaggttctgtgaagtgaaccagcttccgccggagtacgtttgtgtcaatgggaacgaacttggttttgaggaacttgtcacgttgcagagttgtgctaatcctcccaagaatttgaaacccgggaactattggtatgataaggtctctgggttttgggggaaggaaggacagaagccttgcagaattattagtcctcatttgaatgttgggggtcccatcaaaccggatgcaagcaatggaaacacacaggttttcattaatggcagggaaatcacaaaagttgaacttcgaatgttgcagttggcaggagttcagtgtgctggtaacccacatttttgggtcaatgaggatggttcataccaagaagaaggacaaaaaaatacaaaagggtgtatctggggaaaggctggaaccaagcttgtatgtgctttactgtccttgccagttccttctaattctaaatgttcaagttcgtgtgggtttctatcctccaatgtggctaccagaccagttcctgaccactttgagcatggaatagttcataaactcctcttacttggttacaccgggtctggaacaagcacactttttaagcaggccaagattctttacaaaagcacccccttttcagaagatgaacgtgaaaatataaagttgaccattcagaccaatgtctatgcttatcttggcatactccttgagggtcgtgagcgttttgaagaagaaagcttcgggaatttaaagaaaaatcaatcttctgtgcttgacactacaggaaccagtccaaaacttggtgacaagacaatttattccattggcacaagactgaaagcattctctgattggcttctgaaaactatggtttccggcaaacttgatgctatctttccagctgctactcgtgaatatgctcctttgattgaggagttatgggatgatgcagccattaaggccacctatgaaagaagaaatgaaatagaattgctacctagtgttgccagttatttcttagagcgggctgttgagatactgaggactgagtatgaaccctcggatttagatatcctctatgctgaaggagttacttcatccaatgggatggcttctgtagagttttcatttcctcaaccagctcccgaggaaactgttgacactgctgatctacataattctttagttaggtatcaactaattacaatacatgcgagagggctagcagaaaattgcaagtggctagaaatgtttgaggatgttggattggtcattttctgtgtttccttgagcgactatgatcagttttctgttgatggaaatggtcgtcgcacaaacaagatgatatcaagcagaaagctttttgaagccattgttactcatcctacttttgagcaaatggacttcctgttgatattaaacaaattagacgagtttgaggagaaaatcgaacgaattccactcaccaagtgcgactggctatctgattttcgtccagtaattagtcaacatcgctccggcatcaacagcaacagcattagcaatagcccctcccttgctcagctggcttcctattacataggagtgaagtttaagaggctctattcatctcttaccgggcggaacttgtatgtttccctggtgaaggggctggaacctgatagtgttgatgaagcacttcaatatgcaaaggagattttgaagtggaacgaagagagaccaaactttagcttaagtgataactcgatgtatagcattgaggcgaattcattctctcattga

SEQ ID NO: 8253 - DNA, 225 bp, Glycine max
  Peptide Sequence Number=SeqID_125031
atggttaaaattcccttatatggttgtgactgctatgcatatgctcttttgtcttctggttttgtggatcttgttgttgagtctggtctgaagccatacgattttcttgcactgatacctgttattgaaggcgctggaggtgtcataactgattggaaaggagataaactgttttgggaggtttctccactttcaatcccaacatgtatggcgcctttgctctag

SEQ ID NO: 8254 - DNA, 1319 bp, Glycine max
  misc_feature (209)..(209): n is a, c, g, or t
  Peptide Sequence Number=SeqID_125032
catcggttctgggcgtgatgctttatacgctggtgtttatttttgcacatcatttttggtccgccgccgcgacgcaggcggtgcgtggacagccggaactgctgctgtttctgctgccgggcatcgtgatggcgctgctgcagccggacagtccgctgatcggcacactgtggatcgcgctgggcggaacgctgctgggcatgacgtgngtgtggctggtgatgccgatgacgcacagcttgctgctggtgacggcgtggagcctgagtgctctattctgggcggggtgcggtgcgctgctggtgcgcctgttgcgcattatgctggcgatgcggaccagctgagtgaagcgaagacgggcccgcaggcccgtcaggaagatctgcggcacggtagaaaccggtttgccggcacgcgcttccagatcggctttggtgatgccggtcgcctggatatcgacaaattgcctgttactctaatgcgcgctgtctatacccggtcacaatgccgtactacagtattcggcgctgggcgtgctggcagtgattggcgcgctgctgctggtcaacgactggctggcggcaccggcattcatggcgaaaaaaccgctggcaacgctgctgttttttctcggcattgcgctgatgctgcccgcagcgtggctgatgatgtggcgcaccgccaaggcgatggcaccgcagttgttcaatcacacccacaaaaagaagggattgatgacgcccagcgcagcgcgattatcgctgcggcgcaggcggcctcgacctccagttttttacagtgttcttccattgtccgtatcaccgaccgcgccctgcgcgagcaactggtgcagctcaccggcggccagccgtgggtcagcgccgcagcggagttttgggtattctgcgccgacttcaaccgccaccagcaaatctgccctgaggcccaactgggccgtgccgaacagctgctgctgggctgtgtcgataccgcgctgatggcgcagaacgccatgatcgctgcggaatcgctcggtttaggcggcgtgtttattggcggcattcgcaacagcatcgctcaggtgacggagctgctgggactgccgaagtttgtgctgccgctgtttggtttctgcatcggccatcccgacgcgtcaccggacgtcaagccgcgcatgccgcaggcgatgctggtgcatgaaaaccgctaccagccgctggataaagcggtgctggcgcaatatgaccagcaaatcaccgcttactatcagcagcgcgacagcaatcagcgctcggaaacctggagcgaactgattcagc

SEQ ID NO: 8255 - DNA, 813 bp, Glycine max
  Peptide Sequence Number=SeqID_125033
ccctcgcctcagagggctacacgccctcgcctttagagggctatacgccctcgcctttagaggactaaacgtcctcaccttcaggaggctatacgccgtcgccttcaaaggactacacatcctcgcctcaagagggctgcacgccctcgcctttagagggcttcatgtcgtcgcctttagaggactgcacgtcctcgccttcagagggctacacgccctcgccttaagacagatgcacgccctcgccttcagagggctgcacgcccttgccttcagaggactacacgtcctcgccttcagagggctacatgccctcgccttcagagggctacacgccctcgcctttagagggttatacgccctcgccttcagaggactacacgtcctccccttcagagggctacacgccctcgcctttagaggactacacgtcctcaccttcaaagggctacacgcccttgcctttagaaggctatgtgccctcacctccagaggactacacggcctcgccttcagaggactacacatcctcaccttcagagggctacacttcctcgccatcagaagactgcatgtccttgccttcagagggctacacgtcctcaccttcagagggttgcacgccctcgccttcagagggctacatgtactcgccttcatagggctacacgccctggtcatcagagggctacccgtcttcgccttcagagggctacacgccctcgtcatcaaagggatgcacgccctcgccttcagagagccacacaccctcgccttcatagggctacacgccctcgcctcagaaggctacac

SEQ ID NO: 8256 - DNA, 364 bp, Glycine max
  Peptide Sequence Number=SeqID_125034
atgaactctcaccatccctatggtactatggctgtacagctacagtaccctatgaagagattttccactttttgtagagtagggttaccgcgctctctatctagaatcggccatgttagaagtcttaaggaggtggacgcaggattggcttcggtctgtccacaggtactggagtacagcaatggatccctgggtaaccatccaccaactattggatgcccccgtgttaagaggtgtattctcttaaagccggaagtgacgcagaacagctacaccgctagcaggaggggatattctttaaccaagaccggcattttagtggaagggcgtgctcctcaactcctatacccggaagtgggaacta

SEQ ID NO: 8257 - DNA, 252 bp, Glycine max
  Peptide Sequence Number=SeqID_125035
atgtcaggatttacacgcaattctcctcaaatttcagccagctcgcatcaattagaccttgcaccttacgcttcagagccctacaatgctcaatggaacgccccggggcttctccgtgacaagcacacgttgcgttcgagtcgtattctcagagaaatggaggttgatgaaccttggctagggttatggctaccattgaattatcaagtggtcttcgtcattggaagtgcggtagacaggctttgtggttga

SEQ ID NO: 8258 - DNA, 462 bp, Glycine max
  Peptide Sequence Number=SeqID_125036
atgttgaggagtcagtcctcagagtttaggatgaccctgcagagtggtatctacaatatgattgttgacttgttgtttcttggggatatgacactgagtttgtgggctcattttcacaatgctgacctagcaatctcgacaaatgcgagacatagtcggctagaatactcatccttacgtttttattcagggtcagatgacaacacttgtggaggtcatagagatctcgtccgctttggctttactagacacatcatcgtctttttcctcagacacgccaaagtatatgtcctagctgacaccattatcttcttcatcaaacacaccgaactacgtacccgagccacaatacaatggagagggttcttcaaaactttggttgaggtcaatgctcatgttgtggcacctccagtcatggacgtgagggacggggagattaaggaggcccccaagatgctctag

SEQ ID NO: 8259 - DNA, 145 bp, Glycine max
  Peptide Sequence Number=SeqID_125037
atgcgggttggggaccttttcggagtaaggcacagcctgttagataacgggaacgctttctttgatacacggccaccaccgcagaacgacgtcgtgtctcgctcgacattatctcacagttacagctacagcatcaacgagcaac

SEQ ID NO: 8260 - DNA, 1792 bp, Glycine max
  Peptide Sequence Number=SeqID_125038
atgcccttgaaaacagttatacggcggagactactgtctctgttccagccatggctcgctgaagagcctcacctcgatctccaattagggttcctccgttccctcgccgtcttctccgaccttcgcttcgacgcctccgctctcaaccgcctcttccactctcccgccttcctcttcttcaaggacctctccgtcgagcgcctcactctccgattctccacctggttccccccggccttcaccgtcgaactccacggcgtccgcattgtgcaatcgttcgagaagccggaagcggaggaatgcgcagcgaggttgcgaaattcgaagtatgattgtgaggattatctcagaaagaatctctcggcgcttgatcctgaggagttaagcgtaagatctaaatatgttgataaaaaatgtcttctcagaggttttcttagttcagtttttattccaatgaaagatagcactcttgtattaaaaggtgttggattcagggccagattagttggaaaagatcacacaggaaatgttttgctttcttctgatatgcaaattgacattaaattcagagatcttaagctggcaagttgcactctctgttttccagaactagttttttcattctctccagatggcatttctgtatgtctacttttcctcaaattggtatctaataattacaatcaatctagaggtgctagagaattatggagaatagctgctagcagaattggccatgtgactgtgactcctaggttgtcatttcatagattagttggagttataggtcaatggatacactatgccaatgcttatgagaatatcttgctgttaattggatattctactagccacacatggaaaaagtccatttctaaattgactcgtaacaagctgattttaagttctgctagtcggcactggaagttgatttctgacattgagaaaaagttgcctgttgaaggcatatcactggcaaggagaatagctcgtcatagagcagcattgaaagattcaattaattgtcatgaggattttgttgaatctgcacctttgactatgtcagaagaagcatgtacaatggatccacttagttcagctaaaggaaatgaaaaagaaggtattaatcatatggaatcaattatgtgggttgaacctgcaaaaatatttctcctttcggaaattgatggaggccaggctgaagattgttgtgattctcatattgaaatctttatgaaaaagttttctgtgaattggaaacgaatttgcagaaaattgaatgaaaatgagattgagttttctgaaaatccatgtattctctctaagattgagatatcttccacgaacccagacccgaagaatccagattttgggttttgtgaatgtggtttaatgctagggaaattaaatttagttttgactcattcttcagtatcatcgctgtctctaattcttagtcagatccaacatgctctttactgggaggacaggagggaagcatccattgcgtcaaattttgtggacaaagcagaaatggattgggttaataaatatgactgttattgcaaagagttgattatgaccttgcttcaaaagcttccagagaagcacattcattttggggtacttgttgatggtcctgctgctagattttcacacagaagggaggccgatcttgatggtctagacattgatgacattatcagtctggataattttgacctcacttttaatttctgtgatattgaagtggttgttggttcatcttcatttggtatggcaccattgacag

SEQ ID NO: 8261 - DNA, 321 bp, Glycine max
  Peptide Sequence Number=SeqID_125039
atgcatgataagtactttggcggcataataggaatgattccttttgtggatggcaaacaagctaaggatatcataaacacactgcacaataaacttgaaggtgttgggacaccaatcaggcgtcctttcggtgttcctgaaacccttcctcttcaacttgctccacggtatctcaatggttgtttgttgggtgtaccgttgagcaggctgaagaggaaggaaagtagttgtagcatgatctcagtcatttttattcctatgaattatgatgaaaagtgggaaagttatattctgatgagaatgtggaaggttattttctaa

SEQ ID NO: 8262 - DNA, 2760 bp, Glycine max
  Peptide Sequence Number=SeqID_125040
atgcatctctcactatggaagcccatttcacactgtgctgcactgatcatggacaagaagagcaggaggaaagacgaatccaatgttgacatgaggagaaacccatcaatgcttcggaagctgcaagagaacaagctcagggaagcccttgaggaagcttctgaagatggctcactctccaaatctcaagacatagaccagcctgactctgctgccaaccaggatgatgatggccttgggagatcccgatcgctcgcccggctgcacgcccagcgcgagttccttcgcgccactgctcttgcagccgagcgaatcttcgagtcccaggaggaaattcccagcctccgggaagcatttgccaagttcctaactatgtacccaaagtaccagtcctctgagaaggttgatcagttgaggtctgatgaatactcacatttgtcacccaagacaattcactattgggagtcttctacgtttagcctgtctgagataactgctaatttgagtaaccatgcactttatggcggtgctgagagaggaactgttgagcatgatataaagactaggatcatggactatttgaatattcctgagaatgaatatggccttgtttttactgtcagcagaggatcagctttcaaattgctggctgattcctaccctttccatacgaacaaaaagttgctgaccatgttcgatcacgagagccagtccattgcttggatggctcagagtgccagggagaaaggtgctaaagtgcatagtgcatggtttaaatggccaaccctcaaactctgctccactgatttgaggaaacagatttccaacaagaagaagaggaagaaggattcagccaccggtctttttgtgttcccagttcagtctagagtaaccggggctaagtattcataccagtggatggccttggcccagcagaacaactggcatgtcttactggatgctggatcattgggccccaaggacatggattctcttggcttgtccctatttcggccagattttatagttacatcattttacagggtttttggatatgatcccacaggttttggttgtcttctgatcaagaaatcagtgatgcaaagccttcaaaatcagtctggttgtactgggtctggaatggtgaagattaccccggagtttccaatgtatttgagtgattctgttgatggtttggataaattggttgggattgaagacgatgatgaaatcactgggatgggtgaaaagacttctgaaactcgtcagggaacacagttgcctgccttttctggtgcattcacatctgcacaggtcagagatgtgtttgagaccgaaatggatcaagacagctctgaaagagatggaactagcaccatatttgaggagactgagagcatatctgttggtgaggtgataaagagtcccgtcttcagtgaggatgagtcatcggacaactcattttggattgatttgggtcaaagtcctttgggatctgacagtgctggtcaatccaataaacataagatagcttctcccctaccacctttctggttcaatgggaggaggaaccagaagcaacattctccaaaaccaacttccaagatgtatggaagcccaatgtacaatgacagagaggtaaacctaggtgctcacgaggaccgccacgtgctgtcatttgatgctgctgtcctgatgtcacaggaactagaccgggtcaaagaggtacctgaagaagagcatgtcgaggaagttgatcattattcaagaaatggtaatgggtcagatcatctgcacgtcaatgagatcctggaagaacctggaaccagtggagtagtcaataatggatcttggctcgattcaacttctcttgccaggcatcaaagcttggagaatggctctacttctgaaatatgtcctgatgtcaaagagagtgccataagaagggaaactgaaggtgaatttaggttgttgggtaggagagaagggaatcgttatggtggtggtaggttttttggtttggaagagaatgaagccaacagcaggggaagaagagtgtcatttagcatggaagataatcgtaaagagtacctaagccagaccctagagccaggggacatatctgcaactagctttgatgatgaagaggtcacaagtgatggagaatatggtgatggacaggactggggcaggagggaaccagagataatatgtcggcatatcgatcatgtcaatatgcttggtctcaacaaaactacacttcgacttcggtttttggtaaattggcttgttacctcgttactgcaactgaagttgcccggttctgatgggggtgagaaagcaaatcttgtccaaatctatggtccaaaaataaaatatgaaagaggtgcagctgtggctttcaatgttagggacaggagtagggggctaatcaatccagagattgttcaaaagcttgctgaaaaagaaggaatctctcttggccttggttttcttagtcatatacagattcttgataactcgagacagcaccgtggagctccaaatcttgaagacacaactctttgcaggccaatggaaaatggttggcgcaatggaaaaggtagctttgtaaggcttgaagttgtcacagcctcactcggctttctgacgaattttgaggatgtatataaattgtgggcttttgtggcgaagtttctcaacccaacatttatcagagaaggagggcttcctactgttcaagaaggctccgaggcatga

SEQ ID NO: 8263 - DNA, 210 bp, Glycine max
  Peptide Sequence Number=SeqID_125041
atgggtaacaaagctgctcaagcctcaccaaccacatccaattcaactagtagaggagtgatgaaagaagcaaataacacttgggaaatggctaaaggcatgggagtcaattatgaaaaggaggagataaggatgatatccagaatcaaaatattagaaggaagagacaaaaacaatgcagatgtgctgggaagaggacatggagaataa

SEQ ID NO: 8264 - DNA, 402 bp, Glycine max
  Peptide Sequence Number=SeqID_125042
atggtgacccaaacaccccccaaaaacaccatcactgcccagatctgcaacctccaaaccaccggtctctccctttactctctctctctctctctccctcgctctaatatatgtccaagggttttaacaaagttgaagaggttagaattttatgacacaatgccatgctgtcatgtggttatctatgttaggaagaataagaataacagcagtaaaagtttagttagttactgtacagctagaattggttatagggcagtcacaaagagagatttggagggaggggggatattgattgttttggagaaaggaggggagaacctatgtctctcaaatacctggagtgggagtttgtattccatgttctttgttgttcttggtctccatccaacatcaacttga

SEQ ID NO: 8265 - DNA, 330 bp, Glycine max
  Peptide Sequence Number=SeqID_125043
atgtggtgcatcatagaagattttaactgtgtctgcaaaaattctgaacgtgttggggccagtcaaagagatcaaggcagtggggtgatgagggaattcactgcgtggttgaaggagcttgaagtggaagatgtgccatgtgttggacgtgatttcacacggtataggccaaatggagtggcgaaaaacaggttagataggatattggtttcacatgcctggtttgcaaaatggcaagggagcgcgcaatatattatggatcggaacttttcagaccactgtccggttctcctaaagatcaataatgttgactgggggccaaaatcgtga

SEQ ID NO: 8266 - DNA, 1671 bp, Glycine max
  Peptide Sequence Number=SeqID_125044
atggcaacttactacacaagttcgagtaatgaaagggatgcagtgcctatgttgtgtcttagggaacctttgcctgattcatatcccgagacaccaattttgccgagcaatatgtcattgtatatgaactctggatcatattcagaagcattgtccggcaattctcagccgcaaaacaattgctttgtgattccatcaccatcagtaggtgcatcacattccactcctgaacaacaagaaatcttggccaatattggtgggttccaaaccggggttcatgatttcagtgcatggagggagggtagaagtgagatgctagtcagacaaactatggatggacagaacttacaaggtcagggattatctctcagccttggaacccacataccctcaggaattcaaatgccttctatccatgataggaatcacaggccaagttttgattcatttttgggtactaatccatcaagttcgggcaacgaggctgcctaccaaaagggttcatctagagatgagggtatgagacattctgaaaatcttccacctggcttacctgaagctaatcaagatttggacaaagcggatttttcaattcatagaatgtctagtgttggaagaacagttcctagcttcaaatacctcaaggcagtgcaactactacttgatgaagttgttgacatccgaaaagctattaaaagacctgttgtgagaagttatagcacacatgagaactctaagaagaattctaatgaggatgatgagcaactagaaaatgacaggccttctgcaaatggagtgcctaattctcaagcttcaactagtaagacctcttgtgagctttcacatgctgaaaaacaagatctgcaccacaagttaacaaagcttttgtcaatgttggacgaggttgacaataggtacaaacaatattatcagcagatgcagattgtggtgtcatcatttgatgtggtagcaggatgtggagcagctaaaccatacacagcccttgctcttcaaaccatttcatgccatttccggtgtttgcgtgatgcaatcactggtcaaatcagtgcaacacaaaagaaccttggagagcaaaatgcttctggaagtaacaaaggagttggaatgacaagactaaagtacatggaccaacaaatccgacaacagagagttcttcagcagcttggcatgatgcaacatgcatggagaccacaaagggggcttccagaaagctctgttgtaattcttcgcgcttggctttttgagcattttcttcatccctatccaaaggattctgataagatcatgctagcaaaacagacaggtttgaccagaagtcaggtctcaaattggtttataaatgcgcgtgtgcgtctatggaaacctatgattgaagagatgtacaagcaagagaattgtgatgctgacatggactcaagttcttcatctgaaaatgtgtccaaggtaacaaaaagtgatgtcaagacctccaatgatatgggtgatgattggcagcactgtcaaagtccaatagtagccgatacaaatcacattggtggacaagctaaggaccttagacatgatcaggctcttgatacagaaattatgtcatccactggattagctagtctcataaatggagttcgtggggttgaaactgaacataggtaa

SEQ ID NO: 8267 - DNA, 393 bp, Glycine max
  Peptide Sequence Number=SeqID_125045
atggctgagctgtacatatatcagtacaacttggattacatttattccttgagcacaactgtgtctgccttttcagtggcttctgacataacagctgaaggattcactgttttgtcatttttggatgaggtgtctatgatctataagaatgtgggtttgagcctaactcaaccccaaaagctagttcaaaaggttaggacagatttgttgcctttaatatggctctattctaggcaagtaattatgagtcttaggtgtcttgtgtccctactgttagtggaaggccaccctctgttagagccacctgaaactggtcactgcctactagtgcctagagccttgctggcaagaaaaactccatgcctctccacgctcatagagatcctagtgtga

SEQ ID NO: 8268 - DNA, 789 bp, Glycine max
  Peptide Sequence Number=SeqID_125046
atgtggtatgatgaaagaatatcaaaaaataagaattttcagaatccaaggttcagtttatgttgtggagatgacaaagttgaattgccattattacaaaatccacccgaatatctgcaacaacgtctatttcatgatgatacaattgatagtaaaaattatcaacataacttgcgagcatacaacatgatgtttgcctttacttctgctggaattaagctagataaaacaattaataattcaagaggacctcctacgatcagaatacaggggcaaccatgccatagaataggcagcctattaccaatgcctgacaaaaaacccaaatttgcacagctatatatctttgacacagaaaatgaagtgcaaaatagaattaatgtcatgagtcaatattccggaattcagaatcatattgtttcagctttaagtcacatgctagatcaacacaattctcatgctaaaagttttagaatggccagagatagattggcagttgatcaagccaataatatcaaattgcaactcatagctactcggggaaaagatggtcgtgtatataatatgcctaatgttccggaaattgctggacttattgttggcgattttcatccaggctcaaaaagagacattattgttgaaactcaaaatggagaattacaaaaaatccatgaacttcatcctagctatctacccctacagtatcctctgctctttccttatggagaagacagatacagagctgacatacttcatcgttgtacttcatccagcaaaaaaagaaagtga

SEQ ID NO: 8269 - DNA, 1551 bp, Glycine max
  Peptide Sequence Number=SeqID_125047
atggatgtacataagttgcctggctgtggaatatggatttctgttcagcaaacaactattgtaatatcttgtgaagaagggaaaatggatctcctgactgatttatcaagaattctgtcttctgtttttgaattcaagaactcagttggatacaacattgatcatattgtacttgaaaatttactattgcgttctattaattgtttacatgaaatatctattttgggttgcttgtttactttatgcttgagtggtattcaaaatacctcatcttcaggaactgcaagcaaaacatttggtggttttaatgctaatggcaatacatcttactcagtacgagaaactaatttgacagcctctgaaaggttaagtaatcaatcttcccaatcagttataaaaatgggatctcctacaaatatcagcatgccagcttcagctagtcactggttactaatagatgttgcaataactaatatcttcatagggagatgttcactgaagagtgatctgattgaagcacataaattgaataagcttcattctttgctttcaattggtggagagtttcatatgatatcctggaaggtccagggtggattcatttttcttgaaacaacatctttggcaatggccattgataactattcttcatatcttcattgtattggcaatctcacttctgatgcacgacaacctaataaaggcaccaagaaggatgaggatggaaacaatactttagatgatgtgattgatcaagggactgctagtacatctcaacaagcttcacgtagattgccggatgcatttcagttatctttgtctgactttgtttttgttttagctcttgaaaacgaatctggtggtatccaagaaattatggtagaggttgacattcatctgaattttgaattggcaactactgggaggaaattaacaattgacctttctcgtttatcaatcctatctcaaattatgcaagggagggtggaagatgaaacagcaattcctcatttttcttctgtttcatcaaaagatttgtcatctcagcttacttcagcagatcctatttcaggatttcagaactttggtgcattgaactcagttagtgaagcaagtagttcaaaaaacattgttcctgttcagttaagtcatcaaaaccaaattttgaaaaatttaagagctttcatgtcactggagaggccagataatggtactatgcatttgtctcggtgttggtttggcattggttctctttcaggttttgatatgacactttctgtatctgaaattcagacaattttgttactgtactccacactctctgggatatctagtcagaatacaataaaaaatttggagagaaatcattggtctactagccatgaagttgacaatagtttggaagcaatgattcctgatggggcaattgttgctattcaagatgtcaaccaacacatgtattttacagttgaaggtgaagaaaagaatttcagtttaggcggtgtcatgcattattcacttgtaggagaaagggctcttttcatggtatga

SEQ ID NO: 8270 - DNA, 1068 bp, Glycine max
  Peptide Sequence Number=SeqID_125048
atgggtgtgccgttaagattaaattttcaaccaggatcatgttttgttgacatctcttgtactaatgatggaggatgtgcactgtggagagtttatcctcctcaaggtgaaaactatgtaggaatcactgactcagaggctagcaatcaatcaatgaagagaactttctaccttgtgaacaaaaagaatgactctgctattgcttttgttgatggtgctctagagtttgtcaggaagcctggaagtccaatcaagttcaaagtttttaatgatattactgctgcttatggcgtttcagagacagccagctatcctagaatggctccacaaactactctgcgcacagatgaagaaagtacttcgtggcagggtgggaaacatccttgtattgatataagaattgaaaaaatttctctgaatatcgttcatgaactttcagatacagaatatcttttccctctcatttgcttgttcatcaacaatacacaacttattatacaaactttagcaacaaaatccagggtcataagcacgtcaagtgcagtagcacattattttgatgctgaaagaaacttatggggagaacttctccatcctgttgaaatttgcattttttaccgatctaatattcaagcccagctttcagagtatagatctcatgctgtgcctgttaatttcttctgcagaatgaaagagatggacgtttacctaaatgagaattcattggatgtgcttctctttgtgattgggatactgaacctatctggtccttattcactgcgaagctccatcattcaggctaactgctgcaaggtggaaaatcagtcaggcttaaatcttgttgttcactttgatcagcaaagtataacaatacccagaaaacagtctgcctccattttattaaggaggatctctgatttcaaacatcaagcttcagaagcaacttctatttctatccaacttactgattttggttcttttgcaacttcttctaatcatctcttactttcacgaacacaaactcttgcttggagaactcgaattatgtctacagaaggtttttcataa

SEQ ID NO: 8271 - DNA, 369 bp, Glycine max
  Peptide Sequence Number=SeqID_125049
atggtgcatagagttgagccctatgtgacttatggatacccaaatcttaagagtgtgagagaacttatttacaagaaagggtatggaaagctaaacaagcagaggactgctctaactgacaactccatcattgagcagctatatgcaaatatcatttattgtattgagatcacaccactagtttctaggattccttcggctagggaagtaaaacttaaaaggcaagcattatatgttgaagctcattatcaaagtgagccaagagacagaaacaacaacaacagggctaggggtcaaaatagcaaactagggggtataggaggaaacaaagcccaaaagaagaattgtcaaaccatcttacctcagtga

SEQ ID NO: 8272 - DNA, 606 bp, Glycine max
  Peptide Sequence Number=SeqID_125050
atgtctttgggagtaaaggatcagatgcaaagggtgaggcaaggcgaagaagaagtagcatcagggggttcaaagtgccaagactgtgggaaccaagccaagaaggaatgttcatacttacggtgcaggacttgctgcaagaacaaaggttttcactgccaaacccatatcaagagcacttggactcctgtggatcataggagacgccactttcagggtcagggaggagatcatcatattcctcaaaaccaaaaccagatcaacccatattcaggtttagagttgagatttccggctgctacgaattcgatggctacatttcggtgcattcacgttcgttctatggatgatgcggttaatgaaatagcgtatcaaacatctgtgaacattggagggcatgtatttagtggactactatatgatcaaggccctgagtaccaaagaggtcatcaaggtgagagttccacgggctttgttgataagcagcagaataataataataataatctggatagtagtggtgcaagtgcaactcaccaagagtacccgtttcccctttcttccttcaggcccggtatgccctatttgacatacccaagatcttag

SEQ ID NO: 8273 - DNA, 554 bp, Glycine max
  Peptide Sequence Number=SeqID_125051
atggctagaggaaagatccagatcaagaggatagagaacaccaccaagaaggccaacaagctcaccattctctgcgatgccaaggtttctattattatgttctccagcactggaaaactccacaagatcgagcaatcaactaagcagttcttcgatcaataccagatgattctgggagttgatatttggaactctcattacgagaatatgcaagagaacttgaagaaactgaaagaggtgaataggaatcttcgtaaggagtttaggatgggagattgtctgaatgtggaagatctcaggctccttgaggaaggaatggacaaggccgccaaggttgttcgtgagcgtaaggatattggtacttatgactggccagttgaagaatgccactattgctgtcgataccttgtctgtatgattcttgttgctttgacaggtgaaaaagggaagtttaatgagttgcttgaggataagggtgttaatatattgattgatccaaaggcccttatgaatgtcattggaactaaaatggattttgtagatgacaaactaag

SEQ ID NO: 8274 - DNA, 399 bp, Glycine max
  Peptide Sequence Number=SeqID_125052
atggcggtgctacgtgtagtggctctaccagcacaaggagctgggactctacctagacgtgtgattaatgaaagaaagggacaaaggagaacacgaagggttgtcaatgacatacatgggtcttctactaagaagaacaaagagtaccaagagaagctaccccttgttgtgctcaaggcagtggaaattatttactctaaagccaactccgtgattttgcacgttgtgaaagtccctttgagcccatttatcgaatttctcaagctcaccacttgcactttactaagagaaatggatattggccataatccttcaataggtgccgaaccgttgtacccatgcagtgctggtctttcattgctgtcgcaacctacccttcggtgggagggtgacgcgtga

SEQ ID NO: 8275 - DNA, 136 bp, Glycine max
  Peptide Sequence Number=SeqID_125053
atggaggtatgcaccttttgcagaagggtccaggaatctttgactgaagtagatctttctattgagaataatgtttcagatgataatgagttaaaggacgaagaagattgtgacagtgaggttttaaatgatgaag

SEQ ID NO: 8276 - DNA, 1091 bp, Glycine max
  Peptide Sequence Number=SeqID_125054
ggcctagatgtcaccagccttaaggagttgggacggttgatgggacccctccaaaggcaagccttccacaaagtgtacagaaagattttagatttgactgcaacagaggtatttacggaagtcattgtatccctcgcccaatactatgaccagccgttgagatgcttcacgtttagggacttccaaatagtactgactattgaagaatttgaggagattttaggatgccctcttgggggaagaaaaccgtatcttttctctgggtttcttccctccttgagcaagattgcagctatggttggagattcgacgagagagttggatcatatgaagcaaactcgaaacggcgtagtgggcctaccgcggaaatacttggaaggcaaggcaagggatatggcaaatcaagaggagtgggtcccgtttgcggatatactagctttgctaatctttggggttgtcctctttccaaacgtggacggtttggtggacctagccgcaattgatgctttccttgcatatcaccatagcaaggagagcccggtgttagggtaccccatgaggggagcaccgacggaagagagcccgttaaggaaagataaagaacttaggggcatccgtaatggcatcatcggtggttatcatgaatggctaagagttcatacacgagggttagattggctctccaagttgaaaattatcaacaaggagaacttcgaagctccagaagaggatgaagaagtccaagctctaaaatcagagctaggaaaggcaagactctctaaagaaaaattcaagtcagccgctacaaacatccgaaaagagtgtgccgagttacgagaggaaaatgcggctaccacaagagcccttgaacaagaaaccaagagggctcgcaaggaagagcatggccgagataaatttcgaggagctttgtggggcagcaacaatgagctcaagctccggagagaggaaagagaccagtcacgagtacatggcatggtcttaaaggaggagttagccgcttgctcaagatccaagaggagtttggcacaacacttagaagccacgaagcaaagcatgctagctataatagg

SEQ ID NO: 8277 - DNA, 264 bp, Glycine max
  Peptide Sequence Number=SeqID_125055
atggcgccgttgccggggaatcttgattcattagaagagtgcagtgatttgatccccattgatttggatattaacgccacttgtagaaggtgtaattcagagagaatcagtatttttttgcaagatttagaagtagcagcaactccagaagaagaacctcgatcttccgaggcatcttctagttttcctattgcaggacattctcatataggacctgttgaagacccaatcatggctaaagagccaagaagagtaaccctgtag

SEQ ID NO: 8278 - DNA, 321 bp, Glycine max
  Peptide Sequence Number=SeqID_125056
atgggggagacacatgaaattccccaccacaatctagccaacttcgagccttggctcggatatgccactgaagggcaagcagttggtggtataccctttgaaaacactttggagggccctcagtttcgcccacaaccacaaccattgcattttgcggtgggaagagcccctcctgctatggccgaaaagggaaaggcgaatcatctaaaggaaaggctcagggccattgaaggaggtgaagattatgcctttgctaacctagaaaagttgttcctaatacccaaacatggtcattcccaagttcaaggtgctggactttga

SEQ ID NO: 8279 - DNA, 258 bp, Glycine max
  Peptide Sequence Number=SeqID_125057
atgccaccagatacaccggacacgatggaggcccgacgaaaatggaaggtaaaatatgggaagatgttgtttgttctgagaatgacgatcaacaaggaattaattgatcacattagagatcttgacacaccaaaggatgtatgggagacactagaaaaactcttctccaagaaaaatgttgctcgattgcagttgctggaaaatgaacttgcatccacaatgcaagatctgagtgagaaaatcagtgaggcaaggtga

SEQ ID NO: 8280 - DNA, 523 bp, Glycine max
  Peptide Sequence Number=SeqID_125058
agggctacacgtcctccaattcagaggactagacctcatctccttcacaggactacacgtcctcgccttcagagggctacacgccctcgcctttagaggactacagatcctcgccattagagggctacacgccctcactttcagaggactacacgaccccacctttagaggactacacgaccctcaccttcagaggactacacgttctcaccttcaaagggcggcacgccctcgccttcagaggactacacgtactcgccttcagagggctgcacgccctcgcttgtcctcaccttcagaggaccacatgtcctcacctttagaggactacgcgtcctcaccttcagagggctgcaggctcccgcgttcagaggactacatgtcctcaccgtcagaggacaagacacccccggcttcagaggggtacacccccgcgccttcagaggacttcgagtcctcgccattagggggctgcataccctcgcccatcctcaccttcagagaactacttgtcctcaccatg

SEQ ID NO: 8281 - DNA, 336 bp, Glycine max
  Peptide Sequence Number=SeqID_125059
atgtccgattcaggcacacaatatatcaagatgctcgaagttaaacatggaagcacaaggcaaattcaaatggccataacttttgacttggatagtaacatatcgagacgctcaaatttgaacaacggaagctctcggcaaactcgccaaaaatatatcgagtcgctcaaaattgaacaacagaagctctctagaaattcaaatcgtcataaattttcactcggatgtctgattcaggcgcataatatatcaagatgcttgaaatttaaaatggaagcaacaggcaaattgaaacggccacaacttttgactcggatgtctgatctaggccaataa

SEQ ID NO: 8282 - DNA, 676 bp, Glycine max
  Peptide Sequence Number=SeqID_125060
atgccgtgcaaacctgcaagcaaagaggcaccgttaaaggaagatactgttcgatggcggctttttgcacccactcaacaaagtcgggcagcatttgttcagcggaggctttccatggttgatattattgtacagtcctctcttttggatccggcagcgcagccccttatcgatggcctggctcacgaatatgatcttcgttatgccgatctggaccgatccggtggcgcgcgcgcagaaattctgcgttaccccacggacgcatttgcgccgccgcttggcggattcctgttgcttcaacgcgatggggaaaccattgccggtggcgcctatatgagccacgacgatgaaaccgtggagctcaaacgtatctggaccgcgtcgcatttgcgcaggcaggggctggcgcgccgcattgtgctggcgctcgaagaaagtgcgggcaatctgggctatacgcgcgcttatctgtctacgggcttccgccaaccagaagcaactgcgctctacatcgcactcggctatcgtccgcttttcgatacatccgtcgatgttctgcaatatcgctcactgccctttgaaaagcacattggcaccaaattgggccagccgatctcctcgccactttatccagcatcagcctccttcgaagaagcaacccagcgtgtacaggagc

SEQ ID NO: 8283 - DNA, 316 bp, Glycine max
  Peptide Sequence Number=SeqID_125061
atgccctacgcgctcagttttctcgataaaagtcccattcatgacggcgaagcggctcaaacggcactggcccgcacgataaagcttgcgcagaaagcagaaaccgcaggttttcatcgcttctgggtggctgaacatcacaactcaccagagctcgccagttcatcaccggaagtgttgatcagctttttgctggcacataccaaacatattcgaattggttcaggcggcgttatgctgcagcattacagcacctacaaggtcgcagaaaatttcaatctcctgtcttcacttgcgcccggacgtgtcgatctgg

SEQ ID NO: 8284 - DNA, 336 bp, Glycine max
  Peptide Sequence Number=SeqID_125062
atggccaaaatacaaggccccaaagaaggaaaaccctattcgaatatttacaaagaagagtggactcaaccatggcatatggatccatatatctaccctgaggttcttgagaacactagagccatgagcaagaggctccaagaggattgggctagagctgctgaagaaggccctagggttctcatgaaccttaggttcaaagttcagaactctttcgaggcacaaaatttcgtgctccttctctctttctccctctacccatcttctcctaccttcaagatcttatccatggcttcctatggtggtgagcttcttcttgactcatcttctccttga

SEQ ID NO: 8285 - DNA, 321 bp, Glycine max
  Peptide Sequence Number=SeqID_125063
gctggagaggaaaggaagttgcaactaagtgagctagatgagatccgtttagaagcctataagaattccaaattctacaaggagaagaccaagaagttctatgacagtttgatagctaagaaggaatttgtggttggacagaaggttttgttatataactttaggctcagactcatgagtgttgagatcaaaagtgaatccatagataagagcttcaaggtcaatggacaccggctgaaaccattcctcacaaatccctccttcttggatgtagtggtggaggagacctccttacttcaccctacctttcttccaccatga

SEQ ID NO: 8286 - DNA, 183 bp, Glycine max
  Peptide Sequence Number=SeqID_125064
atggcggagacagaaatagcaactaatccttctccttggcggagaaagagtagccgatttctttatcccgggcaggcaatcgggagtctagtctggctaccggtggagcttattcctgctttagcagagaggttgccttgccgccctatccctctccctttcgtctcgtaccctcctatctaa

SEQ ID NO: 8287 - DNA, 222 bp, Glycine max
  Peptide Sequence Number=SeqID_125065
atgtggggcactctagctataatttacgaagaaatgtcacagctagatgaaagactaaagaaaggaaaatctcgggctctcaacagtcagaagaccaaaaaggcttcatcatccagagagaaaggattcaaaagctcatccaaagccattaaagctaaaaaatcccttgataaagaatatgaggaattgtctgatgaatatgagctcgccttcatctcatga

SEQ ID NO: 8288 - DNA, 288 bp, Glycine max
  Peptide Sequence Number=SeqID_125066
atgaaggaactagaagccagtgaatcatcagcatacaaaaaaatgcttcctttaagcgtagaaactggtggatgtgttggatttcaggtttttgagagggatggaattaagttggttgttgacaatatttcatatgattttgtgaaaggcacgactgttgactatgttgaggaactatcttcgcattctttcctccacaggtattacaatacagaacttcatcataattttagcatgatgacattatcactactggaacctccttcattacagatgattcctgtttaa

SEQ ID NO: 8289 - DNA, 597 bp, Glycine max
  Peptide Sequence Number=SeqID_125067
atgaattgtctatcattgttcaccttcctctatgcaatttgtgcgcactccatcacctccacgacatatccttccattctcgacatgaaaaccggagagtgctccctccgcagcatcagcatcggcgatggtgttctggtccctccgtggcgagaagtgtacgaggagaggcgaatcttcgacatcacccacaggtatgtccccgagatgctggtgtgggactcgacagaggggctcgggcaccacttcctgtggctcgaaaagagcatgaagaatggctcacgcgctaacaactccaacatgaaggtcggtgttcacaccgacacccatgttgacgcgctcggtcacatttacaacaattactatgacgtcgacttcgtggttgactcacttgacctaacactcctcaatgctgaggttacgaaatccttgaatatccctagaggtgtaagccacgtgcttttcagaactttaaacactgataggttggctgttcatctgaatctgttaacctgcacacaggttgttagagaatggagagggggtggccgctggtggagtttatactcagaaacaagattggcttattaccaatga

SEQ ID NO: 8290 - DNA, 315 bp, Glycine max
  Peptide Sequence Number=SeqID_125068
atggtgcctgaagccaagggttccaatgtttcaagattggaggtcatcaactttccaggggcattacaaaacaaaaaaccaaaaacatcgacaaccttaccttcacaaacagctgcaagaagcgacaccactcaaaaagggcacgacttcggctacgtggcggtggtgggaacaacacgaggtgcggaggtcaggaaacgtggcaatgtagggttccttttgtggaggtcagggaaacgacacaatgtcaaggtggtgcgagggacattcaggcaaaacagtcgacgggagctgagatttttcgtcagacaataa

SEQ ID NO: 8291 - DNA, 219 bp, Glycine max
  Peptide Sequence Number=SeqID_125069
atgtactaccaatgtgccaccgtcgtttcagatgtcgtcttcacctgtgccgtttgggtgtttgaattcgcagttggtgtcctaccctctgctgtcgtcggggattttgttttccccaattttttagttgttatgagagtggggaggagaaggaggaagaaggagtggagcgagaggagggattcaagctttggcaggggcattttggaacttatctaa

SEQ ID NO: 8292 - DNA, 135 bp, Glycine max
  Peptide Sequence Number=SeqID_125070
atgaagcaggcccagtccaatacgcgcgctgagcgcgcgttacgcgctaagcccatgatccaacagaagcgcgcgctaagcccgcgatctaacagaagcgggttagatgctcgggagagggtaacttctaaataa

SEQ ID NO: 8293 - DNA, 345 bp, Glycine max
  Peptide Sequence Number=SeqID_125071
atggaagaaggttcttttgtgaaaacatacgaaagaacgttcttccgtatgaacgattttcacacaaaaacacctgcagaagaatgttctttcgtgttccaaaaactcttcgtctcctatgtggaagcaatgtctcccaagaaggtacatctacttggggattgttatactgagaacaagagaggatacatctcctgtggatcagttcaagtggagggtacacccacttggttattcaaagagaacaagggagggtacatcccttgtggatctttggcttgtaaaggattttacaaggttgaaagaaatctcaagaaccgtaggttgcttggggactggatgtag

SEQ ID NO: 8294 - DNA, 1629 bp, Glycine max
  Peptide Sequence Number=SeqID_125072
gcgcagtggcacttgtgggatgcctgtccggacgcggattatgtggtgccaccggcgcggggctcgaatcacagccgcggcgtggcgatcgatgtgacgctgatggatgaggcgggcaacattctggaaatggggaccgggtttgacgacatgtctgctgagtcgcacccgttccatcccaacgtgccgcagcaggcgcagcgccatcgcctgttgctgaacgccatcatgctcggcggcggttttgtcgggatgcccaccgaatggtggcactttgaactgccggatgcgcaaaactatccgctgctcagcgatcgctttgcctgcgtcagccgggctgatcgcgctcctcggggggttctgcgccttcccgccttgacacgccctccgttccgaccccagaatgcagcttgttccaaggggtgccctggatgtggaaccggggtcactgcacgccctcattccctctttgcgcctttctgcgaatcctgcgcatttctcaggccctggctggccgttatgccgcagtccaaagagggcaccttcatgaccgaagcgtcaatcattgccacgctgctggcatttatgcagcgcgaagaaaccaccgaagcggatttcaaccagctggcgctgcagctgttcgcgtggcaattcgaacacaatctcccttacgcccgtttcgcccgccagcgcggccgtacgccgctgacggtcaaacagtggcggcagattccggcggtgccgattacggcgtttaaagatctgacgctgagctgccgtccagtggcggagattccccacatctttatgaccagcggcaccacgggtactgggcgggggcgcagctatcacccgacgctggcggtttacgatctctcgatgctgatcaatttccgccagcgctttatggccggatatccgcgcctgccgatggcgatcctgtttccgcacagcagcgagctgccgcactcttcgctggcccactatctgacgctggcgatgcaagaatgtggcacgccagacagcgaagtgatggtggatgcgcaggggctgaaactgccgcgtctgatcgccgcgctggagcaggcgcaggccagcggccaaccctatgccctgctgggtgccagctacagttttgtccatctgctggacgaactggcgcgtcagcagcggcgtttcaggctgccaccgggcagccgcatcctcgacaccgggggttttaagggccagtcgcgtgaagttgcggcggaagcgttttatagcgcgctgcagcagacgctcggcgtgccgcgttcgcactgcatcaatatgtacggcatgactgaactcagcacccagttttacgatgccggcaatgaaatctgcccgccggtgaaatccggaccgcactggattcgcacgcgcgtggtcaatccgctgaccggtgcagacgtgccggaaggtgagacaggcgtactggtgcatcacgatctcgcccatttcaattctgtttccgccattctgaccgaagatgccggcgtgatggtgcccggcgggtttcagctgctggggcgcgtcgcgggcgccgatgccaaaggctgctcgctggcgatggaatcgtttctcgctgccgcgcaggcgcgggcatga

SEQ ID NO: 8295 - DNA, 1487 bp, Glycine max
  Peptide Sequence Number=SeqID_125073
ggttcttgtgctcaatatcactgattcaactggcaaggggaaatcttgggagttgggtggattgcagagagagaaaaaagcagttatggtgattgctgagaatgagattggtgaggatcagaaggagattggtgctcctaagtctccatggaagactcctactgttgatggaaagggaggtgatgtgtctgtgatgatgggcactgagtcttggccacgtctctctgatgcacagagaccacccaagaatcttgagactgctgctgctgctgcttctgtgacaagtgctggtgagattgctcctagacctccttctatgcagaaggtgaatggtgctggaaacgttaacccagtgcataagctgccactatcacgccatcaaaagccaggtgctaagcgcaactcaaatggtggacctccctttcctgtgccaatcccttatcatcaaccagttcctccattttttcatcctatggtaccgcctccgcatgttgctgttcctggttatgctttcccacttggtccaggaccttttccaggtgcagaaaaccctttagtgaagcctgtttctcaggcacccggacaagcttttgctccacctgctcatgctgttgatggcaaaaatgttcagcctctggtgcggggagatccaaatgcctatgttggcaatttttctaatggaagaacaaatatccaagaacaaggtgaccatctaaatcatgcttggcatcatcaaagaccttttccttccagagtaaacattcctatgcaacagggtttgggcccaaggccatttatacgacccccattttatggtccacctccagggtacatggttggtccaagcttcccaggacctgcacccgtttggtgtgtccccatgccacctcctggctccattagaggaccccatcctaggcactttgtcccatatcctgtcaaccccacacctcagccaccgcctccagaaactgtatcgttgaggactagtattgtaaaacagatagactattattttagtgatgaaaatctgcagaatgaccattaccttatttccttgatggatgaccaaggatgggttcccatatccactgttgctgattttaaaagggtcaagaagatgagcacagacataccttttatccttgatgcacttcagagctctaatactgtggaagtgcagggtgataaaataaggcaacgcgatagttggtcgaaatggattggagcttcctcaggaaattcaggatcatcaacagctcaggttcaacagggccaacttgtagatggtgctttcaattctcttgagaatagtgatgctgttggagataagatgaaggagatttccgaagaaaatcctaaagatgctgttcatgactcaatttttgaagagcataatcagccaaacagagatatgttacaagtttcacttatgaaccaagaaaaaaataatgagggccatcgttctaatgataaatcacatgaag

SEQ ID NO: 8296 - DNA, 414 bp, Glycine max
  Peptide Sequence Number=SeqID_125074
atgaggtcagacaccaatactggtgttagaggaaaggcctcatttctattaatgaattgcaaaaggagttgtgagtataggcctaagaagattgatttggtaagaacgtgcactgacactagaaaatgtggatgcccgtttaaattgcatgcgaagccagttttgtcattagttggacatccatatgcgggtcgactgactaaagatgagaagattgttgttgttgatatgacgaagtccatggtgaagccaagaaatattctcttgacgctgaaggagcacaatgccaacaattatacaacaatcaaacaaatttataatgccagacatgcttatcgttcttccataagtgggagtaatactaaaatacaacagctcatgatgctgcttgacagagatcaatatattcactag

SEQ ID NO: 8297 - DNA, 885 bp, Glycine max
  Peptide Sequence Number=SeqID_125075
atggatgtattgactgaaatggatgtccgagacctttccaatgattttggcaatacttttatgctcgatgaagagatagagcttgagcaaaagatgctaaggaagactgaactttcttctagtggaaggaatgatgatgaagatgatgagatggctgtcattgaacaggatgttcagagactagtaattgttacccagaatggtgatcctaaacaaagatctagagggggtggtaaagaatcaatatccatttccaatgagcttgcttccgcaataaatgatggtctttacttctacgagcaggagctgaaacataggcggtctaatcgtagaaagaataactctgatagcagagatcaaaacataaaatctccaagccgtaattcgggtgcatcaaatataaaggcagttgagaatattggtggaaactgtgttgaagagtctggaagctataattctcgaaggaaacaaaaagtttttcacaagcaaccatcttcccttaagcagcggtttttctcaagtaattttagaaatcatggaactggtcggaactctcatggaatcatatctgaaagcccgcctagcaattcggttgggtttttctttgcttctacgcctcctgaaaatcacggttttaagccttccaaattgagtagttcaccacatggggggttttctggtagtccacgtggggggttcgctggtagtccacatggggggttcgctggtagtccacctgtgggttcaatgccaaagtcttttccactatttcagcatccaagtcaccaacttttagaagaaaatggtttcaaacaacagaaatacttgaagtatcacaaacggtgcttgaatgatagaaagaaacttggaattggttgcagcgag

SEQ ID NO: 8298 - DNA, 384 bp, Glycine max
  Peptide Sequence Number=SeqID_125076
atgattcttcatagggtttggaactctagtattttttgctttctacctctaaacttgacatgcattttaatccctctatggaggatgcaattttcttctgctggaggtggctcaaatgaaaggtttaatggtcaaaagctgatggaggatgcaattttcttcttctggagttggttcaaacatttggaaaaaggatttgatattccatttcactcatgggctagcaacataaggatgtctctagcaatcaagaagattctgtatgctgctgatgcaaaaggatcagcattagatgaagctcaggagtaccttaatgatgtcatcaatggcggtgaagatgaagctgaagcagaagcagaagctgaagtagaaactgaagcctga

SEQ ID NO: 8299 - DNA, 180 bp, Glycine max
  Peptide Sequence Number=SeqID_125077
atgaatgcagatgatttgaagcgtgattctgttactcgctcccttcactcttttaatagtggcatcagcgagcacctgttcacatcctctcattcctctgggggatttgtgctgttagccgctctcggacgtttgatgatgtggtgtggtgtggtgacgtggagggctgagatccgatag

SEQ ID NO: 8300 - DNA, 504 bp, Glycine max
  Peptide Sequence Number=SeqID_125078
atgctcgtaagaaatttacattgtcacaaagtccattctctgagcctaaggtgctttacttctggaactcctaatgtacttaagcctggggatgtcttgagaaaagcaagggtatatactgacgaagatgttctccagtactccaaggtgagttgtgattcgaatcctttgcatactgattctgctgcagccaaagatgttggatttgaaggtccactggtacatgggatgcttgtggcatctctctttcctcatatcatctcatcacattttcctggagctgtgtatgtatctcaaaacttgaattttaagttcccggtctatattggagatcagattattggtgaagtgcaagcaactaatctgagagaaaataaaaatcgatatcttgcaaagtttaagacaaggtgtttcaagaatggtgaccttcttgtgattgatggtgaggctgtggctttgttaccaaccttgactgtagaacagattcaacacgagaagtggtaa

SEQ ID NO: 8301 - DNA, 531 bp, Glycine max
  Peptide Sequence Number=SeqID_125079
atggagaaaactgagatggtggaggataattcttctctaaaaacacaaattgagaaacttctaggtgagataaaagcaagagtaacccaatctagacctgacctgaatgcacctcttcatttggaacttcagcaacaagaaaaggcaacaaaatttacaggagagagtctccaattgtctaccacagaacctacattgcagcaaggacatgaagttttgattgtccccttaagtcatcaacaccaagatgctttatcaactcataatgttgctgaggtgactccaaaacccacctccactatcagaaaaccacatgccaggtatcccaccccaatggattcatggccattacagctgcttgcagagcaaccaacttcaatcggtaatcaaaatattcaatgggagaatgcctttgttggtcatcgtcttgttgctggtcatctagctattgatcatttggttggtcattgtcttgttgctgttgttggtcttactggtgttggtcctgatgctgctagaaaggttgttgat

SEQ ID NO: 8302 - DNA, 393 bp, Glycine max
  Peptide Sequence Number=SeqID_125080
atgacaaaaatcccaggaaccgaaaaaggacgaaaccacaaaaaattgggtataggaaacaatgagcacgttggagaaggctcaggaacacaaaaatgtttaaaatttgtattcaaagaactatcaaaccaagcaaaaaagcttcagcctttgggttttcctcacgggagagaaaacaacgactttaccaagcaacaacctttcgattttttggccaaaccaaccaaatggaaaaagaaaacacaacaggataggagagaaaagaacacaaaagaatggagaggaatagaggattcagaagaatggagaggaatggagaagaacgaaaatgggaaacgaagagttgagaagcaatgggaaacagataggggtcagaagcaaaattcaaaatga

SEQ ID NO: 8303 - DNA, 494 bp, Glycine max
  Peptide Sequence Number=SeqID_125081
ggaccagctagaggagtcgacacagtaaaagtgactcagcagctcatggcattgttcagccagatgcaatcccagatgcaatctcagggacttgcactgcctctagagcctctggttggtccctcaggtcctcgagtaagcacaaaggagagttgtgttgatccctcaggaaacgatcctgagacgggtgactcaaacaggtgcggcttgtacattgaagcaaatcttgcccgcctggttgccctgggaagagtttatgagggatccactgttgttcataacactcctttgttgcctggccaagtaaaggtgggcaattcacaccttctttgcttagctgacacatctggcaaagcctttatcagaatggttgtgtctccggcaaaaccacctcaaaagtcggatccggaggtcgatgatccgctttatctgatgacattgaccatccgagagcttttcttgaggccttaccaggttacatgggatgccaccat

SEQ ID NO: 8304 - DNA, 315 bp, Glycine max
  Peptide Sequence Number=SeqID_125082
ggggcgttcaaggttcagtcaggtcttgaaaggatggttgatttctttgataaggtgcctctattgaatatcgagcgggccggccatggttcaaaaaggaagaagcctgacaccattcaccttgaggatgagaatgctcaggccaaaaaggctaaggctcctactccttctactctagggtcaccgcttgctactgaatacgttgaggacaagataaaggaggtcgaaaagaatgaagaggccctattggcttgggtggtgaaggctgagaatttcactaaagccttagaggctatggtcaagaggcttaactga

SEQ ID NO: 8305 - DNA, 278 bp, Glycine max
  Peptide Sequence Number=SeqID_125083
atgacattcaaattgatgaacctgtagtcttctcatctcctcagaaaatcgatattgacaagagagataaagggaaaggaacagacagacagaaatttcttgaagaagcaagcacagacttgaaaccaaaagctagaacagctgacaaaattaaggctaaatacagaaagacgggcacatgggatgcctcggcagcagctgcacttgcaagggataaacttgtagagcggcaagaaaagctccaggaacaatatgaaattaagagaaaagatgattga

SEQ ID NO: 8306 - DNA, 207 bp, Glycine max
  Peptide Sequence Number=SeqID_125084
atgaccataatttgtctctgcgtgccatcagatacgattgtgtctgaatggcgaaaaggcccgccgcctctggatgacaaaaggcgcagaatgaccataatttgtctctgcgtgccaccggacatgattgtgtctgaatggcgaaaaggtgagcggaatgaccataatttgtctccacatgtcatcgggcccgccgcctctggatga

SEQ ID NO: 8307 - DNA, 1620 bp, Glycine max
  Peptide Sequence Number=SeqID_125085
atggcaacgacgtcggtggtgccggcgaaccggcgtcgcgcggcgaaccccgcggaggagatggacttcgagacgacggagggcgtgaaggccatcgcaagcttcgaggagatggggatcaaggacgatctgctccgcggaatctaccagtacggcttcgagaagccctccgccattcagcagcgggccgtcacgcccatcattcagggccgtgacgtcatcgctcaggcccaatccggaacggggaaaacgtccatgattgctctcaccgtttgccaggtcgtcgatacctccgtcagagaagaagaaattttagtgaggtgttgggagagggtccaaggttttaaattgtggtcgcggtttcattgtgttcctttaaattgcggattaatgaggcctgtgcagctgcaattgcagttgcgttgcggtcaggcacccataaacctcgatgttgtgactgaaatcgggatttttcagtcaagggttcaggcattgatattgtcaccaacgagggaactggcctcacagactgagaaagttatattggctattggggatttcattaatatacaagctcatgcatgcgttggtggtaaaagtgtgggagaagatataaggaaacttgagtatggagttcatgtggtgtctggaactcctggccgagtttgtgacatgatcaaaaggagaacattgcgcacgagagctatcaagatgctagttcttgatgaatctgatgaaatgttgagcagagggtttaaagatcaaatttatgatgtgtatagatatctcccacccgaccttcaggtttgcttgatttctgctacccttcctcatgaaatactggagatgacaaacaaattcatgacagatccagtaaggatccttgtaaaacgtgatgaattgacattggagggcatcaaacaattttttgttgccgttgaaagggaggaatggaagtttgataccctgtgtgatctttatgataccctcactatcactcaagctgttatattctgtaacactaagcgaaaggtggactggttaactgaaaaaatgcgtaacaataatttcactgtctcatcaatgcatggtgacatgcctcagaaagaaagagatgctattatgggagaatttcgtgctggaacaacccgtgtactaataacaactgatgtttgggcccgtggtcttgatgtttctctagttatcaattatgaccttccaaataatcgtgagctttacattcatcgaattggccgttctggacgttttggaagaaagggtgttgcgataaattttgtgaagagcgatgacatcaagatcttgagagacattgaacaatactacagtactcagattgatgaaatgccaatgaatttgtcttattcaagctgtggtaaaaaccggggttttaaggaaacctcgcacatatttgtatgcatttgcgtggataatgcaatgtttaaaatggactgggatcaggaaagcttgagaagtaaaaacagtcaaatagtgaaagagtattacatcaaaggttcaacagaactccccgaccaaaagtgttttaaaggctccttgacgtttcagattctgaaggctcgtttagcgagattggctcgctaa

SEQ ID NO: 8308 - DNA, 150 bp, Glycine max
  Peptide Sequence Number=SeqID_125086
atggtaaacaagcctagtgagttcaacatacacaggaaggttaaaaggaattggaaaggaggatttgtgtcatccattaaagaatttcagtcaagaagcgatgggccaaccaccttaagagctattggactaagaagcactccaaattga

SEQ ID NO: 8309 - DNA, 1661 bp, Glycine max
  Peptide Sequence Number=SeqID_125087
ttgtcaaaagttcatactctagggttaaagcacatttgctcagtatttgtggtagtggaattgctacttgtttgaaagttactgatgcatatttggttgatttgaggagggtttgtgaagagactgaaaacagattaaagtctaagaatgttcctttacctactgacaaaaggactccaacaccaccaacattaccaccaaaaagaagaaaatcaagcaatatagaaagtgcatttaatattgaggataggaatcatcttagagcagagatagcaatgatgttttattctgccggcttgtcattccatcttgttagaaatccacattttgttagttcttattcatttgctgctaactgtaatctaagtgggtttcttcctcctagttataatgcattgagaactagtcttttacaacaagagagaagacctttgataaacttcatggctatatctgaagaaggacctatgtttttaaaggccattgatgggtccaaggagtacaaggacaaacattacatgtttgacttattaaaggatgtaatcaaggaggtagggccacaaaatgtagtccaagtcataactgataatgctcctatttgtaaggcatctgggttattgatagaagctgaatttcctcatatttttgggaccccttgtgtggttcatactttgaatcttggagtgaaaaacatttgtgctgcaaagaatgttgatggtaatgataatgtcttcaatgaatgtgggtggattgctgaagtaattggcgatgcttcttttatcaaggttttcatcatgactcattcaatgagattagcaatttttaatgagttttcttctcttaaattgctttcaattgctgaaactcgttttgcctctatgatagtcgtgttaaaaagatttaaattgttgaaacgttgtttgcaaaatatggtcattagtgatcaatggaatagttatagagaagatgatgtcagaaaagctgcacatgtaaaagagttgattttgaatgatataaggtgggataacgttgattacatcctttctttcatggatcctatatatagcatgattagaatatgtgacactgatgcttctaatcttcacttagtgtatgaaatgtgggattctatgatagaaaaggtgaaggcaaccatctataggcatgatgaagtgctagaaaatgaagtttctagtttctttgaagttattaatgaaatacttaattctaggtggagtaagagttgtaatccacttcattgcttagctcattctctaaattcaaggtactatagtgataattggcttaatgaggttccaaatagggttcctcctcatagagatgatgaactttctagccaaaggaataaatgtcttaagagatatttttcacatgttaatagaaacaaaatggatccaaagagggctgaagatttggtttttgtgcactctaatcttaggcttttgtctagaaaagaggaagggtataaaaaaggagagacaagattgtgggacattaatggagatgtacatgatccacttgatgatagtgctggagttcttgaaatggcatatttatctcttgatgagccagatttagaagctatgcttttcttagatgatggcaatggaggagaagaaaatgaaacaattagagtttga

SEQ ID NO: 8310 - DNA, 363 bp, Glycine max
  Peptide Sequence Number=SeqID_125088
atgctaggttaccatctggtcggttcatgtaatgggttgcactgtggggttagcgaaataccagaaggataccgtgtttgtttctggaacaaggcgacaagggtgatatccagagaatcaccaacgctgtctttttccccgggcattggtcgtagaacaatgtttgggtttggctatgatccgtcaagtgacaaatacaaggttgtagcaattgcattgactatgctttcacttgacgtatctcaaaagactgagatgaaagtttatagcgcgggtgacagtagttggagaaaccttaaaggttttcctgttctttggactttacctaaagttggtgaagtgtattttgagtggaacccttaa

SEQ ID NO: 8311 - DNA, 156 bp, Glycine max
  Peptide Sequence Number=SeqID_125089
atgataaacgcaggaatgatatgtccattacgatgccatgaagagatgcatgatgcaatcaaggaaccagccagaggactatcagcgacaatgcatcaccaaaagagaaaaactctagatgaggcttcattgtcatcaaacgagtcggagacctag

SEQ ID NO: 8312 - DNA, 276 bp, Glycine max
  Peptide Sequence Number=SeqID_125090
atggcttgggattgttttccgaattttcgtttgggacagcgagcagagattatgtcaactgtggatttgcttccatgtattctgaagtcagattttttaaatgaggatacaagaatctccattcaagttccctctaattttgagaatatgagtacatcaaagcaagtacaaatcacaatttctgctgaagagtttggggccaaagaaaaatctccctatctttcatatgcaggcggtgaagtaccgtcctcatcattatctcacattatcgggtaa

SEQ ID NO: 8313 - DNA, 171 bp, Glycine max
  Peptide Sequence Number=SeqID_125091
atgaagaaaatatgcagtaatctccaaggcaaggacaatgcacctccacctccacctcaatggattgaggctaagtatttttctgatggaacagcattagacactgacaccatgacgacactacgcaagaaatgggcagcctattttctagaagttggaaaatggatgtaa

SEQ ID NO: 8314 - DNA, 491 bp, Glycine max
  Peptide Sequence Number=SeqID_125092
atggttgctaatagagcttgtccgtgtctaccggtgtgggattctgctaagaaaaaaggatttgagctatattgcaaagaagagatgcctataaggaagatgaaggtggagattgtgaacttgccgctgaattggagccctttgtttcatggaaagcagctgatacgtacttcaaacgctgatgatgctaggaccttttggagtcagattgtgtgggtggtctccaaaaaagcctccacttttggctataatggaagcggcattgttgtgcatcgtgataagaagtttgacaaagatgttgttgttgttgttaaaaaagaagttcttgcctccatccaagttaaatcatttgctgaagttgtggacgacaccattgtgtgtagggttatcattgatcttacaaacattagtatcatggacaaaactggtgatacatccaatgtagttgtggttgatgaagttgaaccacatattcaagaccctgcgtccaa

SEQ ID NO: 8315 - DNA, 363 bp, Glycine max
  Peptide Sequence Number=SeqID_125093
atggaaccccaggatgaagaagagatccataactgtttgatcaagctgagaagtaatccggaaaggcgaagggataaggtctacattggttgtggagctgggtttggtggtgacaatcccttggctgctcttaagttgcttcaaagagttcaagaactaaattatctggttcttgaatgctttgccgagcgaactcttgctgatcattatcaaatcatgatgtctggtggtgatggttatgattctcagatggatcctctgggtgctcaacagaaggtcttagaaatagctaacagcctgggtctcaatgtttctgttgctgtggctcacgaggtgtttgtcactaatatagtaggtatttag

SEQ ID NO: 8316 - DNA, 249 bp, Glycine max
  Peptide Sequence Number=SeqID_125094
ggtatcaacacctacttgggagctgctcctattgttccttgccttgaaaagtaccaaccaaatgtaataattacatcgagaattgcagatgctgctttattcttagcacctatggtttatgagctaggatggaactgggatgaattagagcatctagctcaaggatctttggctggccatcttctagaatgttgttgccaactcacagggggatatttcatgcatccagcatgttcccttaactcatga

SEQ ID NO: 8317 - DNA, 336 bp, Glycine max
  Peptide Sequence Number=SeqID_125095
atgaaacagtgtgaatgtgaatgtaaaaattgtacatttcggattctaaatcttcgccatgaatctcgaggttttagagaatggatgattaagattttagagagatggatggtggggtctgcaagaccttatcggttccaggtgttggctccatggtgggatccagctgctggttattgcccaaaccaattgttatttttctgcccttttcatggagcacttgctggcatcagagtcttaattaatgatcctctgaaatatggcccaccattcaatcaagcaggaccgtccatttggcgggccattctttcgatcgccgcattgaatgattggtga

SEQ ID NO: 8318 - DNA, 241 bp, Glycine max
  Peptide Sequence Number=SeqID_125096
tgctttgtatagaggaaccatgtcaagtgggttgcatttcatgaactttccaaccccaatggcacttttgccaggtcaacaattagggtcttctgggattggtggtaacatgaacgaagggcatttgaacatgctttcggggctaaacccttatcggacgacggtgatcggagtttcggagtctcaggcgagtgagtcacaacagtcccatcatggtggaagcgaggatcaacatgaatga

SEQ ID NO: 8319 - DNA, 1077 bp, Glycine max
  Peptide Sequence Number=SeqID_125097
atggcacttccaaggaagaatgagtcctctagcatcccctccttcaacaacattgaagatacctcacaagctttccctgaagactggtttatccctgggaagtgggtaaactttcaaagcttaaaggaggaaggctttgacgtgaaaggactatttgacagggtgggccggacttctttcttggaaaatttcaacacttggcactatggcccctatgctctcttttgggaaactgctaggcaagatggagtcaacatcaaagggacttttgttaggactcaagtggtgatttctctaaccaccattattgttgtgtctgcatgtgctttggatggtctgaccatgagcaaagattgggagaaggagataaccttggagactatggacaaactactttatggaaagcctcacccagatagaaatggtaataaggctctcaacaccttcttaaggatagctaacttaacctacttgtgtaggatgatccacaatgtgttgttcaacacagtcatgcctagactacactcaaggcactatgtcagtgatagagaccatttctgcatctgcaagatcatggtaggtgagaaggttcaacctcaaggtggagaaaaatcttattccttatggaatgctcttcacctagattctgaggctagctggagtggaggattctttgatggagccatcatctggagccactcgacacaggaggagttagccaagccaagccaacctagacacaagctacccaccaaaagaaaagatcaccctccatcttctaaccccaaacccccaacctcagccaaaaagccaagaacccaacctccatctaaccccaaaaagagaacggctcaccatttttgggctaagcacaacatcagcgcgcttaacgcgatagaagaatatggcagaccatcaatatcaaggccgtgcgctaagcatgagatctgcttgcaaagtgcagcggttgtcttcagccaggctcaacgcatgactggtgctaactcaaatccacttacacacgctaagcacgagggtggcgctaagcgcaacgtcgtggatttagagcctatttaa

SEQ ID NO: 8320 - DNA, 378 bp, Glycine max
  Peptide Sequence Number=SeqID_125098
atgggttcttccaagaagcaaaaggtaatggaaaagatcaactgctcgtccaatgctgttgtcccactggagaaaccaggttcacaaattcacatggggagaaggagatcggtcagaaaacgaaatcctgctgttgcaacgacatccatgttggagaagttggtcgattcccaaaatgactcagatatttatgagctccttcccaagatggagaaacaaggttcccaagttcacatggggagaaggagatcggtcaaaaaaggaaatcctgcgattgcaatgccatcatccattttggagaagttggtggatccccaaaatgattctgatatttatgaacaccttcccaagatggaggtattgccgaattgcaattag

SEQ ID NO: 8321 - DNA, 3123 bp, Glycine max
  Peptide Sequence Number=SeqID_125099
atgattattctatcatataatgtaagagggttagggaggggggttaaatggccaggaattcgaaggctggtcaaggagcatcacatagacatgttgtgtatacaagaaacaaaaaaggagattgttgagaaatcaatgtgtcaagtgttatggggggattcaggattcagttgggagtcatatccttcttctaatgcagatggaggcattctttgtatttggaatgagaaatcgttcaaagtagaaagcaggacttcaggagcaggttttataatgttgacaggcaagtggtgtcaggagacacaaccaaggcatataattaatatctattcgccttgtagtcttcaagataaaaggatgctgtgggagagggttaaacaactgaaaaatcaaaaccctggaggttggtgcgtattgggggacttaaataatataaggacagctgcagagagagtgagcacatttcagggggggacagtggatggcagtattagggatttcaatgaatggattgaggagatggaagttgaagaagtgccttgggtgggaaagagtttcacttggtttaaaccaaatgatccaacaatgttgattggggtccaaagcctttacgaatattatactgctgacttgcagacaagtccttcaagaaattggttcaagaaagctggtcatctaatcaatggagtggttgggggggatgtgataaaacagaaaattaaagccctcaaagcaaagatcaaggtgtggaataaggaacaattcggggacacttacagtaaatacaagaaaatagaggaagatttaaataagatggaagaggaatcagaagaaaggcagctcaatcataatgagttgttacttagaaagcagcttcagcaagaattgtgggaggcagccaaggcacacgagtcattgttgagacaaaaggcgagatccaaatggattaaggagggagactgtaattcgagattttttcatttgatgatcaatgctaggcgcaggtctaattgtttgaatggtgtgctaattgatggagtgtggatcgaggaaccagcaatagtcaaagaagaagtaaggaggttttttatgcagcggtttcaagaaaatgatcacgcaagaccaacaccagatgacatccgttttcagaccattgacacccagcacaatgacatgttggtggagcgttttggggaggaggaggtcaaaagggcggtatggagttgtggtagtgacaaaagcctgggcccagatggactcaattttaagttcatcaagcaattttgggatatcattaaatctgatttcctaagattccttgatgaatttcatgccaatggagtttttcctaggggtttgaatgcttctttcatagccttaatcccaaagacagtggacccacaattgttgaatgagtacaggcctatatcactgataggatgtacttataagatacttgctaaggtcctggctaacagaatgaagaaggttatgcatctcctcataaatgaacgacagttagcattcatagaaggcaggcacatgcttcatagtgtgctgatagcaaatgaagtggttgaggaagccaaacgaggtcaaaagccatgcattatcttcaaggtcgattatgagaaggcgtatgactcagtgtcttgggagttcctgatctatatgatgagaagaatggatttttgtgcaaaatggatacactggattgctggatacctaaaatcagcatcggtatcgatcttggttaatggaagcccttcatccgagtttataccccaaagagggcttaggcagggagatccactatcacccatgctttttaacattgtagccgaaggacttaatggtttaatgaccaatgctttagagaaaagggtccataaaaaggtggagaacaagatagtgcgactacagagaaaattcttatgggggggtgcatctgagcaaaacaaaattgcttggatcagatgggaaaaggtgtgcttgcccaaagaagatggaggattgggggttaaagacatacggtctttcaatacagctttgttgggcaaatggaaatggaagttgtttcagaaacagggggaattgtgggctagggtaattgaatcaaagtatggtggatggaggagtttaaacgaagcaccgagagctaataatgagtctatttggtggaaggacctaaagaatgtatctcaacatccacaacaggggaagctgttgaatactctgatatcatggaaggttggacgcggggataaattcaaattttgggaggataattggacagggggagacaatcgtttactagagaaatatcaaaggatatcggttcagcaaaaccaaataattcagcatatgggagcatacaaagaaacaggatgggaatgggatttcaagtggaggagaccactatttgacaatgagatagatcaggcggttgcatttattcaagaggtggaggggatcagaattcagaatgacattgatgaccaatgggtgtgggaggctgatcttagtggaaggtactcggttaagagtgcttacagtgtgcttagacaggatgtactagaggaggccccagctgaagagtttaaggaattatggaagctcaaagtcccatctaaagtggctatgtttgcatggaggttactcaatgataggctgccaaccaaagataattggaggaggaaacaggttgagctgaatgattatctatgtcctttttgcagcagcgtcgaggagagcgcgagtcatctattttttcactgcagcaaagtacttccgctttggtgggaatccttgtcttgggtgaatatggtggctgtcttcccacaacacccaagacagcactttatccagcacatgcatcaatcgtatgaaggcttgatggcgactagatggaaatggtggtggttatcattgacatggtccatttggaagcacagaaatagcattattttctctagcagcaccttcaatgcaaataaaatgatggatgacgcagtgtttttattatggacttggctgagacgacatttagagaagggttttgtatctcatttgaatcaatggtcttcaaatattagagaaggctttcgatgtaatcgaggatag

SEQ ID NO: 8322 - DNA, 1300 bp, Glycine max
  Peptide Sequence Number=SeqID_125100
atgagtttagagagagaaagtagagagagagactgtgggtgggagagggttaggaatagaagagagaggagagagagagctagagagagaacgacggagggtcctggtctgaacattgatcggaaatgggaaggacatcaacacagctatcagcgagctaactggagagagcacaaggacgtaacctcgttctatttcactaggttccctaaagacacaacggaaaaagatttgtggtaccatttgaagcaggtaggagatgtgagggagaatttcatctctccgaaacgaaacagaaatggaaggagatacgggtttgtaaggttcaaaggggtggaagatgttcatcaggtgaaaaagaagttggacagtatggtatttggagggctaaagatgtatgtcaacacccctaaatttggaagaacacatcgtgtaaactcacaatcagttgttagggggagaatggagggccaacatcatacagaggggactagagacatgtacctgggaatgaagcaagcagcaaatgtgaagttcccgcaagggtcatatgcagaggcagtaaggaggcataccccaagaacagagcagaggaggacccaagctaaggagaacagcaggtgttgcatatcgacgccatcagtgagcctagaaataccggcgacagggaagcaatggctcaaaggggcttgggtagggagattgaaaaatctggccctgtttgacagtttagaggatgaaatgctgtgggacatagaagaaaccatatctccaagatacattggggatgatatggttttactcctcggtctcaccgaaagaaaagctcagaaagtgatggaggaagaagatgcaggatggagcgacctgttctactcattagaaaaatggacaccacagctgcgtctcggttatcgactgacatgggttcagtgctggggaataccactgatagcgtgggacacgcagcatattaaacagatagtgtcttccatcggtgacatggtggacgtagacgacgatgtggaggagctaaggaagttggacagggcaagaatattaattaaaacaccgtggaagccgttcatacaacatactgtcaatgtacagattcgaggagaattatacgtggtacacatagtggaggaaagtgggaaagcctgcgccaactgccagcgcaggagatgcaacggccaaagctcatctgaggagattcaatcggaggaaagtgatgctggaacgcttctcggagatgtcccgccaccatggtggaacaaaccgcgactgctggacaggacgg

SEQ ID NO: 8323 - DNA, 279 bp, Glycine max
  Peptide Sequence Number=SeqID_125101
atggcctcttttcgacggactctgtcgccggcgtatcccgatcgccagtaccttaacgcttccgtcctcaaacgcaaagtactcctcgccgctgccggagcttgtggcggcgttccttcgcctcgccggcggggtgttcacgcgccggcacggtcggaaggggcagtggaggcgcgtggtggtcaggtgcgtgctgtgcttcttcgttgggttcttgctaggcatgttcccgttcggccacgtgtcggaggacgttcgctcgcacgaattctcgtttga

SEQ ID NO: 8324 - DNA, 354 bp, Glycine max
  Peptide Sequence Number=SeqID_125102
atgggacaaaagattgatcgcgaaaaagatttcttgttcttattagaagatcgtgattggatccacatatgtttgagtggcagtaagggtgacttatctgtcaacttttccactattacacccaaaaaaccaaactctgctttacgtaaagttgccagagtacgcttaacctctggatttgaaattactgcttatatacccggtattggccataatttacaagaacattctgtagtcttagtaagaggggggagggttaaagatttacccggtgtgagatatcacattgttcgaggaaccctagatgctgtcggagtaaaggatcgtcaacaagggcgttctagtgcgttgtag

SEQ ID NO: 8325 - DNA, 294 bp, Glycine max
  Peptide Sequence Number=SeqID_125103
atgggaagaaccttggaggatttatggaaggatggtggtgaaacatcttctattgaggaatggtcgatgtcacaaatggtgaaccaactccaacatataaagaagggaaaggggggaattctaagaggagtactaacagcaaacaaccaatacacgttcgagcatcgtcttaaaaataccacacaccatcaagctcagtacaaggttaaagcgaaaattataaagaggtaccacaaaccttccacagcggggaaggccacggcggggcgcgcgcggcacgggcttctcgtttag

SEQ ID NO: 8326 - DNA, 378 bp, Glycine max
  Peptide Sequence Number=SeqID_125104
atggcttcctctatgatgtcctccccagctgttaccaccgttaaccggggcagcatggtggctccattttctggcctcaagtctatggctggcttcccagttagaaaaactaagtatgacattacctctatcgcaagcaacactggaagagtatggcctcggattggcaagaagaagtttgagactccatcctatctgccaccacttacacgagagcaattgttaaaggaagatggatggattccttgcttggaattcgagttggagtgccgaaaggttttgtgtaccgtgagaaccaccgatcacctggatactatgatggaagctaccaatgtttgggtgcacagactcagctcaggtgttgaaggaggttcatga

SEQ ID NO: 8327 - DNA, 684 bp, Glycine max
  Peptide Sequence Number=SeqID_125105
atggtgatggttgctgggaaggcagtaataatgatgatgatgatggtgttggtgattgtggaagacacattaatagagacacaagatcaagaacttaattgggcacatattagtatatataaattgagcaggataattttttcagccaacatagacacttgtccagccgttccacccaataagcagatcatattcatcaatggtctacaatgcaaaaatccagttaatgtagcagctcaagatttcaggaccacaaaactaagcaaagctgaccttacagacatttttggtgcatctttgaaaattgtgagtgctgctgagttcaatggcctgaatactcatggcctctccattggaaaaactgaccttgatgggaagggcctgtatttccagaagtttcttaaagtaggtgatgtctttgtgttccataaggctttgttccacttttgtctaaatactggttttgaagaagccactgtcttctcagtgtacaacagccaaaatcttggctttgtgtcccttagtcctacaacttttgaccaacattggagtcattggacaagatcaagaaaagactcgtctcactttctgcctctgaagctcaaactcaagctgtcaacagtttcatctctccagaattggaaaccatgtacagttagccatctcaaactattgtctatttaa

SEQ ID NO: 8328 - DNA, 267 bp, Glycine max
  Peptide Sequence Number=SeqID_125106
atggcaattgggtggttcaaatgtgaaaaccaccaaggaagagccttatgtgctcttcggtcagaggggatacttgcgcaatctcaaaagctcccacatattcatcaatggtggttctttggtgaagcagcttggtgcacgtttgaaagtggcctaagtcaagtgaggatcagagtcactcaaaaccttgaaccaatgccatgtcatctcgttcatggagatatgagcaagctggatttacaactctggtggggtgttgcggactaa

SEQ ID NO: 8329 - DNA, 1503 bp, Glycine max
  Peptide Sequence Number=SeqID_125107
atggattggcaaaagaagaccgttagcttcaaggataatggccaaatgatcacgttgaatggtcattactttaaatacatccattgttctttggccttgcaaggcttcctacatggggtggccacagaggatgttacacgtcatcaattgcattcctgggtcctttcccctgttgaagattctgagttgaaacaagggttgtctccacagcgtgctcatgaccatgcaattacattgtttccgggttccaaactagtcagcattagaccctacaaatatgtctatcatcacaaggatgagattgaaagacaagtgggagaaatgatgtctgaaggaataattcggcattcgatgatccctttctttagtccagtgtcattagttaagaagaaagacaactcatggtgcatgtgtatggacttttgggttttgaacaagattgagctcaagattggttttcaccaaattaggatgaatgaggaggatatccataagatcgaattttggacccatgaggggaagagtgtggagatagatccctccaatgttaaggctatggtggattggtctaccttgctcaatgtgaatgatgtgtgtgactttttgggcctcacagggtactaccaacacttcattaaagactatggcaagttagtccaacctttgaccgaactcgccaagaaggaaggattcttttggggaccagctcaagtgaatgtgtttgaatgcctcaagcaatcgttatcctctttttcgattttggtgctgtcaaattttactaaagaattcttcattaagtgcaatgatattggtcatgtcttagaagcagtcttgatgcaagataagcaacctatcgcttatttcaaaaaggttatttccccccgcactatgtcaaaatttgtgtacgagaaggaaattatggctttggcattatctattcattattggcaacattaccttttagggaggagctttaaggtttatacggaccatcagagtctgaagcatctccttcaacagtgcattaccacaactgaccagcaatgttggttggctaagctcataggataccaaatcaaggtcatatacaagcccgatcctgacaaggttgttgatgccttatcctaccaacatcccactcctaaaattaatgccatcactatcagaccttattgggttgatttccccaaaattagagctgagggtcgcctaatgtttcctaactcttttgctttgatccctttccttttggctgagtatcacgatactgttacagggggacatttagcctttgagattgtctatggacgctctcctcccactatacttcatttcctgaatggggaaactcgggtagttattgtagcaacaatgctcatggaccgtgatgaggctcttcgccaacccaaatttcatttgcaccgagctcagcagacagtgaagaaatatgttgatgctcataggaggcatgtgacttttactcttggagactggcccacatag

SEQ ID NO: 8330 - DNA, 1828 bp, Glycine max
  Peptide Sequence Number=SeqID_125108
gtactggtgctcgtttggccctgaaaattatggggagggaggcggtatattacctagtcgaaggtatcgacttaatactcgaaatcgtgctgctagacctcaatcaatgcgaggttgtacttgtcattttgttgtcaaacgtctttatgctcagccatcactggcacttattgtatacaatgagaggcgtcatattaacaagtctggttttatctgccacggaccacttgatagagatgccattggcccaggcgccaaaaaaattccgtatatttgcaatgaaattcagcagcaaactatgtccatgatatatttgggcatcccagaagagaatatcttggagaaacacatagaaggaattcagcgatattgtggttcagatgcaaaagtcagtagccttgcttctcagtatgtccacaagctagggatgattatcaaaaggtctacccatgagttggatctagatgatcaagctagcatccgcatgtggattgaacgcaatagaaagtctgtattttttcaccaggatacttcagagtctgaccctttcatcttggggatccaaacagaatggcagctgcaacaaatgattcgttttggtcatcgaagtgttgttgcagcagactctacgtttggtgtgaagagacttaaatatcccttgttcacactacttgtttttgattcaagacaacatgcacttcctgtcgcatgggtcattacacgtagctttacaaagcccgatgtgtctaagtggttgaaagctttaattgatcgagctcgtagtgttgagcctggatggaaagtcagtggatttttaattgatgacgctgcagctgaaattgatcttttgagatcatggcttaggaatattgttaagaaatgtagtaacattgagattcagcgggagatttttaagcgtcttgggagaatagtgtacaacatttggggaggtattaatgcatcgcttgccttggaacaattcttgctggattttgttgaccaaactgctttcatggaatatttcaaagtcatgtggttgcccaagcttgaaatgtggctttcaacgatgagaaattttccattagcaagcctggaagcttctggagcattagaagcctatcatgttaagctgaaagccaaactttttgatgattcacatcttggagcattgcaaagagtagattggttagtccacaagttaacaactgagttgcattcaagctactggcttgaccggtatgctgatgaaagtgattctttccagaatgtgaaggaaaaatatattgcttctacatcatggcatcgggcacttcaaattccggactatgctgtttccttggatgataaagaccacctctttgccaaggttgtgagccagaaagacagtagcttaacacatatagtgtggaatccaggatctgaatttgcattctgtgattgttcttggtcaatgcaagaggttttgatggatctatggaaaaagccagtggatgattcttttgcgttggatctgtcattggcttggacccatcagatgctagatcaaattcaaaaacaagttgaactgaataattctactgatattggcactgtagttaacaatatgccactgaaatgggtttctaagaaaggcagaacctacattggcaaaccatcatcaagtttggctcttcctcatggtagcagtaacacaaaaaacagtggcatcaaaaccaaccgaagtggaaccattcccaagaggcttcctcttcaagctatgacttccacaggatcaaccattcttccaccaagttgccttggtgcttgtttacccgagttgccaaattag

SEQ ID NO: 8331 - DNA, 333 bp, Glycine max
  Peptide Sequence Number=SeqID_125109
atggtgagagacatgatgggcacaacaacaacaacatcatcaggagggtgtggtgggggaggagacatgaatatgaatatgaatgagaagcctgcatggctagagaggttgatggctgagacattctttggtgcttgtggggtccaccaggatcgcaggaagaacgagaagaacgtcttttgcttgcactgttgccttagcatctgcccccactgcctctcttcccaccgctctcaccctctcctccagctgctcatttcagatgaatttcatagcaatttccatgaaattataagatacacaaagatgttccttccttctcatggttgttaa

SEQ ID NO: 8332 - DNA, 270 bp, Glycine max
  Peptide Sequence Number=SeqID_125110
atgagaggctcttataccatgtcacaggtgcgaaggtatgtttaccacgacgtgattcgattagatgatctggaaaaactcattgattgttccaatattcagccctatactataaacagcgccaaagtaatattcttaaatcagaggccacaatcaaggacatgcaaaggtcctgccaactcttgcttcacctgtgacaggattcttcaggagccattccatttctgttctctatcatgcaaggtttttcatctcatttctcactcttga

SEQ ID NO: 8333 - DNA, 414 bp, Glycine max
  Peptide Sequence Number=SeqID_125111
atgacacagaacttgaggtcaaggaaaaggataaagagtggcttacacatgttcgacgatgatgtcgaagtagtctatgatttacgcgtgcagattgaaggtttgggcgcaaatatggtccttgaggtggacaagggtggcactagcgacaatggtggtggttccttcgtcgtcaatgttgagaatgaggtatttgcacatgcaaattggaggtttgtgcacggatctggtcctccggagaatgagggcagtgccgatgacaatggtggtggttccttcatcatcaattgtgagagacattgctactcgagttttgagaagatctctagcgtcactttactaagctccattgtggcattaacaagtgaagagtgtgttgaaagaagagtaaggaagttggggttttggaagtga

SEQ ID NO: 8334 - DNA, 945 bp, Glycine max
  Peptide Sequence Number=SeqID_125112
atggacatgtttgacaagctttatgaggaatgctatctagggagtttaggggagattaaactcaaataccttgatgatgacttggtgcaagtggaaggtggaaaccaaccatggtacctagcacaagcttgtggaagaaacataattactgaggaacatcaagcatgtaagagttcttatcagaacctcaagtccacgaagcatctccagatatcaaagggtgaagatagacgaaaaggtgtaccaggtcatggaaacttacacacaaatggaaagaagggaggcgacgacaaggtgaccgattttgaatctgaaagagatagtctagaggccaaagccaaaaatgtatcagaggttgagaaaattaaggagatggggtacatctacttgggtttgactgagaacaagagaggatacatctcttgtggatcagttctagtggagggtacatccactaggttcaaagagaacaagggagggtacatcccttgtggatctttgcttggtgtggaagggaatgttacgaagttaggtccaagtggcatagaaaggggggatagttctataaaaggagtcactaatactcccacgtctacacaaacaccccttggtgttatggtcttatctacacgatcaaataacatgcttgagggaggcacattcagactctcaagtgtggtgcgtttaagggatgctaaagtggaagccaagaggatttgtgataatggatgtatgctgggaatttcgtatcatggtcagaagcatgagggaatggatatattggcttggagggtatttggaaggaaagaggatttcaattgtgtaagatatccaaatgagcgaataggggaggctatgaaagactattggagtaggaaaagaagtgactttaatcaactcatcaaggatatgagggtggaggaaataccttttgacacggaggag

SEQ ID NO: 8335 - DNA, 222 bp, Glycine max
  Peptide Sequence Number=SeqID_125113
atgacgatttggcgatgcatggggaaccgccagtcaaactggcgagttccacaacataggagtaggctcaggctttgcagggatggcaagcgcatgcagctaaagggaaatcgccactcctatgggcgagttagcctaaattggagttgtcaatggtattggcgagttaggcacaagggaggtgccaacaacattggcgatttatatttccaaaagctctga

SEQ ID NO: 8336 - DNA, 1509 bp, Glycine max
  Peptide Sequence Number=SeqID_125114
cacgtggcagtttgctgctcccaagtgcctcaagtggtggaaggcattgcttgcttcaaaaactgggtgcccccaagggaattttcttcttccactcagcagaatctggagcaggatcaagtgaatagtagtcgtagtggtggccttggagaggataataataatggtgcttctgggaatattggtgttggtagtagtgttggttgtggggagttacagtctctaagtctgtctatgagccctggttctcaatcaagctgtgtcactgttccaactcagatctcatcttctggaactgactccgtgactgtggatgccaaaaagagagggtcttctaagcttggacagaagcaacctgtgcataggaaatccattgacacatttgggcaaagaacttctcagtatagaggtgtcacaaggcatagatggactggtagatatgaagcgcatttgtgggataacagttgcaagaaggaagggcaaaccaggaaaggacgacaaggtggttatgacatggaagagaaagccgcaagggcttatgatcttgcggctctcaagtattggggaccttcaacgcacataaacttctcgctagaaaattaccaaactgaacttgaagaaatgaagaatatgagtaggcaggaatatgtggcccacttgagaagaaagagtagtgggttttcaaggggtgcctcaatgtacagaggagtgacaaggcaccaccaacatggcaggtggcaagcaaggataggcagagttgcaggaaataaggacctttatcttgggacattcagcactcaagaggaagctgctgaagcatatgatatagctgcaatcaaatttcgtgggttgaatgctgtcaccaactttgacataacaagatacgatgttgagagaatcatggccagcaacacccttctagcgggggagctagctagaagaaacaagaatagtgagccaagaactgaggccatagagtacaatgttgtgtcaagccaacgagtcataagcaacagggaagaagttcatgaggctgtgaacaacaacaataataatgaaaatggttcatcttcagattggaagatgggtttgtatcatcatcagcagcagcaacaacagtcaaacaactgtgaccagaaaaccatgaagtgtggaaattataatagaggtggtggtggtgctgctgctgctttctctgtgtccctacaagatctcattgggattgagtcagtagtaggatctagccagggcatgatgaatgagtccactaagatagggactcatttttcaaacccttcctcgctggtcaccagtttaagcagctcaagggaaggtagccctgataaaacgggccccactttgctctttccaaagcctccaatggggtcaaagattgttactagccctactattgctaatggtgtcactgttggctcttggtttccctctcaaatgaggccagtctcaatgtctcacttgccattttttgctgcttggagtgatacctag

SEQ ID NO: 8337 - DNA, 870 bp, Glycine max
  Peptide Sequence Number=SeqID_125115
atggatggtacatcttcacatcctacaaaggttttgaaaatttcaaatggtggtgcttatctgggagccagtaaacaagttcctgtggcaagtaggaagtctgctaaatccaagccattgaatttatgtcctagatctgatggctgtgccaggacttctattgatggttgggaatggcataaatggtctcgaagtgccagtcctgcatataaagcacgtgttaggggtcttccatgtgtccggaacaagtgcatagattctgaaaataatttatttcagttgtcaaatggtaagggtctttctgcaagaacaaatagggtgaaattgcgtaaccttcttgctgctgcagagggtgcagatcttctgaaagtgcctcaactgaaggcacggaagaagcatttgcgttttcaaaggagcaagatccatgactggggtcttgttgccttggagccaattgaggcagaggattttgtgattgaatatattggagaactaattcgtcctcggggtttcttacaagcttcttatctagtggctgctttgttaaagaatgaatacactttaaggctattgatgactatatctgatatacgtgaacgccagtatgagaagatgggaattggaagcagttacctttttagacttgatgatggttatgtggttgatgctaccaagagaggtgggattgcaagatttattaaccactcttgtgaggtgtcgtggatcactgaattaggcattgattgggtttctgatgctggttgttttttccgaggtccacttgtgaaattgttgagtgggcagaatttttgccataggtattattatactcctgccataattgttggatgttgcattctgaagacttga

SEQ ID NO: 8338 - DNA, 970 bp, Glycine max
  Peptide Sequence Number=SeqID_125116
ggcgagccctggtgcagcggtaaagttgtgtcttggtgacttgttggtcatgggttcgaatccggaaacagcctctttgcatatgcaaggcctacctgttggaacttgccagtttgactggcggttcccaatgcatggcgatatcgctattaccactggcgacttctttgcaaacaacaaactcgccagttccactggcggtttgcgtggtcaattggagggctatttggtgcttaataaacaaggaggagccaatttgggggggttattatgcttatgggaggaaggtagctttcaaattttaaagtgtgtggcggcatatggctatttattcttgcaaggtgtttggaaaggctgcaatgaagtgatcaatttaatcaatgtctattcaccatgctcattgattgataagagatctttatgggcaaatttggttcaacttaaaaaggatgtagggggtggtatatggtgtgtggtgagggactttaacacgattgaatgggaaccaaagccatttagaatcttcaatgcttggatcaatgaacttggttttttagactttgtgaagaaggtatatggtaacttggaggttcaaggagcaaagttggagaacttggtggctagtattaataatttggacataaaagatgaattggaggggctttccctagaatcttgttcggatatcattaaagctgacaacataagagccattagggagttcccctctaatggtaggttgccatcgggaacaaatgcatccttccttgctcttatacctaaaaaggttgatcctcaatggatggggactagggagattgtgaagggagaaaagagccataccatggcaacattgtctagttggctcacagtaatgtcgcaacttccagtgctgcaaccaattgtggctgaggaatcaaacagcagaagcaaggcagctgaagaaacaggtggcagaagcaagccttag

SEQ ID NO: 8339 - DNA, 261 bp, Glycine max
  Peptide Sequence Number=SeqID_125117
atggtgaaagaggagaatagtttttggggaagtgttgtagcaaaatatgacattagagacttggatagccttgtgagtggaggggaggttcctaggggatctcaagtgtggaacgacactcataaagtgtatgttgttcttgtgggaagaaaggcaccgcaagaattgagagtgttaataaacactaagggacccaaactagacggacaagatggttgcgagtggttgggaagttccagttgtggttatgtaatgttatag

SEQ ID NO: 8340 - DNA, 934 bp, Glycine max
  Peptide Sequence Number=SeqID_125118
tctaagttttctgctgagattagtaaaggttctgctatttccagtgatcctgcatcttcccacactttggacgatcagacttgtcatgaaagttccagattgcccccagccattattaaatcagttggaagcattgaaaatttttggtggtcatttgctgtggttcgcaaggtacttcttgattattccatgcaagtcatgtggaatgcagtgttttttgacacactagcagaatacttatcttcctggaggaaaaagatgctttggtctcatcctaagcctcaaccatctgctaatggatgtgaagatcatactgaaaagattgaatcagaagctttggttttcaatccagattcttctgaaagcaatgttgatggcgataatcagtttggagtactgacaaccgaaaaaaattgtcccctgttattttcatctcccagtagcctcaaaggtggaaatttactagaaggtcaaaaagtttcatgcccttatgttaactctagagatttgacttgcattcttgaaagtgtggagaatgagcttcacttctcttcaaaggtgtctttagctgattacattcgaagttttgttgaaaaggaagtgaacaaattaattcctttcccagaagaaaacaaatttaatgaggttgctgtcggtggcactcatttttcagggatacttgcggataaaacgtctatgaaggaaattctaaatgacaagtcagtggatcctgtaaaggctggaaattcttttggcgagtctgcatctggaaaccataagtctgacatattttcgaaagcatttaaggagttgtgtggatatgtagatgatgtggttgaagaggagattgatgacctaccacccgggcttgagaaatctcaaacagttgtccctcactataattcgaaatttcgaccttcaaggtcggctgaaa

SEQ ID NO: 8341 - DNA, 1275 bp, Glycine max
  Peptide Sequence Number=SeqID_125119
atggtcttctcaactgtctttctcgatgaagatgacccctttttttctagaaaaaggccaagagtgtcagatcttggacatcaagatgatttacttgctgatgcaggaatttccagtgatatttccttgttctcgcatcaagatatagaaagagggattctggaaggagtaagcaaggctaagtttttagtaaacattttagttgctgatattggttggggtactggtgattttccctcttccagcaatactgatgataaagttgatccagattctggaatggagatgagctgcccatcaaatgttaatagtggctatgttcctgtgtgttctaccacagggcatattttgcacatggaccagagtttctgtggctatgtgcaacaacctgcttttgtgagtggatggatgtatgtgaatgaaaatgggcaaatgtgtggtccctatattaaggagcagttatatgagggcctaacttctggtttcttgccatctgaacttcctgtgtatccagtgattaatggcacaataatgaaccctgtaccactgaattacttcaagcagttccctgatcatgtttccactgggtttgcatatctgagcttgggtatctcaggcacaagggtgcctacattggcagtatatgagcaagataggttttttgagcatgctgctcctctggctgttaatcctgattcacagccagtttcaaagtcgcacatcaattactgcattaaggaatccaatcgcttaaattcaaactcagaggcattcaaaagtttaatatcttgtcagatgttaggtgtagaatgctgttggctttatgaggatgagaagggtatgaaacatgggccacattctattaaggaattgatatcctggcatcgtcatggatatcttaaagattcaacagtgattatttatggtagtgtatggtatttcttttcacatatgatctgggcaatggtcttgtatccaacaccagtgacaactacaccccccttctccaggtcattgacattgtccattctctcggcagataagacctcttgtccaaccgagccttctccaggtcattggcttgtttttctttctcttgatttgttccggcgacttgctctccagcggcagcagtggccagtgatgatgaaaagattgaattgtttcaacaattctctctatctcttgatcatttgctgtttgtctgggtctgggtctgggtctggggaaagggaaactgtggtggtgacaaggaaagggaaggagatgatgtaa

SEQ ID NO: 8342 - DNA, 966 bp, Glycine max
  Peptide Sequence Number=SeqID_125120
atggagtttgatccaagtttcaaagggccacaatacctttcaagtcttttccctagaaactcctacttgaagccgctaactcaaaccatatttccatcacaaagctccattttcactccacctccaccatcatccgtcatgtttcaccctaacaacaattcccaccattttcaagaccacatcatgaatgtgcctaccaacagcactccctttgtgatggaaggtccttctaaccccatcaccacccccatgtatgggataacgaccccttctttaggcgatgggtcttccctgggaggctttgtcaatgttcaatgtcacccccctatgatgttggcaccaaacaacaataacaaaatggaggccttgtatggccaggacaaaggcaaagccatatcagatttttcacaaaaaaccatgctttgttcatctgaagattcttcttccaagtcgccatcacccttttctctccctaatgattggtggatgagtcaatatcattgggacactgatcaaaaggtaaaggtggaaaaggattccaacattggtaatgataatgtaatcaaagggaagtggagtatgaaagaagacagggatctcatagaattagtgaatcaatatgggttgaagaaatggtcacaaattgcaaagttattacattgtaggaccgggaagcagtgtcaggaaagatggaacaaccatctccaaccaaatattaggaaggactcatggaccctaaaggaagataaaattttcatcgaaacccacatcaaagtaggaaacaagtggtcagagattgctaagatgttgcctggtagggctccaaacaccatcaagaaccgttggaatggcagcaagcggcgcaagaatgacaagaggcagaacaagaacaagcatggcccttatgatgggtcagtgcttgatgcttatgttaaaatggtcactgctactgaggaaactacataa

SEQ ID NO: 8343 - DNA, 327 bp, Glycine max
  Peptide Sequence Number=SeqID_125121
atgacggatggctccgcctgctggagaagccactcgatcgtctcgccgtcagacttgtgtcccagctcacgcgtgagctggaacaccctggcggcacagagagccggcattcgaattcgacggccgcggccatcgaccttcgtgtgccggtctttggtagaggttcttttagggggtggttttttgggggagggttcggaggagggtgtggggaggagttggttgttgttgttggaagtagaggttggaatgggaagttttgtcggtggtggttatggttatggagatggtggtggtagtggaagtcatcactacctccctccatga

SEQ ID NO: 8344 - DNA, 1224 bp, Glycine max
  Peptide Sequence Number=SeqID_125122
catggtattgtggcccaatacaccatgcctggctcgctgaatcaaaacgatgaagttacgatttataatccaaatgaaaagaagttggactcaaggaccattagtgcatatttcattggttatgttgaaaggtctaaggggtatagattttattgtccaactcatagcactagaattgttgagtcaagaaatgcaaagtttctagaaaatgatgtggctagtgggagtgatttaactcaaggcattggtcttgagaaaaatcaatgtgagggaatagttcccacatcaagttataagctagtggtttttagtgatactcaccaaaatcgagcaacacaagctccacatcaagttgatcctatcctagaatatctagttgagcaacatcaaacacaagatgttgagcaacctgttgaacaacaactagaaggtgtggatgtaacattgagaatatcaattagaataaagaaaccaacaattcctagtgattatcaagtgtatttacaagagtctcaatatgactttggagttgaaaatgatcctaagtcggctttgcaagcaattaacaattgtaattccaagctatggtatggtgctatgaaagatgaattggaatttatggcaaataataaagtttgggatcttgttgagttgcctaatgggataaagcctattggatgtaaatgggttttaaaaaccaagaaggattcattaggtgacattgagagacacatggcccaattggttgccaaaggattcgctcaaagggaaagagttgactacagagaaacattttcttctgtatctatgaaagattccatacacatcataatggcattagttgcttattttgacttggaattacatcaaatgtatgtgaaaacggtttttctaaatggtgacttagaagaagtttatatgacacaacccaaaggtttttcctctagtgatggggctcacttggtttgcaagatcaagaaatcaatatatggactaaaacaagcatcacatcaatggtatttaaaattctatattgtcatctcatcatttggttatgttgagaacggtatggatagatgcatatatcgcaagacattggagagcctcccaagtataaaggattcttataaggagtatcaagatatgagaatgaggaacaagagccatctaccttctcagcctgaggatgagatccacattacttattatgccattgatacctag

SEQ ID NO: 8345 - DNA, 801 bp, Glycine max
  Peptide Sequence Number=SeqID_125123
atgggtgaggcatgcattccaacagctgatctctctccattcgtgagagaggatgaggatggcaaaaagaaagtcatggaagcaatcactcaagcctgttctgaatatggcttcttccaaattgtgaaccatggagtttctcttgatttgattaaagaggccatgcagccatctaagaccttctttgattactctgatgaagaaaagagcaagagtagtccttccactaatgcaccacttcctgctggctacagtaagcagcctctgcactccccagacaagaatgagtactttctgttttttcccccaggttccagctttccctcaaaaccctcccaagttcagatggttaagggagaaggaaagagcggaaaggttgtggattcaattccctctacttcagtttatgaattgaattgggttaagactaaacctttgaacacttctgtgaatatgataggtgttgatgttcaaatctacattatctccatcatgcatgctgatagcattataaacgagtgtttgggtctccctaccaacttcttgaaggagttcaatcatgataggagttgggatttccttctggccttgcgttactttccggcttctaacaatgataataatggaatcacagagcatgaagatagcaacatacttacctttgttatccaggatggagtgggaagcctgcaagtccttaggaatgttgagtggatccctgctgttccaagagggcactattgtggtcaatggaagcgatgttatccaggtaactcggttttcaaatgcaccaaaatttag

SEQ ID NO: 8346 - DNA, 198 bp, Glycine max
  Peptide Sequence Number=SeqID_125124
atgtttcttagaaattataaaggggaaggctttggttggggtgacatagaagatgacctggtcttggaagttgttgagaacgatcatgacaaagccggcaaggccgccaacgctgagcacgtaggtctagaggcaccgtgtctggagctagcacgtgtgcgtcggtggagggagaagtgcgccggtgaggagatgtga

SEQ ID NO: 8347 - DNA, 348 bp, Glycine max
  Peptide Sequence Number=SeqID_125125
atggcagagcaaaacaaggtgatcctacacgggatgtgggctagcccttttgtgaagagggtggaattggtccttaaactcaagggtataccttacgattatttgaaagaagatttagctaacaaaagtgaattgctcctcaaatacaatcctgtctacaagaaggttcctgtttttgttcacaatagaaacaccatttctgagtccgtggtgatccttcagtatattgatgaaacttggacagatgatggcccaaaattgatgcctgatgatcgctataaaagagcacaagcacgtttctggtgtcattcattgatgaaaagttacttgagaacgtgcttaaagtaa

SEQ ID NO: 8348 - DNA, 339 bp, Glycine max
  Peptide Sequence Number=SeqID_125126
atggtgacaagattgggtcatgcagaatggtgtgaagctttctccacatatccaaggacctatgaccttatccatgcaaatggcgtttttagcttgtacaagaatgtatgtaatgccgaagacattctattggaaatggaccgtatcttacggcctgaaggagcggtgatattccgagatcaagccaacatgttaatgcaggtgaaaagaactgtgaaaggaatgagatggaataccaaaatggtggatcatgaggacggtccgctggtttcagagaaggtgttgtttgctgtcaagcagtattgggctgtcggtgacaacaccatgagctcagtgtga

SEQ ID NO: 8349 - DNA, 1305 bp, Glycine max
  Peptide Sequence Number=SeqID_125127
atggttacgaaaggaaaccctggggacaataaaaataataggagttcactatctattttcatcattgttggattgtgtggtttcttctacatattgggtttgtggcaacggagtggttttggaaagggagacagcatagcggttgagattactaaacggacagattgtattgttctctctgatctaaactatgagacccaccatgatgataattctggaacacctaatggttttggcgcacaagtcaaggagttcaagccgtgtgacgatcgctatattgattacacaccttgtcacgatcaagcgcgagcaatgacatttccccgagacaatatggcttacagagaaaggcattgccctcccgatgaagaaaaattgttccctggtggtggaacgcagtttcccaagggagctgatgcttacattgatgaacttgcatctgttattccattggacaatgggatggttagaactgcattggatactggctgtggggttgctagttttggtgcatacctatttaagaaaaatgttgttgcaatgtcaattgccccaagggactctcatgaagctcaagttcaatttgctttggaaagaggtgttccagcaatcattggtgttcttggaacaataatgttgcccttcccttctggagctttcgacatggcacattgttctcgctgcttgattcaatggggtgcaaatgatggaaagtacatgaaggaagttgaccgggttcttagacctggtggttattggatactttctggtcctcctatcaattggaagaatagcttccaagcatggcaacgtcctgaagatgagcttgaggaggagcaacggcagattgaggatactgctaaactactatgctgggaaaagaaatatgagaagggtgaaattgcgatttggagaaaaaaattacataatgatgattgcagtgaacaggatactcaacctacaatttgtgaaaccacaaattctgatgatgtctggtacaagaaaatggaagattgtgtaactcctagtaaatcaagtggcccatggaagccattccaagagagaatcaatgttgttcctttcagaattatcagtggatttgttcctggtgtatctgtgaaagcattcgaagaggacaaccggttatggaagaagcatgtgaatgcttacaaacggatcaacaaaatcattagctcagggaggtatcgcaacataatggacatgaatgctggtctgggaagttttgctgctgcactggaatctcccaaattgtgggttatgaatgttgtgcccacaattgcttag

SEQ ID NO: 8350 - DNA, 345 bp, Glycine max
  Peptide Sequence Number=SeqID_125128
atggacatgaacctcgggtacctcaactcgagtcacacttctcttattgctccgcatgactcctcgaggctagatgacccttcggtcactttttggggaacccataaatctaggggcaaaggatccgaggtaccatcttcttcagctccttccacatctgctccatctacatctgctctcgcatcttcagccccagctccagttctcccagggccagccactcctagctcagagcatttattgtccatgctgcagagtctgcatcagggtcagatcctgattatgcagagtctgcagaactcggtccagcagaggcctgtgatgagcgttgaggagttcatttag

SEQ ID NO: 8351 - DNA, 648 bp, Glycine max
  Peptide Sequence Number=SeqID_125129
atggagggcactccctttgacttacgccaaattctcttcaactattttgcaactaaagtgatgaaggacaagagcattaggaaagacatctaccatagtgtcatcctcattaaggtatttgaagtccatggagtaatgaggaagttcataagtttggagtcaacactgggcgggacgaccagctggacgcagtttgggagaaagttgttgaagaagaaagagtggacgcagatgaagccattgctcaagctgagtagagaaccaagaagagtatggacacaccttcgtccaaggttgcacccgctcaatagcatccacctcccactctcgctgctcccaaggaaacaaatgccacgactcatggcactcagtgagattgaggatgaggacaataggcctttggtcttcaggaaacacaacgctacaccacctttagatgagacctgtgtgcctcatgtgaagaaggtgaaaccaacacagaaggttcttccttcttcttctcaaccccgtgctagcaaacgagaaaagagaggagctcaaagacccaagcgcccaaagggtgaaaaatcttcaattgccaatgatactgccgatgaccctcccccaactgacattcaacctgttcgacatcaaatttcaactgtttaa

SEQ ID NO: 8352 - DNA, 300 bp, Glycine max
  Peptide Sequence Number=SeqID_125130
atggcctcgtgtaaaacgctagagctattgacaacaactagttgggatctctcaatggatcgaagatttatctctggattaagctctcgacagagtaaaggaaagaaaattcttgaaatgatggaagaaggatttgttgtgaacaagcctcccatgttcaagggagccagctatgactactggaaggaaagaatgattggcttctttgaatccactcacgttgataagtgggatgttgtagaaaaggacaatcatattcctttaaatgctcagaagaacgagatccccgggaacaaatag

SEQ ID NO: 8353 - DNA, 561 bp, Glycine max
  Peptide Sequence Number=SeqID_125131
atggacgatgcaaagcaaatgaaaacgcctattcatccaaccactatacttggactggacgaagaatcaaaacaggtggacgaaaagacatatagaggaataataggatctcttttctatctcactgcatctagacctaacattatcttcaatgacgattctcctgttcagatcaacaaacttgcacccgtgactatccttgctatgaaagtcacaatgaaggacaaggaaccaggagttcatattaaacacttcttcgatatcatctcactggaaaacgctggctatgccatcaaagtttatctcatgttgtgtgacattcaccacttctttgaagaccacaagatggtggtgcctgaacttatcagggagttttggagggctgccaaaatctacaaaaacgaagacagtggaggatactttgctggaaaagtactagggataccaatgaagttgcctgttaaaactatcactcaagcaattggttgcgagcgtcacgaaaccaagttcatgaacaactggggatatgaacttgaagaccacattgggaactccgtgtga

SEQ ID NO: 8354 - DNA, 459 bp, Glycine max
  Peptide Sequence Number=SeqID_125132
atgactcttgaagagctcattaaaattcttaaagtccatcagcaagagcttgctcaaggtgaaagaacaaagaaatggaagtcattagcccttagggttcaaagaccaaaacataactttgcatccaaagagtcatcttccaaagcccttattattaatgatgcttcaggagaagaatctaaggatgatgactttgatgaagaagatgacgagctaagtctgatcaccggggcattactggacgaaaaggtgcaaagaaaccctaaagataaatctagccatggtttcaaaggcaaaaaggttgtgcatggtgaagaagtaactgtttgttatttctatggaaaaggggatcatgaaactcataagtgcaagaacctctctgaaaaggggaacccatcaaagggtccgtgcagtgcttaccaaaacctacaagataaccaggaaaaagacccaaaatga

SEQ ID NO: 8355 - DNA, 152 bp, Glycine max
  Peptide Sequence Number=SeqID_125133
atataaaaactggaggtgtaacaagcaaaaaggacagaaaaattgaagaaaatctgaagcaggcccagtccaatacgcgcgctgagcacgcgtcacgcgctaagcccatgatccaacagaagcgcgcgctaagcctgcaacacgcgcactaa

SEQ ID NO: 8356 - DNA, 195 bp, Glycine max
  Peptide Sequence Number=SeqID_125134
atggaggtggatctagtggtagacaggattttacgattagcggtgccaagcggtgtgtccatggggatttatgaggcgttggagttgagggacaaggacaatagcatttacagtggaaaggctgtcagcattacctacaaatttagggtgttaagatggatgcatttagggaaagtcttggcaagaattgactag

SEQ ID NO: 8357 - DNA, 601 bp, Glycine max
  Peptide Sequence Number=SeqID_125135
atgatgcaacccattgttagtcataaaggttctggaggtgcaacctacaagaatgggaagggaggtacacgtggcgcaacgggaatgagtacatcggagagtggaagaatgatgccatctccggcaatggtgtgctggtgtgaaagaacgggaaccattacgaagagtgttgggagaacggtgtttcgaaggggagaagggtgttcacgtggcgcaatggaagcacttcttctaggaattgggggaaagaatttaatttgtatttgggagcttgatggtgaagctggggatatcacttgtgatattgtggaggcttctatgatttatggtggaggaggagtgtgtgaaagtgatgtacagttacagaagagcccttgtggttctgttgatggggatgttaagaaatcgggtcatacagtttctaaagggcataagaattatgatttgatgcttaatcttcaactgggtattaggtatctcatctacattgctactttaattagcttttcagttatggaagtgaagaacctcgatgatggagatggagaagcttggcgcttcagaatcatcgccaaaacagtgctgagaaacgatggtcatg

SEQ ID NO: 8358 - DNA, 222 bp, Glycine max
  Peptide Sequence Number=SeqID_125136
atgccatttgcaacagcatctgagctagagcagcctattcctcaggattcaccagctgctcagccattagaagagaatgagcatgtgattggaactatgactgaaaatgttagtcagtttgtcagattgattgtgaaggaatgcattaaccgtatcccggtgaaagtgcgatccttaaaatttgagagaaatgactatcatttagtactgatttttgcgtga

SEQ ID NO: 8359 - DNA, 408 bp, Glycine max
  Peptide Sequence Number=SeqID_125137
atggggtcaacagaagagtgctcccaaacagctgataagtcttttgctgggacattaatcagtaggttgatcaccatgaaatttgatggttcacgtactatgcataagcatgtcattgggatgtcaaacattgcagcaaggcttaagaccttgggaatgactgtgaatgagaacttcctggtacaatttattcttagctcattatcgtacgagtatgacccatttcaaatgagttataatatcatgaaagataaatggaatgtgcatgagttgcacaatatgcttgttcaggagaaaacaaggcttaagaatcaaggaagacactcagcccattatgtaagctaccaagggaatcaaggaactagaaagaaatttttaaagaaacatgtaagggcaaagggctattaa

SEQ ID NO: 8360 - DNA, 285 bp, Glycine max
  Peptide Sequence Number=SeqID_125138
atgaaagcaattccatatgcatttgttgttgggagtattatgtatgcttatatctatattcgaccagacataagctttacagatggactgttaggaagatatcaaagtaatccaggaatgaaacattggaaagttgcaaggaaggttttgagatacttatatggaataaaggatcacatgcttacatataggaggtctggtcaccttgaagtgattgggtatccagacttagacttagctagatgcgtccaaattcgcccttgtctatctatttcttttagctag

SEQ ID NO: 8361 - DNA, 150 bp, Glycine max
  Peptide Sequence Number=SeqID_125139
atgcaggaggaaagggccattcgcgtaggaagactcggatataagtggagagttacgcagaatcttcaactcacgctcactccatatctggttcagttgaagcagttcaagggcaggagatcgatagacgaagtgcacagttgcagttga

SEQ ID NO: 8362 - DNA, 691 bp, Glycine max
  Peptide Sequence Number=SeqID_125140
atggcagatgccgaaccttttgacgccagcctggaccggctcgaggcagccatggccaacctcactgcagtggattctgatctccatgcatctcaccttcatttagacacgctccacgcttccatgctcttcaaattagatctcattagcctgaaactggataccctgatctcccgccaacgctccccattctcatctctggagtatgaggcgaacttctacagtccgatgacagtgttttctggaattctctcagttgtaagatggttaggggaagtttccacatggaagcatcctataacaacagtgctggtgcacattctttttctgatgcttgtgtgtttccctgaacttatactgccaaccgtgtttctatacatgtttgtcatcggcatgtggaattggaggttccggccaaggtgccctcctcacatgaacatcagactctcctatgcagaaagggtgaccccggatgagcttgacgaggaatttgacacattccccacctcaaagagccccgacattctacgttggaggtacgatcggttaagaagtgtggctgggaggatccagagtgttgttggagatttagctactcaaggagagaggatccaagctcttgtgaactggcgtgatcctcgtgccactgccatgttcatgggtattttgcttcgtgggctgctattgcgtt

SEQ ID NO: 8363 - DNA, 567 bp, Glycine max
  Peptide Sequence Number=SeqID_125141
atgaaggtttctaactcaatagcatcctttgttctgttgctgattctcatttcaaaaaattgtttgtgttctgaagcacagcagtgtcgtccaagtgggagaatcatgggaaagaagcctcctcctggagaatgcaacaaagagaatgattcagattgttgtgtgcaaggcaaggcgtacacaacatacaaatgttcgccagcagtttcaaggcacacaaaggctgaactcactctgaatagttttgaaaagggtggagatggaggtggcccttcagaatgtgacaaccagtaccattccgatgacacaccggtagtcgcactctccaccggatggttcaacgacaggagtaggtgcctccacaacatcaccatcagtggaaatggcaaaagcgtggtggctatggtggtcgacgagtgtgactcgaccatgggatgtgatgaagaccatgattatcaaccaccttgttccaacaacattgttgatgcctccaaggctgtctggaaagccttaggtgtgcctcacaatcagtggggtggattagaaattacatggtctgatgcttaa

SEQ ID NO: 8364 - DNA, 462 bp, Glycine max
  Peptide Sequence Number=SeqID_125142
atgggaaagaagcctcctcctggagaatgcaacaaagagaatgattcagattgttgtgtgcaaggcaaggcgtacacaacatacaaatgttcgccagcagtttcaaggcacacaaaggctgaactcactctgaatagttttgaaaagggtggagatggaggtggcccttcagaatgtgacaaccagtaccattccgatgacacaccggtagtcgcactctccaccggatggttcaacgacaggattaggtgcctccacaacatcaccatcagtggaaatggcaaaagcgtggtggctatggtggtcgacgagtgtgactcaaccatgggatgtgatgaagaccatgattatcaaccaccttgttccaacaacattgttgatgcctccaaggctgtctggaaagccttaggtgtgcctcacaatcagtggggtggattagaaattacatggtctgatgcttaa

SEQ ID NO: 8365 - DNA, 547 bp, Glycine max
  Peptide Sequence Number=SeqID_125143
atgaagttcaaaatttgtacaacttcttttcaaaccattctctttcttctaattcttgtagccagtttctggctaataagcattgcaggtgctaactgcaggccaagtggaaggctaaggggaaaaaagcctccttcaggaaaatgcaacagagagaatgagtctgagtgttgcaaaaagggaaaagtttaccacacattcaagtgttccccacctatctctcatcacacaaaagcaattctaacactaaatagctttgagaaaggtggagatggaggtggcccttcagagtgtgacaacaagttttactcagacaacactccagtagtggcattatcaactggatggttcaatgacaaaaagaggtgtcatcacaatatcacaatctttggaaagggaagaagggtccatgccatggtggttgatgagtgtgattccaaaagagggtgtgatgctgagcatgattttctgcctccatgccccaacaatgttgttgatgcctctaaggctgtttggaaggctttgggtgtgccaaaacgtgactggg

SEQ ID NO: 8366 - DNA, 213 bp, Glycine max
  Peptide Sequence Number=SeqID_125144
atgaagcttgattttaaaattcagatggttccgtcaacgccgttaacccattatcctgggaagtgcaacatacaaatagcagaacacatagagtatgcagcagttccaaactacacagcagacaacaaagctaaccaagaggaatccacagttacgaatagcagaagcaaacgcgatactcacaggcccaaataccttgcagattatgtgtga

SEQ ID NO: 8367 - DNA, 462 bp, Glycine max
  Peptide Sequence Number=SeqID_125145
atggagtgctccaaaccaatcatggaataccacgggagcatggatgaattcttgggtcgacaaagaacacgaaagatcatgaggtttcgtctcaaatgtaatagcgatgattgttgctcattcgacgtggaggaatgggtcgatgaagtggtaaccagaaaagttaagcatgtgaatatctccttgtacatgtgccattcaagtgttttcaacttggctgccttgttcgtctgcaccacacttgtcacctttgatttctctattccttgtaatgttcatctccctaatctcaagagttttcaccttcatgtgtacacattcttgcagttccccagtattagcaagcttatctctggatctccagctcttgaactgtttcacctcaagcagaaacagtataagcattatttcgacgagttgaagattgaagttttccaccacaactggtcgatctcattgttg

SEQ ID NO: 8368 - DNA, 882 bp, Glycine max
  Peptide Sequence Number=SeqID_125146
atgtctaacttaatagcatcctttgttctgctgctcattctcatttcaacaaattgtttgtgttctgaagcacaacagtgtcgtccaagtgggagaatcatgggaaagaagcctcctcctggagaatgcaacaaagagaatgattcagattgttgtgtgcaaggcaaggcgtacacaacatacaaatgttcgccagcagtttcaaggcacacaaaggccgaactcactctgaatagttttgaaaagggtggagatggaggtggcccttcagaatgtgacaaccagtaccattccgatgacacaccggtagtcgcactctccaccggatggttcaacgacaggagtaggtgcctccacaacatcaccatcagtggaaatggcaaaagcgtggtggctatggtggtcgacgagtgtgactcaaccatgggatgtgatgaagaccatgattatcaaccaccttgttccaacaacattgttgatgcctccaaggctgtctggaaagccttagatgtggatatgctgaagaaactcatcttcatgctatcagggactgcatcaaagctagaagatttgcaaccatttgctggttcatatatatggaactccagaaatgctgaaatattcaatgatgaagtttggcctatatggcttctcaagagtaaggtagaagctttgctgaacatcactcctgaggatatttctgatccaaatcaaagagagatcaaagggacccttgaggttcaaggtgacaattgtggtgcaagtgaacaaggtggagaaggagagcacacttgtatggcacatgttcatgcacaaggagatattcacacgttcaacttttctggctacaactgcagatacccattcttccgtgtaacgtga

SEQ ID NO: 8369 - DNA, 1395 bp, Glycine max
  Peptide Sequence Number=SeqID_125147
aatttcggcataaaatatgaaaatttcgctgactttgacccttcactacgaaacagggttgtcatagacaatgccgtgtgctccactgcgacaatagtcaaggttgatagcgccagaaagcatgggattcttatagatgctgtacaagttctctctgatcttaacctttcaattaagaaggcttacatttcttctgatggcaggtggttcatggatgttttccatgtcacggatgaaaacggagacaagctcacagataaaagcgttttaagttatattgaacagtcacttggtagcattcacaatgcaaaaaccaatcactcaaacggtctcactatacttgaattaactggcactgaccgcgttggtcttctttccgaggtgtttgctgttcttgctgagcagcaatgtgacgtggttgatgctaaggtttggactcacaatggccggattgcctccttaatctatgtgaaagactccaattctgggactcttattgaggactctcagagaatcagtaccattgaagcacgtttgagaaatgttttaaagggtgacaacgatattaggaatgcaaaaacttctgtcactaatgccgttttgcatgccgaaagaagattacatcaaatgatgtacactgaccgtgattaccagaggaatcctattttgaagttcgcttctgttaccccaatagtcaccgtccaaaattgggcagaaaggggttattctgtcgtcaatattcagtgcaaggatcgagttaagcttttgtttgatgttgtgtgcaatttgacagacatggagtatgttgtgttccatgccactattaagacaacaatagaccaagcgtatctggagttttatatcagacacagggatggcaccccaattagttcagaaccagagcgacatcgtgtgattcaatgcttgcaagctgcagtggagagaagggcgtacgagggtgttaggctagagttatgcaccgaagacagacaaggacttctagcagaggtgatgagaactttccgagaaaatgggatgaatgttacacgggcagagatatctaccattgggaacatggcatcaaatgtattctatgttacagatgcggtaggatacccagttgatccaaaaattgtggaatctgtaaggcagaaagtaggattaagcaatttaaaagtgaaggagttgccattggtatgccatgagaaggcagaaagggaagatcaaccagttggggttggtggggcagtgttgctgtgtctggggagcctcaaaggggaggaatttaggagtgtgggaagatatttgcaacttttagagcacaatattctttgcttctggagggggttgggtgaagaagggaagtatttgggagaagttgtcggccttgggtaa

SEQ ID NO: 8370 - DNA, 588 bp, Glycine max
  Peptide Sequence Number=SeqID_125148
atgggttttgaagctttgggaaataagctattcttattgggtggttgtagtgggtttctagattttactgatgaggcttattcatatgatgcttcctcaaactgttgggctgtagctgcttccttgtcaaatgctaggtgctacttgacttgtgaagttttggatgaaaaactatatgctattgggggattagtttcaaattcaagtaatcattcttggaatacttttgaccctttgacaaattgctggacattccatatagatcctaatattggttctgatatcaaagattcagtggttcttgatgggaggatatatgtccgatgtgccagacatccggatgtaactcgtcgtgtttttgttgttgtacatgaaccatcaagtggcacgtggcagtatgcagatgctgacatggtttcaggatggacaggtcctgcagttgttgtcgatggtaccctttatgtcttggataagagtttgggaactagtttaatgatgtggcataaagaccaagttggaaagctttcaccatggcttactagaccaagttttcgatgcatggtgatttggggaatgaaggtcaggtga

SEQ ID NO: 8371 - DNA, 519 bp, Glycine max
  Peptide Sequence Number=SeqID_125149
atgttgcttgggaaaacgaaacgtccacggttacattcacttaaaaaatggttcacggacgaaggcgatttcacgtgcaacaaaacgcagacacggtgcgtgaactgtgccgtgaccgaaccttacctgggatatttaggaatcgtcgaatctctctattgcagcactcttcgagtgcccagattctcaatcagtgccactcctccaaattttgcatcttttctgagcccctccaaggctggaatcaaattgagttgtgggattcacaaaccagtttggaggagtaggtgtgatggtttaagggtacagtgtgcagcctccaatggagaaaatgatgatgatgatgggttttacatcagaaggtgtgttgagcttgcaaggaaggctgttgggttcaccagccccaatccattggtggggtgtgttattgtaaaggatggcaaagttgttggtgaaggcttccaccctaaagcaggccaacctcatgctgaggtacctaccttctgtctctctctctaa

SEQ ID NO: 8372 - DNA, 645 bp, Glycine max
  Peptide Sequence Number=SeqID_125150
atggagcatatagataaaggaaaagaatcatcaaatagtgaaaatgaagtggaagccacaaattctccaattatttgtggccttccagatgatatttttcttatggacaaatcaaatgagattttctgttatgttttggatccaacctcctcaatgagatattggaagcttgttgatgatcttccacctcacatcttgaaaagagaaggcatgggttttgaagctttgggaaataagctattcttattgggtggttgtagtgagtttctagattctactgatgaggtttattcatatgatgcttcctcaaactgttgcgctcaagctacttccttgtcaactgctaggttagtatctttatttctattctttttggaagctaattcaacagatcctaaaattgttaatgaaattaaagattcagtcattcttgatgggaagatatacgtccgatgtagcagatatcctgtaactcctcatgtatttgctgttgtatatgaaccatcaagtggcacatgggagtatgcagatgaagacattgtttcaggatggactggtcctgcagttgctgttgatggtaccctttatgtcttggatcaaatgtggttgttgatgttggtgatttggggaatgaggatcaaatga

SEQ ID NO: 8373 - DNA, 507 bp, Glycine max
  Peptide Sequence Number=SeqID_125151
atggaggccataaaagagcaaatggccaaaatgatgaaggccatgatgagcatgaagaagataatggaagccaatgcggttatagttgccgctattagtgctgtcgctaaagtgaacccgatgctcccatctggcctcaagcaaatgaatcatccaacctcaaatatggcacatatctctcaaaccatgggggagacacatgaaattccccaccacaatctagctgacttcgagccttggctcggatatgccactgaagggcaagcagttggtggtataccctttgaaaacactttggagggccctcagtttcgcccacaaccacaaccattgcattttgcggtgggaagagcccctcctgctatggccgaaaagggaaaggcggatcatctaaaggaaaggctcagggccattgaaggaggtgaagattatgcctttgctaacctagaaaagttgttcctaatacccaaacatggtcattcccaagttcaaggtgctggactttga

SEQ ID NO: 8374 - DNA, 653 bp, Glycine max
  Peptide Sequence Number=SeqID_125152
aacaagagagggtgcatctcttgtggaccagttctagtggagggtacatccactaggttcaaagagaacaagggagggaacaggttaatccaagatcatgatgaagaccaagtcaacttgtgtctcatgacaaaatctgatgagaataacaaagaagattctgtaaggaagaagtggtacatagacagtggatgttccaagcatatgacaggagatgtatccaaattcacaaccatttcccctaagaaaagtggacatgttacatacaataataagattacaaaacattggtatctctacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 8375 - DNA, 339 bp, Glycine max
  Peptide Sequence Number=SeqID_125153
atggcccgctatagcatggaaacttatttgggttggggacagcataagcccttctcgtgtcgtgtagctagttccttggatgagagcctcctgaagggtatgggtggaggtttggttggaatggggagcaatgacctaggagttggtggagggggcgacggtggttgtcgtgaagagactggccctgtggagaagggtggaagaggtttaaaatggctgagacgccgtgaatccaagaatttttcctcttgcaaatgggccaaaacgccacctgagttagagttaatggttgcaaagcctgcacctcccgacgaatttctggtgcgagtccggagatga

SEQ ID NO: 8376 - DNA, 213 bp, Glycine max
  Peptide Sequence Number=SeqID_125154
atgaagtgtgaaaggaaggatatgcgaaccagaaaggcaaaaaggaagaatgaaaacgacgtcgatctagtgcaggaggtgcttctcctctgcctgccacacattctggtgcgaggcgaagatctccactacgcctgcattggcctaggagtccacctgtcgtcgagacttcatcagcaggagctcctcggccacagcggtggcgatgaatga

SEQ ID NO: 8377 - DNA, 225 bp, Glycine max
  Peptide Sequence Number=SeqID_125155
atgtcagtgaaaaaccacgtcgggcgcctaggagtacatgacaagacaaaccgcacactaggagaccagtcagggtcacaatattttgcgagaatgcttcaaccatatgggatcaacataggcttaaaggaacactcaaaccgagtgactcccaaggcctacactccgaagagtccgtcagggcctctccctcacgattcaggtccaacccaaaaaacattttag

SEQ ID NO: 8378 - DNA, 895 bp, Glycine max
  Peptide Sequence Number=SeqID_125156
caccgtggtcagcgccggcgtcagcaaggcgccgaagcgcatgccgtcgaaaccgcagacggaaatatcggacggaaccgacaggcccagcgccaccaggtcggcaatcacggccgtggccagcaggtcgttggagcagaacagcgccgtcggcgcctgtttgccgcgcaatgcggacttgatcgcctcggcgtcgctgccggtgtgcgaattcatggcgatgtgctggatcggttccaggcccagcttcttggcgcaggcgcgcgcgcccgacaggcggcggcgagcgcgatcggaggccgtcagcgggccggtcacgatggcgatgcgccgatgtcccagcgccgccaggtgcgagaccatgtcaatggcggccgcgcgattgtcgaccgaggcatagggatggtcggcggattcgttgtagaccagcacgtagggcatgccggcgctgtccaggtcgtccagcgtggcgctgcgggccgcgtccgccaccgtcaggatcaggccgtcgacctggtggtcgatcaggccctgcaccgcggccgattccaccgccgggtcatagccggtggcggtcagcatcacgctgtagccggactcgcgggcgcgccgttcggcgccttcaaagcactcggcgaataccggattggacagcgtcggcagaatcaatccgatcgtgcgggtgctgccggaacgcaggctgcggccgacgcgattgggccggaaacccgcgcgcttggcgatggcgcggatgtgcgccagcgtatccggatggacgatttcgggctggttgaacgcgcgcgaaaccgtggcgggggaaacccccgccttgcgggccacttcgatgatggaaaagcggggcgatgcgcgcgacgccatggctacattgctgccg

SEQ ID NO: 8379 - DNA, 451 bp, Glycine max
  Peptide Sequence Number=SeqID_125157
atggaggccataaaagagcaaatggccacaatgatgaaggccatgatgagcatgaagaagataatggaagccaatgcggttatagttgccgctattagcgctgtcgctaaggtgaacccgatgctcccatctggcctcaagcaaatgaatcatccaacctcaaatatggtaggcaaagatttgggaagtacggatgaccccatgatgtgcaaattcaaaacgagcacgccttcccatcatatggcttgcctctcaactatacaccacccaatgtggcatacactctcaatgaaaatctcaataactccactccgatactcattgagaacaaataacctcatcaggcacatatctctcaaaccatggggggagacacatgaaattccccaccacaatctagctgacttcgagccttggctcggatatgccactgaagggcaagcagttggtg

SEQ ID NO: 8380 - DNA, 165 bp, Glycine max
  Peptide Sequence Number=SeqID_125158
atggcacaaagcaggttttgtggacttgcattcctgtatggcagaattattaagaagcaaatactttctgcacagagcactgttaaagagtatattgtgggatcaaagaaagaatctcaagaaagccatgtggggagattggacagcaataaagataatccataa

SEQ ID NO: 8381 - DNA, 678 bp, Glycine max
  Peptide Sequence Number=SeqID_125159
atgcagccagctaatttggttgattgcagtcacagtgactattttctaaaacctagatctaacttgtgccacgtgttgtatggttcagatgttaggagagatcttcagcatttgctggaagtggatgatctggtggtggtcatgaattcagagcaccggcctcgctgcattattgagtttatatcgcagagcatccggttgctgaaattggaggagtctagaagaaatgtcctggtatgtgctaattggaattgtttgcaagatatggatttgttaacatatcagctcactctggaatcaaagatcacttgtttccatgaaggtatcggcatatgtgaccaacttatgggtattcccattccactggcatatactcgcttgacctcaaggtttcttgtcttgtggcatttgacactccctatcatactttgggatgattgccattggattgtggttcctgctacctttattagtgctgcctctttgttttgcattgaagaagttggagttctcatagaggagccgtttgcaacacttgcacttgatgatctctgccaaaaggcacagacagacatccaagaagcaattgcgtctggaaatttaattcacgcacgccttgttgcaaagcaaaagagccatgccgaagagcattcaccgaatggctggcctaactcatag

SEQ ID NO: 8382 - DNA, 540 bp, Glycine max
  Peptide Sequence Number=SeqID_125160
atgccctctccatcagaatatccttctccttccatcctggaagcccgccaagcccaccatctcggcctccctccctccggggcccacctccggcccggcccaaaccctaatctcgctcctccgttccatcccggactgggccgatgccgtgcaggagcgcggcatgcagaagaagcgcgccctctacacccaccagaactggcgcgaccaccgcagctccctccgccacctccgccacgtcttctccagcctctcctcccgcgtcatcctctccctcgtccctcccgtactcttcttcaccgctttctccgccgccatcgccgcctacaacgaggccctcctcctccacctcctcccggagttcttaccgctcctccgcacctcctccctcccttaccagctcaccgcccccgccctcgccctcctcctcgtcttccgcaccgaggcctcctactcccgcttcgtcgaggggaagaaggcctggaccaacgtcatcgccggaacccacgatttcgcgagacaagtcgccgccatcgttga

SEQ ID NO: 8383 - DNA, 180 bp, Glycine max
  Peptide Sequence Number=SeqID_125161
atgtctgtcttgcaagttattttcagagatgaagagagtttagcattttgttttcgtgatgaggtatatgctttctgtgggcactggatgcggtccattgttagaagaactagttacagtaagtctgaatctgagcatagagagcaggaacatttgtttgtgatggtttcgaatccttaa

SEQ ID NO: 8384 - DNA, 177 bp, Glycine max
  Peptide Sequence Number=SeqID_125162
atgaacagaaacacctggagacaacttttgcttcaacaatttcttccgtgtggagaggatagagagaggatgatgctagttgtggagatgagcgtaagttgcagaagaggaaatgaggaagcaggcagggatctgcaaaaagtaaatgccccaaagaggcctatcttatcggtctaa

SEQ ID NO: 8385 - DNA, 129 bp, Glycine max
  Peptide Sequence Number=SeqID_125163
atgggtcatgtccatgttgttttgacatatgaggttgtctggataaagaagttcatacttaccacaaaggttaataatctttttctcattactctagcagcgggttggccacttcattttagaatgtaa

SEQ ID NO: 8386 - DNA, 699 bp, Glycine max
  Peptide Sequence Number=SeqID_125164
atggctggtgaattgatgtctggttcggctggaatgggtttcactcctcatatcatcaccattgcagttggagaagacattgcaacaaagatcatgtcattttctcagcaggggcctagagctatatgtattttgtcagctaatggtgctgtctctactgtgacacttcgtcagccttcaacatcaggtggcactgtcacatatgagagcatgtacatggctgttttcaaaatgtcagacatcaagactataggagtttacagcacaaatattattcataaatgcattcttatgtatgggcgttttgagatagtgtgcctatcaggctcttacttggttgctgatagtggtggctcccgcaatcggactggtggattaagcgtttcacttgcaagtcctgatggtcgtgtcgtcggtggaggagttggtggagttcttattgctgcaagtccagttcaggtgatactagggagcttttcatggggcgcatcaaagacgaagatcaagaaaaaagaaggttcagaaggtgcagaagttgctttagagactgatcatcagacagttcataatccagtcgcagtgaatagcatttctccgaatcaaaatcttactccaacctcatctctaagtccttggcctgcatcgcgatcgttggatatgcgcaattcgcatattgacattgatttaatgcgcgggtga

SEQ ID NO: 8387 - DNA, 492 bp, Glycine max
  Peptide Sequence Number=SeqID_125165
atggatcgaggggaccaaatgacattacctggctctgcatcttactatatgcagagaggaatacctggtgctggaaaccaacctgtactgcacaattcacctaatattggaccattgtctaaccctaatctaccatgtcaatcaagcattgggggtggtggtaccattggatccacattacccttagagtcttcgggaatttcagctccatgtgtcaatgtgagtgctccttctgggactctgcctggggaaactgtcaaaaggaagagaggaaggcctagaaaatacggctccgacggagctgtgtcgttggcgttgactccgacaccggctagtcatcctggagccttggcacaaggccagaaacggggcagaggccgcccacctgggtctgggaagaaacagcagttggcttctcttgctaaggtgttgaaacactctagtgttgaacggctgattgtttctgttgttacatcacttgttttattttaa

SEQ ID NO: 8388 - DNA, 1822 bp, Glycine max
  Peptide Sequence Number=SeqID_125166
atggcaaagagtatgctcaaagctagaggtgtgccaaacagattcaggtgtgaagctgtagcaactgcagtgtacattctcaatgtttctcctaccaaagttgtcataaacatgacaccacttgaagcttggagaagaaagaaaccgtttgtaagtcatttgagaatttttggttgtacagcatatgcattagttgatttaaggactaagctggatgataaatctgtcaaatgtgtatttattggctatgctactcagtcaaaggcatacagactatataacccactaactggcaagataattgtcaatagaaatgttgtatttgatgaagatgcaggctgggtttgggaggaatgtgaaatcagtaaaagtgttcagcagaaatcagttagttttgatggttcagatgaggtctcaaatgtgccagaaaatgatcacactccaagccctcctttaacaccatcaagccagggatcattaactcctttaagccagggatcatctagctcatcaagtgattctgctccaaggagatacagatctttggcagacttgtatgaaaattgtgactttgcattgatggcagcagatccaacatgctttgaggaagctgaaaaagaagtggagtggcaaaatgcaatgaaagagcagatcaagtccattgagaagaatacgacgtggcaattgctaaatcttcctgaagggaagaatgtcattggactgaaatgggtgttcagaacaaagttcaacacatatgggagcatccaaaatcacaaagctaggctggtggctaaggggtatgcacaacaaaaaggaattgattttgaggaaacattttcaccagtagcaagatttgagacagtgagagtggtgctagcattggctgctcaatggaagttgaaggtgtttcagttggatgtcaaatcagcattcttcaatggagacttgcaagaagaggtgtttgttgagcaaccactagggtttgtcaaagctggtgaagaaggcaaggtatacaagctgcaaaaggcattgtataggctgaaacaggctccacgagcctggtatagcaagattgattcattcttccttcaaaatgaatttgagagaagtgaaaatgaaccaactctctatgtgaagaaagtgaagcaaggagaagatagaatctttctctgtcaaagaaaatatgcagaggattttcttaagaagtttcatatggagaaatgtgaagcaatgagaactcccatgaacacaaatgagaagctgcaacgtgatgatggcactgagaaggcagatgagaagcttttcagaagcttagttggtggcttgaattaccttacacatatgaggcctgatatagctcatagttcaatcaaacttggaatactttatgaaagtgtggataatttcaagttggttggctatagtgacagtgacagggcagggtgcttagatgatagaaagggtacatcaggttctgtatttagtcttgcctcgggagccatcacttggagctccaagaagcaagacacagttgctttatcatcatctgaagctgaatatgtagttgttggtgcaattgaattgtggtgcaataacaggtctgctatagccatgacaaagaatccagcgttccatgcaagaaccaagcatattgaagttcagcatcacttcataaggcagctagtggcagaagagaagttagtgctaaaattctgtggcacgaatgaacagaatgcagatctgtttacaaaagctttagcacaagcgaaacatcagttctttttggagaaaataggaatgcacgagcttgaattaagaggag

SEQ ID NO: 8389 - DNA, 234 bp, Glycine max
  Peptide Sequence Number=SeqID_125167
atggatgtgaacacaatgttaatgtctaatgatcgattttcatgtgttggaccgattgagttgttatgcaccgttggtagaacacctgatggaattttaaacttacttgaacgcactatgacccctactcatgatgaggttttgaaacaatttgtgccaatagaaattttggctctttttagtaaaccggttatggaaaatgaggacgaggtggttacgtcgttgcaggattga

SEQ ID NO: 8390 - DNA, 867 bp, Glycine max
  Peptide Sequence Number=SeqID_125168
atggctaacaatgcagcagcctgtgctgagagagcaactagtgacatgctgattggtccagactgggcaattaacatagagttgtgtgatataattaatatggaccctagggagcaccatgttttagggactggatcaaaatttattgttggagtcctcggggacttatgcatgctaagggaataccatactgacaacttgggcagtgctaatataactgatatatattttccccttaagatttttatggccggagaattgcaagcaaaggatgcaataaagatacttaagaagcgtttgagcagtaaaaatccccaaatacaacttttggctctttttgcactggaaacccttagtaaaaattgtggtgacagtgtatttcagcagatcattgaacaggatatcttacatgaaatggttaaaatagtgaagaagccagacttacgtgtgagggaaaagatattgattttgattgatacatggcaagaagcttttggaggaccaagtggaaaatatccacagtaccttgcagcatataatgaattaaagtctgctggagttgaatttcccccacgagaagagaatagtgctcctttcttcactcctccccaaaccctgccagttcatcttgctgctgcagaatatgatgatgcttctattcaggcttctcttcattcagatgcatctggccttagtttgccagagatccagaatgctcaagggctggcagatgtattgactgaaatggttaatgccttggatcctaaaaatcctgaggttgagaaccaggaggtgattgctgaacttgttgaccagtgtcgctcataccaaaagcgtgttatgcttcttgtaaatgagacttcgtaa

SEQ ID NO: 8391 - DNA, 225 bp, Glycine max
  Peptide Sequence Number=SeqID_125169
atggaattcgaatcagaagcgattgggatatgtgatgcaagaatgaggaagccgcagcttcgggattgggcaatggggattgttggcgtcacttgtcagaacaaggatgcttacgctaaagtaattgtagatgcactgactaagctcagaatccacccatcaactttcagcaaagcacataagcttttagaaggatattgtggagattgttctgaagatgcctaa

SEQ ID NO: 8392 - DNA, 1194 bp, Glycine max
  Peptide Sequence Number=SeqID_125170
atggtgatagtagcaggaaccggttacactatcacatggaggtttttcgatgcttgctgcgagtgtggattcttcatgaactttgggcatatgattggtctgtccttgtctgtctgtcccaaatgcactggcattgtcctaattattgactcaattacagtccttggggttcgatctgctaaaagcatagttagcttgagggggagtgttggaagctgtgactctttggctcttcctctgcttgtttcaagtcctattgtgctgatatctgagtctctaatgtccttgcattcttgtcatgggtttaagtctgatcccccgcaacatgagttagaagaagaatcttcagtttttggtgtcgtactctgcacaccggtattggatgagcagcttttaggtcagggattggcactgaatgacagtcttcagcgagtgctttgtcaacatgacaatattgtaaaaggaactccagatacaggcacaagaggaacagaaacgtcaactctgccacttgtatatgtaaccaatgaagaggatgagtcagacgttgattttgcccaactagcccataggtcctcacgagatacgaatgcacagagagccaatgccaaggcagaacccgtgagagtaaacccaattcttcctccaccaccagcaccaaagaaaccaatcttcacagatgctggtatgattgactatctcagtggtgatgcatacaaaacagaagcatcccatgaacaatctgaaccaacttcatatgccgtgccccttcattctagtcctactaatcctgcctcaaccgctgcaacactatcttcctctccaccttattccccaagtactccatcgcgaattttaagcaaacagcctgtgtatgatgaaccacctcccatcaataaatcctcagaaagccttcctctatctcccttggaaacacaatctccaggcttccttctgccgcccccttcaagctataatcagagacagcagttttttgagcaacaaggtgttcctcattcaagttctgggttcagttccgcagatgacagcttgttggcacaaacccagaatttgtctctgaattcatctactccaaccaaacaagagaagacagaagatgtcctttttaaagatctagttgactttgcaaaatctaaaacctcatcctcttccaaacccagtaggccattttga

SEQ ID NO: 8393 - DNA, 207 bp, Glycine max
  Peptide Sequence Number=SeqID_125171
atgtcggaatacactgcttcaaaggcacggaagaacttcttccacgaggttgcacgaaagaagatggacgaagatcaatgggcgtatgacaatacgatgtctgaagaagttgatatggattttgaagatgaacaacattgtggtgtgaatgaaggacatgttgattgttcagacgcttttaatacttctcaggtctttgcaacctga

SEQ ID NO: 8394 - DNA, 297 bp, Glycine max
  Peptide Sequence Number=SeqID_125172
atgatgaaaggtgcttggagaaaacagtgcttgctattgagtcttcttgcttttgttgttctatcagaaggatcaagattacctaaggagtactgggaacagatgatgccaaagaagctaccttctccttcttcttctccctccaaaggcacgaattcggtgttgccttcgtctttgtcgaacacaaaaaatgatggtcttcctacgtcagatggaaagattcattggtcttggtccgaagacagtgcagtcccttgtaaagatgttggagtaacaattcctcattggaccagataa

SEQ ID NO: 8395 - DNA, 549 bp, Glycine max
  Peptide Sequence Number=SeqID_125173
atgtacaacctgtccaaggaggatgcactttctggcattgcagcagaatctgtttgtagagtggatggtattttcccatgcaccaactcaaatgccacaagtcaatatatgtttgacgacggagactatgcaccaccctcactgtcagcctctcccctccacgtcccacgaatcaacccaagcatgccaccgttgaagacttcggaagcgtacaagcattgcgcaccgtgcacggggccagcgatggccaacgacgcaggggtgagttcggagcaatgccaccgagttggacgcggattcggaccggttccggtggtcgtaccggagaacaaggagctcaatctcgacaacgacaaggacgttgtccacccaatccatgctgaggttcccgtcttcagccaccatattgggactcgcagttctggcagtggagttggatgcggcggtggtggtgatggtggttgtggggcttcctctacggtgggggagatgccgttggtggctggggaatccggtggcggtggtggtgttggtgctgaattagcttga

SEQ ID NO: 8396 - DNA, 402 bp, Glycine max
  Peptide Sequence Number=SeqID_125174
atgccatatcctgagggtggaaatcctgcatcatgtctagagaatagcttgatattgtctgaacttaattacaacaatgatgaggctagatcagaattcgaaaatctttttctatcgatggcagacgaacaaaaacaaatttattacaaaattatggaacatgtcaacaacaatgaaggtggcatgttttttctatatggatatggaggtacaggaaaaacatacatatggataacattagcaagttcactgagggcaaaaaatcaaattgtgattatggttgcttctagcggcatagcttctttgttattgccaggaggcaggactgctcgttccaaatttaagatacctgtgccaattttgaagactcaacatgcaatatacttcaaggaagtcagctag

SEQ ID NO: 8397 - DNA, 237 bp, Glycine max
  Peptide Sequence Number=SeqID_125175
atgtcatcgggcccgccgcctctggatgacaaaagggtgcagaatgaccatattggcctctgctcatcaatcacactttgggtcactgaacgacgaggtgcggataactgtaaggtgtctccgcgggttaccagctcttgggtcatggcaacaaaaggtggtgtggtcgacaaaagcaaggcttttgctcctacgtatcctccaatgaggaactcagacctacgtagttctggataa

SEQ ID NO: 8398 - DNA, 564 bp, Glycine max
  Peptide Sequence Number=SeqID_125176
atgggctcaaaatctaccctaaggctcatgagaaccctaaggccttcccttggatctctggcccaatctacttggagttttttatccaatccccttgcaggcacacgtttgcgtatgagcatcacatatcacccgcaaatagatggccagaccgaggtcatgaatcgtgttctagaatattacatgtgttcattggtgcatttgaatccggctgactggttcaacttcctggcattggctgagtggttatacaacacttccattcactcaagcacatgcctcactccatacgaggtcatttacggcaaagccccgcgaacaattccccattacatagtaggttcctccaacaatgaagttgtcaactccttgctcccttcccgccaggccatgcacgacactcttcgtcggtgtctgctcaaagcccagaataccatgaagctccacgttgatacaaggtgtcatgatgttacttttgatgtaggccagtggttttatgtcaaactccaaccatttcaccaatgttcagtcaccggcgttcttcatcctaagttgtctaaatga

SEQ ID NO: 8399 - DNA, 378 bp, Glycine max
  Peptide Sequence Number=SeqID_125177
atgggtcagacactttatggacctgccatgactgttactttcttctccttgaatgcacgtttgcaggagaaaccaaacctcttccagcattcaggaaaacttgaaaagctcatcttcttgcatgactatggtcctcaaagtagtcatgcctatctcagggaacaccagtttgtttacataagatggcatctttgtttgaccaccccaactatagttgcaaactttgtcaactttgcccttgttattttctccactgttttgggtgcctattggaaactatccattatccagcaaagttttggggtgactgtatttcctgggaatctcacttttggtatcttaatcatagcaaagctcaaggcttacaatctctcctag

SEQ ID NO: 8400 - DNA, 132 bp, Glycine max
  Peptide Sequence Number=SeqID_125178
atgtgggaggatgaatttgtgcgatgtagccagtttccttctttgatccttaaggacaaggctgtagctccaagaaagggacatgttaggacacatggccagccagtcattgtgagtggtgccctaacataa

SEQ ID NO: 8401 - DNA, 228 bp, Glycine max
  Peptide Sequence Number=SeqID_125179
atgactcttgggagttattttcgaaaattccttactggcttaaaaatcaaatttgaaatttgtaaaattgtttcagaaaccaatttggccactgggggagcggatggtgcaatccttcctatgaagggactagtcaccagagccatgagcaagaggctccaagagtattgggctagagctgctgaagaaggtcctgggattctcatgaacctcagggtagatttctga

SEQ ID NO: 8402 - DNA, 831 bp, Glycine max
  Peptide Sequence Number=SeqID_125180
gtaaatgtgttgactcatattgctgaagtgaaactggattctgatcaacttactgtcattgagaagttgaagcaaaagcatctcgagcaagagaaaagggagctacttggtgatgatcaggatggagaaactaatgttgacatgcttaataattcaccttctacaataaatgctttggacaggcaaagtagtgttgaagtcatggaacaagaaggtggattatgtgatgggaaagaagttgatcagtttcatcaaccgtctggtagtaatgaggttgccattgctaatgaggatggtatttcatatggatcagaggtcatagaggttgacaaagtaaaaataaatcaaggtgatttgttgtttgggggggatgcttcagatggtgctctctgggatatttttcggagacaggatgtccctaagttgcaggaatatctgaagaagcatttcagagagtttaggcatgtccattgctgtcctttaaagcagttggatcatgccaatgaattatcaaactccctgaaagaaagtgccaatattaacactgtttgggcatcgcttattgttgaagaatgcacaagacttggtttgatgtatttgtgtattgctcctggatctagaccttcccctgttgctgttgctgttgcaagtcacaaattaatcacatgtatttcatgcttcgatgagcgttcacttgcatatcatgctgttggatatggaagaggatctcacattccagcagtagccattacatcatcaggcactgcagtttccaaccttcttcctgctggggatcaaaattgcggattgagcattataggggaccaatag

SEQ ID NO: 8403 - DNA, 339 bp, Glycine max
  Peptide Sequence Number=SeqID_125181
atggtgctgtggcaatggggtcaagctgcttgtgcacaacagtgtcatcataggaaagaacccccctcccggagaatgcaaccaagagaacgattcagattgttgagtacaaggcaacatgtggcccttcagtacctttctaatgacacaccagtagttgcactttccactggatggttcaacaataggagcaggtgcctccacaacatcaccattagtgcaaatggcaaaacggggtggccatggtggtcgtatgtgacgaagaccatgattatcaacaacattgttgatgcctccaaggctgtctggaaaatcttaggtgtgcctcacgatcagtag

SEQ ID NO: 8404 - DNA, 446 bp, Glycine max
  Peptide Sequence Number=SeqID_125182
gccatggacaaccaatgcaaaacaagatgatgccaatgatgggccataaagacaattctggtgggagtaggaatattaatggaagtgttaagaaagctgaggtcattgatcaggcaatgctattcaagggcaaagggcaaaatcaagagaagggggatttggataaccctaaggcagtcggtgaggtagattatcataagaaaaagaatggcaaaagtgagaatggatttcttggtcggtttctaggctttgggaaaaaggacaagaaccaaaacagtggtgctgaaaataagaaaggcaaggaagggaaattggaggatcatgaaggccagatggacccgggcccaataatggttaataatattccaatgcgtcatcagatggagaatattcaagcagtacaaggacttccgatgatgaatggtgatggtgggtattatcaaggg

SEQ ID NO: 8405 - DNA, 255 bp, Glycine max
  Peptide Sequence Number=SeqID_125183
atgcaagacaaacagaaagttgagaaagcaagcccaaaggagagaaagagtgaacggagtgagaatgggaaaagaagaaatggaaaaaacccggacaggacacgtggagggaggggcttcaataatgggaaggggaaaaggaaaaaagcaaaaacgggcaggacgcgtggattgaagtgtcaacaggacagacaacaggcagtcagggccttgtttgtatataagatagagatagagatagagattaaaatatga

SEQ ID NO: 8406 - DNA, 1854 bp, Glycine max
  Peptide Sequence Number=SeqID_125184
atgatcaaagtttttggttgcttatactatgcatcaactcataatcaaactcacaagtttcaacctcgttcaagaaaaggagcattcttaggttttcaaaatggtaccaagggatatgttgttttagacattaacacaagagaaatattcatttccagaaatgttgttttccatgaatccttctttcctttccacacaaaccaaaacctctctactagcgaagcccaaccacattcacatatagacccaatttcacatgcactacatatagacccaatttcatatacactacccacaccacctcaatttaccccatccacacctatcacaacaaaccctgaaccaacaattcctcaacccaatggctcaccatcacctttcccaaatccttcaactcctcctacaatcgacacaccaaatcccaacatcattgatcgacacatccaagagctatcatctaaccatgctttaccacgtccctccaaccgcgacactcatcctccttcttacctttctgattatcagtttcaaattccttccctcaaagttgttattgctctagcatcgattaatcaatggcacctccatcaattagatgttagcaatgctttcttacacggggacctcggggaggacgtttacatgaggatccctcttggcttgcttggttacacatcaagtcagagttgcaaattgaagaaatcactctatggattaaagcaatccaacagacaatggtatgaaaaattatctattctattgctgacttgtggttattcacatgcccatgctgatcatagtctattcatcaaggctcataattctgaatttactgctttaattgtatatgttgatgacattgtgctgatcggtaattcccttgctgagattgaacgcattaagcatattcttcacactaattttcacattaaggatttggggaaactgaaatattttttggggattgaagttgcacattctcataaaggaatttcattatgccaacgtaagtattgtttggatttactgaaagattcaggtatgcttgggtgtaagccatcctccactcctatggatagttctcttcgactccataatgattcctctggttttcttgatgatcccctatcttatagacgcctagttggaagactggtctatttgacaagcacacgccctgatattgcctttgctacacagcaactaagtcaatttatgtccaaaccaacaaaaccccatcatgctacagttgtccgcgttcttcgatatctcaaagggtgtccaggcaaaggattattttttccaaggacttgctctggtcatctacttgggtttagtgatgttgattgggcaacatgtattgactctaggtgctttattactggttattgcttctttataggcaattcgcttgtttcatggaaaaccaagaagcaaactatagtatcatgttcctcttctgaggctgaatatcgagcacttgcttctgcaacttgtgaattactatggctttcttaccttctaagagatctacgaattcctcttttaaagactcccgtactttactatgataatcataatgctcttcacattactgtcaatccagtctttcatgaacgcaccaaacatttggacattgattgtcatctagtctgtgaaaagtcccaagctggactcatgttactgctcctagccccttattcaaatcaacttgcggatatattcacaaaggttctccctcctcaatccttcaacaccaatctttccaagctgcagttacaaaacatttttgcacctccagcttgtggggggctaatagaggaaacatataatcctagcttaaatgctacgtaa

SEQ ID NO: 8407 - DNA, 183 bp, Glycine max
  Peptide Sequence Number=SeqID_125185
atgccaaagcttggaggtattggtgttggtggtggtgatattgttggtagatgggcttttatcctttccaactatcaagtgaaaaaggccttccttcaagaaggtggtggtggtggtggagtaagatcgtcctcaccagatgagccggaggtagccacaggaagatggcgatgggaagcttag

SEQ ID NO: 8408 - DNA, 174 bp, Glycine max
  Peptide Sequence Number=SeqID_125186
atggcgatgcggaaggtgacgccgcttcgcccatgtaagggttgcaacaatgagattcacaaggcaatattgaagaataaagagttgtgttcaacacaaatggcggaaactaattcagacacaactatcattgatgacctgggtgttgctggatggggagttggtggaatataa

SEQ ID NO: 8409 - DNA, 372 bp, Glycine max
  Peptide Sequence Number=SeqID_125187
atggttggacttggacttctctttatttggtgggatgttcagttcttatcaaagagaagtcctcctaaaacgtttacttatttgggttggaaaaatggcaatctgttggattggcctaaggagttacataggccatggtggttgagggccaaagcaaaggatatgtttgccataaggtacctcccttatccccatgagaaagaagtgagcacaaagagcacgtatgcggaagcacaaagttacaatgaagacatgaagcttacatcgaacccaacaccgacaatggcagcgagactagcagtgaaacatacctcaggtcaccacgagttccccaatccttgcagcagaaaccaaaaaaggtccttgggttaa

SEQ ID NO: 8410 - DNA, 210 bp, Glycine max
  Peptide Sequence Number=SeqID_125188
atgttgccccaagtaacatggaaaacaagaattctcgtcatttacttgaagaaattagatctaaactacttgaaaatctttccaagctacagcatgctcctagtgtccaattttaggaaaggcctcctgattctgatcttggagaggcactgtgatggctatgttcctagttcctactcagcctatggattataccagccaatatcctaa

SEQ ID NO: 8411 - DNA, 603 bp, Glycine max
  Peptide Sequence Number=SeqID_125189
atggtgtacaccatcctgacactgatgactgttcacgtggcccagataattgctgacgccatttatttgtttgcagggacggcgcccactaggcaccctttggacccagagaggtccaacagggccttgggattttcggccttgatcacgggcctttgccagttctacggggtacttgtcatccccagcaaggtaatccagccgccgatcactcgagttttcatcgagaaacattgcacccctaggcaagcgaagggtgacacacaacaggctgcggatgcaccaccacctcagcagcccgatccggttataccactgagtgtggagcagtatctacggcatatggttcgccagcaaacggccaacaaccgcgtgcaggggcagggctcccctccttttgtacgccctaccccagagcaattcaaggctaaggtcgcgtggcctggagattggcccactgaggagggaaccggacccgcaggatccccgggcgaagcggaggaagcccacatggatgaggatatgaccgacctgcttggttacctgggagagggcggagctacacgaccaaggtcgtcgcacttgttattccatgtcgtctaa

SEQ ID NO: 8412 - DNA, 360 bp, Glycine max
  Peptide Sequence Number=SeqID_125190
atgaatgggtcgtgggagagatggatcaagatgatgataatgatgctggaaatgatttggcttcgagggttggagtgtaggatgtatactaggcggaaaaagcaaaaaacaacaagtgttgctgctacccaaacttctaaaaagcaggcaatggttgttggatcttcatcaaggaagcaaaaagcagtccaagaaaatgatgaggatctagattttgaggagaatattgatcttgaatctgaagaagaagaaatcatggtcaattttgaggcatctgatggggaagagggagagggagatgctccattaccatatgataataatgaagatgattatgttgggattggagaagatgattag

SEQ ID NO: 8413 - DNA, 537 bp, Glycine max
  Peptide Sequence Number=SeqID_125191
atggagtcaaacaacatgccagacttgaacggtgtcgctaagaagactaaaggtcgacaaaagatcgaaatgaagaagatgagaaacgagagtaaccttcgggtgacattctcgaagcgtcgcactagggtcttcaagaaagccagtgagcttgcaaccctttgtggcgtggatgttgttgtgattatgttctcacccggtaatcgagtattttcgtttggcagtcccagtgttgattctgttgtccaacgctataagacacagggcccacctcccctccttaccttggacctcaacaaggtgcactccactgtggacgaagttgagctccacacacacctccactacttgtccaaccaaattgctattgagaagaagcgcacaaaggatttaaatcatttagcgaaggttgcagaggatcagttctggtgggctaggcctattgaaagcatgaccgattcccaacttgacaagtataagaagatgttagaggagtttaagagacaactcaaagaaaaacgtgggaacctcaactga

SEQ ID NO: 8414 - DNA, 324 bp, Glycine max
  Peptide Sequence Number=SeqID_125192
atgtctgggcgctcctccactcgccaatttcctagtcaaaaactaggagggcatggtcataccaaatccaacccactcggagaatcatcttcttatatcgcaacgacttggccttcgtgtttgtcataccctaatttcgttcggggaccattgtttgatggcatgcaccctttgcttgaccgcttcgagggggtgcaaatagcaaccaggcccacttgggccttccaggaagttcctccagaaggtggtgccttttggaggaagcaacctatctcgcctgggcgagctgggtggcaagcttctccgtcttttccctataaatag

SEQ ID NO: 8415 - DNA, 345 bp, Glycine max
  Peptide Sequence Number=SeqID_125193
atgaagatgaaagcaaacaaaacaagaaatgaattgaaagtctcagattcgaacacttaccagttgaagaacaaagaacggatgaagaacgcaggaaaatcttcacagatttactcacggaaacgtctcagaagccccccctcccctatttacagggaaaaagggaggtgcttgccgcccagaggcttcttgaggaaaatttctaagcgcaccccaattactaagttcacccccttttcaacaatattaagtgaaatatgcttacccaagattttcggaaattttacggaagccacggaagccccagaatgttacagaagccttacggaagtttttcggatttga

SEQ ID NO: 8416 - DNA, 744 bp, Glycine max
  Peptide Sequence Number=SeqID_125194
atgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggttggtggatcatcatgtcataacatggcaagacacaaggtcacacgcacacacacacacacacactcacgcaggcacaagggggaggaggggcttggtcgtccgtccgcccgggcacacacctagggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 8417 - DNA, 417 bp, Glycine max
  Peptide Sequence Number=SeqID_125195
atggctacaccacccagctctcctccttctcctactgttgcagaatcacagtcgccatctaccttgaagcggacaagaaaagccacacaactaagatcattggcgactagactagttggggcagagagaccgatggtccatgtcgatcctgggaccgggaaggccaacaatccccatagaaagaagttaagaacatatttgggaatcgtcgctcgtgataaggctaaatttgatatccctgaagcatctggtctaaggacaaaaaagaaaatacttcagactgtgggggagcagtggagacaattcaagtacgatttgacgtcaaaatgtgcacttgcagtcgacaaggaaagtgtcaccaacactatatgcgaaaagtacgacattagcaaggagaagtgggcccaattttgttag

SEQ ID NO: 8418 - DNA, 132 bp, Glycine max
  Peptide Sequence Number=SeqID_125196
atgactaccataaccagaattgtgaatttgatttgggttagaatgagtgaggttggctcgtacaaggaaggtggtggtggtggagtaagatcgtcctcaccagatgagccggaggtagccacaggaagatga

SEQ ID NO: 8419 - DNA, 569 bp, Glycine max
  Peptide Sequence Number=SeqID_125197
atggctcaggttaaggcacgagctcgaactgcattggccatggccgcttccgcaagttcacggaagagaagaaaaatctcgatcaacaacaacttcgttcaaatcaagagtttgagcaacgcaaccgtgccggcgacgggggaacgaatctccggggaatctccggcgtcttgctgctccagcaacggatccgtcgacgatgaaaaccgaatcatcaaattctcagatctagaggttgagagcacgcgagttgtaacgtcgacgtgcgactgcggtgaacaacaacaacaaataaggagagagatgagtctcacgagcgagcttcgaatcacgaattcttcttcgcaagaggtggattcagcggaggagcagatcacccaaaccaaatctttgccgccgcagaaaatgccgacggagttggagctcgatgaattcttcgccgctgctgagaaagatattcggaaacgcttctcagacaagggactcgccagtggggttgacgagttggacacgtggcggcgcctggtggactcgccagtggagttggcgagttgctgtccacgtggcgg

SEQ ID NO: 8420 - DNA, 1296 bp, Glycine max
  Peptide Sequence Number=SeqID_125198
atggagagagaaatgtgcacagacgtgttgctcgtgtgctgggggtcgagtgtctatgctcctaatgtagggctgacatggaggattgacacgtgtctcagagtgccatgtagggtgccacgtgtaattattgaaccctggacagtacataagcccccaagctctgagccggcttgcaggagaaagagattgtccagtgccgaaggagagtatctgttgtccgaggtgagagaattgcaagttgatgcggcttgtcaagcccccgagcctggacaagtgttttctgtgctacttttgtcaagttgtctggatggacatgtcttttatgtgtcaggtgcattgaagacagacattacgttctgtctactactacaggcgtgtgcggcgcacgtgcagtactgttgcatacgtgtcactcgtggagtggacacgtactggagtcatggtgcgtgggtgagtgggggtcactgttactttgatctcttgcttccttctgcttgtgatcccctttctttgattcttcaaggtactttgtcttccataatgtcttcattcttgtctgactctgccattagtatgggtagcagtgattctgggagctcgattgagcaacccatgatggactgggaggatactcatcgtggtgcctctgatagcgagtcctcctctttggagagggtgagcgcttcgtgtcatactggagaggtagtggcagttgagatgtcagggcatctccccgcgtgtgatatagccatagtactaggtcgccgtcatccacacttgtcgtcgctggctatgaccgttcaggcttgtgggagtgatgacttccctttcttgagggcagcgtcaggtcttgggtttcattctccccttgaccgctttccaatgtgctcaaagcttgagcacttgaatttgactggcaagattggttgggtctccttgaacatcgtgtccaagaagctatttgagtttgactcaaacatctttcgtcattttaaggactatttctttaaggtcctatctactgatgccatggatgatggtttgccactgatgttcaagtcgattgatgaggatctgttgacccttgtggaaagaattgacaaagctattttggagcaagtgtcggcctcactagatgcacgagccattctgtctcttccctcagcaagtgatcccctcgctgccttggatgcggaatggagaaggaagaaagatgattggagacaccacttcaaggagaagatgagtcaagaacaagctcaccaccataggaagctatggataagagcttga

SEQ ID NO: 8421 - DNA, 210 bp, Glycine max
  Peptide Sequence Number=SeqID_125199
atggctacaacacagataataaagaccacaggaaatcacaaaaaaatagacaaatatagagaaaataggaagcacattcaaacaggagcaaatagcgggaaggataccaacatccaaaacctttttgttcctgaaaacagtggcaaacaggagcaaataacgggaaggataccaacatccaaaacctttttgttcagaatgaaacactaa

SEQ ID NO: 8422 - DNA, 384 bp, Glycine max
  Peptide Sequence Number=SeqID_125200
atgaggcaagggcttgttgcttctacttccttcattcttgctgcttctacttccttcattcttgttgcttctagtttgtccaaaactgaggatacagagacagtggcgacaatgatgggcacaatggaacttgctagaaccagagaggcacttcctcaagccttgacgaactgcacccatgctaagaagaaggctcacataaagtacttgattagtgacttattttacaagaaggccactagatggaaaccttctcattctccaatgcctccctgtattcctactactctcttctctgaattcgaggactctagtgatgagttccttaggaagcttaatgaagaagctgtcaaaaacaaaaaagggagaaaaagtaaaagctaa

SEQ ID NO: 8423 - DNA, 558 bp, Glycine max
  Peptide Sequence Number=SeqID_125201
atgtctaactcaatagcatcctttgttctgctgctcattctcatttcaacaaattgtttgtgttcagcacaacagtgtcgtccaagtgggagaatcatgggaaagaagcctcctcctggagaatgcaacaaagagaatgattcagattgttgtgtgcaaggcaaggcgtacacaacatacaaatgttcgccagcagtttcaaggcacacaaaggctgaactcactctgaatagttttgaaaagggtggagatggaggtggcccttcagaatgtgacaaccagtaccattccgatgacacaccggtagtcgcactctccaccggatggttcaacgacaggagtaggtgcctccacaacatcaccatcagtggaaatggcaaaagcgtggtggctatggtggtcgacgagtgtgactcgaccatgggatgtgatgaagaccatgattatcaaccaccttgttccaacaacattgttgatgcctccaaggctgtctggaaagccttaggtgtgcctcacaatcagtggggtggattagaaattacatggtctgatgcttaa

SEQ ID NO: 8424 - DNA, 228 bp, Glycine max
  Peptide Sequence Number=SeqID_125202
atggagcaacaccaaataaaagaactatcttcttcaagttctaacaacattgatcttgacaagagaatgttcaagatacaattgaaagtctctaatgacatcggtgtagcaacattcacaatgttcgatcaagatgcacaacaaattctaaacagaacagcatctgaactccttcacactcaaaatgcaaataagcctcacataccccaatattgtatacccttttaa

SEQ ID NO: 8425 - DNA, 1738 bp, Glycine max
  Peptide Sequence Number=SeqID_125203
atgaagcttttcgtgttttttcttgcatgggctatggctcttcttgcttcttcctttgcttcagctgctgtagtggaacgcactttcaaagttcaaaacaagactatcaaacgcttgtgcaatgagcgagtgattgtcacggttaatggaacattccctgggccaaagattaatgtccgtgaaggtgacactgtgattgttcatctattgaacgagggaccctataatatcactattcattgggtcaaaatgtataatatccctaccaagctctatgaactcaaatactctcttggacgagatggtcctgaatatgtaactcaatgcacaattagtccgggaactaagtatacttataaattcaatgtgacacaacaagaaggaaccttatggtggcatgctcatgcatctgttttacgtgccactgttcatggtgctttcatcattcaccctcgttcagggcaatttccctttcctaaacctttcaagcaagttcccattatattaggtgattggtatgatgctaatgttgtggatgttgaaacccaagcactggcctccggtggtcctccaaatgtatctaatgctttcacaatcaacggcttgcctggcgatctcttcaattgttctcgaactcagacattcaagatgaaggtgaagcaaggaaagacctacatgctacgaatgatcaatgctgcactcaataaccatcttttcttcaagatagcaaatcacactttcacagttgttgccttggatgctgcatataccgaccactacatcaccgaaatcattgtcattgcccctggccaaaccattgatgcactattcacagcaaaccaacccttaggttcatactatatggctgcatctccttattctattggtgttcccgtcattgacaacacgacgacacgtggcattgtcgtttacgactatgcaccaccaccatcatcatcaaaacctttgatgccaaccctaccacctataaacgacacagcaacggctcacaaattctacagcaacataactggcaaggtgggggccccacactgggttcctgtgccagccaaagtggatgagcacatgttcattactattggattaaacctagacacgtgtgatcctaagaatgccaccaatgccacgtgtcagggtccatctggccagagattttcttctagcatgaacaacgagtcctttgtgattcctaaggggagagggttctctatgttggaagcgttctttaagaatgtgagtggagtctacactgctgatttccctaacaaccctccggttatgtttgacttcacaaaccctaatattagttttaaccctaaccttttgtttgcaccaaaatcaaccaaatcgaagaaactcaagttcaattcaaccgtggagattgtgtttcagaatacagcgattgtcggtgtgcagaaccatccaattcacattcatggttttagtttccatgttttggctcaagggtttggaaatttcaactccaccgtagattcaaccaagtttaatttggtgaatcctcagctacgcaacacaattgctgttcctgttggaggatgggctgtcattagattccaagcaaacaatccaggggtatggtttgtgcattgccatgtggaagatcatgtgccatggggactagacatggcttttgaggttgagaatggaccaacttcttcaacttcactccctccaccacctgttgatctgcctaaat

SEQ ID NO: 8426 - DNA, 267 bp, Glycine max
  Peptide Sequence Number=SeqID_125204
atggaggtggcccttaagagtgtgacaacaagttttactcagacaacactccagtgtcatcacaatatcacaatctttggaaatggaagaagggtccatgccatggtggtcgatgagtgtgattccaaaagagggtgtgatgctgagcatgattttcagcctccatgccccaacaatgttgttgatgcctctaaggctgtttggaaggctttgggtgtgccaaaacgtgactggggtgaatcagacattcactggtccgatgcatga

SEQ ID NO: 8427 - DNA, 565 bp, Glycine max
  Peptide Sequence Number=SeqID_125205
agtcggcgggcccgatgacaagcagagaccaagtttggtcattctgcacccttggtatcatccagaggcggcgggcccgatgatacgcggagataccttacggttattcgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaaaggcggcgggcccgatgacaagcagagaccaagtttggtcattctgcacccttgtatcatccagaggcggcgggcccgatgatacgcggaaatacccgagtgaggctgacatagtcttctgcaccttttgttcctccgggaacaacaagtcatttacatgcggaaatttcatggtcgcccgcgactctcgtcaaccgagaggagcgaaattagtgtcatacactgattttcagggacctttgcttgatgacatgcgaccattctttggtccttgtgag

SEQ ID NO: 8428 - DNA, 204 bp, Glycine max
  Peptide Sequence Number=SeqID_125206
atgatgactgagcccgcacaggaaatcgctgagaagatcgattcctttgaggagcaggatgttctcaccgctgctattggacgtccagagcaccctggacgtattcgtgctgctggagccggtgtcaccatcaagcaatactttggatcggctccacgggcatcccatagctcttcttccctgcctcctgaagaattgcagtag

SEQ ID NO: 8429 - DNA, 163 bp, Glycine max
  Peptide Sequence Number=SeqID_125207
atgatggtgttgtcgccttgctgggggtggatgacaaaggagtcactgcacgagagaacctccttggtggcttccagtggcacaaagggcaccatcagtgatggtggcagtgttgttggaccacgacgacgacaaagcgatcaaaactattgttctggaaacg

SEQ ID NO: 8430 - DNA, 225 bp, Glycine max
  Peptide Sequence Number=SeqID_125208
atgacgactcacactacttctggttttgcatccccatgtttcggtggtggaagtctcgcttgttttagggatttcgtaagggacaacggtggttgccgcgaaaccaagtcccacctctgtcactggcccctaaccgctattgctgccatcagccgcttctccaactccttgtcgcagtccttcctcaacggtttcagctccaccaaccctctcatcagcctctag

SEQ ID NO: 8431 - DNA, 348 bp, Glycine max
  Peptide Sequence Number=SeqID_125209
atgggtgagaggatgaatggagaaggtgggttgtcatcgttgttctcatttcttggtatggtgaaatgcaaatttgaggtacccgttgttatgttcacatcacgtagtgtgaaccatccagagaaaaggttttggagatgcccacattggaacgaatcaagttcttgtagattttttcaatggattggtgatactgaggctgacaataatgtgtctgtagaggagagtgagttggtccgatatgttcgagaaaatgaagagctgaagctgaaagttgcttcattaatggaggaagctaaaacaaatgtacaagaaataacagatttgaggaaaaaaattgttgcataa

SEQ ID NO: 8432 - DNA, 621 bp, Glycine max
  Peptide Sequence Number=SeqID_125210
atggcgaaatggattttcttccccatcatcttctttgttgtatttgttgcaagcaccttcctcctggaaattaacctttccagaataacaagaactacaattttcaagacaattataatattcaataagcaacaacctcaattcccacttaactgcacggatggaaacttagcaaaaacttgttcatcatactatccaacaacattcgatcttgatgatgattcatcaactacatcatgtccaaattacttcaaatggatccatgaagatctaaaaccatggaagagtaaaggaatcacaagagacatggttgaaagaggcaaaaacgtttcccattttaggcttgtaattgtaaatggaaaagcttatgttgaaaagtatgacaaagtgtatcagacaagagatgtgttcacaatatggggaattttacaacttctaaggttatacccgggaaagataccagatttggatctaatgtttcaatgtggagacaagcctgttgtgttaaaaaaagattttcaaggaccacaagccatgtcaccaccccccgtgttccattattgtggagatgaaaatgcacatgacattgtattccctgattggtccttctggggttggtaa

SEQ ID NO: 8433 - DNA, 1152 bp, Glycine max
  Peptide Sequence Number=SeqID_125211
atgtccactttgcagatgtcccgtgttgatttggagcaagggaatgtgaatcatcgccattcggttgttggaagtgatgtgagtggtgaagggagcgtatgcttctctgatgctgatgatggttcttgctattcccgtttctactcaacaaatggtggttcatatgatgattacagctttgcttgtgtttctgatcctgaggttgggggtgttcctcattctgggagagcttcttcttcggcttctgagtgttctgtggaggcggaaactagaagtggggttcctgagatcaaggtgcatttggctaaagtggagaaggattgtaggatttgtcacatgggtttggagagtgatagtcatgagtctggtgcccccattcaattgggatgttcctgtaaggatgatttggctgctgctcacaagcactgtgctgaggcctggttcaagattaagggaaatagtgatgaatgtaaggctgaagaagatggtgggggatgtatttggaagcctattttagaagcaacagttgctgctacaacagcacgagccctacagtgggatggtctcgctgttcgacaccgccacgttcatggttgtggtcaccacagtcacgttgcggagcctcatcacggcggcaaaggagtcggtgctaccaccaacgtcgaggccaaggacacgtggaacaaccaagggaaatgtagaagctttagtgagagggagtgtttaagggattgtaggtgtgtcgggttgagttttgacgaagggagtggggggggatctagtgggaggaagaaggggtttgataggaaggttttgagtggaattgttgtggttttgggggtggtggtgaggaagaagaggggttttgagttggattgttgtggttttgggggtggtggtgaggaagaagaggggacatgtgaaatttgccattctgttgctcggaatgtttacggaggaaatgaggagtcgacggagcatttgagcgacgttaacaatgctactacagcagccacactctccacacctgctccttcagcagaacctcgaagattttggcacggccatcgcttcctgaatttcttgcttgcttgtatggtttttgcgtttgtcatatcatggctattccactttaatgtgccatcatcctag

SEQ ID NO: 8434 - DNA, 699 bp, Glycine max
  Peptide Sequence Number=SeqID_125212
atggctgatattaggagagaacttggcaagtgcaaccccacaaaagaacatgattggaatgcaagaatacataacatacaatggaacaaggaggaagcaaataattttgagagctcaaaactagaaaaccaatgcaactttagatataagatctacgtagaaggagccgcgtggtctgtgagtgaaaaatacataataggatgtgactcaatgaccttgttcatagagcctacatattatgagttttttacaagaagcatggtacctttgcaacactattggcctatcagtcccaaaaatatgtgtgaagacattaagtatgctgtggattggggaaatgctcaccttgataatgcacaagtaattggcaatggaggaactagtttcattgtagagaatttaaagacgaagtttgtgtatgattacatgttttatctattgaatgagtacgcaaaactcttgaaattcaaaccaaccataccaacaggagcggttgagatttgttctgaaagtatggcatgttctgtgcatggtctagagaaacgttttatggttgagtccatggtgacctcaccaagtgatactcctccatgtaccatgcctcctccttatacacctgaaactctaaaagagtttttacaagaaaaggaaaatataatcaaacaagtgaagacaaaagaggtcaatacaaagatgtaa

SEQ ID NO: 8435 - DNA, 174 bp, Glycine max
  Peptide Sequence Number=SeqID_125213
atgaagggccatggggttggggtcgtcgaagccaaaaaagctaaagacgagggtcatgggattgaggttgccattgctagcagcggagatgaatgcctcgacggaaggaacatgatggttgggcacggaggcaactccgttttaaagtcagtgtttgggagtggacatttgtag

SEQ ID NO: 8436 - DNA, 162 bp, Glycine max
  Peptide Sequence Number=SeqID_125214
atgtatcgttgtcatctccatttgactctgcattggaaagtcgacgagggttggagttggctagtatttggaattggaggaactcatgcatcttcagaggctcatcatttgataaaggaaagattctggatcaagctaggctacaagtatggtcgtggatga

SEQ ID NO: 8437 - DNA, 264 bp, Glycine max
  Peptide Sequence Number=SeqID_125215
atggctagtggtagtttgaagaacatgttgagtgtagcaatgaatcaaggagtggtggaagcacgagccaggatcttcggccaccaattgaaccccactggcatgaaaactccacacaagcttctccgcatgaagctcttcggtgaaaaagtcgctcagtggtaccctcacgacatcaagaaagacgaccctcttgtcatggcccgtcaagaacaagagtactctctctctctcacccacattttcattttttatccatcgtaa

SEQ ID NO: 8438 - DNA, 384 bp, Glycine max
  Peptide Sequence Number=SeqID_125216
atggatacttgggatcagataacaaattttaacccatctactattaggaacgggtacaaggatatgttggggaggggaaagagagtcgaagtcagggactttcccctccccttgccatgtctagcgaggagtattcatgttcacttggaagaatttgcaaactgtatctgcattgcctgtggattgcaactgtatatagagacttccagaaagcctactccaaagttgacatctaatagcaataaagaacattgggtcattgctgcgttacacttcgatggaagctccttcggtaaccctaggtttagaggactgtcggcagattgcactgcgaagtgttttgagaggattttcgggtatttttacatgcataacatggaatga

SEQ ID NO: 8439 - DNA, 2254 bp, Glycine max
  Peptide Sequence Number=SeqID_125217
tcgaagcctcgtgaagaagagcatcgcacctgcgcgtgggaaccctgacgacgaaggagaacgaggcgtgcgcgctgctaagactctcacaggtggaggagagcaaggcgccgatcgggcggtccagtgcgattccactgctggtgagcctcctggagagtggggggttccgcgcgaagaaggacgcatcgacaacgctgtacttgctgtgcatggtgaaggagaacaagatcagggcggtgaaggcggggatcatgaaggtactgggggagctgatggcggacttcgagtcgaacatggtggacaagtcggcgtacgtggtgagtgtgctggtggcggtatcggaggcgagggtggtgctggtggaggaaggaggcgtgccggtgctggtggagatcgtcgagaagagtatcaccgtgaagatgtcgccgactccggcgccgacggccacgttgaagtagtttgcgatggtggtgttttggtcgctggatttcttcctcaatgcggcttccaggtaggcgaggacttttccgacgagaatcccgcgcatgtcgtcgctgtcgatggcgagaatgcaaatcttgctgcgttggttcttgactacaaagatgcaatccatggcggcgaacccgagcctgaaccagaacccgaacctgaaccagaatcatcacgcgttccaggctcggccgccgtaccaccaccagcaacaacagccgcagtatgtgcagaggcatttgttgcagccgccgccgccgcagcagcagcagcagtggctgagaagggatgccaatgccgtcgacgaggtcgagaagaccgtgcagtccgaacccatggattcgaggtttctgattgtgtaggcaatgatgaaatggtgaaatcagtgtttgaaaattttaatggtttgtactcttgcattgtggaattcctggggatcaggactgtttcggccatgggtgttgtggttgcagcttgcatcctgcaaccttatgtcatctccagcaagtctctttcccaagattggaaagcaagactaaagattccaccagctgatactcgctataggacagaggatgtaacggcaactaaaggaaatgagtttgaggattactttttgaagcgtgagctgctcatgggaatatatgagaagggttttgaaaggccttctcccatccaagaagaaagcattccgattgctcttactggtagtgacattcttgctagggctaagaacggaactggcaaaacagctgcattttgcattcctgcattggaaaaaattgaccaggacaataatgttattcaaggttcagctggagttgcagtaacaagccgaactttcaagtttgaagggcacatcaattatttcatggttgtggactttttgaataagcatgatgattggctttacccttgctttgaattgaatgttttcaatgtatttttctgtaatgcagttgttatactggtcccaacccgagaattggcattgcagacttctcaagtgtgcaaagagcttggaaagcacttgaaaattcaagttatggttacaacaggtggtaccagcctgaaagatgatataatgcgcttatatcaaccagttcatttactagttggaactccaggaagaatattagatcttgccaagaaaggtgtttgtattctgaaagattgtgctatgcttgttatggatgaggccgataagcttctgtccccagagtttcaaccttctatagagcagctgattcattttcttcctacaactcgtcaaatcttgatgttttcagcaacatttcctgttactgtaaaggatttcaaggataggtatcttcgaaaaccttatgtcatcaaccttatggatgagctaactctgaaagtaaatcgggttgaactccttgccaagaaaatcacagaacttgggtattcatgtttctacattcatgcaaagatgttgcaagaccatcgtaacagagtgtttcatgacttccgcaatggcgcatgtcgaaatcttgtttgtactgatctttttactagaggaatagacattcaagcagtaaatgttgttattaattttgattttcccaagaatgcggagacttatttgcacagggttggtcgttcagggaggtttgggcaccttggtttagctgtgaacttgattacctatgaggatcgctttaatctgattgaacaagaacttggaactgaaataaagcagattcccccacaaattgatcaggcaatttattgccggtga

SEQ ID NO: 8440 - DNA, 324 bp, Glycine max
  Peptide Sequence Number=SeqID_125218
atggggttgaagaaaggtccttggactgctgaagaggatgagattcttgtaaattatatcaacaagaatggtggtcatggaagttggcgttctctccccaatttagcaggtcttcttcgttgtggtaagagttgccggttaagatggacaaactacctcagaccagatattaaacgtggttcctttacacttgaggatgaaaaactaatcatacagcttcatggtatccttggaaataggtacctaataatgttgactaagagtgagacacaaaattttaacatagctttggtaaatgatggaaagatctatttcaattcttag

SEQ ID NO: 8441 - DNA, 624 bp, Glycine max
  Peptide Sequence Number=SeqID_125219
atgatttctctctttttctttaaggctatatattttgacagtgttcaaaaaaatgaaccaattcacaggtgggctgctatagcctctcagctaccaggaagaacagacaatgagataaaaaacttatggaacacccacttgaagaaacgtctcatttgcatgggccttgacccacaaacccaccaaccactagcctctccacataaccctaatgacaaggctcatgcatcatcatccacttcaacccgccacatggcccagtgggagagtgcaaggcttgaagcagaggcaaggctctcaagggaaccacacttatactacaacaacaacaaaactgactctgactacttcctacgaatttggaactctgatcttggagaatcttttcgtgatgtccacaaattagaatcttcaatcaaatgtgagtcacagtctgccacaacggatttggcttccttaaccccagcaagcattgtgaaagaggagtttctgtggggtgttaagaaaattgtctcggattcatcatcaagctctagtgaactacaccatgactcttgtgacacttctttgcagctcttgttagactttcctatgaacaatgacatgagcttcttagaattatga

SEQ ID NO: 8442 - DNA, 198 bp, Glycine max
  Peptide Sequence Number=SeqID_125220
atgaaaggtcagattagggtttttgttctctaccgaaaccgcaagccaagttggaagattccgcttcggttgaaggtggctgtgggtgatggagaaagtgcttggaactttagaaatggctttggaagaggcttcctccagaagcttcctcgtggcttctttgagaagctttctcaagagacttctttgagaagctag

SEQ ID NO: 8443 - DNA, 339 bp, Glycine max
  Peptide Sequence Number=SeqID_125221
atgcacagggaatttaaagagaggcttttagatttaggcgttgaggtcggcccagttttaccacttggcgatcatggaagttcacaagtttcagggggaagccaactatcatcaaaggatgcatttctctcgaaagctgaagtcaaaactgattccgagaacaatggcatttctgaggatgttgtttgtgttacgttgggcactattagcaaaatagtcatggataatcattcatggtgttatccagcttgcattcaatgtcataggaaaattgacatccaaacaggaccattcacatgcggatgtggcaaggataatgatcagcctgttctgaggtaa

SEQ ID NO: 8444 - DNA, 237 bp, Glycine max
  Peptide Sequence Number=SeqID_125222
atgcaagacgaggtaaatggctcgactgggaataacaaaaccaaatggtacccgattttgttaaagaaaaggggtccgactgggggtcacacggttttactggggaggcaaatgatgcacaagctgttcattaaagaaattgccacttggcggagagagggtgacacctttggatcagacccattggggatgacacttggggaaatagaagattacaaattattcatgattgattga

SEQ ID NO: 8445 - DNA, 441 bp, Glycine max
  Peptide Sequence Number=SeqID_125223
atgaaattaccgatctacctggattacgcagcgacaacgcctgcggatccgcgtgtcgccagcaaaatgatgcagttcctcactttggatggcaccttcggtaaccccgcttcccgttcccaccgttttggctggcaggctgaagaggccgttgacgtggcgcgcaaccaggttgccgaactgatcaacgccgatccacgcgaaatcgtgtttacctccggtgccaccgaggccgataacctggcgctcaaaggcgcggcgcagcagcatcagtcgcgcggtaaacacatcatcaccagtcagaccgaacataaagcggtgctcgacagctgtgctcagctggcgcgcgaaggctttgaggtcacctttctgcagcctggcgcggacggcatcgtcacgcctgcgatgctggaagcggcacttcgcgacgacaccgtgctg

SEQ ID NO: 8446 - DNA, 204 bp, Glycine max
  Peptide Sequence Number=SeqID_125224
atgaagtctggtgacatgcagagatacccaagtggttatccgtataaacgatttttgttaaccctaactcgggaagttaggtggcaggcggagggacagcgagtcaggtggcaagcggagataccttatggtcgttcgcacctttcgtcaaccaaggcaaacgagtttgacggtatcaggatgatgttcgtcatccgattctga

SEQ ID NO: 8447 - DNA, 417 bp, Glycine max
  Peptide Sequence Number=SeqID_125225
atgggcccagaatctaccctaaggctcataagaaccctagggcttctcttgcatctatggcccaatcttcttggagtcttctatccaatgcccttgcggggtaggattgcatcaccccaagtccgattgacaagcagagaccaatgtggttatctgcaccctttctggagatgtcagcatcttccggtagagactattttagtctcacaccgctttctcaagaactacgtagacttggagcccggttgcatgcaaagactaacgtcgtcttttgcaccctttgtcaatcagggtcaagcaaacccgttgacacgcggagacttacatcgtcttatgcacctttgtcatcctgacccgggaagtcaggtgacatgcgaagatatccaagcggttatccgtacaaacggtttctgttaa

SEQ ID NO: 8448 - DNA, 252 bp, Glycine max
  Peptide Sequence Number=SeqID_125226
atggttgaggttcagcaaccctgtgaccctgaactaagctgtcatattgatctccaaagctgggttcaaggatcatgcatatgcatctattgttctggatattacaaggctttggcttcatttagacatattctacgaggccagaatactgttgccaaggatgcgttgcggcgtgtgcagcaagtgctagtcttggaggatcctcctcattacattgctgctgatgtagatgccactttgcctctgttttag

SEQ ID NO: 8449 - DNA, 453 bp, Glycine max
  Peptide Sequence Number=SeqID_125227
atggcgtcttcagtttcatcttctgaggaaagtaattggggcaaaagggtatccgaaaaggttctttctttctacacttctcttcccaaaaagggcaaacctcaaggccgtgaagtcactgttttggcctctttccttctctcttctccttccaatgatttgaaggtggttgcaatgggaacggggacaaagtgccttggacgttctctcttgcgaacttgtggtgatgttgttcatgattcccatgctgaagtcattgctcgaagagccttgataaggttcttctatacacagattcaacatcttaccggtagtaagcatgcacctagcaatggagggaaacggttcaaacttgatgatggcaactcgccatttgagttggatccagggtggagatgcttcactgagctggcaagtctctcctttggaaactgcggttttaggagaaagtga

SEQ ID NO: 8450 - DNA, 660 bp, Glycine max
  Peptide Sequence Number=SeqID_125228
atgtttttcttatatggatttggaggtacaggaaaaacatccatatggagaacattggcaacttcattgagagcaaacaatcaaattgttattatagttgcttccagcggcataacttctctattgttgccaggtggcaggactgcacattcaaaattcaaaatacttgtacccatttttgaagactcaacatgcaacattcatcaaggaagtgaattagctgaattgctaaatcaaacaagcctaattatttgggatgaagcaccaatggctcacaaattttgttttgaagtgcttgtccaaagtttaagagatataattaaaactaaacctagttcaaatcaaatatttggagttaaagtcatgatcttaagactgaaaaaaaatatgcatttgcaaaacaatgtacaatcaccagatgaacaagaaactgccacatttgctaagtggatcctagacattggagatggaattattggacatgaaaatgatggctattccacaattgaaatccctgaggacctattgataactaaatatgatgatcaaatccatgctatagttaactcaacattcccagatttatctcagcatcacaatgatcctcaattcttcaacagtagggcaatattagcttcaaccaacgaaacagtcgaatag

SEQ ID NO: 8451 - DNA, 399 bp, Glycine max
  Peptide Sequence Number=SeqID_125229
atgccaggttaccatctggtcggttcatgtaatgggttgcactgtggggttagcgaaataccagaaggataccgtgtttgtttttggaacaaggcgacaagggtgatatccagagaatcgccaacgctgtctttttccccgggcattggtcgtagaacaatgtttgggtttggctatgatccgtcaagtgacaaatacaaggttgtagcaattgcattgactatgctttcacttgacgtatctcaaaagactgagatgaaagtttatcgcgcgggtgacagtagttggagataccttaaaggttttcctgttctttggactttacctaaagttggtggagtgtatctgagtggaacccttaattgggttgttattaaggtcacacgggggatcctctag

SEQ ID NO: 8452 - DNA, 673 bp, Glycine max
  Peptide Sequence Number=SeqID_125230
atgtctcataaaattgcattgattaccggcggtaaccgcggtctgggcaagaatggcgcgctaaaactggccgctaagggcgtcgatattctgtttacctggcgcggtcatgctgaagaagcgcaggcggtcgtgaaggagattgaggcgctgggcgcgcgtgcggtggcgctgcagctggatgtgggcgacagtaaacagtttgatgactttgcggcgcgggtcaaagcaacgctgaacgagacctggcagcgcgatagctttgattatttagtgaacaacgctggccacggtcattacaagctgctggccgaaaccagtgaagaggagtttgatgcgctggtgaatgtgcattttaaagggccgtatttcctgacgcagaaactgctgccgctgatcgccgatggtggacgcatcctgaacatttccagtggcctgacgcgcatgacgctgccgggttcaggtacttacgccgccatgaaaggggcgatggaagtgctgacgcgctatcaggcgaaggagctgggcgagcgccgcattcgcgtcaacattctggcgccaggggcgattgaaaccgactttggcggcggtcgcgtgcgcgacacgaaagatctgaacgcgcatattgcttcagtgaccgcgctgggccgcgttggtctgccggatgatatcg

SEQ ID NO: 8453 - DNA, 174 bp, Glycine max
  Peptide Sequence Number=SeqID_125231
atgaacgaaaccaccaacctgacaaaaagcgcgaaccctcataatcacgataatgcaggagagggaaaagcaaaccgcaaacagttaaaaaaccctacaagtatccttgccttgccacataatattgctgacttggactcaaacctgccacattgggatgcttacgtggactga

SEQ ID NO: 8454 - DNA, 129 bp, Glycine max
  Peptide Sequence Number=SeqID_125232
atgaaacgtttggttagcatggagagtaatggcaagggtgtctcaattgatggcgtccctctaccatttgaggctggtgaaattgatgttggtgaaccaggaactaatgggcagcatagcttttattag

SEQ ID NO: 8455 - DNA, 585 bp, Glycine max
  Peptide Sequence Number=SeqID_125233
atgtcactcctccaactccaactcagctctcatgcattgcgctctatcacttcctcttcccataacttcagacccacctattcctctaagcgtgtcagctatgtaagaaccagaattagagctgttggcacagtccccgagaaggactctgactcagacaccaccgaccccgatgagccaccttatgtcggactcgtgtttgttagttctgtattgctaccagatggaacaccagatatgcactttcgttctgcttgtggaggccagaggcttaggaagataatgctcgattccaatgttgaactctatggaccctatgccagacctttgttaaattgtggagggggtggaacttgtggcacatgtatggtggaggttcttgaaggcaaggagcttctaaaccctcgcactgataaagagaaagaaatactaaagaagaaaccaaagaattggagattagcatgtcaaacaattgttggtaaaccagattccagaggggcggttgtgattcaacaactaccagagtggaaagggcacgaatggaaatatgcaaagcctggagagtcgaactgggagtcggattaa

SEQ ID NO: 8456 - DNA, 876 bp, Glycine max
  Peptide Sequence Number=SeqID_125234
atggggaagaagccgccgcacctgtctgacgttgaggcggcccgcaaccccccgtcaccgccgcctactttccatgtgccactgccttccatgtggttcccgtggttggtaccactcatttttttggccaccattgcaatgttcgtgtataccatgtatgaaaatgattgccctgcctacttagatgaagaggtttgccttttctctcaatatctcggcaggttctccttccaacctttcagggaaaaccctctccttggccctgccatccgcacgctgcggctgttaggagcccttgaaaaggaactagtggtggaccaaaatgaagtatggcgctttttttcctgtatgtttcttcacgctggagtcgtgcatttactagccaatatgttcagtcttctgtttataggcgttcggcttgagaaggaattcggatttttgaaaattggattgttatatgtgctttctggttttggcggaagtgtgttgtctgttttgcatttgaaagaatctgaagctaataccgtatcagttggcgcatccggtgcgctatttggtcttctgggagccatgctttctgagcttctgactaactggagtatctatgcaaataagtgtgcagctcttacaagcctattgatcattgttggcctaaatttggctgttggatttctacctcatgtggacaattcagctcacgtaggagggttcttggcaggatatttcctcggttttgttcttttaatgcgtcctcaatatggatacgtaaatcgcaaatatatacctccaggatatgatgtgaagcgtaaatccaagtacaaatggtatcaatatttcttcctgatcatgtcagtgatcatcttactgctcgggtaa

SEQ ID NO: 8457 - DNA, 306 bp, Glycine max
  Peptide Sequence Number=SeqID_125235
atgggttggatcggcgagagtgtggattccattaaatctcttcagatccgtcaggtcctcacccaggcggttagcctcgattatgcaaaccacgtaggtagttttatatcatttctctatcctactacatcaatctgcctctgcctcaggcatggtgatagagaagtagaacatgccacacaagcaggagcagatattcacgaagaggtgcaaacagcaacagagcaacaggatacaggggtgctagcagaaaacaagcccaagagaagaatagctaaaccaacatacctcagagattacatttga

SEQ ID NO: 8458 - DNA, 246 bp, Glycine max
  Peptide Sequence Number=SeqID_125236
atggttgctaggacaattagatatgaatctcttcagagtgaagcgggtaaattgttactcaggagatcaggaaaagctcctgatgatatctcaagtgttgtacttgttgaaaaggaaagatccttcataaagtcagaagccgtgctgaagataatggaatatatagacttaccctttccacagcttgcaattcttcttcaatttgtgcctctactcatagaagcagaggacatcaccaagtcataa

SEQ ID NO: 8459 - DNA, 624 bp, Glycine max
  Peptide Sequence Number=SeqID_125237
atgactgacccttcctccacctccgacaaattagaagctgctcttattcttctcacgaatcaacagctttccctcaccaaccagcaacgttccctcggtgactccatgtcccaaatcacccatcgtcttgacgagcttattcaccgtgttacccctttcttctcgtcccctccaccacataattccaacccagttcatcacccaccacctgtccctgcattgcaacacagaatgaagttagatgttcctcgatttgacggaacagacccattaggttggatctttaagatcaaccaatacttcgagtatcacggcacatcggagcatgatagactcacgattgcctccttttacatggagggccgcgccttggcctggtttcagtggatgaccagtaacggtcaattcactttgtggccggtctttctgcaggcgcttcagacacggttcgcaccgtcgcagtacgaggaccccatggggtctctgttcaaactcatgcagaagagttctgtttcgacttacctcgcggaatttgaagaccttgctaaccgcatcgtgggcttgccggcaccgttcctccttagctgctttgtctccgggctcaccccggagattcgccgtgag

SEQ ID NO: 8460 - DNA, 617 bp, Glycine max
  Peptide Sequence Number=SeqID_125238
ctatcagtggaaaagggaccattgatggtcgaggctctgcctggtggcaacagccttgcgtaggaaatccacaacccggagcaacgtgccgtccaccaacagcagtaactttcaatagatgcaatcgtcttcaactgaaaggatatacaagcattaatcccgcaagaagccacgtgactctaacaagctgcaacaaaggcataatctctaacatccgtctaattgctcctggaacaagccctaacaccgatggcattgatatttcaggctcaacaggcattcaagtacttaattcttttattgcaacaggtgatgattgcatagctattagtgctggatcctccaagatcaaaataactggtataacatgtggtccaggccatggtatcagcattggatcattgggaacacgtggagataccgacattgtagaggacgtgcatgtggagaattgtactttgaccgaaacattaactggagtaagaatcaagacatggcaggggggagctggatatgctaggaggatcacgtttgaaaatattaggtttgttcgagcaaatagccccattatcattgaccaattttattgtcctcatagatcggactgccaaaaccag

SEQ ID NO: 8461 - DNA, 192 bp, Glycine max
  Peptide Sequence Number=SeqID_125239
atggcgtgtgaggtaatgattataatttactggggaatcattggtttgtccatttccaactgctccatactgcaacacattgaaagtaattattgtgctgctcaatccgggtattctgaccattatatcaaactttgcagtgctcttgagcaacatcaaaagattgacaccctcaacgtttatgttatatag

SEQ ID NO: 8462 - DNA, 531 bp, Glycine max
  Peptide Sequence Number=SeqID_125240
atggtgcaatcaaagaagttcagaggtgtcaggcaacgccattggggctcgtgggtttctgagattcgtcacccattattgaaaagaagggtgtggcttgggacatttggaacagctgaagaagcagcaagagcatatgatgacgcagccattttgatgagtggcagaaacgccaaaacaaacttcccagttgcggataatcaaaagggcaatcacatttctagttcttccccaacattttcttcagctctcaatgcaaagctaaagaagtgctgcaagtccctttcaccttccctcacttgcctaaggcttgacaccgagaattcccacttcggagtgtggcaaaagcgagcagggcctcgttctgaatcaaactggattatgacagttgagttggaacggagtaatgttaatgttgtatctgattcacaagtagtgtcagtgccagagaaggttgaaagcaagaatgggttggatgaggagcagaagattgcactgcagatgatagaagagcttctgaataggaactga

SEQ ID NO: 8463 - DNA, 474 bp, Glycine max
  Peptide Sequence Number=SeqID_125241
atgggttttcatggagttcctgcagaggagcgtctacactggcgttctttcttggttaaactaggagctgacaatcttaagggtgtaaaaaatgaagaactcctagttgcttgccataagtcagtttacattgtatacacagtacttggggatgtcagcatatatgttgtggggaaggaagagtatgatgaacttgctttgtcagaagtgatctttgtgataacctcagctgtgaaggatgtatgtgggaagcccccaagtgaacgtcttttcctggataaatatggaagaatttgtttgtgcttggatgaaattgtatggaagggatatttggaaaatacagaaaaagatagaatcaaaagattggtcaggacttgggtcttgggaggtgtagtaactcttttgacgctgtatggcatgactgcaaaaatgtggattgcgaggaatgcgtgggcttgtaaatttgtactctaa

SEQ ID NO: 8464 - DNA, 183 bp, Glycine max
  Peptide Sequence Number=SeqID_125242
atgaatcaagctcaaactttacgtattcaactcacgccaagctcaaacctggtaaaacttggcttgactgagctcatttccacccctgctgacaacttccaagttccacgtgtgtctaccatgcatcctccaccatcaggttatggaatgatctttgtggcagcgtgtgtggaagctcagtaa

SEQ ID NO: 8465 - DNA, 108 bp, Glycine max
  Peptide Sequence Number=SeqID_125243
atggtgtccaaaggagttgcagaggtggctttgtggtggcacggtggtgactggaccgtggtagagggggtcgttgggaaacagaaggggccaacaaggagccactaa

SEQ ID NO: 8466 - DNA, 1260 bp, Glycine max
  Peptide Sequence Number=SeqID_125244
atggtggcaagtgagctacaaggatttttcatgtccctgggttcaaagaagacatccttccaccgtgacaggaatctgccttcctctttcactggtagcagagtgaacttgcttcattcaaagagtgtagcatctggttttcgtctaggaaaatattttagtgttacacagagaaatacaaccagaagatttttggctacttctactcttgcagatgttgcaaatgattttatggcccttcaatcaccaatacttacaggaagagaagccaacccaaagactgttgcatcgatcatattaggtggtggagctggaactcgtctattccccctcactcaaagaagggctaaacctgctgttccatttggaggatgctataggctggtggacataccaatgagtaattgtattaacagtggaattaacaaaatctacgtccttacacaatttaattctcagtccctaaatcgccacattgctcgaacatataattggggaggttgcattaactttggaggtggttttgttgaggtattagcagcaactcagacacctggggaatcaggaaagaagtggtttcagggtacagcggatgctgatgctgatcataaaaatatagaaaacattctgatattgtgtggtgatcagctatatcgaatggattacatggaaattgtacagcatgtagatacaagtatttttggactatcagctcaagaagcaaggaaatttccatacattgcatcaatgggtatatatgtgttcaaaatagatgttctgctaaaagttctcaggggttgttatcctaacgcaaatgattttggatctgaggtcattcccatggctgcaaaagattttaatgtccaggcatgtcttttcaatggttattgggaagatattgggactataaaatctttctttgatgcaaacttggctcttatggaccagcggcccaagtttcagttgtatgaccagtccaagcctatttttacatgtcctcggttcctaccaccaactaaaatggagaagtgtgaggtaattaactctttaatttcagatggttgctttttaaaagagtgcacagttgaacattccattgtgggaatccgatcaagacttgattctggagtgcagctaaaggataccatgataatgggtgctgactattaccaaactgaggctgtaatagcttctcttttagcagcgggaaatgttccaataggcattgggaaaaataccaaaattctgtcagaattctga

SEQ ID NO: 8467 - DNA, 1728 bp, Glycine max
  Peptide Sequence Number=SeqID_125245
atgatccacgtgaagctgcaatacttccatgtttcaaaagacttgagctggggccaaggcattggaagtcctaaattccctggagtgccttacacttctcacacagagacaaggattctaggaggccaaagcgtaggagatgcaacacttggtgagcttctcaagaaaaaagcacgtgatggtgtcagggttttgatgcttgtttgggatgatagaacttcggttcctttgttaaaagaagatggcttgatggcaactcatgatgaagacaccgagaactacttctacgacagtgaagtgcactgtgttttatgccctcgaaatcctgacgatggaggaagcgttgttcaggacgtagaaattttctccatgtttagtcatcatcagaaaattgtggtagtggacagtgctttgccgaatggaagatcagataaaagaagaattgtgagttttgttgggggtattgatttttgtgatggaagatatgacactcaatttcactcactttttagaaccttgggcactgtacatcatgatgattttcatcagcctaacttttcacatacttcaataaagaaaggtggtccaagggaaccatggcatgacattcactctcggcttgaagggcctattgcatgggatgttttgttcaactttgagcaaagatggaagaagcaaggtggaaaggacttacttattccacctaaagatcttgaaaatgtcattattcccccatcagtagtaacttaccctgaagaccatgaggcatggaacgttcagttatttagatccattgatggtggagctgcttttgggttcccagagactcctgaggaagcagctagatctggactcattagtgggaaggataatataatagaccgtggcattcaagatgcttatattaaagccattcgacgtgccaaaaatttcatctatattgagaatcagtactttcttggaagttgttatgcttggagtgctgatgggattaagcctgaagacattggtgctttgcatctgataccgagggagctttcacttaagattgttagcaagattgaagcttgggaaaggttcagtgtttatattgtggttccaatgtggccagagggttacccagaaaaaggaacggttcaagcaatattggattggcagaggagaacaatggatatgatgtacaaggatgttgttggagcactaaaaggcaagggtaatgaggaagatcctctcaactatttgacattcttctgcctcgttaatagggagctgaagaaagaaggagagtatgtgcccccagaaagaccagatcctcatacagattatatgagagcacaagtgtcccgacgcttcatgatttatgttcatgccaagatgatgatagttgatgatgaatacataatcattggatctgccaacataaaccagagatcaatggatggtgcgagagactctgaggtggcgatggctgcttatcaaccctatcatttggctaccaagcagccagcaaggggacaaatccacggtttccgcatgtcattgtggtatgagcaccttggcttgcttcatgactccttcctccatcctgagagtgaagaatgtattgagaaggttaaccagattgcagacaagtattgggatctctatactactgagccacacttgagcaagaccttcctggccatctgcttcgctaccctgttgcgatttccagccaaggaaatgtga

SEQ ID NO: 8468 - DNA, 3690 bp, Glycine max
  Peptide Sequence Number=SeqID_125246
atgtcgcagataccgaaggaaccggagcaggtgatgaagatgagaggagggtgtgtgttgggaaagaaaacgattctgaagagcgaccatttccctggttgccagaacaagcgtttgtcgcctcagatcgatggcgctcccaattatcgccaggcgtccgactcgttgcatgttcacggtgttgccattccaaccattcatggaattcggaatgttctcaaccacattggtgctcgattgaaagttctttggattagccttcgtgaggaaccgcttgcctacattaatggccgtccttttgttttgcgtgatgtggagaggccgttctccaaccttgagtatacgggaattaacagggaaagggttgagcagatggaagctcgtttgaaagaagacatcctggtggaagctgcaagatatggaaataagattcttgtgactgatgaactgccagatgggcagatggtggaccaatgggagccggtgtcatgcgattctgtgaagacaccgctagaggtgtatgaggagttgcaagtggagggatatcttgttgattatgaacgcgttcctataactgatgaaaaatcaccaaaggaattggattttgatattctgtttccttctctattgccttgtcattcagctgctgctgctggcaacataaggctgatggctgcatccttcttttctgtatttgtttgcagctaccttggttatgatgttagttatgagtttagtggagtaggaactgggtttccaagaagcaattcaattggtagaatttttcaaagtatgaccaatgttgctgatcatttgcctaactcagaagaggcaattcgccgaggagagtatgcagtcataagaagcttgattcgggtgttagagggtggtgttgaggggaaaaggcaagtggacaaagtcattgacaaatgtgcttcaatgcagaatctgcgtgaagcaattgccacctatcgcaatagcattttgcgacagcctgatgagatgaaaagggaggcatcactatctttttttgtggagtacctggagagatactactttttaatatgttttgctgtgtacattcattcagaaagggctgcactccgttctaatactgctgatcactgtagttttgctgactggatgagagcaaggccggaactctacagcattattcgcaggagagatccaatgggtgcacttggatattcaagtttaaaaccatctttaaagaagatagctgaatctactgatggccgcccttctgagatgggtgtggttgctgccttgagaaagggcgaggttcttggtagtcaaactgttctcaaaagtgatcactgtcccggatgtcaaaacccaagtttacctgagagagtggatggtgctcctaatttccgagaagttcctggatttccagtttatggagtggcaaatccaaccattgatggtattcgatctgtcattcaaaggattggtagctccaaaggtggacgtccaatactttggcataatatgagagaagagcctgttatttacatcaatgggaagccatttgttcttcgtgaagttgaaaggccatacaaaaacatgctggagtacacaggcattgaccgtgaaagagtggagaaaatggaagctcgattaaaagaagatatcctacgggaagctaaacagtatggcggtgccataatggttattcatgaaacagatgataagcatatatttgatgcttgggaggatgttacctctgatgtgattcaaaccccacttgaagttttcaaaagtctggaagccgaggggttgcccattaagtatgcacgtgtgcccatcactgatggaaaagctcctaaaagctctgattttgacactttggcaaataatattgcttctgctgcaaaggacactgcttttgttttcaattgtcagatgggtaggggcaggacaagcactggtactgtcatagcttgccttgtgaaacttcgcatcgattatggtaggcccattaaaatactgggtgatgatgtgacccatgaagaatcagaccgtggttcttcaagtggagatgaagctgggggttatgtcactacattatcctccaatactttgcaaagaaagacagacgataaacaaaattgtgcttttggtataaatgacatccttctgttatggaagataacaacattatttgataatggtgttgaatgccgagaggccttagatgttattattgatagatgttctgcacttcaaaacattcgtcaagcagtcttacagtatagaaaagtattcaatcaacagcatgttgagcctagggtaaggagggtggcattaaatcgtggtgctgagtacttggagcggtactttcgtctaattgcttttgcagcatatcttggaagtgaagcatttgatggattttgtgggcaaggagaatccaaaatgacgtttaaggtttggttgcatcagagaccagaggtgcaagctatgaaatggagcatcagattaagaccagggcgatttttcactgtccctgaagacttgagagaaccacaagagtctcagcatggagatgcagtgatggaggccattgttaaggccagaaacggttctgttttggggaaaggctccatactgaaaatgtatttctttcctggtcagagaacttccagtcacatacaaatacatggtgcacctcatgtttacaaggttgatgaataccccgtgtattgcatggcaactccaaccatctctggtgccaaggaaatgctagactatttgggtgctaagcctaaaccttccctcactgctcaaaaagttatattgaccgatctgagagaagaagcagttgtttatatcaattatactccctttgtcctgagggagttaaataaaccagttaatacactcaagtatgtaggaatcactggtcctgtggtggaacacatggaagcacggctaaaagaagatatactagctgagattaggcagtctggtgggcgaatgctattacaccgtgaagagtataacccctcaacaaatcagtcaggtgtggttggatactgggaaaacattcaagcagatgatgtgaagacacctgcagaagtttattccgctcttaaagatgatggatatgatattgtctaccagagaatacctttaacaagagagagaaatgctttggcctctgacattgatgcaatacagtattgtcaagatgatctgtatccttattgtctagaaactgtaatccctccatgttttggtggagttgcgtatgcaatggctataatttgtatcagacttgatgctggatccaaagtctcacagccattattcggtcctcatataggtgcagtgactgaagaggacttgccttctcaaacttctaatgaaatggcacttagtatgggtgactatggtgacattttgaaccttacaagggtcctcatacatggtccccagagcaaagcagatgttgacattgtcattgaaagatgttcaggtgcagggcatatacgagaagatattctttattataatggagaatttgagaagttcacagatgatgatgatgaggaacgtgcgtatcttatggacatgggtatcaaggctttgaggaaaatgcttgttgcacatcatgcatcattctcatcagctcaagagtatgaggttgcacagtcagagtacaggtga

SEQ ID NO: 8469 - DNA, 282 bp, Glycine max
  Peptide Sequence Number=SeqID_125247
atgcaagcaaatcttacttttttaaccattacttttgtctttcttataggaagtgttaacataaggtttgagggcgcgattcaggaaaacaaaaggtttgagaggtatcttaggatagaaaaacctaggaagacatacatttccgtgaataacaaaggtgaaaggataactgcaagttccatcatgccatgcagcaagcttgcttgccaaaagcattcgaaatccttacaactgcgggttattaagaaactcgtaccagacaaaagtcaccagccaaaatga

SEQ ID NO: 8470 - DNA, 195 bp, Glycine max
  Peptide Sequence Number=SeqID_125248
atggaagttttcttctcaggctttggcggggaaggtggagaagcggttgtgactgagaggaatggggcagccatgagcttggaattgtttagagagacgaaaggaatgaaaagaagcaagggtttgaagttgaagggaatgacatgttggaaagaaatggtactagttgaagaagtcacagttggaagctggtag

SEQ ID NO: 8471 - DNA, 927 bp, Glycine max
  Peptide Sequence Number=SeqID_125249
atgatgttatcttccttttttctttggcttctgctattctcttcattattttctcatggggataaagcatttacaggaacatatggagtaaactatggtaggatagctgacaacttacctcccccagaaagcgtggttaccctactcaaagcagcaaaaattaagaacattaggatatatgatgctgatcatcaagtcctccgtgccttcaaagggtctggcattgaaattgtggttggtcttggcaatgaatttctcaaggacatgagtgtgggggaggatagagccatgagttgggtcaaagaaaacgttcagcaatttcttccagagaccaaaatttgcggaattgcggtgggaaatgaaatcttgggaggcacggatatggaactctgggaagttttgctccctgcagcaaaaaatgtttacaatgcccttagtaagcttggtctagcaaaagatgttcaggtgtcaagtccacattctgaggctgtgtttgctaattcctttcctccatcctcatgcactttcaaggaagatgtccttccttatatgaaacctctcttacaattcttctcacaaattggcactcctttcttcattaatgcatatcccttccttgcctataagaatgatccacaacatattgatcttaactatgccctcttcctaaaaaatcccgggatttatgatgcaaagactaagctgcattatagtaacatgtttgaggctcaggttgatgcagcttatgctgccttggagaaggttgggtttgacaagatggatgttattgtttctgagactggttgggcttctcatggggatgataatgaagctggagcaacaataaaaaatgcaaggacatataatggtaatttgcgcaagcggttgctcaagaagaaagggaccccttataggccaaaaaaagtg

SEQ ID NO: 8472 - DNA, 2010 bp, Glycine max
  Peptide Sequence Number=SeqID_125250
atggagttgcttgactcagggaatttggtgttgcttggggaaaatgggacagctatttggcaaagttttagccatcccactgatactcttttgcccagacaagactttgtggatggaatgacgctcaaaagcttccacaacagcttgaacatgtgtcattttcttagttacaaggcaggagaacaagctcagggaagctcaagaaataacactggtaaggttcactcagcgtctttggtgtccaattcattgagtttttatgacataaatagagctttgctgtggaaagttgtcttctctgagcactcagatcccaagtcattgtgggctgctaccttggatccaactggtgcaatcactttttatgatcttaacaaagggagggctccaaaccctgaggcagttaaggtaccacaagacccttgtggcattcctcagccttgtgatccttattatgtttgcttctttgaaaactggtgcatctgtcccaaacttctcagaactcgctttaattgcaaacctcccaacatctccacctgttctaggagttcaacagaacttttatatgttggtgaagagcttgattattttgctctcaagtacactgctccggtttcaaaatcaaacctgaatgcttgcaaagagacttgtttaggaaactgttcatgccttgtgcttttctttgaaaacagtaccggaagatgctttcattttgatcagactgggagtttccaacgctataagaggggtgccggtgccggtggttatgtttcgttcatgaaggtctccattagtagtgctagtgatgatggacatggcaacaaaaatagaaggaatgacgcggtgctagttgttgtcatagtagttctcacagttctggttatagttggtcttataatgggattctggtacttttacaagaggaagaagaatgttgctaagtatcctcaagacgacttggatgaagatgatgatttcttggacagtctctctgggatgcccgcacgttttacttttgctgctctttgtagagcaactaaggacttttccacaaaaattggggaaggaggttttggctcagtgtatctaggtgtgcttgaagatggcatccagttggctgtgaaaaaattggaaggtgttggacaaggtgcaaaagagtttaaagcagaagtgtccataattggaagtattcatcatgttcatcttgtcaagctcaaagggttctgtgccgagggtcctcatcgccttcttgtctatgaatacatggcaaggggttctttggacaaatggatcttcaagaacagtgacaacaccttcttgttgaactgggacacgaggtacaacattgcaataggcacggctaagggattggcctatctccatgaggagtgtgaagtgaggattatccactgtgatattaagccgcaaaatgttcttcttgatgataacttcactgctaaggtttcagattttggattggctaagctaatgagccgtgagcagagccatgtgttcacaactctaaggggtacaaggggttatctagcaccagaatggataactaactatgcaatttcggagaagagtgatgtgttcagctatggcatgctattgcttgagatagttggagggaggaagaactatgatcaatgggaaggggcagaaaaagcgcattttccttcttatgtgttcagaatgatggatgaagggaaactgaaagaggttcttgatccaaagatagatattgatgagaaggatgaaagggttgaggctgctcttaaagttgctctttggtgcatacaagatgacgtgagtttgaggccttccatgactaaggtagctcagatgcttgatggtttgtgccctgtacctgatcccccctcattatctcaatctggtacttattcagctttcatgaaattgagtagtggagaagctacttcatcgggacaggctagtttttttagtaatgtacccatgtcatgtgttcaattatcaggaccaagatga

SEQ ID NO: 8473 - DNA, 528 bp, Glycine max
  Peptide Sequence Number=SeqID_125251
atggaaaagatcaaattggtggtacgggaatgcgatggcaacaaatgccccgggccagacggaatcctcaactacgtcagtgttatgaaagagttaaagaatatcagagacttgagactggacgatcccttggcgtcgttcctctttctcatgggtgacagggatttatttatctccttacaattcgctgatggggaggccttaatccagaatgtcctttctctcaaagtagtcctcgtcaaatgctttgagataatatttgggttgaaggtcaattttcataaagctaagttgactgttataactgtttcaaatgagactttacaaagactagcggtgaaagaaaatgaatacaaagagaagaaaatatatgattggtgtacttctaaaaagaagaatattgatgcggcatgggaagtcgtaggggaatcagcacacgacaacgtacactaccatatccgaccattcagtcaacgacgcaaggcatggtccaagctctctgcgtcggcgagcacctccaccgcgtga

SEQ ID NO: 8474 - DNA, 1099 bp, Glycine max
  Peptide Sequence Number=SeqID_125252
taaaatcaaagctatgcaggaggcgaagctcggtggcgaaatcaacatgcaacgcagtggaagtatgcaactaaaggagaagaaggtgagggatttgatggtggacaagaagaggctagtggaggtgccgtacatggcgtcgctggcccacacaatgactacactggtagcgaacaaggttgtggcggtgccggtggctgcgccgccggggaaatggatcggagccggaggttccatgatcgtggagtctgataagcaaaccggagacgtacggaagcactacatagggatggtgactatgcttgacattgtggcccacatcgctggtgatgaccatttgggtggtggcgatgatatcaccaaagaccttgatcaaaagatgtctgaccctgtctcctccgtcattggccactcctttgaaggtcttaccttgtggactctcaatcctaataccagtctgctagattgtatggaagtgttgagcaaaggggtgcatcgtgctatggtaccggtagatgggcaggcggagaacatgtcagctggggtggaacttgtagagtctgcttccagctaccaaatgctgactcagatggatgtgcttaggttcttgcatgatcgtgctggtgaagctgatcgtgaactgcagagcattctctctcgttctgttcaagatttgggggccgacactgaacagatttatgccatcactgaccgcacaaaactcgtggatgccattaagtgcttaaaggccgctatgttaaatgctgttcctattgttagagcctctgatggcagatgcaggaagcttattggtacattttctgcaactgatttgaggggatgccacgtagccacgctgaaatcatggttgggaataagtgcactagcattcactgaagaagttgcatcgagtcctttgtacacagaatcggacacccagatcaatagaagggagcttgtcacttgctttgccgaatcacccttgtctgaggtgattgaaaaggcagtgactaggcatgttcatcgagtttgggtggtggatcatgaagctcagtttcatgcccagttggagctttgcttaatctgtcatgagaactga

SEQ ID NO: 8475 - DNA, 243 bp, Glycine max
  Peptide Sequence Number=SeqID_125253
atggggatccatttgaatcagttcatgggtagcagctcaagcattggtgccaagagagtcacaaacgtctgtgctgcctttcgtgctgctactgaccagagcaaccgtgctggatgcttgcgagcgttggagatgctggagcatgaatattgctatctcaagaacaaattgcatgaactgttccaaatagagcagcaacgtgctttggtagcaggagtgagataccctgtgcagaatcaataa

SEQ ID NO: 8476 - DNA, 1902 bp, Glycine max
  Peptide Sequence Number=SeqID_125254
atggcgcaagtatcaaagtttgggcaccttcttcttcattcttctctccccaaaccctccaactccaacattcaattccgttctcttctaacacttcttgcctcgtcctccaaacgacaccgtagcatccctcctttccgcagaaaaagcacgacgccaaagccaatggaagtgaaggaggagtcgtcgagcttcaacaagagaagggcccagggcagagacaaaaacgacatctcccagaagaacctctatctcaaagttcgcaagctcaacccaatcaataccatctcttttgttcagatattgggaactggcatggatactcaagatacttctccgtcagtcttgcttttcttcgacaatcaaagatttatattcaatgctggggagggattgcaaaggttttgcacggagcataagattaagttatcaaagatagatcacatatttctttctcgtgtctgttctgagactgccggtggccttccaggcttactgcttactttggctggcatgggagaagatgggatgtctgttaatatatgggggccatctgatctcaagtatttagtagatgccatgagatcttttattcccaatgctgccatggttcacacaaagagctttgggcccatcttcaacactgatggacccattgtgccacatcaaagcaagcttttggaccccattgttcttattgatggtgaggtggtcaaaatatcagccattatcctacaaccaaattgcattgaaggtcaggtgctgacaccttcagaaagctcttcacaggagaggatggatcatagtccagaaacccttgactctcccaatggcaaaaagctacctgctgcaaaacctggtgatatgtctgttgtatatgtttgtgaactgcctgaaatcaaggggaaatttgatccagagaaagctaaggcccttggtctcagacctgggcctaagtatcgtgaactgcaacttggaaactcagtgaaatccgatcaccagaatatcatggttcatccaagtgatgtcttgggtccttctgttcctggtcccattgtactccttgttgattgcccaacagaatcccatttggaagcattattgtctatgcaatcacttgccagttattgtgatcaaacagacaacctaccagaggctggtaagagtgtcacttgtgtaattcacctaactcctgcatctgttgtgagttgttcaaattaccaaaaatggatgaagaaatttggttctgcacaacacatcatggctggacatgaaaagaagaatgtagagattcctattttgaaagctagtgcaagaattgcaacacgacttaattacttgtgtcctcagttctttccagctccaggattatggtctcttcctaatcacgatagctcaaaatttggctgtcttgcttcacgtgaggattcactttcagaattttctgaagtcatttctgctgaaaatcttcttaagtttacattgcgtccttatgctcaacttgggttggatagatcttgtattcctactagggcggattcctcagaaatcattgacgagttactgtcagagattccagaggttttggaagcagtaaagcatgtaagtcagctctggcaagaatgtagtcagacaaaagaggatttaactccagtggcggatcatgggatgatgaatgaggaaccatggctatgtgctaatggtattcctgcttgtttggaaaatataaggagagatgatttggagatagttcttcttggaactggttcatcccagccatcaaaataccgaaatgtgagttcaatatatataaatcttttttcaagaggaggtttgctcttggattgtggtgaaggaaccttgggacaacttaaaagaaggcaagtctatccatatccctaa

SEQ ID NO: 8477 - DNA, 279 bp, Glycine max
  Peptide Sequence Number=SeqID_125255
atgcaagcgttaaatatgcactttaagaccgtacagtatgtatgcaaaaccaatgttcggtatgggttaacgtctactttaacttggtttatagatacctcgaaatccttgtttgaaaggcatactttgttcacagtctacggacgaagagtccaaaaagataaggttttcttgtatggaggcctggtggggaatatcggcatagtgaaggaagttcaaacttcatctcaaagtcagaatagaagagaaggaatcagaaaatgtattggaagaggatag

SEQ ID NO: 8478 - DNA, 150 bp, Glycine max
  Peptide Sequence Number=SeqID_125256
atggcaatggctgataactctggtttctctgtttctttctacttccttttgtcttcctcattgcattttatactttgcggtcaagtagctggaagcaatacaggccacggtcaagtgaaggagaatgcgctagttgtcgagaccgagtaa

SEQ ID NO: 8479 - DNA, 2085 bp, Glycine max
  Peptide Sequence Number=SeqID_125257
atggcttttggtaattcaagatctgcaaggtttgaagatgatccggagctagcaaaatttcctgttactaacggtgacaatggtgctaagattaaattccacattgatggcacacaaatacctgagcctagttccaatatggctccgaaaaaggtggcagggaagttcttgaaaactagaatgctgtcaagagtgttctcagaagactatggcagagtaaaacgaatagtgttagatcctaggggacaaaccattcaccgatggaacaagattttcttggtagcatgtttagtatctttgtttgtggaccctttgttcttttatcttccagtggttcgagatgaagtgtgcattgatattggaataactcttgaagttatcctcacattgattttgatgaagtttcggacggcttttgttgctccttcttcaagggtttttgggagaggagaacttgttttagggtattataagattgcatttaggtacctccgcaagggtttctggttagactttgttgctgccctgccccttcctcaggtgttaatttggattgttatcccaactcttaggggttcaaccatggcaaacacaaaaaatgtccttcgctttttcatcattttccaatatattccgaggctacttttgatttttccactttcatcacaaattgtaaaagctacaggggttgtgacagagacggcatgggcaggggctgcttacaaccttatgctttacatgctggctagccatattttaggggcttgctggtaccttctatcaatcgaacgtcaagaagcatgctggagaagtgtatgtgatttggagaagtcattttgtcaatatggattctttgactgccacagggttaaaggtgccctcagggtctcctggtttatggcaagtaatatcacaaatttatgctcaccaaatgcaaaccatgacttctatcagtttggtatatacgctgatgccgtgacttccaaagttacatcctcggcattcttcaataagtacttcttttgcctgtggtggggcctaaggaatttgagaattatccctttggttaatgcttttctgattggaggatgcagttctttgggtcaaggccttcttactagcacatatgttggagaaataatggtcgccattgttgttgcaaccctcggattggttctttttgcattgctgattggtaatatgcagacatatctccaatcaactactgttcgcttagaagagtggagggtgaaaagaactgatacagagcaatggatgcatcacaggcaactacctccagagctaagagaatctgtgcgtaaatatgaccaatacaaatggctggctacacgaggagtagatgaagaagctcttctcaaaggacttcccgtggatcttcgtagagacatcaagcgccacctctgtctcgatctagttcgaggagtgccattatttgatcaaatggacgagagaatgctggatgcaatatgcgagaggctaaagcctgcattgtgcactgagggcatgtttctggtccgcgagggtgatcctgtgaacgagatgctattcataatccgaggccatctagattcttacaccaccaacgggggccgggccgggttcttcaactcgtgctgcattgggcctggcgatttctgcggggaggagcttctaacatgggccttggacccacggcccagtgtgatactcccctcatccactcgaacagtgaaagccatctcagaagtggaggcctttgcactcatagcagaagacctcaagttcgttgcgtcacagtttagaagactacacagcaaacagctcaggcataagttcaggttttactcgcaccagtggagaacttgggccgcgtgtttcattcaagctgcttggagaaggcacaagaaaagaaaggaagtggctgaactaattagggcaagggcaattcatgttaatgttgttgatgagcctcaaactcaaacaccaacctatgctaaaagggttgccaggagtactaggacagattctggagttgtaagctccttgcagaagccagcagaacctgatttctctgttgttgaatag

SEQ ID NO: 8480 - DNA, 783 bp, Glycine max
  Peptide Sequence Number=SeqID_125258
atgagggattcttaccctatttgccaatcccaggtcgaagaaaaaagggtatacagaatccctagctttggctctcccgagagactagcccagtccatcgattcaggtgctgcggaacatgtctcatcttatgatttaaaatctgccacagatgggtggccgattaatctacaaggagacattttggccttcctatttggatcagaagtggaagtgccattctgcagggccccttaccataaaggtggttggggtgatcctgtagaatatccgttcgctcgtggtagacccgttgtctcttttgagacagggcagccattgggttatctgtcatcttggcctctcttcacactgagtcaccatttagtgcttcagtcttgtgcagagaaggtgtatccgggcagatattttgacaggtacgctatcctaggcgatgacatatgtatcactgataggaagattgcgtccatatatcatcaggtcgtgacaaatcttggtgtagatctatctatacctaagtctcttgtctccaattctggtggtgctgaattttcaaagtgttttaggtgtcataatttgagtgtggatttcttaagatggaaagcctgccgaagacttctaggcaaggaaagagaggaagcgcctacggttgttgatgagctttcttccatttatatgtcttcttcgtcttctgctggaactattttctctaaaggtagtgaagtgagccgaggacatgaaatgaaagggattaagaagggaaggcggaagctaaggcattag

SEQ ID NO: 8481 - DNA, 1719 bp, Glycine max
  Peptide Sequence Number=SeqID_125259
atggccgttacaacactctctctgctcccaccctccactcgtccctgcttctgcggcaccgtccatctccgctcccacaacagcttcctttccatccattctacttcttcttcttcctttctttccttctcctcaatttcaattcccaaccactctcccacgcgccgtcccttccacactgtcctcgcctcttcctccgactactattccactctcggagtccccaaatccgccaccggcaaggaaatcaaagccgcctatcgaaggttagctcgtcagtaccatcctgacgtgaataaggagcccggggcaactgaaaagttcaaagagattagtgctgcctatgaggtgctatcagatgataaaaagagggccttatatgatcaatatggtgaggcaggagttaagagtgcggtcggaggaggatcaagtgcctatacggcaatttttggaaaagagaaagaattcgagctttctcatttggaaacatgtgaagtctgtaccggtactggagcaaagataggctccaagatgagagtatgttcaacttgtggtgggaggggtcaggtgatgaggactgaacaaacaccttttgggttgttctcacaggtttcagtatgtccaaactgtggaggggatggtgaagtcatatctgaatattgccgtaaatgcaacggtgaaggacgaatacgggttaagaaaaatattaaagttaaagttcctcctggtgttagctcaggcagtattctaagagttacaggggagggtgatgctggaccaagagggaaggaaggatatttcaaagtaaaaggagcattagtatctgtcctccttaatctaaagacaaatgtcccatcaaagcttgagtattcatccatagtaaatggcactgaagggttggatataaagaactctaccatacagcctactccaaatgtcttttattctcaaaaagttaactcaagggaggagaattgcccaagtcttacaaggggtcctccaggagatctttacgtatatcttgatgtgcaagagatacctggaattcaaagagatgacattaatctcgtctcaatgttatcaatcagttatctagatgctatacggggggctgttgtgaaggtaaagacagttgaaggcatttcggaactacaaatacctgctggtacccagcctggagatgtcctcgtccttgccagaaaagaacttgctactctaggtgacgcaagcagacgttcaaaatcccgtcccaggactcactcttccggaggtggtacggaaagtcctacagctcaaaaggatgaaagtccaacagcaacagtcgaagaaaaaactgaaaaatcagaagatgaaaacgatgtatggaataaattgaaggactttgctggcgccgtcactctcatcctcactggcgccgtcaccttagtctggttctacaatggcttctatgtcctcgacaacaacttgcagatctggattaaccttcgccgccctcctccaaccactgtacatggaagcaactgtgacagagagacatggtggtgcgaattcagacagccactatcaaagcacgtgtggggtggcatcactatcagtggtggttgggtgagggaaggagaaggaaaggaacgatcggagagagggagaggagtggatgcggtggcagaggtggaggaggaaggcgacgacggtgtcgaggagaagaaacggagatggtga

SEQ ID NO: 8482 - DNA, 7113 bp, Glycine max
  Peptide Sequence Number=SeqID_125260
atgtggaacaacggccagattctgccgcctggaacttccgttcctccgattcctccgcctccggccgcgcaaccctcctacacggtgcttccaccgccgcctccacctccagctcccatggagaccgaggccgatgcagaggcgcgcctcgaggagaaggctagaaaatggcagcagctgaattccaagcggtacagcgacaagaggaaattcgggtttgtcgagacgcagaaagaggacatgcctcccgaacatgtcaggaaaatcatcaggcaagtgttcttcctttcagaatctgaatcctgctcggatcatggtgacatgtcctcaaagaaatatcgtcatgacaaacgtgtttatcttggagcacttaaattcataccacatgcagtttacaaacttctggaaaatatgcctatgccgtgggagcaggtccgagatgtgaaggtcttgtaccatatttctggggctatcacatttgtcaatgaaataccatgggtcgttgagcctatttatcttgctcagtggggtaccatgtggatcatgatgcgaagggagaaaagagatcgtcgtcattttaagaggatgcggtttcctccatttgatgatgaggagcctccactagactatgctgataatcttttagatgttgatcctctagagccaattcagctggagctagatgaggaggaagattctgccgtgtatacttggttttatgaccataaaccgcttgtgaaaacaaagctcataaatggtcctagttaccggaaatggcatctttcccttcctataatggcaactttgcatcggctagctgggcagcttctttctgatttaattgaccgcaattatttctacttgtttgacatggaatcattttttacagcaaaggcattgaacatgtgcatacccggtggacctaaatttgagcctctctaccgtgatatggaaaagggagatgaggactggaatgaatttaatgacatcaataaactcattataaggtcaccacttcggacagagtatagaattgcttttcctcacctttataacaacaggcctcggaaagtaaagctttgtgtgtatcatactcccatgatcatgtttataaaagctgaagatcctgatctacctgcattttattatgatcccctgatacatccaataaccagtgctaacaaggagcggcgtgagaagagagtttatgaagaggatgacgatgatgattggatattgccagatggtgtggagcctttgcttaaagatacacaactttatacagacaccacagctgctggtatctctttgctgtttgctcctcgtccttttaacatgagatctggtcgcatgaggcgggcagaggatattcctcttgtgtcagagtggtataaagagcattgtcctccgtcatatccagttaaagttcgagttagttatcaaaagttgctgaaatgttttgtgttgaatgagctgcatcatagacctcccaaggctcaaaaaaagaagcacttgttccgatctctccaagcaacaaagtttttccaaaccactgaacttgattgggttgaggcaggtcttcaagtttgtcggcaggggtataacatgctgaatctgctgatacacaggaaaaatttgaactaccttcaccttgattataattttaatctaaagcctgtgaaaaccttgactacaaaagagcggaagaaatcacgatttggtaatgctttccatctctgtcgtgagatcctccgattgacgaaacttgtggttgatgccaatgttcagttccgtttggggaatgttgatgcttttcagctggcagatggtctgcagtatactttttcacatgttggacagttgactggtatgtatcggtacaagtacaggcttatgcggcaaataaggatgtgcaaggatctgaagcacttgatttactaccgctttaacactgggcctgttgggaagggacctgggtgtgggttttgggcaccgatgtggagggtttggttattctttcttcgtggtattgtgccccttcttgaacgatggttgggcaatttacttgcacggcagtttgaggggcgccattcaaaaggagtggctaagactgtaactaaacagcgtgttgagagccactttgacttagagcttcgggcagcagttatgcatgatgtgcttgatgccatgccagagggtataaagcaaaataaggcaagaactatattgcaacatttgagtgaggcatggcgatgctggaaagcaaatattccttggaaggttcctggtctgcctgttcccattgagaacatgattcttcgatatgtgaaatcaaaagcagactggtggacaaatgttgctcattataatcgtgagcgtataagaagaggtgcaactgtggataagactgtttgtcgtaagaatcttggaagattgacacgcctctggctgaaggcagaacaggaacgccaacacaattatttgaaagatggtccatatgttactcctgaagaagctgttgccatctatacaacaactgtacattggttggaatctaggaagttctcccctattccctttccacctttatcatataagcatgataccaagctgcttatccttgcgcttgagaagttgaaagaatcctatagtgttgctgtgaggttaaatcaactgcaaagagaagagttggggctgattgagcaagcttatgacaatccacatgaggcattatcgcgaatcaagcggcacttgctcacccagcgtgcattcaaagaagttgggatagagtttatggatttatatagctacctgattccagtttacgagatagagcctcttgagaaaattacagatgcatatctggatcaatacctgtggtatgaaggtgacaagcgtcatctcttccccaactggatcaagccagcagattcagagcctcctccccttttagtttacaaatggtgtcaaggtataaacaatttgcaaagtatatgggacaccagtgagggtcagtgtgttgtgatgctgcaaactaagttcgagaaattctttgagaagattgatttaacaatgctaaacaggcttctgcgactggttctagaccataatattgctgattatgtcactgcaaagaacaatgttgtgttgtcatacaaggatatgagccatacaaattcatatggtcttatacgaggcctgcagtttgcttcctttgttgttcagtattatgggctggtattagatcttttacttcttggactgactcgagccagtgagattgctggcccaccacagatgccaaacgaattcattacttactgggatacaaaagttgagactaagcatccaatcaggctttattctcggtacatagatcgggttcatatattatttcgtttcactcatgaggaggctcgggatctcattcagcggtatctgactgagcaccctgatcctaacaatgagaacatggtggggtacaataataagaagtgttggccaagagatgctagaatgaggctcatgaaacatgatgtcaatcttggaaggagtgtcttttgggatatgaagaatcgtcttcctcgaagcatcacaacattggagtgggagaacagttttgtttctgtttacagcaaggataatccaaacttgctttttagcatgtgtggatttgaagtaaggatacttcctaaaattagaatgactcaagaagcattcagtaacacaagagatggtgtctggaatctccagaatgaacagacgaaagaaaggacagctgttgctttcttacgagttgatgatgagcacatgaaagtgttcgagaatcgtgtgagacagattcttatgtcttccggttctactacattcacaaaaattgtcaataagtggaatacagctttaataggactcatgacttatttccgggaggcaactgtgcatacccaagagttgttggatttgctagtcaaatgtgaaaataaaattcagactcgtattaagattggactcaactcaaagatgcctagcaggtttccacctgtcattttctacacccctaaagaaattggagggcttggaatgttgtccatgggtcacattttgattccacaaagtgatctccgatacagtcagcagacagatgttggagtaacccacttcaggagtgggatgagtcatgaggaggaccaactgattcccaacctttatcgttatatacagccttgggagagcgagttcattgattcacagcgtgtctgggctgaatatgctttgaagaggcaggaagcacaggctcaaaacagacgtttgacccttgaagatctggaaaggcaatgttcctgtgtttttcttggaacaaatctactggtttacttagacagacacaccttggcttatgataaaggatggagggtgcggactgatttcaagcagtaccaagttctaaaacaaaatcccttctggtggacacatcagaggcatgatgggaaattgtggaacctgaacaattaccgtactgatgttattcaagcccttggaggagttgaaggaattcttgaacatactttattcaaaggaacatattttccaacctgggaaggtcttttctgggaaaaggcatctggttttgaggaatctatgaagtataagaagctcaccaatgctcagaggtctggtctaaaccagatacccaaccgaagatttacactatggtggtcgccaaccattaaccgagccaatgtttatgtgggtttccaagtgcagctagatctgactggtattttcatgcatggaaaaataccaactttgaagatatcccttattcagatattcagagctcacttgtggcagaagatccacgagagtgttgttatggatctctgtcaggttttggatcaagagttggatgctttggagattgaaactgttcagaaggaaacaatccatccaaggaaaagctacaaaatgaacagttcttgtgcggacattcttctctttgctgcccatagatggccaatgtcaaagcctagtcttgtaggtgaatctaaggatgtttttgatcagaaggcaagcaataagtactggattgatgttcagctgcgatggggtgattatgactctcatgatattgagcgttacactcgggccaaatttatggactacacaacagataacatgtctatatacccatctcctactggggtgatgattggccttgatttggcatataacttgcattctgcgtttgggaactggttcccagggtcaaaaccactacttcagcaggccatgaataagatcatgaagtcaaatcctgcactgtatgtgttgagggaacggatcaggaaaggtttgcagttgtactcttctgagcctactgaaccatatttgtcttcccaaaactatggagagatattcagcaaccaaataatatggtttgttgatgatactaatgtgtatcgtgttacaattcacaagacttttgaaggaaatcttacaactaagcccatcaatggtgctatatttattttcaatccaaggactgggcagttgtttctcaaggttattcataccagtgtgtgggctggtcagaagcgacttgggcagttggcgaagtggaaaacagcagaagaagttgctgctcttgtaaggtctttgcctgttgaagaacaaccaaagcaaattatcgtcactcgtaaaggaatgttggatccattggaggttcacctgctggacttccccaacattgttattaaaggaagtgaactgcaacttcctttccaggcatgtttgaaaattgagaaatttggggatcttatcttgaaggccacagaaccccaaatggttttgttcaacatctatgatgactggctgaagagtatttcttcatacactgcattctccaggctgattctgattcttcgtgcacttcatgtgaataatgaaaaggcaaaaatgttgcttaagcccgataaaactatcatcacggaacctcatcacatctggccttctctaagtgatgatcaatggatgaaggtggaggttgcattaagagatcttatactatcagattatgcaaagaaaaacaatgtgaatacttcagctttgactcagtctgagattcgtgatattatacttggagctgagattactccaccttctcaacagcggcaacagattgcagagattgagaaacaggcccatgaagcaaatcaggtgacagctgtgacaacaaagactacaaatgttcatggtgaagaacttatagtaaccaccactagtccttatgagcaagctgcttttggttccaagactgattggcgtgtccgagcaatatcagccacaaatttataccttcgtgtgaaccatatatatgtgaactctgaggatataaaggaaactggatacacctatattatgccaaagaacattttgaaaaagtttatatgcatagcagatcttcgaacacaaatttctgggtacatgtatggcgtaagtcctccagataatcctcaggttaaagaaattcgctgcattgtgatgccaccacaatgggggacacatcaacaagttcatctgccatcagctcttccagagcatgatttcttgaatgatttggagcctttaggatggatgcatactcaaccaaatgaacttcctcagttgtcgcctcaggatctcacttcacatgccaagatcctagagaacaataagcaatgggatggggagaaatgtattatcttgacttgcagctttactcctggttcttgttctttaactgcatataagctcactccatctggttacgaatgggggcgtgtaaataaggatacgggaagcaatccacatggttaccttcccacccattatgagaaggttcagatgctccttagtgatcgcttccttggtttctacatggttcctgataatggtccatggaattacaacttcatgggggtgagacacgcatcagggatgaaatatggagtgaagctcgggactcctagggaatattaccacgaggaccatagaccaacccatttcttagagttcagcaatatggaggaagtggagacagctgctgagggagatcgagaggatacattctcttga

SEQ ID NO: 8483 - DNA, 1278 bp, Glycine max
  Peptide Sequence Number=SeqID_125261
atggagaagttgttaccggacgttgatgtatcaagaagtgccccggtggcaatgtttcttgagctagaagctgctgctagatcatcattccatgatgtgaatgagcatgtttcggatgaagcatctgctaatgctaccacaccgtcacatatgatccaagataactcacctggttctgtaaaagctcacggttcatctgcagcaatagttcctggtaacaatgaagtttctgagctgggaacaccacaacatggaaaggataactgttctgatcaaatcatggataattcaacattggaacatggcttaattaatccaactgaaacgaatgttcattgtgccacatccagtgaaaacttcgtttataaggataatattacagacaaagtcactgggtatactgctgatgctatagctattcacctagatggaactgagtttacacctgctgtacaagattataacttgaatgctcatgttaagagactgtcaacagaaaacattacaagtgacttaagttctctaaggaataccgaaacatctaatttaactacaaccactttggttcaggatgctttgcatagccttgcggggagccatgaagcctcaagaaactcagatttattttttacttttccattggatgagcagcacaaattgaagaaaattcttaatacccagaaacagagattggtgactacaaaagctgatgttgaagatcttatagcaagattgaatcaagaaatggctgcaagacaatatcttgtgacaaaggtatccgtggtttacacaaatgcagtgggatatggaggaacttcggaggaaatgcctgagacagaaatgaaattgaagttggaagaggatgaaaggctgctagcagaatctacgaaagaatctgtcattcaggagaagcaaatgttgcagcaagagctagatgtagccagagaacaacttaagcacttgcaaaaacatcatgatgagtttgagatgaaatcaaagacagatatgaaggttctgataaaggaggtaaaatcccttagaagttctgagttagaactgaaacagcagctaagtgaattgatgaaggagaagttagatttggaggggatcgtgaagagtttgctgcatcgaagctgccatctccatgaatctttcatcaatcttggaactgagacgattttccacgcaatcttcaatttcacgtttgaaaacacgattccgtgtagcatccgccaaggctggtcacgcttaaggttacaggctgataccacttgttaa

SEQ ID NO: 8484 - DNA, 283 bp, Glycine max
  Peptide Sequence Number=SeqID_125262
atggagtttaatatccctgattcagaaacacaacaaaatagcaggaggagaaagaaatcgactgtctgggaacacttcactgttaaaaaggatggacctggatgtgccagggcttactgtaaaagatgccaaaaatcatttgcgtatctaaaagattcaaaacaatctggcaccagtcatctcaagagacacattgctttgggaatctgtcagaaaaatctaggaatcctgtgttccaaaactgatgccaatccaccaaagaaacaagcaagagcgaaacctt

SEQ ID NO: 8485 - DNA, 333 bp, Glycine max
  Peptide Sequence Number=SeqID_125263
atgttcattccagttctagttatagccataaattcttgggttcaggatatatgttactcgaccccacggtgggtgccaaggctccaaaatgttcctgtcacaaatggaaagggtactcatccttttgttgaagggtctttcactgtgccgaaaggtctactaagttgcaggggtgtctgcttgatgtttcttgttgaggtctcgggtgcgcgagtattcggtaaagcgaagggaatgatacctacaaaagatactccaacactcaatgatgataatcatggtcgaatggtgttccctgtttgcacatgccgaaggacgagatgcaatgtttag

SEQ ID NO: 8486 - DNA, 846 bp, Glycine max
  Peptide Sequence Number=SeqID_125264
atgctggcacgcctcgccgcgagtcgcttcaacgagatccgtcagattttccgtcagccttctagggctttctcaaccgctctgaactaccaccttgacacaccggacaacaaccctaaacttccatgggaattcaccgaggccaatcaagcaaaggttaaggagattttgtctcactatccatccaactataagcaatctgctacaattcctcttttagatcttgcccagcagcagcatggaggttggctacctgtttctgcaatggatgcggacgcaaaatatatttacagcaaagatgatccttttgaaattcttgctaacattgtcaaagtgaagccttttgtgcttgttatagtttgtcttgtacatccttttgttaaagtagctaagattgtagaggttcctcccatacgggtgtatgaggttgccacattttactccatgttcaatcgagctaaggtgaaagcttattgtgctttaatgctttcaatgttgctaatccacattaataaaggccaaagcttatctggaccaacttgctttcaggttgggaagtaccatctgttggtttgtggaacaacaccttgtatgataagaggttcacgaggaattgaagaagccttattgaaacacttgggagtgaagcgcaatgaagtaacaccagatggtttgttttctgttggagaaatggaatgcatgggatgctgtgtgaatgctcctatgattacagtggctgattattcaaatggatcagagggatatacttataattactttgaagatgtaaccccagagaaagtagttgagatagtagaaaagctgagaaagggtgagaagccaccg

SEQ ID NO: 8487 - DNA, 369 bp, Glycine max
  Peptide Sequence Number=SeqID_125265
atggtgatgactcaaggaccaacagtggctgtgcgagcaagcagcagtggtggctcgaggggtagcaacggtcgcgctaaggaggacagttgtgattacgcaagagagcgacgtcaacaggcgatagcaaagggtggttgcgaaacgaagaagaagaaaaaggagaaagaagaagccaaaggaataaaaaaagacaataggagagaaaatgtaaaagaaagaaaaagaaatgagaaaatgaaggtgggtgatctctctagtctccatcgacaagaattgcttgttcacggcaccaccacggaaggtgatgggcagcaaggacgtggacacgctgtgagttgcgacagaggacggtggcatggttcttag

SEQ ID NO: 8488 - DNA, 339 bp, Glycine max
  Peptide Sequence Number=SeqID_125266
atgggagtattgagaaaagagaaatgcatgatgcatcagaaaatgagtaaatgtggccaacagattgaggaaaaaatcaaatctgaaaattgggtttcaaacttagtttcccagcaggaaattgtgtccttatatcaaaggttttgtcaacttgaccgcaacgccaagggatttatttccgcagatgagttcttgtccgttcccgaatttgccatgaatccactttctcagaggctgctcaagatggtcgacggtttgaattttaaagactttgtggccttcttatctgcattcagtgccaaagcgagcgcacaacaaaaaatagagcgtacgttttag

SEQ ID NO: 8489 - DNA, 2604 bp, Glycine max
  Peptide Sequence Number=SeqID_125267
atgtcatctctaagtagggagttggtgttcttgatcttgcagtttctggatgaggaaaagcttgagcaggagtctgggtttttctttaacatgaaatattttgaggatgaagtgcacaatggtaattgggacgaggttgagaggtacctctctggtttcaccaaagtggatgataataggtattctatgaagatattttttgaggtaatgaagcagaagtacctggaggcattagataagcatgatcggtccaaggctgtagaaatattagtgaaggatttgaaagtctttgccacatttaatgatgaactgtttaaggaaatcacacagcttttgacattggagaattttagggaaaacgagcaattgtctaagtattgtgatacaaagtctgcaagggcaatcatgttggttgagctcaaaaagttgattgaggccaatcccttatttcatgacaaattgcaatttcccaaccttaaaagctcaaggttacggactctaatcaatcaaagcttgaattggcagcaccaactttgtaagaatccacggccaaatccagatataaaaactctttttgtggatcattcatgtggacaactaaatggtgcaccggctccatcacctgctaataatctgctacttggatcattaccaaaggccggaggatttcctcctcttggtgcacatgggccttttcaaccttctccagcccctgtgccaacacccctggctggttggatgtcaaacccaaccactgtagcacatcctgaagtttcaggaggagctataggtcttggtgtgccatcaattcctgctgctttgaagcaccctaggacccctccaacttatccttctgttgactatccatctggtgattcagatcatgtttctaagagaacaagaccaatgggaatgtcagatgaggtaaatctgcctgtcaatgttttgtcagcaacgttccctggtcatggtcatggtcatggtcatggtcaggcttttaatgcccctgatgatttgccaaagactgccatgcgaactctgaaccaaggctcatctcctatgagcatggactttcatccggttcaacagacactgcttcttgtcggtacgaatgtgggggacattgctttgtgggaagtgggctctagggagcggttgctcatgaggaactttaaagtttgggatcttagtgcttgttcaatgccctttcaggctgctcttgtcaaagatccgggtgtttctgtctaccgtgtgatttggagtcctgatggggctttatttggagttgcttactcaaggcacatcgttcagatatactcttaccatagtggggatgatgttcaacagcatctggagattgatgctcatgttggtggagtaaatgatctagcgttttctcacccaaataagcaactatgtgtcataacctgtggtgatgataagaccattaaggtttgggatgctgctacgggtgcgaaacagtatactttcgaaggtcatgaagctccagtttattctgtctgtccgcattataaagaaaacattcagttcatcttttcaacggcattagatggaaagataaaagcatggttatatgataatttgggatctcgtgttgattatgaagctcctggacgttggtgtacaaccatggcctatagtgctgatggtacaagactcttttcatgtgggacaagtaaggatgcggaatcctctattgttgagtggaatgaaagtgaaggagctgtgaaaaggacttatcaaggatttcggaaacgatctttgggttttgtacaatttgatacaaccaaaaaccgatatttggctgcaggtgatgatttctccattaaattctgggatatggacaatattcagcttttgacaactgttgatgcggatgggggtctccctggaagcccacgaatccgttttaacaaggatggagctcttttagctgtttctgcaaaagagaatggaattaaaatcttagccaatgcagatggtattcgtttgttacgcacattagaaaattctttatatgatacatcaagaacatcggaagtcatgacaaagcctacaataaatccaatttcagcagccgccgccgctgcaactagtgctgcacttggagagagggccttgtctgtgaatggggatgcccggaacttgggtgatgttaaacctagaataagtgaagaatccaatgataagtcaaaaatatggaagctaactgaaatcaatgaaccatctcaatgcagatccttgaagctacctgagaatgtcagagtgaacaagatatcaaggttgatatatactaattcaggtaatgctatcctggcattagcttcaaatgccattcatctgctctggaaatggcagcgaaatgaccgtaattcaactgtaaaggcctctgccagcgtgcaaccccagttgtggcaaccttctagtggcatcctgatgactaatgacattactgatagcaatactgaggatgccgttccctgctttgctctgtcgaaaaatgattcttatgtaatgtcagcatcaggagggaagatttctctgttcaatatgatgacttttaaggttagctatgatccttag

SEQ ID NO: 8490 - DNA, 264 bp, Glycine max
  Peptide Sequence Number=SeqID_125268
atggtagctgcagcatgtgagtcagagacagagtcaggaggaacatgttgcagatgtgtgacttgcaaacatcattctactcatttcctcctatctcaatgtccatccttgttgaacttaatcactcacgctctggatagttacttgggagaatatgcaaatgcatatggtggtggtggtgctgctgctgcaattgtggttgatgcttggatggatgtcatctcatcacagggatcctctttacttaaacttctgcttcagtag

SEQ ID NO: 8491 - DNA, 288 bp, Glycine max
  Peptide Sequence Number=SeqID_125269
atggagggagtatttcggagagctgatagctgcaacaatgaatttttcacagttattttcaaagtatatgattcagaccgcaatggaaaggtgtctttcaaagatatgctggaagtgctaaaagatttgtcgggtccattcatgtctgatgaacagagagaggaagttctcagccaagttctaagagaagcgggatacacaaaagactcctacttgacattggatgacttcattaaggttcttggtcaatctgacctaaaaatggatgttgaagtccctgttgattga

SEQ ID NO: 8492 - DNA, 249 bp, Glycine max
  Peptide Sequence Number=SeqID_125270
atggcgcaggaaattgttggtcctgagattagaggccatgataatggagtttttcctcttccttctcctcttgcagttccaaaacagagaggtggaagaacaaggcttgttcagagtgggatcgaacgcaattgggtgaagagggtcacagggtactccacccagtttcctggttatttcttgcaagttacaaagcatattgccatccccagtttctctatctatggtatttcagctccaatggactag

SEQ ID NO: 8493 - DNA, 1614 bp, Glycine max
  Peptide Sequence Number=SeqID_125271
atgaagagggtagataccaaatggaaggaagggcgtgatatatggtggcaggatgtcattcatcaatatccaactacttgtccagtggagtgggttgatgcagaggatccactttttctactctatacaagtgggagtacaggaaaaccaaagggtgtcctccatacaactggtggttacatggtgtacactgcaacaacattcaagtatgcatttgactacaagccgcatgacatctactggtgtactgctgattgtggttggattactgggcacagctatgtcacttatggacccatgctcaatggtgcatctgtcatcgtgtatgaaggggctcctaattatcctgatgctgggagatgttgggacattgttgacaaatataaggtgacaatattctacactgctcctacattggtgcggtccctcatgcgtgatggtgacacgtttgttactcgctactcaaggaaatctttacgagtcctaggaagtgtaggcgagcccataaatccaagtgcatggaggtggttttacaatgtagttggagattcaaggtgccctatctctgacacttggtggcaaacagaaacgggtggcttcatgataactccactaccaggtgcttggccccagaaacctggttctgcaactctccctttctttggagttcagccagtcattgtggatgagaaaggtgttgaaatagaaggagagtgcaatggatatttgtgtgtgaagaaatcatggcccggggcattcagaactctgtatggtgatcatgaaagatatgaaacaacatatttcaagccattttccggatactatttcagtggtgatggttgcagcagggataaagatggataccattggctcactggaagagttgatgatgttatcaatcatttaaacatgaatgtgttccatgcagttctattctatttgatgttcaagtctgatatagttcctgttatatgcagtgggcatcgaattggcacagcagaagtggaatcagctttagtttcacatccgcaatgtgcagaggctgctgtggttggtgtggagcatgaggtcaaaggacagggcatctatgcatttgttacagttgtggatggtgttccttacagtgaagaactgcggaaggaccttgtactcacagttcgaaagcagataggagcctttgcagcgcctgacaaaattcattgggcacctggccttccaaaaacaaggagtggaaagataatgcgaagaattctgagaaaaattgcttcccggcagctggatgaacttggagatacaagtaccctttcagatccaaatgtgatcaaagttctttggagtttttgctttggttacggttctacttggacaattacgtatgacttcacttcgataatcactccggaagacgtgttggagtcgttgatgaacgacggcacagttgatgccctcagattgaagatcatcaaccagctcaaagccaatgaggaattgaaaaatactactataaagatgaccgagcagaataagattttgaacacccctgcggctgagaaacagaccaaaagagacgagagctctttgaggcgcttaggcaagaactactcactctgctaa

SEQ ID NO: 8494 - DNA, 789 bp, Glycine max
  Peptide Sequence Number=SeqID_125272
atggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagggtgtgacagaagcaaaactgaaggttgccataaacggatttggaaggattggaaggaacttcttgaggtgctggcacggtcgcaaagactcccctcttgatgtcattgccatcaacgacaccggtggcgtgaaacaagcctctcaccttctcaagtacgattcgatcctcggaaccttcgatgctgatgtcaagcctgttggcagcgacatcatctctgtcgatggaaaggaaatcaaagttgtctctgaccgcaaccctgccaaccttccttggaaggatttggggatagacttggtgattgaaggaactggggtgtttgtagacagagaaggtgcagggaaacacattcaagcaggagctaagaaggtgctcattactgctcctggtaaaggagacatccccacatatgtggttggtgtcaatgagtatgattacagccctgatgaacccatcatcagcaatgcatcttgcaccactaactgccttgcaccctttgtcaaggtccttgatcagaaattcggtaatgtgccttgtcacaaccacatttttttttctctatcaagttgccccatccatgaaattgaagagtgcttcaaatga

SEQ ID NO: 8495 - DNA, 437 bp, Glycine max
  Peptide Sequence Number=SeqID_125273
tgcaggaggtgccggaaaaaatggggaaaggagactgacggcgagacttccggaagaagtgttccggaaactttccggaagaagagttcttccggaaatcccaaacgtttccggaagaaaccttcttccggaaagtttccggaagcagggttcttccggaaaacgtttggtttcttccggaagaacacttcttccggaaagtttccctaacgggtcttccggaagtctcgccgtcagccccctttccccattttttccggcacctcctgcactcgtcttctaccctatggcgaaagaagcagcagctgggctcgcggtggcttgcggtggaagagaatgctcccggaagaggaaagaaaagaaacaaaagcactgggtgaaagtgaagagaatgctcccggaagaggaaagaaaagaaacaaaagcactgggtgaaa

SEQ ID NO: 8496 - DNA, 1533 bp, Glycine max
  Peptide Sequence Number=SeqID_125274
atggcttcagctacactctctgcagccaaaccagctcttcaggttcaacaagttaagaaaattcatttacttttccaaatccaattttttgtctgtattcacccagacattattaatgctccctacttgggaaccccaagaacaaggtttggttctgaggaagcccttgtcttgcttcaaaaatgtagcaacttcaaacaactcaagcaagtccatggcaaaataatccgttttggtcttacctatgaccaattgcttatgaggaaactaattcagctctcttcctcttatggcaaaatgaaatatgccactttggtatttgatcaactcaatgccccagatgtcttcacttggaatgtcatgattagagcttttaccattggtggttctcctaaaatggcccttcttttgttcaaggccatgctatgccagggctttgcacctgacaagtttacatacccttttgtgatcaatgcttgcatggcctctagtgcccttgatcttggaatagtagcccatgctttggccatcaaaatgggattttggggtgacctgtatgtgcaaaacaccatgatgaatctctacttcaagtgtgagaatgtggatgatggacggaaggtgtttgataaaatgcgtgtgcgcaatgtgttcgcgtggaccaccgtgatttctgggcttgttgcctgtgggaaattggacactgccagggagctatttgagcagatgccttccaagaatgttgtttcatggactgcaatgattgatgggtatgtgaaacacaagcagcccattgaagccttcaatctgtttgaaagaatgcagcaggttgataatgtgaggccaaatgagtacactttggtgagcctggtcagagcatgtactgagatgggtagcctcaagttgggtagaagggttcatgattttgctctcaagaatggttttgagcttgagccattcttgggtaccgcgcttatagacatgtacagcaagtgtggctatttagatgatgcgaggacagtgtttgatatgatgcaggtgagaaccttggctacttggaataccatgatcactagcttgggtgtgcacgggtatagagatgaagccttatccctttttgatgaaatggagaaggcaaatgaggttcctgatgctatcacttttgttggtgttctgagtgcttgcgtttatatgaatgacctggaactagctcagaagtatttcaatcttatgacagatcattatggtataacacctatcttggaacactatacatgcatggttgaaatctatactcgtgctattgagttggatgagaattacacatcagggaacaccatggaagctaatcatgatgttgcagaattgctccacaagaacaaactcactagtttcgacgacattaaaaaacttatacacaagcaatacggggatttggatttctcagaactagttttggaccattcctccacgagctctccacctcaagtcccgagctcaagggggatgcagattgatatcagcaaaacaagttga

SEQ ID NO: 8497 - DNA, 513 bp, Glycine max
  Peptide Sequence Number=SeqID_125275
atgaagcgcatttgtgatagtatcagctgcaagaaggaagggcaaaccaggaaaggacaacaagttgcaagaaggaagggcaaaccaggaaaggacaacaagcactgccgtgaagtccgtcctgctaccagcctaacattttggtatcgccgtgaagaacttgtccccgtgacccgctgctcccaccaccgctaccgcgacacaggcgaagtcatgggtttttcagacctttccagtgttggtgaagggtgctatttggaactaagtagaagaaggtcacaccctcaaacaaaaacccatggtattgcatgcacaaatgatgaggacatgaccaagagcaagggcaaggatccacttgaaggacttggagggcctatgacaagggctagagcaaggaaagccaaggaagctcttcaacaagtgttgtccatactatttgaatacaagcccaagtttcaaggagaaaagtccaaggttgtgagttgtatcatggcccaaatgaaggaggactaa

SEQ ID NO: 8498 - DNA, 402 bp, Glycine max
  Peptide Sequence Number=SeqID_125276
atgacattaattgttattgtcgtttatattttaggaagagccttagggagacagattagtggtgatgtagaagaatcccctcagcgtcgaaggtcgacagtagctgcacatagacaactagcagctgcagctgctgctaaggatgttgagcatgtgaatcatccagttaacgaggttcataagcagtctcacaaaagcccgttattaatgatgttagagatgaaatttatggacgatgatggtgatatggccgaaatgtatcttcctgagaagaaaagtttatcaaccaccgtttcctgccttttgtttcagttgaaagaatacattgatgacacagaagatttcatcaacattcaactggtgtatgggacaacgacttcttattcccatggtgaaacatag

SEQ ID NO: 8499 - DNA, 336 bp, Glycine max
  Peptide Sequence Number=SeqID_125277
atggatattgatttgggattggataatctctctaattctcgtcaccagcttctaccgaataacatgaaaaacacaaaaggtgcggcaatttttttggggagggaaacaaacctctttgcactaagactcccactttcctacgtggactttttcattcttacattcaaagctttgtccaaggccaatgatctagacccagctgagcggatggcagattcagagctttgtccaaatccaagtttatatctgagtgggaggcccatacattacaaattcttcttcatcaacaaagccctgttggaattggaatttggaatcaagaaaaaccagctctag

SEQ ID NO: 8500 - DNA, 255 bp, Glycine max
  Peptide Sequence Number=SeqID_125278
atgtcaccacaaaatttactcaaaaaacaaagcaaacaacacattaagttaaactcaaaaagaaaagatattgtcttcttcgagatcactgtcggaatcgaaggcttgaggatcaggaaaaggctcggtgacagagttagggtcaaagagaacgccgaaggaggagtagttgctgttaacggtgctttggttgtcccattgggactcttcggtgagggtttgcaagagtctgggtggaatggagaaaaggtttga

SEQ ID NO: 8501 - DNA, 641 bp, Glycine max
  Peptide Sequence Number=SeqID_125279
gggttgcttctgacagcttggtcttcaaacacctgagcccagtcattaacttggcctatatcaggaaaaactgttggaaccctgatgatttgacagttactatcagagaggccaggagagtgaggacaaggctagttgaggccccttccacatctacagctcctcctccagcatgtaccctagcagctccttctgccccagcttatgcagattttcagcgtcttgaagccgtgcttcaaaacatccatcaggggcagattatcttattacaaagtttacagatggtggcacctccaaactctattccttcagtagagcagtttaatgagtgggtagcctggcccggaactcagtcttctcttcacagggaaggtgaaggtccccaacccaggaagaaggcagatcaaacacaagaagctgcaaccacttctgagaaatctcttgaggccactttcgagccttcagaaccagtgacaaatatagcttcacttcagcaggcagcagacccttccactcctgaggatcagactacacctgtcttgtctccgaaaacctctcctacaactaccgttgtgcttcacttaacagatgaggaggatgttcagacacaggatactcaggaccgatcacaggatttttga

SEQ ID NO: 8502 - DNA, 294 bp, Glycine max
  Peptide Sequence Number=SeqID_125280
atgtccccagtggagtcaccaactgtcgcaacctacccttcagcaggggtgcgaaaagggcctctcgagtgggccaagggtgcgtcttccattgaaggaaaatgcatggagtcgccatcaacgtttattcaagaaaaatgctacaaaaaccaaaaagacaaaggtcagcgtattttgaaaatgaaggttccggagttgtttacgcatggggaagggtatgaacaatcggtcaaaactcgctttaaacaaagaaaaagatcactaatgatcgaagaaggagatgaagatgcataa

SEQ ID NO: 8503 - DNA, 654 bp, Glycine max
  Peptide Sequence Number=SeqID_125281
atgaagtctgcatatctttacctgatagatgatgtatcacaggatgccctatcagcttgtggttctcttcttgaaatttctattcagaaggcagctatatgttgcacagccatgcaccgtggtgcagcgcttgccgcaatgtcatatttatcttgtttcttagatgtgggccttgtctctttgttagaatgcatgaattgtattactgagggatcattcaacatcacagccattcatgtcatatctcacagtggtgagggtcttgtatcgaatgtggtgtatgctttacttggtgtgtctgcaatgtcacgggttcacaagtgtgctacaattttgcaacaactggcagcaatttgcactttaactgaaagaacaacgtggaaggctatactttgctggcaaactctccatggctggctgcatgcagcggttcaggctcttccttctgagtaccttaaccatggagaagcagaggccatagtgccactttggtccaaggctctagctgatgcagcctctgattatcttgagagcaagaactctgatggattaaagagtgattttgggcatatgcaaggaaagggtggccgagttttaaaacggctggttcgggaatttgctgattctcaccgcaatattccaaatctaacttga

SEQ ID NO: 8504 - DNA, 543 bp, Glycine max
  Peptide Sequence Number=SeqID_125282
atggtggtatttgagggtcggggaacgttgaaggcattgctcgtccttggatttgttgtgtctgcgttgttcaacttcagatttgatgacaatgacaaggactttgcttgcatgctagaagccacaatgatcttgggctttggacatgagggagaggcgagtgggcctgggctgaaaggtttcgcggcgacgcaagtgatgagaggagggcctaatgagagtggtcgtcaacgctctcctcacaatctgatcaccttccactcctccgattctcaccaccgagttcttcatcgccgatctaagaaggttcagcctccgacaactcaacgacaacacatgcacgtcctcttctcgctcgacgacgacaccgcgtctttgttcctctcactcttcgacggcaacggacggtgttcctgcactctgacgggagagaaactagtcgacgacgtggacgtggacgtggacgcgaacgccgaggagtacgaacgcggcgacgacgtttggtttcttgaagaaggagaagccattgacattgttgattga

SEQ ID NO: 8505 - DNA, 474 bp, Glycine max
  Peptide Sequence Number=SeqID_125283
ggtttagacaagtggcatttatctttggaagatgaggaagaagttatgcatgctataagtctgatccttggttctgttcccagtcgagaactaaagaacaagttattggctaaattgctttcacctagctatgaagctattgggaaacttgttgatccagagatcagcctttctcttaaacagaaccctgcttcttatacacaagttttgaatgcttcctcaagagggttgcacagaatgggaactgtattcagtcatcttcccatatccatggcaactgagcctgctgcagatgactcaatactttcactgctaagggttttctggcccatcttggagaaattttttggctctgagcatatggaaaatggcaatttatccgtagcagcttgccgagctctttcactagctgttcgatcttcaggtttacccacttggacacatttgtttacagttctttggttcctcttgtga

SEQ ID NO: 8506 - DNA, 591 bp, Glycine max
  Peptide Sequence Number=SeqID_125284
atggattggttctcatggctttcaaaaagtgggcttgagccatccctagtgtacgagtatggccttacctttgctcacaacgagctcgaagaagaagacatgttttacttcaaccacgagtttctccaaagcatgggcatctccatagcaaagcacagactagagatcctcaagcttgccagaaaagagaagggaaagagcccacgcgcggtggcaaggctcgcggtggcaatcaagaggactaagaacacctttgccagctatgtaaggactttgatgcacaaagaagaatcatcatcatctaattcagcacttgttgtagtgccagtgccaccatcaaggcctagtagtagtggtttggggaaaagatggaagagtgctatgatgaagaggggcaaaaagcaagagacactctttctcactaatggaagttccacggtagttccagctcagcctggtttttctagtcctgtggtctaccatttccagaaggatgagaagatgggtggagatgatgatgatggctattggtctgccgctgttgaagagatcaaatgggataccatgtttcaggatctaaagccaaactga

SEQ ID NO: 8507 - DNA, 648 bp, Glycine max
  Peptide Sequence Number=SeqID_125285
atggatcgagaatggggatcgaagccggggagcggaggtgcggcgtcggcgcagaacgaagccatagaccggcgagagcgtctccggcgactggctctggagaccatagacttggcgaaggatccctatttcatgcgcaaccacctcggaagctacgaatgcaaactctgtctcactctccacaacaacgagggtaactacttggcccacactcagggcaagcgccaccaaaccaacttggccaaacgtgccgctcgcgaggccaaggacgcccccgcccagccccaaccccacaagcgcaaagtcactcttcgaaaaacagtgaagattggacgccctgggtatcgtgtgaccaagcagtatgacccggagacaaaacaaagatctctcctattccagattgaatatccggagattgaagacctcatgaagccgaggcaccggtttatgtcctcctatgaacagagggtgcaaccctttgataaaaggtatcagtacctcttgtttgctgctgaaccatatgaaatcgttgctttcaaggtgcccagcacggagattgacaagtccactccaaatttcttctcgcactgggatcctgactccaagatgttcacgttttcagaagaggctctttcttcaagcttttga

SEQ ID NO: 8508 - DNA, 456 bp, Glycine max
  Peptide Sequence Number=SeqID_125286
atggataacaataattggagacctaatcaaggcactgaagccaatatggatactagtgattggagaggtggactgccgcacgagtcacgccaaagaattgtcaacaaaatgtcaaaggacccctggcgagctgaatcgctggagggtgagatcactctaggattgcgatttaccaagttcaatcatgggattgtcgatcccagcatcccagcaaagcggagtatggctaaaattaccctttatttctcctttgatgaaatgttccctgccattcgagacctaaatcccattcaaaaatcactcaatcgtgtgccattggatctctccttcttcacaactgccaaagcttcacctcgtgccactagtgctgctgtgcgttgtcactgctgttgccagttattgcacctgttacccaacgtcccagactcccagcatatttcttctcattttctctag

SEQ ID NO: 8509 - DNA, 294 bp, Glycine max
  Peptide Sequence Number=SeqID_125287
atggctgttagtgaatggcacatgcttgttcttacctatcctaaagctacattggtgtcagcgagcaaagcaatgaaatgcagcacagtagagagtatgaaaaatatagggacaagcaagattaacctacttacgatagaaaataaaatggagaatttagaagccaacccagatgaagatgcctatgatttggttagtcacaacagaattgaaaatgtgaaggcaagaacggtggagcgggacaagggttttcacgagctcatcacaaacagtgcattccaaactgtgtgttga

SEQ ID NO: 8510 - DNA, 204 bp, Glycine max
  Peptide Sequence Number=SeqID_125288
atggctgttggtgttatgggaggccagcaatccccttccgactcccatgtgtttatgggtgaaagtcattacaaaaactcgaaggagaagaaatggactaagtttgaggttgagaattatcatcgtgtcttgaaatgtggaggtgaagatagtttccaaatagcaaatacagaggaggcaactgccatcaggatgatcctataa

SEQ ID NO: 8511 - DNA, 1503 bp, Glycine max
  Peptide Sequence Number=SeqID_125289
atgtctcatgaatcttctctggattcaacagcacagactggacagtcaagtgggggtgattggcaagaagaagtgtatcaaaagattaaatctatgaaggaaagttacttgcccgagttgaatgaaatgtaccaaaaaatagctagtaaacttcagcagcatgattcccttccacaacaaccaaagtcagatcagcttgaaaagctgaaggtttccaagagcaacatctcacctaatttcaaggagaaattgaattcatatgagaagcagattataaattttataaatacaaatagacctaggaaaaacatgcctggacatcttccctcacctcatatgcattccatgtcacaatcacaaccccaagttactcaagtgcagtctcatgaaaatcaaatgaactctcagttgcaaacaacaaatatgcaaggctctgtagcaacaatgcagcagaataatatggcagccatgcagcataattctctgtctggtgtatccacagcacagcagagtaagatgaattcaatgcaaccaagtaccaatttagattcaggaccaggaaatgctgtgaactccctgcaacaggttccagtgagctcacttcaacaaaaccctgttagtgctcctcaactaactaatgttaactccttatcttcacaagccggggttaatgtagtccaaccaaatcataatccccttcagccaggttctagtatgcttcaacaccagcaactaaaacaacagcaggaacaacagatgttacagaatcaacagttaaaacaacaatatcagcggcaattgatacagaggaaacaacaacagatcttacagcagcagcagcagcaacaacagctacatcagacagcaaagcaacagctgcctgcacaattgccaacacatcaaatacaacaacttcaccaaatgaatgatgcaaatgacataaagatgaggcaaggaatcagtgttaagccaggggtctttcagcaacctcttacttccagtcaacgctcaacttatccccatcaacagatgaaagggagtccttttcctgtttcttctccccaactccttcaggccacatctcctcagattccacaacactcatctcctcaggttgaccaacaaaaccaccttccatctctcacaaaagttgctacccctctgcaatctgctaactcaccttttgtggtacccactccttcacctcccttggctccatctcccatgccaggggattctgaaaagcccatttctggtgtttcatcaatctcaaatgctgcaaatattggatatcaactaacagggggtgcagcagcacctgctcaatcccttgccattggaacacctggaatatcagcctctcctttacttgcagagttcactggccctgatggtgctcatggtaatgctttagcacccacttctggaaagtcaactgttactgagcagcctattgagcgcctaattaaagcggttagtttagtggatcttaagctggcctga

SEQ ID NO: 8512 - DNA, 240 bp, Glycine max
  Peptide Sequence Number=SeqID_125290
atggaagagaattggcgcagccacgcatttcacgttcaagtctccttcgaggctttcaattccaaacccaacaaggaccacacctccttctccaacctcgttggcgctgcttacaatgccttgatagatatggctaggaagtatgatgaggagatgttagccgaaggactttcacctaagccaaggaaagacttggggacaaagctgttgctgatgatgaatctcaaagtaccatactga

SEQ ID NO: 8513 - DNA, 759 bp, Glycine max
  misc_feature (720)..(720): n is a, c, g, or t
  Peptide Sequence Number=SeqID_125291
atgtggagttcaacttcaagcacagcagcgattccctccgacgaggaacctagcgaatcctcctcctcgtcctccttctccacctctctcttcaatttctcttctggaaacccgagaatcgaggagacccgtggcctcatgcatctcttcccagacgacactccttctactctacccgttggacggaagcctctcgtttgcgttgtcggcgtcccaaatcacatgacctatgcggatttctgccagttctgtggttccttcattcagcacatgctagagatgcgcatagtcaggatggatgggatggaggatcagtacagtgttttagttcgctttgacgatcaagactccaccgacagcttctacaagcactacaatggccgccgtttctcttctctcgaggttgaggtttgccgtgttcttttcacattagacgtgcagtacactggctccattgaacatgcacaaccctccaatgctacttcaactgaactgcctacttgtcctgtttgccttgagcgattagatcaggacaccggtggaattcttacaactatatgcaaccattctttccattgttcctgtatttctaaatgggcagattcttcttgtcctgtatgccgctattgccagcagcaagctgaaaaatctatatgttttgtttgtcaaaccactgagaacctatggatatgtgttatatgtggtgtgcgcatgcagacnatggatgtggaagttgcagctgtgaagatcatgccatga

SEQ ID NO: 8514 - DNA, 267 bp, Glycine max
  Peptide Sequence Number=SeqID_125292
atgaggaacctagcgaatcctccttctccacctctctcttctggaaacgacactccttctactctaccccctctcgtttgcgttgtcggcgtcccaaatcacatgacctatgcggatttctgccagttctgtggttccttcattcaacacatgctagagatgcgcatagtctggtatgctactggtatatatgcatattcatgctcacaaatcacaatcgcaatcacatcggcaatattgatgtcttcttctttctttatgttttaa

SEQ ID NO: 8515 - DNA, 1128 bp, Glycine max
  Peptide Sequence Number=SeqID_125293
atggcggcttgtctgcaactgtggcaatgcaaactagcgagaccctttgactcattaccggtgcgaaggtcaattcctttgagtctgaggtgttcggccgcgccctcttcttccaagccgacgcgctcctacagcatcactctcatccccggcgacggcatcggccccgaaatcatctcggtggccaaagacgttcttgtcctcgccggttatctcgaagggattaaatacgacttccgcgagatgcttatgggtggagctgcattggatgccacgggactccctttaccccatgaaaccctttctgccgctaagcaatctcatgccgttctccttggtgccgtcggaggttataaatgggataggaacgacaaacatctcaagcctgagactggcttgcttcagatacgtaaagagcttggagtatttgcaaatcttagaccggctaccgtatactctccgttagttgatgcttctactttgaagagagaggttgctgaaggggttgatatcatgcttataagagaactcactggagaacccaggggctttggcaccaatgataatggtgaagagattggctttaatactgagatttatgctacacatgaggcatcaatgttatggaggaagagatttttggcaatagcacaagaatatcctgatgttgagctctcacacatgtatgttgataatgcctcaatgcaactaatccgcgatccaaaacagtttgacaccatggtgacaaacaacatttttggcgatatattatcagatgaggcttcaatggtcactggaagtattgggatgcttccttctgctagcctgggggcttcgggacctggactttttgaacccatacatggttctgcacctgatattgctggacaggacaaggcaaatccatttgccactgttcttagtgctgctatgcttttgagatatggcctaggagaagaaaaggcagctgaaagaatagagaatgcagtgatggacactttgaacaggggatttcgaactggtgacatatattctgctggaacgaagctggtaggatgcaaacagctaggtgaggagatactgaagtcagttgaatctaacgttcctgctggtgctgctgcagtgtga

SEQ ID NO: 8516 - DNA, 320 bp, Glycine max
  Peptide Sequence Number=SeqID_125294
gtcaatgcaattctcctggacttcctgggaaagatggactaagtgagagctctttgagggatcttctccatggatctgaatatgttcttacatatgaagacaaagatggagattggatgcttgtgggtgatgttccttgggagatgttcactgattcatgtcggagactaaggatcatgaaaggctctgaggcaattgggctagatttattaaacatgtgttctgaattgtcttggttgcagctccaagggccatggaaaaatctaggagccaaaactaatgcagaaaaaacctgtttgaccgaagctggttattactga

SEQ ID NO: 8517 - DNA, 435 bp, Glycine max
  Peptide Sequence Number=SeqID_125295
atggtgtatataagtgggggtaactgtcatatcataacagggcacgccgagggatccgaaatcggagtcgaggccatcgaagccgaagaagccggcgccagagacggggctgtaggaagaggagatgcagacgaagccgcgagatgtgaagaggaaggagaaggccaagaagatgaaaaggaggatgatgacgcaagggaggtagaaggaaccggaaccggcgattcgggagaggtaattggaggctctggtggtgatgcggaagagaatgtgttggttcttctttgtcttggattcgtcggcgtctccgtcggcgtcgccgtcggcgcaggagttgacgcggcgggaggagagagtccgctccaacatggagggcgcggagagattgggatgacggtgagtaggggtggtggtgctgctgctctgcgtctgtga

SEQ ID NO: 8518 - DNA, 1089 bp, Glycine max
  Peptide Sequence Number=SeqID_125296
atggatatgccggttgacaaagacgacgctcccacttcaaagagaacttccaagaaacccatatgtgtgttcttcacttggttagataattgtcctgtttcgtttaccattctatcacattcaaaattctcacagcaagaactccctgcatggaaaccgattctaacacctggatgggtcattgcaacattttctgtcattggagtcatcttcatcccaattggtctagcttccttgttttcgtcagagagtgtggaggaagctgttttcagatatgatgagacttgccttcctccctcacatgctcaaaatgcagtggcttatattcaaagcgataccaccaacaagacctgcatcaccaaatggactgttgagcataaaatggaagctcctatttatatctactatcagcttgacaattactaccagaaccatcgcagatatgttaagagtagaaacgacaagcaactgtggaataaggcagctgagggggaaacaaacaattgttttcccgaagacaagacaaaagataaccagcctattgttccctgtggcctcattgcatggagtatgttcaacgacacgtacaaattttcaaccagcaacaaggacttgacggtcaacaaaaagaacattgcatgggggagtgagcaaaggtccaaatttgcctctgatgtttatccaaaaaactttcagcgcggagatttgattgggggtgcaaaactcaacgagagtatacccttaagtcaacaagaggatctgatagtgtggatgcgaacggcagcactacctacattcagaaaactatatgggaagatagaggttgaccttgaagtgaatgatgagatagaaatagcaatagaaaacaattataacacatatgagtttggagggaaaaagaatttggttctctcaaccacaactgtcatgggaggaaaaaatcccttcttggggactgcatatcttttcgttggtggcctatccttgttctgtgccatagcattcatacttctctatgtcatcaagccaagacctcttggggacccgtcttacttgtcttggaacagaaatccagggagtatgaaatga

SEQ ID NO: 8519 - DNA, 1371 bp, Glycine max
  Peptide Sequence Number=SeqID_125297
gaagtggatgacgaggttgtgaatgaaagtttgtgccacacgaacctttttgatgaagagttcctaagagatattctgcaacggccacaagagggtgctccaaatcttaacaactcatccatcatgtcgtctctttgtgctcaagacattaagccaactaccttatttccaaccacttacatactctctttcgacaattccgctgcattgttaccaacagaaactgatcgtgatttttcttcttccaaattgccctcatcaaattcaagggccaaccatggaatcaagaagcctggaagcgcttcggagtcactgaatcacatcatgtcagagagaaataggaggcaggagctcaccagcaaattcattgcacttgctgccactatccctggcttgaagaagatggacaaggcccatgtactaagagaagctatcaattacgtgaaacaactacaagaacgtgtagaagagttagaagaagatatccagaagaacggtgtagaatcagagataaccataacaagatctcatctctgcattgatgatggcacgaacactgacgaatgctatgggcccaatgaagcacttcctgaagttgaagccagagtcttagggaaggaagtgttaatcaaaattcactgtggcaaacattatggaattctgcttgaagtaatgtctgagctcgaacgtcttcatctctacatatccgctagcaatgtcttgccttttgggaatacccttgatatcaccattattgctcagatgggtgacaaatacaacttggtagcgaaggatctagtgaaagaactgagacaagtggctatgatgaagcgaaaaggcgtgggaacgacggcagtgaagagttggatggtggtgtcggagacaggacattcgcggcttgaagatgttggaaaacactccataatgcgacgaactgggttgccggcgcgtgaccctagggttctcgatcccgtcctctcgtacccttcttccatcctaggacgcgaaagagccattgttgtcaactttgaacacgtcaaagccatcatcactgcctccgagctcctcctcatcaactcctccaaccctttctttctctccttccttcaagatcttcagacccgtctttccaatctaaatccctcccattgtgcagagactgtaaccggaacaccagctcctaataagccgttaccttttgagtttaaagtacttgaggagtgtattgaatctgcttgcaggtgccttgaatctgaggtagaggcttacccagctttagatgaattgacctctcagcttagcacactcaatcttgaacgtgttagacagatcaagagtcgtttggttgaactctccggtcgtgtgcagaag

SEQ ID NO: 8520 - DNA, 156 bp, Glycine max
  Peptide Sequence Number=SeqID_125298
atgtccgagagaaaaaggagacagctaatggcagagatattcatagcgctttcagctattatacctggctcgaacaagagtttctgcaatgcttttcaccatgaactgatgaggggcatacaatataaaaatcccatgttaataactctaaagtag

SEQ ID NO: 8521 - DNA, 222 bp, Glycine max
  Peptide Sequence Number=SeqID_125299
atgatgagagtcataagccagttgggcaaggtcttcttggtgctggggaagacagaatggagcaatcatattcatgggagaattgggctcttgacaaggaaatgggggaggatgaggaggagttccttcgcgacatccttagtaaaccggctttttcttccgagagtgaaagtcaagcaccagttgtctcatgctctgccaaaagcaaaagggctccgatga

SEQ ID NO: 8522 - DNA, 2552 bp, Glycine max
  Peptide Sequence Number=SeqID_125300
atgccagaaaaggtagagagccatagggctctttggtcttcttctattaattggcgttttgggttgctcactgctcttgttttgggtggcatggttgtggtttggagcgttgatggcttcactgttagggatgttattgaagcttggagctggagctccccatctattccacttagtttgaatcaaaaccaaaccaatgctactaccctttttgattcccacaatcttgtgaacatcacattgtctgagcacagtgaaactgtttctgctaagaactatagtagtagtggtgtgtctgataagctcgacacaaaaaccccagtgaagcctgaagttaaggggcattcaacttggctttcaagggaattagagccagacttgacttcaaatcttctagcaagatggttagctcctgggggagaaccttgtaaagattctaagacagtgggaatatcaattcctgggttggatggtgggaaactgatagagctatcagctggagatgtgcatgagtttggttttcaggcattggatgattcaggaaagcctcattgtttaggcggggattactttgagactgatctttcaggggacgcatggaaatctaggccattggtgaaagatttctgtaatggttcttactctatttctctgcaagttcatcctgattttgttggggtttacaatctgactataattctgctttatagacactttgaaggtctgaagttcactccatggcgatttgtctacgatcgagtggtttggaatgttgcaatcaggttctacaaaagcagtgctcagttacttgaacttgagacttgtaaagcttctgattttggcaaggatgtgtggtgtggaaggtggacaaggcatggcaggaatgatgactgccaaataggtaatgatggtaggtacagatgcttggcacccagttttccttgtaaagctccatggtgtgatggttcattaggagttatagagagtaatggttgggtgtattcaactcactgctcgttcaagatgtattcagccgagtctgcttggaagtgcttgaagaataggtggattttcttctggggtgattcaaatcatgttgacacagtacgtaatatgctcaattttgtcttagatttgcctgaaatacgttctgtccctaggagatttgacatgaacttttccaacccaaaagacccttcccaaacagttaggatcacaagcattttcaatgggcattggaatgaaacacagaactatctaggattagattctctgagagatgaaggatttcaaaatctgttgaagaagtacttctcagaagacacaatcccggatactgtgatcatgaactcaggattgcatgatggtgttcactggctcaatataagagcattttctgctggagcagactatgcagcatcattctggggagatgttatgatgtcagtgaagcaaagggggttaggttggccaagagtcttttatcgttccacagttgcaactgggggatatgcaagatcactagcatttaatccttacaaaatggaggtgttcaatggagtgctcatagagaaattgaagaaagctggcatcatcactggggtgattgacgactttgatatgacatttccatggcattttgataaccggtgtaacgatggagttcactatggaagggctcctgcaaagatgaagtggcgagatggcgaaattggtcatcagtattttgtggatctcatgttagctcatgttctgctcaatgcactgcattccctgtggaataatgcataccatagcagggctcggtcttcgtcgaagcaagcttcccctgatttgcaggacgacgaggaggagtgcaggccttggcgtcgaaggttaataatgtctttctcctggtcctccacccttaggatcaccatcctcctcctcctcctcgccgcggtcatcgtcgcgtgcttcactctccccatcgaaaagatgatgaaggacttcttattatgggtcgatcacgatcttggcccctggggcccacttgttctggctgttgcttacattcctttgactgtcttggctgttccagcttcagtgcttactcttggtggaggttatctttttgggcttccggtgggatttgttgctgactctataggtgcaactgttggtgccggagctgcatttcttcttggtagaacagattatccacaattcagatcagtggcaattgcaattcgaagatctggttttaagccaataacactggcacttgtatatgttggaacaactcttaaagatctttctgatgttacacatggttggggcgagttctcaaagactcgttgggcgtttatcattcttggtcttgtgatatcggttgttctgatgatatgtgttactagagttgccaaggctgctttagataaagccttggccgaaaatgaagatattgatgggattacttcctcgccagatttacctattgttgctgaaccatcagcagatcttaaccaacctctcataattaagatagattcttctgaagacagtcatgaaaa

SEQ ID NO: 8523 - DNA, 507 bp, Glycine max
  Peptide Sequence Number=SeqID_125301
atggctttaacaagaaatggacttgagagatttgtaataattaatataatacagaaggacaagagttctatgcttggcaaagcaattgattacgtgaaacaacttcaagaacgcgtgacggagcttgaacagagaaagaagagaggcaaagaatcgatgataatcctcaagaagagtgaagcaaattctgaggattgctgtagagccaacaaaatgctccctgatgttgaagcaagagtgacggagaatgaggtactcattgagatccattgcgagaaggaagatgggcttgagctgatcaaaatattggaccaccttgaaaatcttcatctctgtgtcaccgccagcagcgtattgccctttgggaattcaactcttagcatcactattatcgctcagaaaggacaaaaattaagaaagaatatgtatccatttgtggaaggtcattcaagcttttccggagagtatgacatggattacttcagcgctgtagcgttcgatacttga

SEQ ID NO: 8524 - DNA, 519 bp, Glycine max
  Peptide Sequence Number=SeqID_125302
atgaaacttagaatgtccacaagtggtggccaccccaagccgaggttgctaatcccagcgaaacaaccactaccagaaagaccaggagaaaaaagatgttgctacttgctaaccttagctgaactaaaagcggaggaggatttgttgctgaaagaaagaagaaatttgaaaaaagaactggcattcttgcgtctcactgttgagaaacatagagccacaaatgaaagcataaagagaaagaagcttgattttgagtcacggcagaattctagtgctgctgctacggcctctgaggtgtctgggaaagctgtgaatggctcatttcaatttgtaaaagcagagtgtcatccatctaattcagtctcacatgacgattcacctgtttgtgcagcaaatgtttctcccaaagcacaagataatattggtaaccaagaatctacattcgtgctccctgatctaaatttgcctgtcgatgaggatatcagcgccaatatcatgcattatattgaactaagctaa

SEQ ID NO: 8525 - DNA, 285 bp, Glycine max
  Peptide Sequence Number=SeqID_125303
atggaaggttcccaacaaaacactcactatcctaaggaaaaattgcctaaaattattacacacaaatggaagtttggtaacctattggaggctcccaacacacttccaatgaaagacctttttgttacaaaacttgaaagcaatgaagtgcttcttagtccaatagctcttaaggtggttggcccatttcttcttgactcaaattcttcaagggatggcaccaatcctccttccaatttcctatatggcaacccacaaacaaggacacaaagagacaagcaataa

SEQ ID NO: 8526 - DNA, 738 bp, Glycine max
  Peptide Sequence Number=SeqID_125304
atggaaaataataaaactttcattggtagtggaattcaggaggttagaacagtgcatcaccagaatttgaataagagaattctaatcgcactagttgcttgttctactcttcttggtggagtcttcctattcttgttatatgtctggttccgtcgacataaaaacttaagatgctccaaaagtataagccaagaaaccattgagactgcaaaaggggaaaccataagctcggttaatgctaaactgaactactctaggatggcagataaaaggagttcagttgccatttttgactatcagctgttagaggctgcaacaaacagctttagcacaagtaatattatgggtgagagtggttctagaattgtttacagagctcgttttgatgaacatttccaggcagctgtgaagaaagcagagagtgatgctgatagagaatttgagaatgaagtgagttggttgagcaagatacggcatcaaaatatcataaaacttatgggttattgtattcatggtgaatcgaggtttcttgtttatgaattgatggagaatggatctctggaaactcaattgcatgggcctaattgggggtcatctttaacttggcatctcaggttaagaattgctgttgacgttgccagagcattagaatatctccacgagcacaacaatcctcctgtggttcatagagacttaaaatgctctaatgttcttctggattctaactttaatgccaag

SEQ ID NO: 8527 - DNA, 159 bp, Glycine max
  Peptide Sequence Number=SeqID_125305
atggagaggattgagaatgagacagctcaaattgccagagctaaggccaaagaagagaaggctaaagcagctaatgactcgctcagcgaggtagatccgctcagcgagatgcatccgtttagcgaggcatcagctcccttagcggatgggaaatcctag

SEQ ID NO: 8528 - DNA, 2985 bp, Glycine max
  Peptide Sequence Number=SeqID_125306
atggacctaaggcaaatgtgtccatggctttgctatttacacggccatgttgaagcgcatgacaggggtcaaacacaacgagtcccactgctttgctattggattgaattgttagagaacaacatgggaagtctcgaaaacatcaagaacgaggcagttgatcttatttatgtattatattacatgcaatgcaatgtgattggcttgcaggagcggatacctattgatgaagtgttccgagaattgaactgttcgaaggaaggtctctcaaatgaggaaggccaaaagaggttgcaagaaagcaaggtgctaaaattcttgggttttatgtggaaccctctctcatgggtgatggaagcggcagccatcatggcaattgcattggcaaacggagggggtgagcctccggactggcaagactttgtgggaatcatggtgttgctagttgtgaactcaacgattagtttcattgaagaaaacaacgctgggaacgccgctgcagcgctgatggcagggcttgctccgaaaacaaaggttctgagagatggaaggtggtcggaggaggaggcttcaatactggtaccgggagacataatcagcatcaaattaggagacataatcccagccgatgctcgtctcttggaaggagatccactgaagatcgatcagtcagcactcaccggcgagtccctgccaacaactaagcaccccggcgatgaaatcttctctggctccaccgtcaagcaaggagagattgaggctgttgtcatcgccactggggtccacaccttcttcggcaaggctgctcatttagtcgacagctgtaaccaagttggccatttccagaaggtcttgaccgccatcggtaacttctgcatttgctccatcgctgttgggatgatcatagagattgttgtcatgtatccaattcagcaccgcaagtataggagcggaatcaacaacctccttgtgcttctcatcggaggtattcccattgccatgccaacagtgctttctgtgacaatggccattggttcccacaggctgtcggagcaaggtgctatcaccaagaggatgacagccattgaggagatggctggaatggatgttttgtgcagcgacaagaccggaactctaacactcaacaagcttacagttgacaagagtttgattgaggttttcgccagagatgctgacaaggatacggtgatgttgcttggagctagggcctccagggttgagaaccaagatgctattgatgcttgcattgttggaatgttgggtgatccaaaggaggccagagatggcatcacagaggtgcatttcctaccctttaatccagtcgacaagcgcacagccataacatacatcgacactgagggtaactggcaccgagtaagcaaaggtgcacccgagcagattatcgaactttgcaaacttcgggaagacgtcaagaagaaggctctttccatcattgataagtttgctgatcgcggtcttcgttcccttgctgttgccaaacaagaagtcccagaaaagagcaaggagagtgcaggaggaccgtggacgtttgttggtttgttgccactttttgacccaccaaggcatgacagtgctgagaccataaggcgtgctctcaatctgggagtgaacgttaagatgatcactggtgatcaacttgctattggtaaagaaactggtcgcaggcttggcatgggaagcaacatgtacccttcttcctctctccttggtgagcacaaggatgagtccattgctggccttccagttgatgagcttattgagaaggctgatggctttgctggtgtcttccctgagcacaagtatgagattgtgaagagacttcaggaaagggatcacatatgtgggatgacaggagatggtgtgaacgatgctcctgcgcttaaaagagcagatattggaattgctgtagccgatgcaactgatgcagctcgaggtgcatctgacatagtcctcacggagcctggcttgagtgtgattgtgagtgcagtgttgacaagtagagccatcttccaaagaatgaagaactacaccatatatgctgtctctataacaatccgaatagtgctgggctttatgctgcttgctctcatctggaagtttgacttctcaccttttatggttttgatcattgccatactcaatgatggcaccatcatgaccatttccaaggatagggtcaagccatctcctgtgccagattcctggaagctcagagagatttttgtcactggaattgtgcttggtacctacctcgctgtcatgactgttatattcttctgggctgctcatgcatctgatttcttctcggataaatttggcgtgagatccatcagggagaactacagtgagctcacagcagctgtttaccttcaagtgagtattgtaagtcaggctctcatctttgttacacggtcaaggagctggtcttatgttgaacgtcctggcatgtttcttcttgttgcctttttcatagcacaactgattgccacgctgatagctgtgtatgcaaactggggatttgcaaaaatgaaagggattggatggggttgggctggtgtcatttggctctacagcattgttttctacatacccatggacatactcaagttcatcatccgatatgcattgactgggaaggcatggaatactataactgagaatagggttgctttcaccacaaagaaggattatggaaagggagagagagaagcacagtgggctgcagctcaaagaacattgcatggcctgaatccacctgaaacggaggaaatgttgaatgaaaagaacaactatagggaattgtctgaacttgcagaacaagcaaagaagcgtgctgaagttgcaaggctaagggagcttcacacactaaaaggccatgttgagtctgtcgtcaaactcaagggacttgacattgagacgatgcagcaacactacacagtttag

SEQ ID NO: 8529 - DNA, 144 bp, Glycine max
  Peptide Sequence Number=SeqID_125307
atgaggtgtcacaccgaatttggagtagaagagcaagagcatgagaatggaggaaccaagcgtgatgacactgccaaagagtgtgcggagcttggtcactatgatgtccatgatttttgtgtggatccaaaatcacatatttaa

SEQ ID NO: 8530 - DNA, 1626 bp, Glycine max
  Peptide Sequence Number=SeqID_125308
atggcaagtagcggtgctgcaacagcggcgttgcagagcgatgcaagtagtagaatggaaggctggttgtaccttatacgcttcaaccgtattggacttcagttctctcggaagcgttacttcgttctcgatggtaaccttctccgcagcttcaaatcagttcctgtttcaaataatcaggatcctgttagaagcgcgattgtagattcctgcattcgagtcatggataatggaagggagagcgttaaccgaaaagtgttcttcatattcactctctataacacttcgaatcacaatgatcagttaaagtttggagcaagccgtcctgaagaagcggcgaggtggattcagtcctttcatgaagcatcgttaaggggtgcgcctgacggaggagatgatgctgtaggttgttctaagaggagatggcaatcctttagactcagtggatcttctagtagtataagtcacccaaattctgtagactggactctttcttctgctgatgttattgccccttcaccatggacaatctttggctgccaaaatggtttacgactattcaaggaagcaaaagacagggattctaatgggaagaaatgggatgatcaccctgcaataatggctgttggtgtggttgatggaacttcagaagccatcttccagactcttatgtcgcttggtccttcaagatcagaatgggatttctgtttctacaagggaaatgtggtggagcacttggatggtcacactgacattattcacaaacagctatttagcgattggttgccttggggaatgaaacgaagagatctcttgttgcggcgttattggaggagagaagatgatggaacttatgttattctttaccattccgtgtttcacaagaagtgccctccccagaaaggctatgtgcgtgcttgtcttaaaagtggagggtatgttatatcaccagtgaacaaaggaaagcaatcagttgtaaagcatatgcttgctattgattggaaatgctggagatcatatcttaaatcttcatcagcacattccataaccattcggatgcttgggagagttgcggcattacgggagttatttaaagctagactagggaattgttcttcgtctgattattcatctggagagttgacgagaaacagtgagcttcatataaaggaagaagtcatcatcaattctgatactgaaattcaggcagatgagaacaatcatgataattcagttggagaagtagatcaaacgcaatcagaacatgcatgccttgttactctaaatgatgctgatgatgagttctatgatgttccggagccgtcagactgtgacgagtcagaaaatggatggatgactgaatgtagtcaacagaagtctcaggcaaggaatgaaatgacaaagcttaaaaaaaagttcattgggagttatttagaaaggaaggagtggaaggggggggggggggctcctatacggttttcatatagccctacaaattttagcatttcttgtcaaatccattgggtgcttactgcaagcatgtttatcattgctcatgacattccaagaggtgcattcaaagtcggggctgcatctgggcatatctacttatcatcatttttatga

SEQ ID NO: 8531 - DNA, 195 bp, Glycine max
  Peptide Sequence Number=SeqID_125309
atggtaagtgaattcacaatgcctattcaaggttgcacattgtcagggcacaccttaccttcgaacaccaaaaagcttcaaacacgacaaagcgtacggtctgggcacgacggtggcccgacatgggagacactattgacggagtgcaatggaaagagcaacgatgtcactaacgggttcgaccgtagggtatga

SEQ ID NO: 8532 - DNA, 1656 bp, Glycine max
  Peptide Sequence Number=SeqID_125310
gagagtatcatgaaagagaatgagaatgaagatgatttagattatgagcttgatgatgcttctatcaattcagataacaaaaacaatattttcttgccagagatgaagatggttaaggatgaggatatcgagcccaaggcctcgaagaatactcagaggaaaaacaataatcagacacttagtatgaatgatgacaatgagaatagcctaggactaaatgacggttccctttgtgaaagtgataagggaaatcaaagtagcatttcactgccaaaattagagaaactgacaattggatcaaaaccacccaaagactttgtttgcccaatcacagaaatagcaagattatggaaagattcaaagactgatcctcagattgatgcttatttatcaaagccaactatcataagtgatgaaagacttggagaaacacttaacagtgcagattctgattttgattgcttggctactctacttaagaacgacttggttgaggctgctcttcttatttaccagctaaggccagtttttgctcagctttcagcacatgaacttacaccatctcttatgcaagtgattcagaacacaaacaaggggtcaaatgattttcagttagctatagaccccaaagatgtagacagagaaattcttgagcaaattttaataagaggggatgaatatagcaggtcccttaatgctttgagtgttatttctcaaaatggaattccagccttagcgaagtatttggagaggataaagggaaggaggttagttgtttccatacttttgtgttgtatgcaacctgaaaaaggttccaagagcttgatagcagacataattgaattgtctcctgttcttgaattatttcacggtggaaatgataatgtgagaggcatctatgtggagtttctattagaattggttcaattgaataggacagtctgcaaccagatattacagacaatcaaggatgaaggagcatttagtatgatgcatacatttcttgtatatcttcatatggctccaatggagcatcaacttgttgctagtcttcaggttgagccacgaaagatgagtatttacagggaagaaggtgtagagacactaatagaagcactttggcaaaaggatttctcaaatactcaaatgaaggctttggatgctttactatttcttattggacatgtaactttgtcaggaaagtcatatactaaagtttggctactcaagattgtaggatttgatcaaccttacaatgctttaattaaggccaagcggttggggcagtatgctttggaagaatgcctaaggattaattccttaaagatggaaaaatcttgccttgttcttgtcatatggctcacacacatgctctctacttttcctgataccgacataaaggatgttgcttgcaaatccttacttcatgaacttataaatgtcttacagtcatccaagaacttggaggaaaagatctgggttgccctagccttgaaaaatttcataaatgatctaattgctcaacaagaacttagagcttatgctaaaagcatctacaaaatcatgaggaagctcatcaaatattcaacaatagttgttgatattatgaaaaccttactaaacttaaactccattgatgtggtgagtactaagtag

SEQ ID NO: 8533 - DNA, 285 bp, Glycine max
  Peptide Sequence Number=SeqID_125311
atggcggctcgcggtgccaccggtgatcgtgagtggtggagaaggagcgtgcaaattctcgctcagcgcaacttcctttgcattatggctcgctcaccgagccaattctcgctcagcgtaattccctctcgggttggaattgcgcttagctcgaccttcacacttagcgagacatcaaaggttgttattttcaaaatcccaatggtcaaactgtggagaaatgtcttaggaagctctagaaatgaattgaagatgatccaacggttaacgaatacaagtttgtga

SEQ ID NO: 8534 - DNA, 1332 bp, Glycine max
  Peptide Sequence Number=SeqID_125312
atgaagggtgttggtgttgttgttttcccaaatagcttctgttgtgtggaagcaaggaatgacaatgatattgctaacatgaaggactcttggtttttcgacaataactttaatggtctgtcagatgagatttttgatgatgtcatcaacttttttgatttcccgctggaagacgtggatgctaatggtgtggaagaagactgggatgctcaattaaaatgccttgaagacccgcgttttgatgtttattcagcatcatcagctgggctgtgtgccgaaactcaaaatgagaagccccaacttggaatgaagttatctgcttctgtgagtattctgttcacagttatggaaacgcagccgatgcagctgcaattgcggtcacagcaaggtatcataataaaacttgtaataattaacaactctgagaaaaattgctacatttcatctgatactgacccaaaatgtgctggagatgctgctattatctgtatgaagttctctgtcattaattatgcacctaaagtttctggggttgcaagacaaatggaggaggaaggtaggaagcttggtgctaatctctttcctttgccattcaggttgcagaaacttcctctcttgagtaatgggatttccccaataaaacagctggcaaaagctcctggaccagcatatggaaagaccattccccaccagaatgtcacttccaatggaaaagatttgcatcaattccaaacctacacctacagcccagtttcggtttttgaaagtagcagttcgtcctcagttgagaattccaacttcgatcgacctgtcatcccagtgaagcgggctcgtagtaaacgtcagcgtccttcaaacttcagtcctctattttcaattcctctcatcgttaatttgccggctgtgcgaaaagatcaaaggacagcagcctctgactcagattttggaacaaatgttgctgggaatctatcaaacaaagtaaaaaagcagaggaaaaaggatttgtccctgctatcagatgttgagatgacgagatcctcatcaccagagtcaggtccccccagaaaatgcatgcattgtgaggtgacaaaaaccccacaatggagagagggacctatgggtcccaaaacactgtgcaatgcttgtggtgttcgatacaggtccggccgcctctttcctgaataccggccggcagctagcccgacttttgtagcatcgctgcactcaaactgccacaagaaggttgtggagatgagaagcagagtcatccaggagcctgttaggtgttctatgttggcttcatcaaatctccatggaaattctgtaggataa

SEQ ID NO: 8535 - DNA, 273 bp, Glycine max
  Peptide Sequence Number=SeqID_125313
atgacacagggtaatggtgatgcacttcaacacggtaaagggttattaaaaaaacaagacagtgacagagaagaggtcagagcatgccacataacaggaagaaatttgggaacaaatcagaagagcaaaagggatcaccctgcacttaaaataggatttggacatctgaactgctctgctgttttctttcggtttcaaaatggattgcgaatggagacttgtacttcgatccaactgctcctgcatccatgctttatgataagaaaaacatag

SEQ ID NO: 8536 - DNA, 188 bp, Glycine max
  Peptide Sequence Number=SeqID_125314
atggaacttatacgggtgccacattcatatattggtaatgaaagtgaggtcaaatatagcagctactaccctacaagccctcaagactcgagagaacagaggatgggcttgaaaaattcatcaaacatgggttcagtctctggtcaccttgcattgtggtatatgggtagtgttgagaatgctgtgat

SEQ ID NO: 8537 - DNA, 423 bp, Glycine max
  Peptide Sequence Number=SeqID_125315
atgcagttcacaacaccattccacaatgatatggacaccatagtggtgccttcttcttaccaccaacaatgtgcaccaaaataccctgactttgtccatttcagatatgatggaataacataccaaatcagactaagacaacatcaacaaaaaagacttccaaattgtgtcattacacatgttaatgcctgcagccaacacatgacgatccttagaaaatttggacctccactgcagtggaatgttgtgctccttgacattggaattggccacagatatgttgtacaaccatgttatcaattccttgtcgacaatgatttctcccacggcgatgaggtctccttctattacagacataaggataaaatatgggaaattatcatccgtcgcagtaaacactgggatgatagtgacactgaataa

SEQ ID NO: 8538 - DNA, 372 bp, Glycine max
  Peptide Sequence Number=SeqID_125316
atggaaatcattcctaactgtaatccacataattgtataagaccatcaacacctgggaggcttggcggcaaaggagcaaaggaatcacccctacaacaacaacaactttcaggtagcgatgaagtcgaggatatcggtgcccctgcaagcttgctttgttactataaagacgtttgcctgtactttggacttgaggagcctcatcatgacttggagttcgagttgactttggtggggtacgatgaacaaggcaacgttcttagttaccacatggagctagagattgaagagcacaaaaaactattgtggcagttagagccttctttcaaggaggagtatgacgatcttcttgaggacatgtcatatagttaa

SEQ ID NO: 8539 - DNA, 231 bp, Glycine max
  Peptide Sequence Number=SeqID_125317
atggggtttgaaatctaccctgaggttcatgagaaccctagggctttctttagccgctctagcctaatcctcttgaagtcttctatccaatacccttgggggtggcgtcttcaatcacctttcctctttgtccattccactgccatcaatcttcaagaagcaaaggactccattgatgaagaagatccaaggcctgccagctctacatggagctacatcatgtggtattaa

SEQ ID NO: 8540 - DNA, 2103 bp, Glycine max
  Peptide Sequence Number=SeqID_125318
atgaaggaaacagacaagagtttggatccgcagctgtggcacgcgtgcgccggcggcatggttcagatgccgccggtgaactccaaagtgttttatttcccgcagggacacgcggaacatgcgcagtccaacgtcgatttcggagcggcgaggattccgattccgccgctcattctgtgctgcgtggcagctgtgaagttcctcgccgaccccgaaaccgacgaggtcttcgccaggctgcggatggttcctctaagaaactccgagctcgactacgaagacagcgacggtaacggcgcggaggggtcggagaagcccgcgtcgttcgcgaagacgttaactcagtccgacgcgaacaacggcggcgggttttccgttccgaggtactgcgcggagacgatattcccgcggctggattactcggctgagccgccggtgcagacggtgatcgcgaaggacgtgcacggcgaggtgtggaagttccggcacatttaccgagggacgccacgtcggcacttgctgaccaccgggtggagcagtttcgtgaaccagaagaaactcgtggcgggtgattctatcgtgtttcttcgggccgagaatggggatctttgcgtggggattcgtagggccaagagagggggagttggtggggccgaggggccgtgcgggtggagtagttctggtggtgggcttgggcctgggcctgggcttgggcttgggcctgggcctgggccttacggggccttttcgggttttttgagggaggagagtaaggtggtgaggagtgggaggccgaaggtgagtggtgagtctgtgagagaagctgttactttggctgctagtaatcaaccttttgaggtagtttactatcctcgggctaatactccagagttttgtattaggacttctgctgtgagaggggctatgaggattcagtggtcctctgggatgaggttcaagatgccctttgagactgaggactcttccaggataagctggttcatggggactattgcttctgttcagcttcttgatcctatccgctggcctaattcaccctggaggcttcttcaggttacttgggatgagccagatttgctacataatgtgaagcgagtaagcccatggttggttgagttggtatcaaacgtgccaatcatccatctggcacccttctctccaccaaggaagaagcttaggtttccacaacacccagagtttccccttgactttcaatttccgataccatcattttcaggcaacccctttgggtctagcactagcagccccttgtgttgtctatctgataatgctcctgcaggcatacagggagccaggcatgctcaaattggaatatctttatcagatctccaccttaacaataagctgcagttggggttgcttccgactaacgtccaccagcttaatttgcacactgggatttgtaatggcaacatcaccaaccatggtaagagtaaagaaagtctatcatgcttgctgaccatgggaaattctaacaagagtttggagaaatctgatcatgtgaagagacaccaatttttgcttttcggtcaaccgatactcaccgagcaacaaatctctagatcttctagtgatgtgttgtctcaaaattttactgtgacggatgatgagaataaggagaagaaggagaagggatttcttagtgactcccagtcttcagtttcacccggaaagtcatcttctaccaccgagttctcttggcaagttggttcggataccagtcattgcaaggttttcatagagtcagaggatgtgggacggacccttgacttgtcctgtcttggttcatatgaagagttgtacatgagactggctaacatgtttggaatagaaaggtctgagatgttgagtcatgttctctaccgtgacgcagctggtgctcttaagcaaactggagaggaacccttcagtgagttcatgaagacagcaaaaagattgacaattctgacggattcaaacaacaaagatagtagaagggtttggatcacaggaattcgaaatgctgaacatggattggatactgcatcaaataagacaggtcctcttggtatatttgcttaa

SEQ ID NO: 8541 - DNA, 270 bp, Glycine max
  Peptide Sequence Number=SeqID_125319
atgggaagggggaagattgtgattgaaaggatcgacaattccactagccggcaagtgactttctcaaagaggagaaagggattgatcaagaaagccaaagagctagcaatcctctgcgacgcacaagttggccttgtcatattctccagcacgggaaagctttatgaatatgccagcaccagaaatttcactcttgaaaaatatgatgcaacaaatatgcatggctacaagttcaaagagatcacgttcaaggcatgtgatcgatactaa

SEQ ID NO: 8542 - DNA, 378 bp, Glycine max
  Peptide Sequence Number=SeqID_125320
atggttttacctttggaaactaaggtgaaggataagcagaggttcggtagggttttgggtttggggatgagttcgatttcagtgttgtttgatttatttgggggtttaagtgtgttggttcagttggggtctgggatgaacctggtgaatgaggtgatggagagacggttctacgggtcaaggtattgcttgtggccgaggtgggtgatggagttggtcataagcttggtggcgcttttgagagtttcctataaaaatgggaaggctttaagctttaaatatggtagcaaacagttcaaaaagaaagggggcctggcagctagaactgccacaagcaatgtgttccgtagtgctggttacaagtttattgacggatag

SEQ ID NO: 8543 - DNA, 780 bp, Glycine max
  Peptide Sequence Number=SeqID_125321
tcacgtccatcagaaaatctgagcattccatttttagagactccacgtccatgctcaaagccgcaagtaccttccatggatacccagaaggagaagaaggaggaggacaaagaacaaccccatgagtctgctccacaccttgcactactggatctaagtctccctagtaaagattcaggcggtgatgatgatgagtcaaagccactcaacctcatcaactgtatcgatacaaatttgtccatgaactcctcagaatctagtcatggacatggtgatgaattggagccccggatattctcatgcaactactgccaaaggaagttttatagctcgcaggcacttgggggacaccagaatgcgcataagcgtgaaagaacattggccaaaagaggacacaaagctggtgctgcagtttccatagattttgcacggaggtactccaacatcagcatggcttctctgcctttgcatggttcctacaacaggtcacttggcattcaggcgcattctatgatcaacaaaccctcttatcaaacacaaacacccttttctggtttgtcccgttctcatgctcagaagcggcttatgttctcacaaccgccaattggggcagaaagtgaatcatctttgactggtggcatcccagtcccacggttagggaagttttctccaaggctggtgccagagggatttggaggttactggttggatagtattaaccatttgaagactaaacaagaggatcagttgcacaagcttgacttgtccctcaaactctaa

SEQ ID NO: 8544 - DNA, 159 bp, Glycine max
  Peptide Sequence Number=SeqID_125322
atggtgaagaagacttcatcaccgtatgaattgatttccaacgacaatccgggaactagacgaggaaaaggaggaacaatgcgtacaaatgttgtgcacaatgatgaaacaagtgcagacaccaggatctcagaaggagacagttcagatgatagatga

SEQ ID NO: 8545 - DNA, 138 bp, Glycine max
  Peptide Sequence Number=SeqID_125323
atgaaaagacttttttatgttcccagcatgaaatcactgatcgagagatataacacatgcaaggaagaacatcaccatcagatgaatccagaatccgaagtcaagcaactgagaagtgagaacagtgacaacccttga

SEQ ID NO: 8546 - DNA, 327 bp, Glycine max
  Peptide Sequence Number=SeqID_125324
atggagtcagatcgagacccatggttgggaatggacaagttgtatcacgtcctcatgtgtttctcgctcacatttctcttctacgcccttgcttctctcaccccttacccataccgacgctacgctatttccatcggatctgtgctttctctcctcgccggcgccgccaaagaggccgctgatcacctcggctacttccgctcttccggagcttccctcagggacgcccttgccgacatccttggcgtctgcatcgcttccttcgctctttctcttttccgatcccctcctccgcctcctcacctccgcgctctctcccttgtttga

SEQ ID NO: 8547 - DNA, 354 bp, Glycine max
  Peptide Sequence Number=SeqID_125325
atgcagaagcagcattcatttacctccatcttagactacttacaagaaacattaatactatgtcccaacaggcaattgatgggagaacagctatatggtctaactgtcagaaacctacaagatctagagaatcaactggaactgagtctccaaggtgtccgcatgaaaaaggaacaaattctgaaagatgaaatccaagagctgaaccgaaagggaaaccttatcttccaggaaaatgtggaactttacaagaaggagggaatccacaagaattggtccaacttcagttatgccagcctgaacaagaagtttgtgagacattggacactgccacaaaatgaaggtcacgtctaa

SEQ ID NO: 8548 - DNA, 1047 bp, Glycine max
  Peptide Sequence Number=SeqID_125326
atgagggatagtgatgatgatgaacttcatgacagagactatgatgttgcagctctagcaaataatttgaaccaggcttttagatataaaatttatgggaatgaggataacgaggaggaacgtggcaaccttgatcgagatgatgaggatgtctactttgataatgactctgcacaagtagtcatatcatccctcagactcagtgacgatcaagggagtagtctgtttacaaactccaactggtttgaattccaagatgacagaattggtgatgcaactgggggaacaacatcatcggagatgatggatgagataaacttgaatggtgctgcaaatggtggcaacagtagtgatgatgaggtagtggttggagaggatgaagaattggatgaaagcaaaaataatctgaatggtacatctagctcaagcacaaacttaaatggaataactggtagtgattccatgaatggagacaccttgaactttgaaagcaaaaagacaagtgcttcacatgatatgggattcttcaggtttgaggcatcggacaatgaagagttgtttggggacaggcctttgcctgattgggtgggatggggtgaaccttcagatatgcaagatgctggatcaagcaagaacccatttatagatcacgatgattcttctggtagcaacctttgtactaccaaacctcaaatagatagccctactccgagtcctccttcaaatggggaatctgttccttcaaacaggtcaccaactaaagaagattcgattgatgggggtgttgactcgagtcaaagagcagtacctgtaccatcgctcttcgaagaagatgttgaatttgtaggtgtagaattagaaggtactgagaaggctatggaacaggctctgaaagaagggatagttggggaggcaggaccattgaaaagaaacatggtctctaaagtgccagaaaaggaaagtactgacgagggtggtcctggaataaaggaattcaatgatgcaaattactggagggttgaccaggaggttgctgttctagagtga

SEQ ID NO: 8549 - DNA, 294 bp, Glycine max
  Peptide Sequence Number=SeqID_125327
atgatttactgcactaatgatcggttgaaatttactttacaagaagaaaatagattactgatgatagaagaaggatatgaagatgcacaaaacaacaaagaggatgtagaagttgattacagtcgtgattcggaaatgagggcatttgggactatggtagcttggccaggtgagttgatgcttagtctagaagaaaacgactcgcctaggcgagctgtttccttcagccctaagcaatttgggggcccgggcgagccagaggcgagccagggtccagaaaatttcctgaaatga

SEQ ID NO: 8550 - DNA, 249 bp, Glycine max
  Peptide Sequence Number=SeqID_125328
atgaaggttgaacaactctttgcttgtcatcatattagtgaagagagaaaagttccattggctacctttagcttccaagggtatgccctctattggtggacttcacttgttagggaaagaaagattcatgcggatcctctagtagatattggaatgatattaagagtgcccttaggaagaggcacatttcctcctactctaaaagggagcttatcgacaagctccaaaggcttagatatgggagtatga

SEQ ID NO: 8551 - DNA, 186 bp, Glycine max
  Peptide Sequence Number=SeqID_125329
atgaggattcttttgataggccaaggtgtcagtctcgggccgaacttccatattattccacaaggcacgcgcgacagtgatgatttggaaacaacgtgcaaaattagtcatggccacagccaggtgggcactcaagcatcccatttacggcattgtgatactacggtcgggaatttacacaaatag

SEQ ID NO: 8552 - DNA, 717 bp, Glycine max
  Peptide Sequence Number=SeqID_125330
ggcctcggccgattcgacgaaggcggcgcgcaggaagcgggcgccgccgttgatccagtccggattgatcatgctgttcaggtcgccttgcagcttcagcatcgtggccgcctgggcctggttcaatccgacaacgttattcactttcactccgggtattcatggggtctatgcgagggcggcggaaatgttagcaccattgccgccgaggccgggccgcttcagccgtccttgcggtacgacgaggtcttgagcggcggcagcttttccagcggtcgcttgcgcgggtcgcgcgcgccgctggccgccttgaacagcatcagcgcgaaaaagcccaggaacaccgccggcatgaagtcgtccaggtcgaagcgcggcgcgtgcagcgccttgaaggcgacgttgacggcggcccagccggccacggcgccggcgatggtcaggaagatgccctgcttgcgctggcgcgcgcgcttggccagcgagaccgcttcggcgtcggtctggcccggggcgacggtggacggcacgctgtcggcgcggtgcgattgcggcggcgccgtcttgccccaggccaggtcattcagggatcccgggctcggggcgggcgccggcgtgggcgtggcgaccggcgcggtcgcttggcgcctggtctcggtcttgctcggcacccgtccgggcgtggcgccgcccgcgcgcgacaggttttcgatgtag

SEQ ID NO: 8553 - DNA, 276 bp, Glycine max
  Peptide Sequence Number=SeqID_125331
atgtcttcctccttcttcctaacatttcctaccccatcaaaaacatcttgtcctcaaggtgttgggtgcagaaaacagaacatgagtaaaatagaagctcagcctgtgccaatcatggttgtggttgaggcagtggcttcggtggtgaatccaaaccaagtgcaaaagaatctgatgctttacggcatcgtcgtcgagcaagatggtgtcattgctgtaaggagttttggggcaatggccatgaaggtaacgacgatgggtggggcggatcaataa

SEQ ID NO: 8554 - DNA, 1410 bp, Glycine max
  Peptide Sequence Number=SeqID_125332
atggccgaaagttttaagaggacaactgaatcggcaacccaagtggagacaatattagacaaggagaatttcactttggaagagcttctggacgaagaggaagtgatccaagaatgcaaggccttaaacagtcgtcttatcaactttctgagagatcaagcccaggttgagcaattgttacgatacattattgaagaaccaccagaagatgctgaaaataaacgggccttcaagtttccattcattgcctgcgagatatttacatgtgaaattgatgtcattttgaagaccttggttgatgatgaagagctgatgaacttattattctcttttttggaacctaatcgctcacatagtaccttgttggctggctactttagcaaggttgttgtttgcctaatgattcgaaagacagtgccacttatgaaatatgttcaagcccatcagaatgtttttcgccaactggttgatttgataggaattacatccattatggaggttttggttcgattggtaggcgctgatgaccatatgtatcacaattttatagatgtgatgcaatggttggctgagagcaacctgcttgagatgattgttcataaattgagtccatctagtcctcctgaagttcatgccaacgcggctgaaacattgtgcacaataactcgaaatccctcatcgactctagcaattaaactttcaagcccaagttttgttgccaaaattttggatcatgcactggaagattcacaatcaaagtctagccttgtgaactcactttcagtgtgtgtttctttattggatcccaaaagatctgctatatcatctcccctttttcattcatttcgaagtcaacacatgtatgagccacccattcctgtaaacccagacactattggtgctatgctacctaaattaagcgaattgcttatgcttttgaatgtatcatctgatgaaaaagtattgcctacaacatatggagaattgagacctccactcgggaagcatcgattaaagattgttgagttcattgctgtccttctaaaaactggaaatgaagtggcagaaaaagaaatggtcaattcaggaaccattcaacgagtcattgacctcttctttgagtatccatataataactccttacaccatcatgtagaaagtatcatattatcttgtttggagagcaaaactaatgccattgttgaacatcttcttcaagagtgtaatttaattggaagatttctccaagcagacaaacgttctactctctctgctgacataaatatgccaacagtacctgctgctggaaaacaagtgccacgggcaggaaacattgggcatattactcgaattgttaacaaacttgttcacctggctcataatcgaaacctcatactgacatgtcttcag

SEQ ID NO: 8555 - DNA, 351 bp, Glycine max
  Peptide Sequence Number=SeqID_125333
atgtcagtgaaaaatctcgtcgagtgccaagaagtatatgacaagacaaaccacacactggtgagtcaagttattctcactctattttgcaagaatgctccaactatatgggatcaacatatgtttaaaggaacactcaaatcgagtgaatttacccacaaggcctacactctgaagagtccgttaggatttctccctcctgattcaggaaaaagaaaataccgtggaatggatattgctctcactatatatcgaaggtggcacgatggagacacaaccatggtcggaggtgtcgactccaaaggcacaatgacccgcatggctagaggcgttagcgcaaggcgcaagtga

SEQ ID NO: 8556 - DNA, 1908 bp, Glycine max
  Peptide Sequence Number=SeqID_125334
atggccaaagaagagaatgaagcagactctgaagaacaatccttgctgctgatgatgattactgattcagaatctcagaataatgaaatctggtacatagattctggatgctcaaatcatatgactggacatagggattggcttgtcaattttgatgcaatgaagaagagtaaagtaagatttgtagacgacagagtcatacaggctgaaggagaagggaatgtggctgttagaagactagatggaagacaagcaatgttcacatatgtactctatgttcttgggatgaagagtaacctgataagtatgagtcaactcctagagaatggattttcaatgaaaatgagtaatggatctctggaagtctatgatacagcaaaaaaaatgatcgtgaaagctctattggctagaattagaacattcaaggtcaagagtgaagtgttcgatacctttaagggattcaaggctttagtagaaaaacagtcaggaaagtgcatcaagactttcaggattgatggaggaggagaattcacttctagtgagctagaagatttttgcaaggagcatgaaattgtgcatgaggttactgccccctacactccccaacataatgggatagtggaaagaagaaataggactatattgaacatggccataactgaaacaattccaagattgcagcttgattgggaagaaattgactcaagaaaagaagccacacaagacctagaagaaacaaaaatttcccctcaagactatcagattatcaactatatcctgataatgctatctctgatgatgaaggaaggaatagattacacagaggtttttgcccctgtagccagacttgagactgtgaggttagttattgccttggctagttggaaaaattggaagttatgggaactggatgtgaagtcagtattcctcaatggaccacttgatgaagatgtgtttattctgcaacctcctgactttatatgcaaggggaacgaacacaaagttttgaagttgaggaaggcattatatggattaaaacaggcacccaggggctggaacaagagtattaacacttttcttcataatattggctttcagaaatttactgctgagcatggagtttacataaaatttgtgaaacatactgaaattatcatcatttgtctgtatatggatgatctattacttactgggaatagctcaactgggattgactcactaaaacagaatttgaagaaggaatttgaaatggcagacctgggaacattgtcatactttctaggattggagtttgcatacattgcacaaggaattttcatgcaccaaaagaagtacacttcagatgctttgaagagaaactccaacagaggtgaatttgaagctgcaaaaggtgagaatgaagcctcaattgatggaaccttgttcagacagattgttggtagtctaagattcatctgccacagcagaccagagatcacattcaatgttggactggtgagaagatttatgggtgaccctaggcaatcacacttgttggctgctaaaaggatcatgaggtatctaaaggggacattgggatatggaatcatcttccctcatcaaaccaaagaggatgataatctacatcttgtagcctattcaaactctaattggtgtggagatttggttgataggaaaagcactatgggacagcaaatcaactatagatttggtcaagaatccgtagctcatggaagaagcaagcatatagacactaaattccatttcctcagagatcaagtaagtaaaggcagaattaaactaaggcactgcaggtcagaagttcaattagctgatataatgactaagtcattgaaggctgaaagatttaaagaattgagaacgctactgaatgtagtttacttgtaa

SEQ ID NO: 8557 - DNA, 552 bp, Glycine max
  Peptide Sequence Number=SeqID_125335
atgaaggatggcatgcaagttgcaatgaaaattcagtaccctggtgtggcagatagcatcgatagtgacattgagaatgtgaagcttcttttaaactacacaaatttaattcctaaaggactttatcttgacaaacctatgaatggaacgttacctagaggtcaagatgtagcagtaaaaaggcttttaggtgtttccactcaaggcttacaggaattcaagaatgaggttattttgatagcaaaacttcaacatctgaaccttgttagactcaggggctattgcataaaaggagatgaagatatcagactttggccatgtagatatctgaaggagttagatgaacttagaactcaacttgtagcaaccagagcaactgttaatcataaagaccgtgtcctaaggctaggggagcaactagacaatttacaaaaggatcttcaagcaagggaatcttcacaaaagcaattgaaagatgaagttttaagaattgagcatgatattatggaggctctagcaaaagttggagagaacaggaattgtgaactgtag

SEQ ID NO: 8558 - DNA, 540 bp, Glycine max
  Peptide Sequence Number=SeqID_125336
atggagaaagcaaggaaggagattgactctatcattggcaaagacataatggtattggaaacagatatagataatattccttctcttcaagccatagtgaaggagacactgaggcttcaccctccatctccatttgtattgagagagtcaactaggaattgcaccattgctggatatgacattccagcaaagactcaggttttcactaatgtgtgggctattggtagggatccaaagtactgggatggccctcttgagtttaggcctaaaagttggattcaggggacaacattatcaacttttgcttttgggagtggaagaaaagggtgtcctggagcttcactagcactaaaggttgctcacaccacccttgctgctatgattcaatgctttgaaatgaaggctgaagaaaaaggagggtattgtggttctgttgacatggaagagggaccttcatttattctttcaagagttgaacccctgatttgtgtcccaaaatcaagactcatgccattccctttgtatcatgctaaatactag

SEQ ID NO: 8559 - DNA, 558 bp, Glycine max
  Peptide Sequence Number=SeqID_125337
atgtcatccaattgtttagccatcatcagattcactgcaccatttcatgttcaaaagaaccttctgcaagtcccattctcttttcataggcaatggttgtacagatacccaaagtatgttttattccactatgatggcaacaaatatttcattcgagtaaggaggcacggtggcaaatgtttttttgctgatggcctaaaggaatacagaagggcacacgatctaaatgagagtgtcattctccgttgtgttgcttctgacaaaaatactactttctcggttcatatacttccagcagcagcatcaagatttgtccatgcttcaaagaaatttatcacccttcaacgaggactggcaaaacgcacccactgggacatcaccatccataatgatgtcccatcagttgccgacccatggttccacttacttgatgaaaaaaaattgatccccggagatgaggtagtcttctactaccggtttgatgaccatgcatgggaactgctggataagaaagatattgaatgggagaacgacgacatcaactttgaagaaatgtaa

SEQ ID NO: 8560 - DNA, 735 bp, Glycine max
  Peptide Sequence Number=SeqID_125338
atggaaaaccatagatttataagcaagtctgattcaacaaaagccaagagcaacagaaagcgtattagacaacaaaaagtccatcttgatgttcagcatagtgtccaggcaagtctcaatccagcttcatcccacactgaagatgattataaccaaccaaagacaccacctcatagtgttcatgcaattgccgatcgggctccacacgatgctgaagatcattttaatatctgcgattcatctgagaatgagacttttggatcagcagaagaatctgagactatttcttcagttcgatatccaaactgtgaatcctcgcatcatgattcttcaatggacacaggagaatattttgatcttggtgaccagctcatacaatgtagacattgtaatgctaaaatgtggtatcatgaaaacatatcaaaacgttcaaatgcctcaagcccacgattcagcctatgttgtggagatggcaagattgaacttccattgttacagaatccacctaaatttctgcagcaacttctatttgagcaaaatacagcttatgcaaaaaattatcaacagaacataagaacttataacatgatgtttacatttacttatgctggtattaaatttgacaaaacaattggtcattccagaggtcctcctacaatcagaattcagggtcaaccctgtcacagaattggaagtctattaccaatgcctggaaaagaacctaaatttgcataa

SEQ ID NO: 8561 - DNA, 1479 bp, Glycine max
  Peptide Sequence Number=SeqID_125339
atggggcctgggtttcttgtttccattgcatatatagatccaggaaacttcgagacggatcttcagtctggggcacaatataaatatgagttactttggatcatattgttggcatcatgtgctgctcttgtaattcaatcaatggcagccaatcttggggtggtcactggaaaacacttagcagagcactgtagatctgaatatccccgggtgcccaacttcatactttggattattgctgaaattgccatagtggcttgtgacattcctgaagtaattgggacagcctttgcattgaacatgctcttcaacatacctgtttggattggtgttcttctgacaggactcagcacattgatcctcttagcattacagcaatatggggttaggaaacttgaattcttgattgcatttctagtatttacaattgctgcatgttttatggttgagcttggatatgcaaagcctgatgctaaagaagttctgaagggtctttttgtgccaggactaaaagggagtggtgctactggtcttgcaatttctcttcttggagctatggttatgccgcacaatctcttcttgcactcagcactggtgctctctaggaaaataccacgatcagttctgggaattaggttggttgataaactgttaaggtttatgtcttctgatcatcttcctggggttaatctttgtctgccaatggctcaccttctcttagtgttgcacaagttttacatgatagaaagtgcttttgctctcatggtggccttcctcataaacatctgcgttatttctgtaagtggcactgtttgcaattcttcaaatttgaatgctgaagatcaactgagctgtcaggatttggatctgaacaaagcctccttcctactcagaaatgtcttggggaaatggagctcaaaactatttggaattgctttgcttgcatcgggtcaaagttctactattacaggaacctacgcaggacagtatgtcatgcagggatttctggatttacgactggagccatggattcggaatatgttaactcgttgcttagccatagttcctagtttgattgttgcagtcattggtggctctgctggggctgggaagctcataataattgcatctatttcggctgttacttggataatcggtaccctcctcatggccattaatatatactacttaataactggcttcatcaagctgctgcttcatagtcacttaaaaattgtggctaaggtgtttcttgggatactaggattttcaggcatggcaatgtatttggctggtacaacatatctagtacttcgcaaaaacaaagaggctacacaccttttggctctaacagcaccagaaaatcaacaaatgacaaatgaactaggcaatggttcaatctattctcttccaagagaagacatagtaagcatgcaattgcctcaaagaagtactcctgctcctgcagatgttgactga

SEQ ID NO: 8562 - DNA, 897 bp, Glycine max
  Peptide Sequence Number=SeqID_125340
atgacacttttgctttacaccagtgcgtcaaagacacttttgctttacgttagtgcgttagtgacacttttactttacgtcagtgcgtcagggacacttttactttatgcagtacgtcaaagacacttttgctttgcgtcagggaatccaatgcttcaaaccctaaccctaggtcataaacccttaactctgacccctatatatagaagtcatattcgccttcatttaacacattcccacaatactttcttcctctgttactttcttccaactttgcaaacacaaaccttttgtcatattctttctctaatactcaacatgtcttccttatctatcaattgtttagtgcactacaatggtcaaataatcaaaatagatgaaggggatatgtttcaatgcccttacccgatgttatttcaaacaaagcgaggcctcacacttgaagccttgaaaagaaaaatccacaaagggctccaacttcaaccactagaccaacagagcctagcttacctaacgaagaactcagtccctttagtgaggacaaagatgaagttatatgcaatcaaccccaggaagatcataagaaagaagctggttgagcttagaggtgtagggcagtatacatccttgcaagtcgatggaacatggttgtacggtaagtacaagggaaccctccttgtgacagttgcacaagatggcaacaataaaatccttccaatagcctttgccattatcgagggtgaaatagtggaagcatggctcttcttcctcaaaaatttaaaaagacatgccaccccacaacatgcatatgcaaggacaaaccctacattcaatcactactacaacattttgagggaggaagcagaggatgatcaagcaattaattggctcagctag

SEQ ID NO: 8563 - DNA, 156 bp, Glycine max
  Peptide Sequence Number=SeqID_125341
atggaagataattctacgttgcatgctctaatttgcaaggaattgaacgatagtacaaacaacaccatgtgctcattgtccttagcgaaagtgactgtcgcaacctacccttcagcggtcgacaagggtgttgcccttgcttctatgtatcctcag

SEQ ID NO: 8564 - DNA, 279 bp, Glycine max
  Peptide Sequence Number=SeqID_125342
atgaaaaaagatgatggtactcactatcataccctaatttcgtttggggacaattgtttgtcaacatgcgaattttcgctggccaagttgagccgcttaacatcaatcactacggaatctgatttcgcgatgtttcagaaagaaacgggcaaagaactcaaggtaggggcaaaagggtccattctggataacttaggggagaagcaaccagctcgcctgggggagctgctcgcctgggcgagctactcgcctaggcgagcaaggttgtttttgaactaa

SEQ ID NO: 8565 - DNA, 1516 bp, Glycine max
  Peptide Sequence Number=SeqID_125343
atggaccggcgatcccatcccacgggcaccgtcagcacccggaacatcctcttcaacaagtacgagattggaaaattgctgggacagggcaacttcgccaaggtgtaccacggcagaaacctcagcacaaacgagagcgtggccatcaaagtcataaaaaaggaaaggctccagaaagagaggctcgtgaagcagatcaaacgcgaggtctccgtcatgcgcctggtgcgtcacccccacatcgtcgaattaaaagaggtcatggccaacaaagccaaaatcttcatggttgtcgaatacgtcaagggaggggaactcttcgccaaggtagcaaaagggaagatgaaggaagatgtcgccagaaagtactttcagcaactcatcagcgccgtcgatttctgccacagccgcggcgtcacccaccgcgatctcaagccggagaatctgctcctcgacgagaacgaagaccttaaagtctccgactttggcctgtcggcgctaccggaccagcgcagatccgacgggatgctcctcacgccgtgcggcacgccggcctacgtggcgccggaggttctcaagaagaagggctacgatgggtcgaaggctgatatatggtcctgcggggtcatcctctttgctcttctttctggctatttgccctttcaaggtgaaaatgtgatgagaatttacagcaagtctttcaaagccgattatgcattccccgaatggatttcccctgcggccaaaaacttgatctccaatttactcgttgtggacccgcaaaagaggtattccattccagacatcatgaaggacccttggtttcaaattggcttcttgaggcccattgcgttttccatgaaggagtctgcgcttgaagataacattgatttcagcggggatgatgttcctagtcctggtagtgatgatggtaatagcagcagcaacaacgaggatggggagttgacgggggctaagcctgctcgtccgtcttacaacgcttttgagataatctcgtccttgtcgcatgggttcgatctgaggaatttgtttgagacgaggaagcggtcgccgtcaatgttcatttccaagttttcggcttcggcggtgatggcgaagctggagggggtggccaagaagctgaactttagggtgacggggaagaaggagttcatggtgaggatgcagggggcgacggaagggaggaaggggaagctggccatgacggtggaggtattcgaggtggcgccggaggtcgcggtggtcgagttctccaagtccgccggagacacgcttgaataccttaatttctgtgaggaccaagtcagaccttcgctcagggatattgtgtggagttggcaaggggacgctaattgccaccagtcaggaaatgagggctttcaagtttcaaacaataacgaggaccaccatgacgtgattagctcagcagtccagcacgacagcgatgacaacaaccaccacgacgcgagtagctcagtgagagtcattttggggg

SEQ ID NO: 8566 - DNA, 201 bp, Glycine max
  Peptide Sequence Number=SeqID_125344
atgaagatagcgatgtgggaattggaattggtggaggtgggagagacccagatcgaagggcttaaaccttttaatgatgaagagggtgtcgaaaggacacaccacgttctggagaaagcatttggaggggttgaaaatcttcatggttgcatgcagcagaggagaggggaagcaaaagcaaaagcagcgcttaaggcgtga

SEQ ID NO: 8567 - DNA, 369 bp, Glycine max
  Peptide Sequence Number=SeqID_125345
atgaatggagccagagatcaagaccctgcgcttgccgtcgatgaccaatgctctgtgatcatactctacattggcgcagaacaacttgggagtgtgaatgcagagcaaccaaaacagaaccaacacaatctgtgccgtgagaaaaggacacgccaggtgacagatgtgtgtgttaacgaagacaaaaaggttgtcggtgagatcgtcgtgttgctctgcgtgtcaatggtggagggtggagagtggagcacagaggaaaatggggtcttttcaatcaatgtgagaactgagaacaatggcggtcaaaaatggatagtgagaagagaactgagaagagaaagtgggatgtggcgtacggtgaaacaatga

SEQ ID NO: 8568 - DNA, 1245 bp, Glycine max
  Peptide Sequence Number=SeqID_125346
atggttgaatcggaaaaacttaactacatcaggaacaaccaaaagaaactcagagttgacaaatattgtagcttacaaaattcactagatgatgggacaatccaaggtttaaataaaggcaagagagtaatttggccttctacctttgttgggagcccgcgctacatggatcaactatattttgatggtatggcgatatgcaaccacgatttcccaaatctttttatcactttaacatgtaatctaaattggcctgaaatccatagattacttgcgccattgaatttgaaagtagcagatagaccagacattatgtcacgagttttcaagttgaaatatgaagaaatgctttcagacctaacaaagaatcacctacttggaaaagcagtggcatatgaaattgaccagattatatcagcagagataccttcaaacgaagatgacccagaactgtatacattggtgcaaaatcatatggttcatggcccatgtggaattatatgctttgaatctccatgtgccatcaataaacctgaagaagtttggaaccaaacttggcattggttagccgatgacattgcatatcattatagcaaatcaacaataaatacagaattacatatcgatgataatcatctaagtaatttggcattgctcgagattgaacaactattgcacgtaaaacaaaaatcacttaaagactatccttcaatgtcatatcctgaggatgctgattgcacgtcctatctagacaatagcctgatattagcagagctaaattacaacaatgatgagaccaatgagcaaacatcaattaataaccaaatcattgaagccgtcaacaaaaatcaaggtgacatgtttttcttatatggatttggaggtacaggaaaaacatccatatggagaacattggcaacttcattgagagcaaacaatcaaattgttattatagttgcttccagcggcataacttctctattgttgccaggtggcaggactgcacattcaaaattcaaaatacttgtacccatttttgaagactcaacatgcaacattcatcaaggaagtgaattagctgaattgctaaatcaaacaagcctaattatttgggatgaagcaccaatggctcacaaattttgttttgaagtgcttgtccaaagtttaagagatataattaaaactaaacctagttcaaatcaaatatttggagttaaagtcatggtatttggtggagacttctaa

SEQ ID NO: 8569 - DNA, 840 bp, Glycine max
  Peptide Sequence Number=SeqID_125347
atgaagagattcactgccaaaattgtggatatgatcaagcaagagaagctatatgcctcccaaggaggacctgttattttatctcagattgaaaatgagtatggaaacattgatacggcctacggtgctgcgggtaaatcctacattaagtgggcagcaactatggctacatctcttgatacaggggttccatgggtcatgtgtctgcaagcagatgctcctgatccaattattaatacatggaatggattttacggcgatgaatttacaccaaactctaacacaaaaccaaaaatgtggactgagaattggagtggatggtttcttgtgttcggtggtgctgttccttaccgacctgtggaagatcttgcatttgccgtggcacgctttttccagcgaggaggaacatttcaaaattattatatgtaccatggaggaaccaactttgaccgagcttctggtggacctttcattgctacaagttatgattatgatgcaccaattgacgagtatggaattattagacagcctaagtggggccaccttaaagaagtgcacaaggccataaagctttgtgaagaagcattgatagctactgatccaacaattacatcccttggtccaaacctagaggctgcagtttacaagacaggatctgtatgtgcggccttccttgctaacgtaggcaccaaatctgatgtaacagtaaacttcagtggcaattcatatcacttgcctgcatggtctgtgagcatcttaccagactgcaagagtgtagtgcttaatactgcaaagtgtatcggaagtcaaaaacatttctgttatttgctagtccaagaa

SEQ ID NO: 8570 - DNA, 234 bp, Glycine max
  Peptide Sequence Number=SeqID_125348
ctgcatcttctaagatattgtctccacggtggtggtattgttcttcgtcgtcgtgatggggttctctgcggtggtagcgttgttctttgcctctgtgatggggttttccgtggtggtggtgctgttcttcgttgccatgatggggctctcctcagtggtttttgcgttagtgtagcagaagtgcagaacagcaaaagccaagatcgaatagaggtaaacgaaaatgacaaatga

SEQ ID NO: 8571 - DNA, 492 bp, Glycine max
  Peptide Sequence Number=SeqID_125349
atgatgggctgctgtggttgctttggatttgtccaaaaaccaagaccgcgtcgggctaaacgtagcatcagtaatcttctctcccaggggctattattggatggagaaactgaaggtgaagagacatatagtggtgatgttactagtaactgcaccagtggagatgataatgaggtgcaagctgtacgcaaccgttcagaggatattttgaacttcagagctgagaatggcatggtttgcaggccgtttcctgttaaggagacttgcaaacttgatcgctcagaggatgaaaatgggaacaagatgataaatgaatatgttcgagagtataaaattggttgcggaagctatggcaaagtggtaagcatagtttttgcagaattatcttttctttattctcatggaatccactgtcctgagcccttccttgacacgcatcgcaggctctttatcgaagtagtgttgatggaaagcattatgcaattaaggtaa

SEQ ID NO: 8572 - DNA, 1053 bp, Glycine max
  Peptide Sequence Number=SeqID_125350
atgggttcttcccctcctattttcttggcacacctctcagtgctggtaatgaagttagacttagagaggtggagtcaaccaggcaacagtggcaaatataagttcactgtggacatccctgtcacactagtcgctggaaagaacacaattgatctcttgagtttaactgtgggacttcagaactatggagccttttttgacacatggggagtggggatcactggtccagtgatattgaaaggttttgcaaatggcaacacgcttgatctctcctcccagaagtggacctatcaggttggcctccaaggggaagatttgggtctgtctagtgggagttcgggacagtggaatttgcaatctaccttccctaagaaccaaccattgacttggtacaagacaactttttctgctccatccggcagtgatccagttgcaattgacttcacggggatgggaaaaggcgaggcttgggttaatgggcaacgcatcgggcgatactggcctacatatgtcgcttcagatgctagttgcacggactcatgcaattatagaggaccttacagtgcatccaaatgtcgcaagaattgtgaaaagccatcacagacactataccatgtaccgcgatcgtggctgaaaccaagtggcaacattcttgtattgtttgaggaaaggggaggtgatccaacacaaatatcttttgtcacaaaacagacagaaagtttgtgtgcgcatgtatccgattctcacccaccacctgtagacttgtggaactcagaaacagaatcaggaagaaaagtaggtcctgtactatcactcacctgccctcatgataaccaagtcatctcttccattaaatttgcaagctatggaacaccccttggaacctgtggtaacttctaccatggacgatgcagcagcaacaaggctctatctattgtgcagaaggcctgcattggatcaagcagttgtagtgttggagtatcaagtgacacattcggagacccttgtagaggaatggcaaagagtttagcagttgaagctacttgtgcatag

SEQ ID NO: 8573 - DNA, 162 bp, Glycine max
  Peptide Sequence Number=SeqID_125351
atgggaagaggcgcggggcccacggaaacgtggacagctgagccatttgaggcaaggaaaatccaaccgttggattttggggacggaaagatgaagagtcagagatggaggcgggataagcaaaagccactccgatctgtgcattgccatggctaccgttga

SEQ ID NO: 8574 - DNA, 2802 bp, Glycine max
  Peptide Sequence Number=SeqID_125352
atggctgaatttcagtttgattatatccttgctattgcccttctcaattggtgttatgcagggcacttcatcttgatgaatcacaacgctaaggatgaggaaaataataacaggagggtgacgcgaaacagcgagaagggaaaaatcaaatcacatcgtaatgtatcagatacaactggtgtcagaaggtctcctagagagacatcatcgaagaagaacattcctagcccttcttcaagtacccgtaagtctgggcgacttgaaaatagacccccaccagctcctgtcaacaaaaggaaatctgaaagggttgaaaaaaaaaagccaagtcctttgagaagatctggaagaactaggagtcagtcttctaccggttattctgattctaaaagctcagggtcagtgagttcagaccctaagccaaaaaaagagaagagtgtgaaacagttgatatttgaagctaaggaagtgaatggaactgagcagcatgatctgggaacacctcaggttaaagtaaagagaatgaatgctcgtatgtatcggtctctctttcaattaccaaaggaagagcctaataggatcgataacttaaatcaaggtggcaacaatggtggaggcaagattgatgagtgctctggagagtgtcatgattttgaagaaatctccaagaatggtgcgctaccatctgaagatggaaaatcaaaagagatgagagttgacactgggttgagtgggtctgtgaaagatctggtagaaaataacatgactctaggttcattggcaccatctaatgttgcactaccatccgaagatggcaaatcaaaagagatgagagtcgacactgggttgagtgggcctgtgaaagatctggtagaagataccatgactctagattcattggcaccatctaatgctgcaacttatgagactggtctggcacctgaaagcattcaccctgattactgcagagaggaaacgttacaggtgttagtgtcaagcaattccatattggatgaagattctatcaggaacagtgttggggatgatagaggtgaaaacttgataccttctaagagcaaggaaatcacagtggatgtggattccgatgtttctgccatgttggcgaagggtgacaactgcaacttgacccctgatgctagtagcctgtcaaggctaggtggctatattatggggactgactgtccatctaatgccacactttatgagactggtttgctacctgaaagggttcagcctgattgttgcagagaagaaacattaccgtcaagcaattccaagaatggtgtgctaccatctgaagatggcaaatcaaaagagacgagagttgactctgggttgagtgtgcctgtgaaagatctagtagaaaataccgtcactctcggttcattggcaccatctactgctgcaacttatgtggctagtttggcacctgaaagctttcagactgattaccgcagagagaaagggaattccatattggatgaagaagacttaataagtaacagtgtagggcatgatagtagtggtgaaacattggtaccttctaagagaaagggaatcatggttgacatggattcagatgtttctgccatgttggctaagggcgataactgcaacttggttcctgatagtggtagcccttcacaactaggtggcaatattatggggattgatgggtcatgttctaagcgaataagtgagggagaacttgccattgaccctgattttgtcttgcatggccagaaactgaagaggagagaggagcttgatgagaaagtacgcattttgatgaagggctgggatgaaggagattgtgtagagggagaagtagggtttggagaggataaagttgggttggtagaggaagaggaggaattagatatgacaactatacaactaaccgctgagtcggattataatcctatagacagtgagtcttgtatcccttctgcaactgagcttcaagatggagattatattgatgcaagcatgctgcagaaggattctcaaatcgataatgaaaaagaacctggtttaataaataattccaataacagtgtaactcaactgaaggagaggttgtcaagccatattggatacagatgcaagtttgttgagtattgggttcctgtacaaatatctaatctgcagcttgaacagtattgttctattttactttcaaatgcttcaattcttcgctcctcatcaaaggttgatagtgttgaggctgttcgtgatgttcttatttctacccgaaagtgttgtagtcatccctatcttgttggtccggaactgcaaccttctcttaacaagggtctcaaaccaattgagtatcttgattttgatttaaaagcaagtggcaagttgcaacttcttgattcaatgctcgaggagttgagaaagaatgatttaagggtggtcattctttttcaggtttgcaagcaaagagcagagagatctggatgctggagagctatgggtctgttggaaatactggggttggctgtaaacaatggttgtgagctaggccagatcactgctgtctacatgttcgttgggtatctggcccctgctgaggttgctcaaaactgctggaagaagtggagagactcaaccatccagttgccatgcctgactcatagacaagtgaaaactattgggatccagaagaagaataaggaacatgtgcagctaacggagatagcggcaaatagaagtactgtacaaatgatgcaggatgaacatcaattatcggctaatcctcaggagatggcagaatag

SEQ ID NO: 8575 - DNA, 135 bp, Glycine max
  Peptide Sequence Number=SeqID_125353
atggcgaatgttaaagggattttagagtccggcggtgtctcaggcaaatttatgatttacgataaaacacaaggtatcctcctcgggagctcgaatacagagtaccaggcgaattttctccttaagcctatataa

SEQ ID NO: 8576 - DNA, 309 bp, Glycine max
  Peptide Sequence Number=SeqID_125354
atgaagccttctaagtcatctaccctagggttcaaaataaaacttaacaagagagggaaaaagaaaacttacttgagattgcagagacgaagtgaagtgaagatgcaggaagtagaatgcaacggtaagcacagtgcaaatggtaccagaagaaatgatgagcgagacagactcgcttcgcccaattctcaaaaatatgaacccgagaggtttttgggcttagcgcgcagatgcgcgtttatcgagttctacaactctgattggtctgcaacttccgctaagccggacatggctcgctcaacggattaa

SEQ ID NO: 8577 - DNA, 504 bp, Glycine max
  Peptide Sequence Number=SeqID_125355
atgaagccttgtaaggtttcctatcaaaacataaagcataaaatgaagttcgacaatcaagaattgcctgtacttacaaatgagtttcactaccctggtagagaagctgttaatgacaaattcaattgtctcattgataatatttggaatattccaaaaatacaaataataacgagcggccctcatagaggtgtttataccaattttaaagacctttgccttgcaaaggaggacttggaccagtttaagtcctttggatatgaggacctagcaatttccgcgaaaagtctattggactatggatgtttggaatcaatcctaattcctccatctgatagattcgagggattcaatccctcaatcaatgaggccataaacctgatccaggaaaaaatgatggactacattgccatcaaaataacaacttgccccaacaactttactgttgagaattacccatgccatgttatgagggtaatacacaatatcaatatagcctcatga

SEQ ID NO: 8578 - DNA, 217 bp, Glycine max
  Peptide Sequence Number=SeqID_125356
atggctaccattgttatggctaccattgaattatcgagtagatatgggagcaaattagcatattacaccggaattggggtaggctttatggttgatttagggatggcccttgtggatgactgggtggtgggtaatgacattgttgagccggtggaaaacttggccatacccacttcgatcctttcgccagcaaagaccaaatctgcaaagtttgaag

SEQ ID NO: 8579 - DNA, 639 bp, Glycine max
  Peptide Sequence Number=SeqID_125357
atgcatagagctaggctgatatttggcctagtctctcgcttggatatgaacataggagcgctgatctctggccagatgacctttatagtccagtctaacacttctagacttgggttccctgctttaatcaccgcattatgtagagccagaggacttctctctgatagcatcacttttgagcgcctgagcccggtcattaacttggtctatatcaggaaaaactgttggaaccctgatgatctgatagttactatcagaagggccaggagagcgaggacaaggccagttgaggccctttccacatctgcagctccccctccagcatgtaccctagcagctccttctgccccagctcctgcagattttcagtgtcttgaagccatgcttcaaagcatccatcaggggcaaattatcttattacaaagtttacagatagtggcaccaccagactctattccttcagtagagcagtttaatgagtgggtagcctggcccgaaactcagtcttctcttcacaaggaagatgaaggtcccacagcccaggtaccacagcagattgaggatgagtcatctgagactaccacttgtcataccctaatttcgtccggggattataatttgatgatatacaaccattga

SEQ ID NO: 8580 - DNA, 807 bp, Glycine max
  Peptide Sequence Number=SeqID_125358
atggttgataaccctaactggtggagcatgcatcaacaaccttctttgatccctccccaatatgtgtttcctccttcttcaattccttttaattctttgactgaaaatcaagagcctcctcagtcatggagtcaactgttttttactggattaccgggagaagaagagaaacttgggcctaagaagttggaaaactggaatgtccaagatcttaatactgcttctagagttccatttcttgatgtaataaggcaacaagtttctcaaaggggcaatttgtacgaccacgggccatcttggtcacatatggtgcctgtttcttcccccgtgtcttgtgtcactagcttcagtagtaataatatattggatttcacttataacaagtcagatcataggagaaatctacaacaagaccaaatatccaagtgtaatagcacagccactgttggagtttgtaaaaaggctagggttcagccatcttcaagccaagcacctctcaaggtgcggaaggagaagctaggtgatagaataacaacccttcaccaactagtttccccgtttggaaagactgacacagcttctgtcctgttagaagccataggatatataaggttcctacagggccaaattgaggcactcagctctccttacttgggcagtgcatcaaaaaacatgaggaatcaacagtctgtacatggagaaagaaattctgttccagaggaccccggtcagctgttgaatgaccataatattggcctgaaaagaaagggagctccgaaccaggcgtacgcatcatattctgatcac

SEQ ID NO: 8581 - DNA, 510 bp, Glycine max
  Peptide Sequence Number=SeqID_125359
atggcagataatgaggctacagaaattgttggtgtagaatggttctcgacttatagaggttgtttactcactgttactatatttgctcgctgcttcatttgcaacttaatggcgataatcctgatttctttaggtaccgatcatcatttcgacattgtggcattcatgtggatgaaccagacagggacggtattaggcatgacaatggaacccgaactcgaattttataagtatgtcggggtgggggggagggagataaatctacattccattggatttcaggcgggggcaagggataaatggggatttagaggtgggagtgagcttgttcactcctgcagtgacattaataagtcattctgtggtgtcctgtatcatgggatggacctggacaataacattggggttgcaacgggagattggattattgacgaagatcctgcaataaaggccataattcactggcttgcagcttctcagaaaaaggcgtctcgtattagtgaattttga

SEQ ID NO: 8582 - DNA, 414 bp, Glycine max
  Peptide Sequence Number=SeqID_125360
atggaactgatggtggcgggtgataatcataatccaagattcatttacttctacacgcaggagttgattgctgctcttcttggttgctcattactttgtctattccctgatagacctgccaaccatcaatttcgatcaattgtttgtataagttctgatatgcctaagggcattgtctcattcaagcgaatagtactgcctgtcaccctacatggtttgtctgactttcctcaccgcatgtctgatacgcttctatgggaattgaaggtaaaaagcttgggggagatgctcttggcaaggggacttcacaggaacctgtttgatgattgctatattagaaaacaggcaatactttggcattttaataggttcacacttcagggcaaattgaagatcaatcaagtaaaggtgtag

SEQ ID NO: 8583 - DNA, 357 bp, Glycine max
  Peptide Sequence Number=SeqID_125361
atggagaaggaaatggaggctgctttagttcatgtggagacgacccagcaacacatgaatccacatgtactaaggcgcaagggtggcttcattaccatgcctttcattatagcaaatgaggcactagctaagctggctagtgttggacttatgccaaacatggtattgtatttgataggggattacaggctccgagtactgaaagcaaccaaaattatgttctattggtttgccgctaccaattttgctcctgtgattggtgcttttgtggctgatgcttatttgggtcgcttccttgccattggtttaggttcaattctcagtttcctggtaccttcctttctccttagtccttaa

SEQ ID NO: 8584 - DNA, 1338 bp, Glycine max
  Peptide Sequence Number=SeqID_125362
atggtcccagaggcaaggccatgcagccattgtgaagaatcagcaacaacaccccaaatggctatcttactctcttgctttgctctcatatccattggaggtgggggcatctcatgctccttagcatttggtgctgatcaacttaaccaaaaatccaaacccaacaatccgagggtccttgagagcttcataagttggtacatagcttctcaagccattgctgtggttttttccttaaccggaatagtttacatccaagaccattttggatggaaactgggttttggggtcccagcagcacttatgttcttgtccactctcatgttcttcctcatttcttcacgttatgtcaagcagaaaccacacagcagcttactcactggctttgtccaagtgcttttcgttgcctataagaacagaaacctttcatttccacctaaggactccacttgcatgtatcaccataagaaggactcaccccttgttgctccaactgataaactaaggtttctaaacaaagcttgcatcatcaaagatagggaacaggatatagcctctgatggatcagcctcagataaatggagtctttgcacaatagagcaagtggaagaactaaaagccatcattaaagttattcctctttggtctaccggtatcatggtgtcagtcagcactagccaaacatcactttggttgctccaagccaaaacaatggacagacacatcacttcaagcttccaaattccagcaggctctttcggtgtgttcataatgttggcagtgtgtgtaactgctggtgtctatgatcgtgtcatccttcctctagcatcaaaagtgagaggaaaaccagttactatcagcgccaaaaagagaatgggaattggactgtttttctcatttttggactttgtagcctcagctgttgttgagagcataaggagaaggaaagcaattagggagggatatattaataatcctgaggcagtgttggacatgtctgcaatgtggctcatcccacataatattttgtgtggtatagcagaagcctttaatgcaatagggcaatcagagttctattactctgagtttccaagcagcatgtcaagcattgctgcatccctattcagcctaggatctgctgtgggaaacttggtggcttctcttatactcagcattgtggatgacattacttccagagggggaaaagagagctgggtttcagataacattaacaagggtcactatgacaattgggcttatggccctagtgctgaaccagcttcaaagaaggaagaaagagggaatggggttcgtgatcaacaagaagaggcaatgtaa

SEQ ID NO: 8585 - DNA, 408 bp, Glycine max
  Peptide Sequence Number=SeqID_125363
atggctgatctaattatatattcccttttattttggtttgcagctgttatgacagcattttttccctgtgtaacatttgggcagatagcagaagtacaagatggtggagaacttagttgtcatctggggagcttcatttatctattaatgatgcctgctttgtgctctcaatggattatggggtcaaagtaccgcacaaagttgaggaagaggtataatttggtggaagctccatatacggatatagtctctcacatcttttgtccatgttgttccctctgtcaagaattcagagagctaaaaattagaggacttgaccctgctcttggatggaatggcattcttgcacaacagcaaagtgatcaaacattaaagaatcctcctttaaaccaagtcatgtccaagtga

SEQ ID NO: 8586 - DNA, 1905 bp, Glycine max
  Peptide Sequence Number=SeqID_125364
atgagcaactcaggtttaggtgggtgcagcagcttgtgtgatgcgcagagaaagcgttcaactcgtttcagggtggtgagtatgaccccaagcagcagcaggtccggtgatagaaacggcagcgttgtgatggagacgccgttgaaagaattgaaaaaggaatccacggtggctgacgtggacaacaatcccatctccgccggtggccctcaagatgtttacggcgaggatagggctacggaggatcactttgttaccccttggagtgtttctgttgccagtggttatacactgttgcgagatccccacttcaacaaagggttggccttcactgaaaatgagagggatgcccactacttgcgtggtcttcttcccccatcagttattcctcaagaaactcaggtgaagaaaatgatccagcacgtacgccagtatcaagttccattgcagaagtatatggcaatgatggatcttcaggagagaaacgaacggttattttacaaacttcttattgatcatgttgaagagttacttccagttgtatatactccaactgttggtgaagcttgccagaaatatgggagcatctttatgcgtcctcagggtctttatataagtttgaaagagaaggggaagatccgtgaagtgctaaggaattggcctgagaagaacattcaagtcatagttgtaactgatggagaacggatcctgggtcttggggatcttggttgtcaggggatgggaataccagtgggaaaactttctttatatacagcacttggaggagtgcgcccttcagcttgtttgcctattaccattgatgtgggtacaaacaatgagaagctgctgaatgatgaattatacattgggctaaagcaaagacgagcaactgggcaggaatatgctgaacttatgcacgaatttatgacagcagtcaagcaaacttatggggaaaaagttctaattcagtttgaagactttgcaaaccacaatgcttttgatctgcttgagaaatatagatctacacatctggtctttaatgatgatattcagggaacagcatccgtggttcttgctggacttgttgcagctctgaagttggttgggggtaacttagctgatcacagattcttattccttggtgctggagaggctggcactggcatagcagaactcatagcacttgaaacatcaaaacagacaaatgctccactggaggaagtgcgcaagaatatttggttggtggactcaaagggattgattgtcagttcccgcaaagattcgctccaacattttaagaagccctgggctcatgagcatgaacctgttagaaatcttgtagatgctgttaataaaattaagccaacagtgttgattggaacatcgggacaaggaagaacatttactaaagaggtgattgaggcaatggcttctattaacgagagacctattattctttctctttccaaccctacgtcacagtcagaatgcactgctgaagaagcttacaagtggagccagggacgtgccatttttgcaagtgggagcccatttcctcccgttgagtatgaggggaaagtgtttgtgcctggccaggccaataatgcatacatatttcctggatttggtcttggtttaataatgtctgggaccattcgagtgcatgatgacctgcttctggctgcctctgaggctttggctgcacaagtgagccaagagaactttgataagggactcatatacccaccattcaccaacataagaaagatttcagcacacatagctgccaatgttgctgctaaggcttatgagcttggcttggccactcgccttcctcaacctaaagatttggtgaagtttgcagagagctgtatgtataccccatcctaccgaagctaccggtga

SEQ ID NO: 8587 - DNA, 1599 bp, Glycine max
  Peptide Sequence Number=SeqID_125365
atggtttggccgtggaaaggtttggacaatgtctataggagaggagaggaagagggtgaagagctttccaaaaaacaggctgctcaagaatccacaattaggaaactaagggctcagattagagattttgaggaggagaagaaaggcttgactactaaacttcaggtagaagagaataaagtagaaagtatcaagagggacaagacagctacagagaagttgttgcaagaaacaatagaaaaacatcaaaatgaaattgcagcccagaaagaatattatacgaatgctttggctgctgccaaggaagctgaagcattagcagaggctcgtgcgaacaatgaagcaagaactgagctagagagtcgtctgagagaagctgaggaacgtgaatctatgctagtccaggcacttgaagaattgaggcaaacattaagtagaaaggaacaacaggcagttttcaaagaagacatgcttcgcagagacattgaggatcttcaaaaacgttaccaggcaagtgaaagacggtgtgaggaactgattacgcaagttccagaatccacaaggcctcttttaaggcaaattgaagccatgcaggaaacaaatgccagaaaagctgaagcttgggctgctgttgaaagaactcttaattctcgacttcaggaagcagaggctaaagctgcaactgcagaggagagagaacgatctgtgaatgaacgcttatctcagaccttatctcgaattaatgtccttgaggctcagatttcatgtcttagagctgaacagactcagttaagtaggacccttgaaaaggagagacaaagggcagctgaaagcaggcaggaatatcttgcagcaaaggaggaagctgacactcaagaaggtcgtgtgagacagcttgaggaagagattagagacattagacagaaatacaagcaagagttacaggaggcattgatgcaaagggaacatcttcagcaggagatagaaaaagaaaaggctgctcgatcagagctggagaagactctacgtgttcattcttcaccattatcagatcaaactcctactacaaagctaaattctgcttttgagaatgggaacctgtctcggaaactctctagtgcaagctccctgggaagcttggaagaaagccactttctgcaagcatcattggactcctccgatagtatatctgagaggagaaacataggagaattaagcatgagtccttactatgtgaaaagcatgacacccagttcttttgaagctgcacttcgtcagaaggagggtgaacttgcttcatacatgtcacgcttggcatcactggaatctattcgcgattctcttgctgatgagttggtcaaaatgacagaacagtgtgagaagttgcgtggggaggctgctgtattacctggcttacgatcagagctagaagcactaaggaggaggcactctgctgctttggaattgatgggcgaacgtgatgaagagctggaggaacttcgtgcggatattgtagacttgaaggaaatgtacagagaacaagtgaacttgctcgttaataagatccagacaatgggtccatcaatgggtagcgactag

SEQ ID NO: 8588 - DNA, 999 bp, Glycine max
  Peptide Sequence Number=SeqID_125366
atggagttcaaatatcatgatggtcagatccaaaggacaccatcaccattgcggcgccctcttccttccaactcctatgtctccaatcgcccattacatgggtgtgactttgcatcaggtggctttcccagcaatgtttcagcgcctagagttttcccaatggccatgccgatcaatgtcaatgaagtgttccaacgagagttggagaaagagaaaatatggcgagagctagagaaggaagaaataaggagagaaatcattgctcgtgagatggcttttgcacaacgacgagagctggaagacgaagtgagaaaggaaatagaattggagagaacatctagaatgtcgatgcaaagatcagaggggattgcatttcgagaaccaatttcagtgtctattattcagagttcgtcgaataacattaccatgtttggtgggcgacaattccatttagcgtcccaagcttctatgaaaattcacatggataatatccaaattgataacaaacaagcttctaataacaaggataaagtgattatactgaataaaccagatgatcattctggtgaaaagcgcaaagcagtgacacttgcaattgatgataatgagagtgtacagaagaaagccaagaaggcctggaattgcgagttgtgtcaaatttctgcaacaaggttggattcaagaccacaaggccaaacacttcatccttgcttaacccccatggacacatgcaaattggaatctaaagaaaagggtcaggctgtccaaaagagcaaaggtttaggtggtttggacaaccataatgaaacaactattagtaaacaagcaccggaaacaagcgcaccgctaaaagggaagaaatttaaattttggtgcgagttttgtcaagttcaaactcaatcagaaattgtgatgcaaagccataagaatggaaaaaaacacttggcaaatatgaagaaatttaaccacaacaatggtggtgttgcaaattctggatga

SEQ ID NO: 8589 - DNA, 1896 bp, Glycine max
  Peptide Sequence Number=SeqID_125367
atgtctttctcttccattaggaagacgcaggaaacctcaagaatcctctccatactttcattctctctgaacctcttccccgtttcaccttactatttcctacatcaatcttttgccacacaactaatccctcagcacaaagtcgattcattcccttcatcaccatccaatcactactattacgcttcactactcgagtcttgtatctctgccaaggcgttagagcccgggaaacaactccacgcccgattgtgccaattgggtattgcttacaatctagatttggccactaaactggtcaatttttacagcgtctgcaactctctgcggaatgcccatcacctgttcgataaaattcccaaagggaatttgtttctgtggaacgtcttgattcgggcttatgcgtggaatggaccccacgagactgccatttcactctaccaccagatgcttgagtacgggctcaagcccgataatttcactcttccctttgttctcaaagcatgctcagcactctccacaattggagagggaagggtcattcacgagcgtgtcatacgatctgggtgggagagggatgtgtttgtgggtgcagctcttgttgacatgtatgccaagtgtggttgcgtggtggatgcacgtcacgtgtttgataaaattgttgacagagatgctgtgttatggaactccatgctggcagcttatgctcaaaatggacaccccgatgaatcgctttctctttgctgtgagatggcggcaaagggtgtaagacccaccgaggcaactctagtcactgtgatttcatcttcagctgacattgcctgtcttcctcatgggagggagatccatggatttggttggagacatggatttcaatacaatgacaaggtcaaaactgctttgatagacatgtatgcaaaatgtggttctgtgaaagttgcctgtgtcttgttcgagcggcttagggagaaaagggttgtatcttggaatgcaattattactgggtatgcgatgcatggtcttgctgttgaagctttggacttgtttgagagaatgatgaaagaggctcagccagatcatataacctttgttggtgctcttgcagcttgcagccgagggcgtttgcttgatgaagggcgagcattgtataacttgatggtgagggattgccgcatcaaccccacggttgaacactacacttgcatggttgatctccttggtcactgtggtcaacttgatgaggcatatgatcttataagacaaatggatgtaatgccagattctggtgtatggggtgctttgctgaattcatgcaaaacccatgggaatgtggagttggcagaggtggctttggagaaactaattgaacttgaacccgatgattctggcaattatgtgattttggctaacatgtatgctcaatcaggtaagtgggaaggagttgctagattgaggcagttgatgatagataaaggaataaagaaaaacattgcttgtagctggattgaagtaaagaacaaggtctatgcatttctttctggagatgtttcgcacccaaattctggtgcaatatatgctgagttgaagaggttagaaggactaatgcgagaagctgggtatgtcccagatacaggatctgtcttccatgatgtggaggaagatgagaagacagacatggtgtgcagtcacagtgaaagactggctattgcatttggactcataagtacattgccaggaaccaggcttttgataacaaagaatctacgaatttgtgaggattgccatgttgctatcaagttcatctcaaaaatcacggagagggagataactgtgagagacgtcaatcgctatcatcattttaggcatggactgtgttcatgtggtgattattggtga

SEQ ID NO: 8590 - DNA, 312 bp, Glycine max
  Peptide Sequence Number=SeqID_125368
gtcttcatagtcctgcaagagactctggtgcctcagcctggccctctgatcctgatatacctcataaggagggtccaaggagacaacccctttcatcttcttcatgagatcaaagagaaacaagagaacccaaaagggaagaacaaacgaagactaaagggaaaaggggagaaagagagaaagaagaagaccagtgatgaagatgggattttttgggggcttgcagaagggcaattcggggaacatagttttgatgagagagagagaaatgtaagagagagaaagaagggtagtagtattgaagatagatag

SEQ ID NO: 8591 - DNA, 102 bp, Glycine max
  Peptide Sequence Number=SeqID_125369
atggcgaaatgctttgccctccatcaacttctccctttggtagagcgcaaggctcttaaccttgtggtcgtgggttcgagccccacggtgggcgctaagtaa

SEQ ID NO: 8592 - DNA, 1176 bp, Glycine max
  Peptide Sequence Number=SeqID_125370
atgtcgcagctagtatgtattttgagttatgtaacttgtaagaatggagtaaaaaaagggccgggttgctcatcagtagcatacggggcatcagaggaaattgggccgttccgtataaacaaaacgggctcttctctatatctcaacaaatatgcatggaacaaagaagcaagtattctctttcttgaatctcctgctggtgttggcttctcatacacaaataccagctctgatctcaaaacttcaggggacaaaaggacagctcaggatgcactggtttttctaattagatggatgtcaagatttcctcaatataaatatagggagttttacattgctggagagagctatgcagggcactacgtcccccagttggctaagaaaattcatgattataataaaaacaatcctcaaattattaatctcaaagggttcattgtgggaaatgctgtgactgatagctacaatgatggaattggaactgtcacatattggtggagccattctatgatatctgatcagtcatacaaatctatcctcaaatactgcaatttcacagcagaagaaacatctggaaaatgtgatgatgtttatagttatgcggttaactatgaatttggaaatatagaccagtacagcatctatacgcctacgtgcacagcatcacaaaacaataccgttaggcacatgcgattcaagaatcttcatctgatttctgggtatgatccgtgtactgaaaattatgcagagaaatactataaccttccagaagtgcagaaagcaatgcatgcaaatgttaccaacattccttacaaatggactgcttgcagtgatgtgctcctgaaaaattggaaggattctgcaatttcagtgttgcccatatacaaagagttaattgccgcgggattaaaaatatgggttttcagtggggacacagattctgtggttccagttactgccacaaggttttctctcaaccaccttaacctcagcatcagaactcgctggtatccatggtactctggtggacaggttggtggatggacagaggtgtatgatggactaacttttgcaacagtaagaggagctggccatgaagtacctttatttcagccaaagcgagcttacattcttttcaagtcttttttggcagcaaaggaactgccaaaatattga

SEQ ID NO: 8593 - DNA, 681 bp, Glycine max
  Peptide Sequence Number=SeqID_125371
atgaatagcacaagttttcaaggtttggaaaaccagaaaacttcagaaagcttttggtacaaagaagaagaagaagttcaaagagattcaaggcttgtaaatgattttcgagccttttataataatctgcaaattcgggatggtgtcattttcttcgaggtgcataaaataccaattgtcgttgatcaatctctgttttattcattgacaaaactaagtagtcagggtgttccttttgagggcactttggttgataattggaagcatatctattccactcatgatgcccgtaaaatggtctgtaatgaacatgctgatatgatcagcaaattgcttgttggatcattcacctttgaatgtcgtatcatgcattatattttgtgtcgtgttttgcttcctcgttccacaaatcttgctcaggcctctgaggaagaattaattctgctatgggctcttcaaaccggtcgccaaattgaatgggctcatcttgccagataccgtatgcataaggcattacgggccaatacacctctcccttatcctcatcttgtcactctttttcttcagcattttaatgttcctttagaggatgaaccatttgttaaagtcaatcgttcttttgctattggtgttgatgttgttgcctcctttggataccgaaaggatttggatggccaatag

SEQ ID NO: 8594 - DNA, 282 bp, Glycine max
  Peptide Sequence Number=SeqID_125372
atggtgctgttttggaacttattccttcatgggtctgttttttacgtaaattgcatggaaatcgccagccccattggcgagtttgggctggcgtcaacatgtggcactggtctcgctagtctcactggcgatttgaccatgcatgggactcgccaatttgactggcgagttgcgctagggggagcttttttccaggctagggttgcaggcatgtgtagcagaagaagagtagggtgcagtgagcatcagctagtggcactggcgagttgcgcactgatatag

SEQ ID NO: 8595 - DNA, 234 bp, Glycine max
  Peptide Sequence Number=SeqID_125373
atggccgccgacatgtccaacaataataatcctcctcccacttctcacgccaaagacttctttgcttctcctgctctctctctcagccttgctggtatttttcgccatgccggggttgccgcggcggatgaggctgccacttcggtggaggagggtgaagagtgtgagaggttagatgatattagcagcgagaactccggtcccacaagatccagatcagaggatgatttcgaa

SEQ ID NO: 8596 - DNA, 1584 bp, Glycine max
  Peptide Sequence Number=SeqID_125374
atgggttatgcatcgaggttggggtggcagcgcgatggtcaagcagtcaatttcgtcgtccacggcgaagcggaagaacttgtgtggatgggaatggctgtgcgggataacgtcttggcgtttggagaagatgatccacacactcccaaaatgcaagaggaggagcttctaacgcttgaggaagcattggatagcattctttctttgaaaaaaatggaatcaatcggggtgttaatgacttgcccaatgcacagttacatccaagaagagctcgcaaaacgcttcaacctcttcaaactctggcactatccctcgttctccgccttcgcccaagcccacgcccattccattcgcgccctcgtcgcaagcgccaaagtcggagtcgacgccgccaccatcgattcccttcccaacctcgagattgtctccacctacagcgtcggatacgacaacatcgacctccacaaatgcagacacagagcaatccccgtcaccaacacgcccaacgttttaaccgacgacgtggccgacgtagccatcgccctcgccttgtccctcctctgcagaatttgtccccgaaattccacttggcaattcacaccaaagcttagtggtaaagcggttggaatagttgggctgggaaggattggttgggcgattgcgaagagagccgagggttttgggtgtccagtgagttaccattccagatctgaaaaatcagagacagggtataagtattactctcacatcattgatttggcggctaactctgaagtgctctttgtggcgtgtacccttagtgaagaaacgcgtcacattgtgaaccgtggggttattgatgcgttgggcccgaaagggattctgatcaatgttgggcgaggcccgcacgtggatgagcccgaactggtggccgcgttgattgaagggagactaggtggggcgggccttgatgtgtttgagaacgagccggaggtgcctgaagacctgctggggcttgagaatcttgtcatgacccctcatgtggggactgacactctggaaacttgcatcgctatgggagaccttgtaattgctaacttagaggcacactttcttggcaacccacttttcacacctgctggtagtggcggtgacagtgtacatgatgaggaggaggaagctgaagcttgcgatgacatggaagctgacgacggattgtgtaccgcgggtccatgcaaacggaacttggaggcccatgttgctgattttggccttgccaagttcttgtacgaccctggcgcctctcagtccatgtcctccattgctggctcctacggctacattgctccagccattctcagtcttagaataagatgccttgggaattgggatgggaggggcaacaagagtagtggagacaattttcttgctgctccaaacattgatcattcacaggactttgtgagaaaggatcttaaagaatggttatgctggatgagccagtttgctacttcattcattataattctattgtttattattcaaggtttcatttttaaagaggaagctgtgtttcagtatccagaatgtggcttgaccaattag

SEQ ID NO: 8597 - DNA, 321 bp, Glycine max
  Peptide Sequence Number=SeqID_125375
atgacgaaaaagcatgagagagtgttggacagcatgttggaaggtaaagctgtgatagaggatactgacatgccagataagatgcagatccaagccatggcatccgcttctgaagctttggatctctatgatgtttttgattgcacatccattgctgcccacataaaaaaggagtttgatacaaagtatggttctggatggcagtgtgtggtgggatcaagttttgggtgttttttcacccattctaagggaactttcgtgtactttactctggagactctcaatttcctcatcttcaaaggggcttcttatctcatctaa

SEQ ID NO: 8598 - DNA, 1602 bp, Glycine max
  Peptide Sequence Number=SeqID_125376
atggttcgagcaggggaacaagagcaggaaggttacagggccaaactgtttaatttcagagggatatttgagggcactgggaggcatactaagagccttagcgttgacactgctaccatattggaacctacagaggatggtgcagcgtcatcaagaagtcaaggatcaaagcctcttaatgatttagataacattattcccaaagtaagggtcataagcaaggaggaaattgcagttaaggaagccaaagagaagctattgcaagatatggaacagatgaaggagagatttgccaaattgttgttgggtgaggacatgtccggtggaggaaagggcgtttcatctgctttggcactgtcaaatgcattcacaaaccttgctgcttcaatttttggtgaacaaaagcgcctagaaccaatgccggcagaaagaaaagcaaaatggagaaaagaaattgattggcttctatcagtcacggattacgttgttgaaatggttccttcacaacaaaagtctaaggatggttcaaatatggagattatgacgacacgacaacgaacggacctccacatgaatgtccctgccttgcgcaagcttgatgcaatgcttcttgaatgtctggataatttcaaagatcaaaatgagttctattatgtgtcaaaaggttcagatgattcagatcaagacagtgcaaagacaaaaaatgatgataagtggtggttacctacccctaaggttcctgcagaaggtctatctgatatggctagaaaatttctgcagtatcagaaagattgtgttaatcaagtacttaaagcagccatggcaataaatgcccaaatcctgacagaaatggagattcccgaaagctatattgactctctacctaagaatggaagagcaagtctaggggactcgaactacaggagtataacagttgaattttttgatcctgaccagttcctatcaaccatggacttatcatcagagcataaaatcctagatctcaagaatagaattgaagcatcaatagtgatttggaagcgaaagatgcaccaaaaagattccaaatctgcttggggttctgcagtgagtttggaaaaaagggagctctttgaagagagagcagaaaccatattacttctcttaaagcaccggttccctggccttcctcaatctgctttggatataagcaaaatccaatacaacagggatgtggggcaagctgttctagaaagctattcaagaatattggaaagtttggcttttacagtactttcaagaatagatgatgtactccaagcagactatcaaattcaatcccaaaatctattagggagaaggataagttcggtttcaaggccttctagagaagagatagacaaggctagtgcagaagctggttcaatgacactatcagattttatgggttggggctctgatcaaggtgacgcagacatgaagaaggacccgtttgcaatttcagatgacttatgcaaagacgatgatccaaagcaacaaaaacttcaaaccgtagtgaccaacaagaaggtttcatatcttgagaccttgggagtcatgagaagccccacatcgcgtcattaa

SEQ ID NO: 8599 - DNA, 2278 bp, Glycine max
  Peptide Sequence Number=SeqID_125377
gcttttcaaagagtcaccacatcctgatgaaaagcagaggcaacaactaagcaagcaattaggccttgccccaaggcaagtcaagttttggttccaaaatcgtcgaacccaaatcaaggcaatacaagagcgtcatgaaaattctttgttgaagtcagaaatagagaaactaaaggagaaaaacaagaccttacgagagaccataaacaaagcttgttgccccaactgtggcgtgcctaccacaagcagagatggtgccatgccaactgaagaacaacaactacgtattgaaaatgccaaactcaaagctgaggtagagaagctccgagcagttttagggaaatacgcaccagggtcaacgtccccttcatgttcttctggccatgaccaagagaatagaagctctttggatttttacactggaatttttggacttgataagtcaaggataatggatacagtaaaccaagctatggaggagctcatcaagatggctaccgtgggggaaccattatggcttcgtagcttcgagactggtcgcgaaattcttaactatgatgaatatgttagggagtttgcagttgaaaattcaagcagtggaaagccaaggagatccattgaagcctcaagagacactgcagttgtttttgtggatctccctcggcttgtccaaagttttctagatgtgaatcagtggaaggaaatgtttccgtgtttaatatctaaggcggccactgttgatgtaatatgcaatggagagggtcctggcaggaatggtgcagtgcaactgatgtttgctgagctgcaaatgctcactcctatggtgcccacaagagaagtatattttgtccgtttctgcaagcagttgagtgctgaacagtgggcaatcgttgatgtatccatagacaaagtagaagacaacattgacgcgtccctcgtgaaatgcagaaaacgcccttccggttgcattattgaggacaagtccaatggccattgcaaagtaatatgggtggagcacttggaatgccagaagagtgcagtccattcaatgtatcgcaccattgtgaacagtggcctagcttttggggccaggcattggattgcgactctacaacttcaatgtgaacgtctagttttcttcatggcaacaaatgttcccatgaaggattcaaccggtgttgccacgttggccgggagaaaaagcattttgaagttggcacaaagaatgacatggagtttctgccatgcaattggcgcgtcaagcttccacacatggactaagtttacaagtaaaactggagaagacataaggataagttctagaaagaacttgaacgatcctggtgaacctcttgggttgatattgtgcgctgtttgttctgtatggttgcctgtctcacctaatgttctgtttgatttcctgagggatgaaacgcgacgaactgaatgggacatcatgtcaagtggtgggacagtgcagtccattgcaaatttagccaaaggacaagaccgaggaaatgccgtagccattcaaacaattaaatcgaaagaaaacagtgtgtggatactgcaagatagctacacaaacccttatgagtcaatggtggtatatgcttctgtggacattactggcactcagtctgtgatgacaggatgtgattcgagcaatcttgccatactgccctcaggattctctattattcctgatggtcttgagtcaaggccattggtgattagttcaaggcaggaagaaaaaaataccgagggaggatctttgtttacaatggcattccagattcttaccaatgcttctcccgctgccaagttaacaatggagtctgtggactcggtcaacactcttgtatcttgcctggggctgggactcgaagggaatggaaagctcatcgggctggggctcgggcctgttggaggacctcttgggaacggggagtgcgagaaaggccttggtcttgctgatgggcctggtcttctggagctggacgatgtcgccgacattgaattggttatcgggatcgtgggcctggtacttcttcttcttcctcacgcgcctcttgtactttgggtgaggggccagccgcaccacctccactgccaccgtcttgtcgttcgtggagcacaccacttttccctgcatcgtcttcatcgcattgatttgaggcagcaaactcggcggggcccagtgggtctgagtcaccgccgaactgggtttccagagaaggctggagccatggccatggccgttcagaaatggggttga

SEQ ID NO: 8600 - DNA, 1278 bp, Glycine max
  Peptide Sequence Number=SeqID_125378
atgtttgactgtggtcccaagtcagaatacatgggtggccagcgggaaaattttttgaggttggaggccttggattctacactatcttcatcttctgatgccggagttatcaaatctggatttagtattgataaattaagccatggtcatggaaacagcacaacttctaggtctttcaaaaggggaatgagaaggggatctgaaggactgaaatcaattgggcgatcgcttgggttgggagtatctagggctgtgttcccagaagatcttaaagtgtcagaaaagaagatatttgatcctcaagacaagtttctgctcttatggaataaactttttgttatctcatgcattttggccgtctctatagatccactatttttttatctcccagtcattaatgattcatttcattgtcttggcatagaccgaaagttggcaacaatagttacaaccttaaggacattggttgatgctttctatcttctacacatggctctccaatttcgtactgcttatattgctccatcttctcgtgtctttgggcgtggtgagcttgtgatagattcagcacagatagccaagcgatacttgcagcggtatttcatcattgatttcctatccgtgttgccgataccacagattgtggtttggagatttcttcagaggtcaaaaggttcagatgtactagcaacaaagcaggccttgttgttcattatcttgcttcagtatgttccaagatttctccgaatggtaccattgacttcagagcttaagagaacagccggtgtctttgctgaaactgcatgggcaggggctgcatattatttgctgctatacatgcttgccagtcatatagttggtgccttttggtacttgttagctattgaacgcaatgactcatgctggcagaaggcttgcagtgacattaggtgcaataaaaatttcctatattgtgggaaccagcacatggaaggttatagtgcttggaataaaacaagtgaagatattcagtcaaggtgctctgcagatggtgatcctgcgcattttgattatggaatttttgggcaagtcttgtcttctggcatcatttcatctaagaagttcatctccaaatactgttactgtttatggtgggggctccagaatttgaggctaacagccattagaaagactgaaacaagtatattctatgtgaagcctgacctgaatactgatataccaagcatttctccagaaatgaagaatgaattagggaagaaagaaaattgtgttgtttga

SEQ ID NO: 8601 - DNA, 339 bp, Glycine max
  Peptide Sequence Number=SeqID_125379
atgagtgtatcattgactgtgatgaccttcaatctctatgatgatgagccacaagacagtcctaattcgtgggagaagagaagggatttgtgcataagcgttattaccagttactcaccaatcatactctgtacccaacaaggttatgatcagtttgggatatcacggaaagggcctcaagacactactagcgagcactgcactatcttctatgataaggaaaaggtcgagcttctagaaggtggaaccttttggttgtctgagtctccctctgtacctggaagcatgtcatggggctctgaagttccttgcattgcaacatgggctatatccttatga

SEQ ID NO: 8602 - DNA, 933 bp, Glycine max
  Peptide Sequence Number=SeqID_125380
atgggatcctatctgggtgttgctgcagcctcggaaaatcctcctcattttatccatctatgttacaaacctctgagtggacctgtcaatgtcaagttggctttagttggcaaaggtttgacttttgacagtggtggctacaacatcaagactggacctggctgttcaattgaactcatgaaatttgatatgggtggttcagcagcagttttaggaacagcgaaagctcttggtcaaatcaaacctctaggggtggagtgtcttttgtggtgtagtaatgataatgcatgcaatgcccagattaaaaatcctacatgtgcaggtatgaggcctggagatattgtcacagcttcaaatggaaagactatagaggttaacaacactgatgctgaaggtagacttaccctggcagatgctctggtatatgcttgtaatcaaggtgttgaaaaggtttttggtttcaatttacataagcttaataattgtttcataggtgtacggtttgtttttagaatggtgctaatgggttggtcaactgttcttcagattattgacttggcaaccttgaccggggcctgcgttgttgcccttggaccctcaattgctggtgtgtttacacccagtgatgacctagcaaaggaagtttttgaagcttctgatgtgagtggggagaaactatggaggttgccattggaggaaagttactgggaaacaatgaaatcaggagttgctgacatgttgaacactggtggtcgacaaggtggtgctattgtggctgctctcttcttaaaacagtttgttgatgaaaaggttcaatggatgcacattgacatggctggtcctgtgtggaatgacaagaagcgttcagcaacaggatttggcattgctactttagtggaatgggttttgaaaaacgcttcaaaggccaactga

SEQ ID NO: 8603 - DNA, 1188 bp, Glycine max
  Peptide Sequence Number=SeqID_125381
atggcattgcctttcgaggaacatctattaatttttatctttttatgtagttttacatctagaaaaagtagaaagggtactaagggaattgtactgactgctgaggctgaagagtgtgagaagagcagaggcttataccaatctgcacacacggcaagggatttgggacttcaaactagcacctatcctggggaggttatcttttcaatagcactagctataagtggcctcatcctttttgcccttctgattggcaacatgcagacatatcttcagtctctcaccattaggcttgaggaaatgagagtcaaaaggcgtgattcagaacagtggatgcaccatcgcttactcccacaagatcttagagagcgtgtgagacggtatgaccaatataagtggctggcaacgcgtggtgtagatgaagaaaatttagttcagagtctaccaaaggatcttcggagagatattaagcgtcatctctgtttggccttagtgaggagggttccactatttgagagtatggatgagagattgcttgatgctatatgtgagagattgaaaccgtgtttatttacggagaatacttacattgttcgggaaggagatcctgttgatgagatgctgttcatcatacgtggtcgccttgagagtgttaccacagatggtgggaggagtggatttttcaaccgcggttttctaaaagaggctgacttctgtggggaggagcttttaacctgggccctggatcccaaatctggttctaatctcccatcttctactagaacagttaaggcattaatggaggttgaggcttttgccttaactgctgatgagttaaaatttgttgctagtcagtttaggcgccttcacagtagacaggttcaacacactttccgtttttactcccaacaatggaggacctgggctgcatgctttattcaagcagcatggcgtcggtattccaaaaagaaaattatgaagcttcgtcaaaaggaagatgagtcagacggagctcatgaaaatgttggtggcagttcctacagctttggtgctgccttgttagcctcaaagtttgctgcgcacaccctacgtggtgtacatcgcaatcgacttgccaagactgccagggagttagtgaaactacagaaaccccctgagcctgacttctctgcagatgatgctaactaa

SEQ ID NO: 8604 - DNA, 1929 bp, Glycine max
  Peptide Sequence Number=SeqID_125382
atggcgagagagcctctggctcgtgacctatgcatctctgtattcatttgcattctactcattacccaccaaagtacatgtttttacctccctggtgttgcacctgaggatttctggaagggagatccgttgagggtgaaagtgaacaaactgacttccacgaaaacacagcttccttactcatactattcactgccttattgtcggcctaaacacatttttgacagtgcagaaaatctaggggaagttctccggggtgaccgcattgaaaactctccctatgtgtttaaaatgagagaaccacagctgtgcaatgttgcttgtcgtctaattcttgatgagaaaacggccaaagagttcaaggaaatgatagatgatgagtatcgggtgaacatgattctagacaatctccctttggttgttcctataagaaggcttgatcaggaagcttccgtggtgtatctgcatggcttccttgttggtctaaagggacaatattccggaatcaaagaggacaagtatttcatccacaaccacttagcatttgtggttaagtatcatagagatccagagttagagttgtcaaggattgtaggatttgaggttacaccattcagtataaagcatgaatatgaaggtaaatggaatgagaatacccgcttaactacctgtgacccccatgcaaaaaagctagtcaccagctctgaatctcctcaagaggttgaagacaagaaagaaatcatttttacgtatgatgttgagtttgaggcaagtgatgtgaagtgggcatatcgctgggatacctatcttctaatggccgatgaccagattcactggttttcaattgtcaattccttgatgattgtactcttcctttcaggcatggtggctatgataatgttgaggacactttaccgcgatatctccaagtacaatcaactagagacacaagaagaagcacaagaagagacaggatggaaactagtccatggggatgtattcaggcctccatcaaactcagacctactttgtgtatatgttggaacaggtgttcagtttttcggaatgactctagtcactatgatgtttgctgcccttggatttctgtctccctcaaatagaggagggttgatgacagccatgctcttgctgtgggtatttatgggaatgcttgctggatatgcttccgcacgtctctataagatgttcaagggaacagaatggaagaaaatctctttcgggaccgcatttatatttcctgccactgcctttgctgtattctttgtgctaaatgcactaatttgggggcagaagtcttctggggctgtgccatttcaaacaatgtttgctcttcttttgttatggttcggcatctcatttccacttgtgtttgttggtggttttgttgggtttaataagaagccagcaattgaggatcctgtgaagacaaacaagatagctaggcagattcctgagcaggcttggtatatgaattatgtatgctctattctgataggaggcatactcccatttggtgctgtcttcattgagcttttcttcatcctcacatcaatctggttacatcagttttattatatatttggtttcctgttcatcgtgttcgtcatcctcatcatcacttgtgctgagatcacaattgtgctctgctactttcggctgtgtagtgaagactacaattggtggtggaggtcgtatctgacttcaggttcctctgcactctaccttttcctatatgctgttttttacttcttcacaaaacttgaaatctcaaaaccgatatctggaatcttgtacttcgggtacatgctgctgctttcatatgctttctttgtgttgaccggtacaattggtttctatgcatgcttctggttcacaaggctgatctattcgtcagtgaaaattgactga

SEQ ID NO: 8605 - DNA, 864 bp, Glycine max
  Peptide Sequence Number=SeqID_125383
atggcagccattgctactatcttcgtttctttcacaaccacttcgtcttctccgtttctcactagactcacatcgcgcctccatttcgctgcattccctctgcgttctccaacgaggaaactcatgtcgcacactctcgcacgtgccactctcggtctcacacatccttctaacatcgaaacacccaaggcgttttatgtttgtgaaaattcgtggaagatctcttttggttctaaggatgttgatgtgacggaatggaaaggggacattctggcagtgggtgttacggagaaagatttggctagagatgcaaactcgaagtttgagaatgtgattttgagaaagatcgactcaaagttgggtggtttattagctgaagcctcttctgaagaggatttctctggcaaagttggtcagtcaactgttcttagaattacaggacttggatcaaagagggttggattgattggtcttggtcagtcaccttccactccttcaccttttaagggtcttggcgaggccgttgtggaggctgccaagtcttctcaagcaagcagtgttgctgtcgttcttgcctcttctgaaggactctctgctcaatcaaagcttagcactgcttatgcaattgcttctggggctgtgctgggattatttgaagataatagatacaagtcagaagcaaagaaatcaacacttaggtccattgatattattggtcttgggatgggacctgaactggagaagaaactgaagtacgcaggagatgtttcttccggaattatctttggaagggagcttgtaaattctcctgctaatgtgctcacaccaggttcatatgacactttgaatgtatatgatatgtga

SEQ ID NO: 8606 - DNA, 897 bp, Glycine max
  Peptide Sequence Number=SeqID_125384
atgattacgggtggagcagcagcgacagttttctacaatttgaggcaaaaacatcctacgcttgacatgccagtgatcgactacgacttggcacttcttttccaaccagtgctggtgcttggaatcagcattggagttgccttcaatgcaagaaaattattaacaactgaatcttttcttttcttccctaccaatcctttgactgggtgtatatgtaaaacaggaattgcaaccaaggcattcttaaaaggagttgagacatggaaaaaagaaaccattatcaagaaggaaactgctagacaatcacaatttaatggcactgaaaggaccgcggaggtcgcatatgagcctctaccgggagggccaaacacaagcaatcataaagagcctaaaaaatccaaggaaacgggatcaattcttgagaatgttcgttggaaagcacttggagttcttttcactgtctgggtccttatacttgcctccgagattgcaaaagtccctgtggcattaggagcgacttcatatcaagctgtgcttctgtacacagggaagagagtgatagcatccaaaggagatcaacgaactcaatggagagcgcaccagctaattatgtattgttcctgtggcatatgcgctggtatagttggtggcttgcttggtcttggtggaggttttattttgggacctcttttcctcgagctaggaatccctcctcaggtgtcaagtgctacagctacttttgccatgacattttcagcatctatgtcagtggtggaatattaccttctaaaacggtttcctattccttatagtggtgtgggcatatcaaacatgatccaaagaattgcaaataaagagtacatggggtttgaaaacctttgtacctactcagcctag

SEQ ID NO: 8607 - DNA, 654 bp, Glycine max
  Peptide Sequence Number=SeqID_125385
atgctgcttagagaaaccattcgcaagaccagggttttatttcacaagaccctccgaagcttcaagtctgtcatctttggagggtaccaaaaactacccagatctctctccttcaatccgtttctcggtcgcagtggcaatgcaagaacttacacaagcgagcaattctacaacgagttttatgacatgctgcagtctgatctgaacagaataaagaggagtgatagcaatagcatgaacaggtcaagagatcatgcaattggagatgccgcagcaaacactgaaatccttaccaagcaaagttcgcaaaagagcattgctgaagagggagtagtactgaaagagaagaaaagcaaagggagctgtgaattgggaaagaaggaatgcttgaataattcaaaaagcattaacgagggagttcatgatttgacgcaaaagatgaaggaattggagatgatggatacgggtgatgttgagcacgtgctagacattgaagaagcacttcactactattcacgccttaaaagtcctgtttatttagacatcgtggacaagttcttcatggacatgcactctgaattctctgttcaagactcctctatcagtgtcaaacgctcaaagtcgaagggaagacttggctcaatcaggctatag

SEQ ID NO: 8608 - DNA, 174 bp, Glycine max
  Peptide Sequence Number=SeqID_125386
atggggaagggaacagggagttttgataactggagcgtcaaggcaatccgcagaaagaccaccggaactggcaggatgaggtacttgcgtaacgtgcctcgccgattcaagagtggcttcagagaaggtaccgaagctgcacctaggaagaagggagcagctaccactgcataa

SEQ ID NO: 8609 - DNA, 420 bp, Glycine max
  Peptide Sequence Number=SeqID_125387
atgaacggtgcagggagacaggggctgagatctggtgcggcgggggtgcaccaccagcgccagtactccgataacttcctcgacagctcatccaacggcaacaggtggctccagtcggctggccttcaacaccttcaatcctcctccaatcaacttcctccgcttcaggactataacttgtacggcggtgcacaaggaggaagaatgtaccggaatgcgccaaggagctttaacggaggaaacgagtattatatggagccttccacgcctcccggtggttaccgtgcttcgatgcagaaaaagaatggcgaagatttgtccggtgatttcagccccggcttgttggatctgcagtccttcgacaccgagcttcttcctcccgaggttgttattttcctcaacggaagaactttcatttga

SEQ ID NO: 8610 - DNA, 180 bp, Glycine max
  Peptide Sequence Number=SeqID_125388
atgcagccagcatacttcatcaatgaggttgtggaagagtcagagcttccttacaaccagcaagaatttcattccgaaaatgagaagatcacccatgaggccatgactatcattcagaaggagataatccagaggtgtgggaaaatcatccgaaatacaatacaaatacaaggagaataa

SEQ ID NO: 8611 - DNA, 885 bp, Glycine max
  Peptide Sequence Number=SeqID_125389
atggaattttggccagaatttcttgctagtagtacgggtaaagagtttgtagctggaggatttggaggcactgctggtataatctccggttacccattagacacgctccgtgtgatgcaacaaaactccaacaatggctctgctttcaccatcctcagaaatttggtggccaaggaaggaccaactactctgtaccgtggcatggctgcacctttggcctctgttacctttcagaacgctatggttttccaaatttacgcagttctctcaagggcatttagcacgtccgtttctgttaacgaccctccttcctacaagggtgttgctttagggggattttgctccggcgctttgcagagcatgttgctgtctcctgttgagttacttaaaattcgccttcagcttcagaacacaggccaatccacagaaccacaaaagggtcccataagggttgccaacaacatatggaaaagagagggtcttcgtggcatttatcgaggacttggcatcactatactaagagatgcacctgcgcatggcctttacttttggacatatgaatacgcgagggagaaacttcacccaggttgcagaaaaagttgtggagagagcttgaatactatgttggtatcaggaggattggccggggttgtgagttgggttttcagctaccctttggacgttataaagacaagattgcaggctcagacattttcttcgctgaaatacaaaggcattttggattgtcttcggaagagcgttgaagaggaaggatacgttgttctatggcggggtttaggaactgcggttgctagagcgtttgttgtgaatggtgctatattttctgcttatgagatcactcttaggtgtctgtttgacaaataa

SEQ ID NO: 8612 - DNA, 579 bp, Glycine max
  Peptide Sequence Number=SeqID_125390
atggctcacttcattccttaccataaagtggatgatgattgtgtggtaaaagacttgttctttagagaggtggtgtgccttcatggactgcccaaaagcattgtgtcgaatagggattctaagttcctaagtcattttttgaagactttgtgggggaaagcttggcaccaagattattctatccacaacatgtcacccccaaaacgatgggcaaaccataaatcttactctttatcaactcctatggcagattattttcaaggaggggatgatggaggtccaccaatggaagagcttgaagtgaaggggcctttgacaaggtcaagctccaagaagcttgaagaggaactcaagaggaagctcaacacacttggggagcatggagtagagagattggatttaaagtggctaaatttgagccaaattttagaacaagcaaaaggccaatttggggcagttgcagctcgcccaggcgagttgaaccttagccctgaagtaaggggtggttccttgctttgcactgtaactagcattcaatgtcataagtcgactaacaagaatcaaaagatcaacgaatga

SEQ ID NO: 8613 - DNA, 207 bp, Glycine max
  Peptide Sequence Number=SeqID_125391
atggtggagagagcgaagaagagtgcacattttaggttagtggtgaagagaggaagggtgtacgtggagagggataagaaatcgatacagacaccttctgaggaagtgaggtcgcggaaggaagaagaagcgaaacagacgaggcgtggaaggaagagaaagtgctgggtgtacaaatattttaaaaaatttgacaagggtatttag

SEQ ID NO: 8614 - DNA, 285 bp, Glycine max
  Peptide Sequence Number=SeqID_125392
atggataatgaagagggtgtgcaagagcagatgaaggccgacctatcggccttaaaagatcaaatggcttctatcacggaggccatgctaaaactccagaaaactctagaggataatgccacggcgaccgcctccaatgcagttagggaagcgaaaccggtgctacagcccgccataaacttgagccatgacagaaacggaacggtgttcggtcagaggtacagtccgcaagcttacccttatggcttgcctccggacttcactccccgtgccgctccagaagat

SEQ ID NO: 8615 - DNA, 321 bp, Glycine max
  Peptide Sequence Number=SeqID_125393
atgcatactcttaagagctcatgggtctccgacaccatcctcagccacgtcgactccgacaaattcttagtgcattaccacaacttatccgagaaagcagttgtcggccttcaccgcctccgaccactccccttgccggagagccaccatgaattcaactccggtgacaatgtagaagccttccgcaaggaccgctggtgggaaggccgcgtcaccgaaaccctaggaaatggaaggttcattgtgtctttcaacgactcagaggagataacgttttcaaaagaattgctaagggcacccctccagtggatcaatcaataa

SEQ ID NO: 8616 - DNA, 228 bp, Glycine max
  Peptide Sequence Number=SeqID_125394
atggtgatcaaatacgcggtgttcgaaccgcgctctgcagtggaagcccgcatagactccaacagattcttattgcattaccacaacttttccgagagagcacttgccaatcttcaccggccccggccacttccccgccggagatcgatcggaaattcaagtccggcaacagggtggaagcgttctgcaatcatcgccggtggaaaggtcgtgtcaccaaagatttag

SEQ ID NO: 8617 - DNA, 1506 bp, Glycine max
  Peptide Sequence Number=SeqID_125395
atggcaaatcttgcacaatatctcaaatcaaattcagattcacagacgatacaacaaaaacaactacctgcatctttgtacttgtcagcagcacctcagtgtccgtttcctgatgctaggctgggttcggccattggtaccggcatttttgactatgtctgggtacaattctataacaacccttcgtgcagttatagccaaaacaatttagataactttctaaaatcatggagagagtgggccacatcattgaaagtaggtaaactgtttctggggttaccagcagatgaagctgcagctccggccggaggttatgttccggctgatgtattaatgtctaagatcttacctgaaataaacaagtcaacaaattatggaggtctcatgttgtggtcaaggtactacgataaaattagtggatacagtacccgcattcaaaatcctctaagaaatgggacagcaaaccctctatgcacacggaaaagtcaagcatgtaggagccatgagggcggtttcgcggagcttcttggttacatgtccacgctcggtatcaaagtttatgaagacgacaacaatggaacacagtgctgtgagatcatatgtaggaacaactgttcctgcgacgcgtttgctcccttaaatcacattaacaatactagtactggatgtcagatatggctcaaaggaaccaaatttgttagagcttctggaaatatagctctgccaatcaacgtttctgttgcattgctggaacacaaagtaaacagctggtggatttggctcatcgttggggtgggagcagcttttgtaatacctgtgatattctatttatcgcgtgccttcctgagaaaatacaaagcaaaagtggagagaaaaaagatgcagaagaagttattacatgacattggaggtaatgcaatgcttgcaatggtgtacggcaaaaccataaaaagtaataacaagggaaagactaacaatgaagttgaactatttgcttttgataccatcgttgttgccacaaacaatttctcagctgcaaataagttaggagagggtggttttggtcctgtttataagggaaatctaagtgatcagcaagaagtagcaataaagcgactttctaaaagttcgggacaggggctaatagagtttacgaatgaagccaaactcatggccaaactccagcacactaatctggtaaagcttttagggttctgcatccagagagatgaaagaatattggtctatgagtacatgtctaacaagagcttagacttctacctatttggtaggctttcttttatcttaacaaagcatattaacaagcaaccttactttaaaacagattcggctagaaaggatttgctagactgggaaaaacggttgaacatcattggaggaattgctcaaggacttctataccttcataagtattcaagactaaaggtgatacatcgggacctaaaggcaagcaatatattgcttgatcacgagatgaaatgctaa

SEQ ID NO: 8618 - DNA, 180 bp, Glycine max
  Peptide Sequence Number=SeqID_125396
atgtccttttccaaaaaaatatactcccctgttgtcagtttcggaaaaatcatccacccccaactaggacacaacatcgtccccgcctacgacaacttcgacctcagccggtatcaagcaagtcatgaacaacaatcacaaagagagttaaactcgttaaggaatctacaaagtctttag

SEQ ID NO: 8619 - DNA, 207 bp, Glycine max
  Peptide Sequence Number=SeqID_125397
atgggtaaagatctgagcgaggagcaagtgtctttgatgaaggaagcgtactctctattcgacacaaacgatggcagtggaattgcgccgtttgagttgaggatcctgatgcggactgatttgtgcttgattgcaccgaacactgaagcattgaatgcattatatctttcgtcaacatcaaatagagttctagggttttggtcttaa

SEQ ID NO: 8620 - DNA, 225 bp, Glycine max
  Peptide Sequence Number=SeqID_125398
atggattcacgatatgtatacattggattctttccagaagggcaactaaaaaccccggtaccttgctcacagaacccaaatgaccattcatcatctccaaaaacctgtaatggcaaaacaatcttaaatatgtcagcacaagataaaacagcaggcctaccatatgtcaaggaagcagaaaaccacaatatcaacgaagatgcaaatattgataccctcccttga

SEQ ID NO: 8621 - DNA, 780 bp, Glycine max
  Peptide Sequence Number=SeqID_125399
atggaatcagaagaagtgatgagcgaggtgcacctgggttgcccagccggtttctccggaccctatatttcccttttctctttctctacgaatctccaattcgaccaagatggtgaccttcttctccctcgacgacgcaccgctatgttcgaagcaaacgcacaacattcatttagtgtcagaatccagcataacatcacttcgtcaattccaaatgttggtctccaggtttggagagctgaactattattatctgattttatattgcataaagcatcttcttcctctcaacttcatcaagttattgcattagaacttggcgctggaactgtgccactcttccctgctcctatgaatcatcatggtggaaattcatattctcctactacaaatggggagtggggaccatattgcataattatagagaactatgaccatgggactgaaatacttgacaactgtgcaaagaacgttcagcttaattttggattattgaattatcaagccaaaatttatgtacgtgaacttgattggttcggttgctggcctcctaaagcaaaaacaggagaggctccttccacacaaaaagaaattgaagatgcagaaaatgcttctttgctggtggctgctgatgttatttatagtgatgagctgactgatgcatttttcagtaccttagagagattaatgtcaaggggttccacaaaggggtatggagataacacgcaccatgatgagtatggaacatggggaggaaatgttgcagtcatgatctgttga

SEQ ID NO: 8622 - DNA, 771 bp, Glycine max
  Peptide Sequence Number=SeqID_125400
atgggttgcaatcaatcgaagatcgagaacgaggaagcggtggcgcgatgcaaggagcggaagcgcttcatgaaggactcagtagcctcccgcaacgccttcgccgccgcccactcggcctacgccacctgcctgaagaacaccggcgccgccctcggcgacttcgcccacggcgaagtccaaaaccctcaatttcactcaaacgacaacaacaccagcagctcctcctcctacgtgacggcggcacagcccttcgaaattcctctcccgccgccccctctccccgatttctcccccgccccacctctccagcgggccgccagcatgcccgagatcaagatcaacaatcccgactccaggcccaggcccgagcccgtcaccacaatcgtcgaagaggacgatgaggaagacaaggagttagaaaacgaagggtctttaaggatgagaagaagcaacagagttaatagtaatagaagggtgtcagaagaagaagtgcaagagcctcgtcctcctatgcctcctcctccttccaaacaacctgatcacgcgacacatcatcaccaccactccatggcgccggacactcaaagtggtgcttgggagtacttcttcccttccatggagaacattgccgggaccagcctcaatgccgctgaagaagatgctgtccataaagtgcacgatattgagaggaaggtgtttgaggaaaagcccagcagggttgtccttgaggaggaggatgaggttgtcacacctgtcaggaaggttgag

SEQ ID NO: 8623 - DNA, 1473 bp, Glycine max
  Peptide Sequence Number=SeqID_125401
atgaagattcatatgagaaacatagtttctagactctgcgttgctcacacgtggattgcaccccacgttgtttcttgtagctatataactaaaacccatcatgccaatgtcactaagcatgaagcctcagttgcacacatagacattaatccatgtagtttggattcaaccactttccaggttgcttgccacatgtttgaggaaatgtctgagcaaactgtagcattggcaacgaccataattcagggctttgttaagcggcattgccatgaagatgcaatctatcttttctccaagatgttggcctcaaaaattagacccaatgagttcacatttggaactgtgcttaactcctccactgcacttggaaatgttgttgttggaaagcagcttcatgcttgtgcaatgaaaattggccttagttgtcatagagggaggtttgaagatgctttgcaggttttccatgagatgcctgagagaaatgttgtctcatggaatgcgatggttggtgggtgcagccaaatgggccacagtgaagaagctgtggatttttttattggcatgcttagagaaggatttataccaaatgaatctacatttccttgtgtgatttgtgcagctgcaaatataacttcccttggaatcgggaaaagttttcatgcatgtgcaatcaagtttttggggaaggttgatcagtttgttggtaattcacttattagcttttatgcaaagtgtggaagcatggaagacagcctgctaatgtttgacaagctttttaaaagggacatagtttcatggaatgcgatgatatgtggttatgcacagaatggaacaggtgttgaagcaataagcttgttcaaaagaatgggttcagaaggctataaacccaattatgttacccttcttgggttactctgggcttgcaatcatgccagtcttgttgatgagggctactcatatttcaatcgggcctggcttgacagccccagtttgctgaagtctgagcattatgcttgtatggttaacttgctcgctcgctctggacggtttgcagaagctgaggattttcttcagagtgtacctcttgaccctggacttggattttggaaggcattgcttgcgaggtgtcaaatccactctaacctgaagttgggagagctggcagcaagaaagattttggctttggatcctgatgatgtatcgtcatatgtgatgttgtcagatgctcattctgcagcaggtaagtggtcagatgtggcaaccgtaaggactgaaatgaaggaaaaagggatgaagaggattccaggtagcagttggattgaagtaagaggtgaagttcatccctttcttactggagaccagaatcataataaacaagatgaaatttatttgattttaaaatttttctttgagcatttaagggaaaatgaggattccgatttgctcaacatttattggtatttcagttcataa

SEQ ID NO: 8624 - DNA, 207 bp, Glycine max
  Peptide Sequence Number=SeqID_125402
atggcaccaaccatttttgtgcagttcttcttcttcgttttctctctttgttcggtgaaggtgaaggtgttcattgttgcggtggttaattcgtcgtcgacgacatacaagatcaacttgatccctaagctcaacacaaactacggatcatctattcctattgtggatcaactacgtcctaccttgtctctattacggatgacctaa

SEQ ID NO: 8625 - DNA, 255 bp, Glycine max
  Peptide Sequence Number=SeqID_125403
atggcgccaaaatttacttgttcgaccagaatacttgtttactccctcttccaaattggtattacttgttttatatgggagtggtcttatcggcaagcgcaccgggtcaccaacctttcatggcaaggaaactccttttacactgaagaagaggaatccagagaaatcgcttgtctacaaaggagtggggatgtctcctccacctctaggaatctcacaatcactcaaaaactcactaatctccctaaaagatga

SEQ ID NO: 8626 - DNA, 615 bp, Glycine max
  Peptide Sequence Number=SeqID_125404
atgggaactggaaaaaccagcatagcattgcgatttgtaaaaggccatttctttcctaaccaggtttacttccatttcatcgcattaattgaaattggaaagctgctttcccagcacaataacaactacagtttaggaatcttaacattaatctacgcacaggaaccaaccataggagctgcttttttcacccaaatattatcattatctgaagcaactgtaaagttcgatatatgggacacagcaggacaggaacgttatcatagtttggctcctatgtactaccgtggtgcagcagcagcaattgttgtctatgacatctcaagtgttgatacatttgttcgagccaaaaaatgggttcaggaattgcaaacacatggtaatgcctcaaactcgaagtcggtgatggcattagtggcaaacaaatcagatttggagccaaagagagaggttgaagctgaggtaggagagcaatttgctcaagagaatggaatgttctacatggaaacatctgctaagactgcagagaacatcaatgagcttttctatgaaatagcgatatacaagatagagggagaaattatttttgttgctcagcctgatattcctacgtaa

SEQ ID NO: 8627 - DNA, 297 bp, Glycine max
  Peptide Sequence Number=SeqID_125405
atgccaagttggagaacgttttggaggaagatcaagtgggaaaagaggaggttattcagctcttcacccgcagttcatgtccaatatgatcctagctcctactcacagaacttcgatgatggctattccaccgaccctgataacctttctcgctcattctcagctcgatttgcagtcccctccaagatttttgacaagagtgaaatgtttatcaactttctttccaattctggatatgccatttttgagtcaggttgctgtcagtccaagtgcctcaaactgtcattaaacaagtaa

SEQ ID NO: 8628 - DNA, 537 bp, Glycine max
  Peptide Sequence Number=SeqID_125406
atggaagcatcatgtagccatattgtggagggagggctgaaatgctaccaaaaagtcattaaagaaaataaagagttttcgtcaatcaagctgttgggttatacattggtagatggggaggtcagggtgtacttttctaggtttgacgagaaatttagtatccaacacttccttgattacatcctggtatgtctgatagaggaggatgagctttgtttggtaacactgcaattgtatcaaaccgatactcatcctcaaacaaattttgtatttgtcaataaaggaaaagaaaacaatgatttttttttctatatgtatgactgcatatacttgaaccttcatgtatcttcgaatcttgaatgtcgccccttctcaattgcacctgaatgggtgggtggccattcaggcattatgcttgtatacttataccaaggttacccctgggttgtttttctatttcttttgttcttggctgaaaatgatggcgaggtaggtgtcctaggttcgtcttgcctctcgacccttgttttggcttaa

SEQ ID NO: 8629 - DNA, 798 bp, Glycine max
  Peptide Sequence Number=SeqID_125407
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatggtctgctggccactcccgccaacgccttgcgcatcaaggaagtggcctcggttcagggcgtgcggtctaaccagttgaccggctacggtctggtcgtcggcctggatggtacgggtgaccaaaccacccagatgccctacaccacccagacgctgtccaactacctgcagcaaatgggcatcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 8630 - DNA, 252 bp, Glycine max
  Peptide Sequence Number=SeqID_125408
atgaccccttcgcagcaacatgatgccccaatggcaacacctaatgccccattagctccgcaatggaatgtacctggagcaatacctgatatgggtgatttattaggtgttgatttgcatcatgagttttctgctgaggctgagcaacaagggcggcgacagcgggcaagaagaaatcctgatcgtgaagcccgaaggtgggatcgaccatgtggcacaggctcacgccatcacggacaccataatgattga

SEQ ID NO: 8631 - DNA, 442 bp, Glycine max
  Peptide Sequence Number=SeqID_125409
aggactatacatcgtcgcaatcagaggcttacacgtcctcgcctttagagggctacacgtcctccccttcagaggacaacatgacctcccctttagaggactgcacgccctcgccttaacaggactgcatgttctcatatttagaggactacacaacctcgccttccgagggctagacgccctcgcctttagaggagtacacatcctccccttgagagggctacacgccctcgccttcggttacacgtcctccacttcagaggactacatgcccataccttcaaaggataccttcataggactacacgcccttggcttcgtaaggcttcacgccctcaccttcagaggactacacatgctcgcctatagaagactacacgcctttgccttcgtagggctacacgccctcaccttcagaggactacacatcctcgttttctga

SEQ ID NO: 8632 - DNA, 683 bp, Glycine max
  Peptide Sequence Number=SeqID_125410
atgccttcagagggttgcacgcccttagaggattgcatgtcctcgccatcagagggctgcacgccctcaactttcgacgactacacatcctcgccttcagaggactacacatcctcgccatcagaggactacacgtcctcgccttcacagggctacgtgtcctcaccttcagagggctacatgcacgcccttagaggactatgggtcctcatcttcagagggctacatgccctcgtcttcagagggctacacatcctcacctttagagaattacacgtcctcacctttagagggctgcacgccctcgcctttagagggctgcacaccctctcctttagagggctgcatgccatcgctttcagaggactacgcgtcctcaccttcagagggcaacatgccctcgccttcagagggctacacgccctcaccttcagaggactacacgccctcacctttagggggctgcacgtgtttgcctttagagggctgcacaccctctcctttagagggctgcacgccctcgctttcagaggactacacatccttgccatcaaggactacacgtcgttgccttctgagggctacacgccctcaccttcagaggaatacacgtcctcacctttagagggttgcacgcccttgccttcagaggactacatgtcatcgccttcagaggactgcac

SEQ ID NO: 8633 - DNA, 126 bp, Glycine max
  Peptide Sequence Number=SeqID_125411
atggtgaggggaaacgaagatgatggcatacgaaggcaagggcataagtacgagaggcgatggcaagagtacaagaggttcaaagaagataggcaagagagaatcatcgtcgatagagtgtcatga

SEQ ID NO: 8634 - DNA, 750 bp, Glycine max
  Peptide Sequence Number=SeqID_125412
atgcccaagaaaattcgagattacctcttcaaaataaaaaaccctcgccctcaagtccggttaccctctaagaactggattctctctggctgcaagcatcctaggaccccttcctttgccttatacagtggtagaaaccaatctcatcataatcctgttctcaacaacaataacaataacgatgctgccaccttagcagacgttgatcgtttcctcatggagaatttcaagtctctatacctcaaagacgaacatgatcatcaaaaccacgaccaagaaattacaacgccacgtgatcttcctggctcgacccgattctttgtgaagcctgcagggttctctgggtccctagtggaggatgctttcacaagtgacgaagcagcatcaatctcaacaatcaacgatgtttcttcttcaaattcttatgagaaggaggctcttccggataatagcatcgctttattgacgcgctcgaccagcccctacgaggacttcaagcgctccatgcaagaaatggtgaacaaccatgaaagcgtggttgattgggatttcatggaggagctcttgttttgttaccttaacctcaatgagaagaaatcgcacaagttcattctcagtgctttcgtcgatctcatcaccgtcatgcgtcggaactcggagacaccttccaacaacccacagagcgttcgaaccgttaggagtcatcgtgggaccagaaatgttacgttagaatttgggtcctcctcctag

SEQ ID NO: 8635 - DNA, 173 bp, Glycine max
  Peptide Sequence Number=SeqID_125413
atgtcctcacttgaagaacaaaacgcgttgtctcatttctttccacatcgctatcacaacaacaacgccgagaagagaaccttttcaatcgaaaaatggacactggtaatggttccagagacgccaaactcgacaacacaccaatgcaaatggatttggattctaccgctcaa

SEQ ID NO: 8636 - DNA, 345 bp, Glycine max
  Peptide Sequence Number=SeqID_125414
atggagtacgggttcccgttgggtcttcttcccaagggagccatagggtattcgcttaacaaagacaacgacgagttcacagtgtatttccaaggagtgtgcagcctcgacatagaagcctacatgctcaagctctataatctcaaaggtgtcactgtcaaaatattgctcctttggctcaacatcgtcaaggtctatcgtcaggggaacgatttttacttctctgtcggaatcacttccactgattttgacatcgagaatttcctcgaaagcccccagtgtggttgtagtttcgattgcaaaccactacccttaaacagtgacgtttccgtttcctcaatttaa

SEQ ID NO: 8637 - DNA, 264 bp, Glycine max
  Peptide Sequence Number=SeqID_125415
atgacaagagatgttggtactcaaagtacacctccttatattagttcaaccagtctcagccctgcttcaactccgtccatcacagagagatcaaaacctctagtctctgactcgcctaactcaaatgcaaaatcaaaatccgaggaagagctcttccctttgtctcatatgaaagcactgaagactagtccctactctactaatgattcatttacgacgtgtgttttgacgacagttcataatcgtcgtaaaaagtcaaaataa

SEQ ID NO: 8638 - DNA, 423 bp, Glycine max
  Peptide Sequence Number=SeqID_125416
atggcgacgaagacgacgagcctgatggagacaatgacaacgagggcgagagggaacaaaagtcaaggtgtatgttcaaaaaacgacaacgttcattttgccgttgagggagagctagatttggatatcaacgaacatcttcccagttgcaatgcaaccattgtggagagtccaaaaactaaggatgattgtggaaaacttagtaatgctactagggttttgaatagaaatcattttggtttttctgcttattgtgtggctaccattgagttttctagacggcagattccaattgctttccttcaacgaatcaacgaggattttaccaagaaatatgttggaggaaaagcagcaacaacagctgctcagagcctcaacagagagtttgggttgttgaccgtggggcaaaagttgagcttttga

SEQ ID NO: 8639 - DNA, 1194 bp, Glycine max
  Peptide Sequence Number=SeqID_125417
atggatggcattgaggatgatgcaaggtatccccataacccatatggttatggttatcagaattctccatattcccccccagttgatactgaatatgcccatgatgataatgatgaaaatgaacaagaacagttagaaggggatgatgaggttgatgttgatcaaagtaacaatcttcagcttccccaagaggatgctgttgatgaagatggcatgtatgggggtggtgatgaaaatgatgataaccatgatgatgatgatgatgatgatgaggaggaggaggaggaggaggaggaggaggtggaagagaataagcagattgattattatgccattaagagtgaagatgagttagagtggcacccaaaaaagcaaaagctaaagagtttgatttcgacctatgaactcgcacctcgagtgccagcaccatcatcagttgcagctactgctcccacggttcctaaaccatcttctgggggtaggaattcactaactgactggactgagcaagagacttttgttcttcttgatgcatggggtgataggtttcttcaacatggaaggaagagtcttcgatgtgaggaatggcaacaagttgcaaaaatggtatcacaagtttcaaaaattgaaaggacagatactcagtgtagaaatcgtctagatacattgaagaaaaaatacaagaaggagaaggctaaatttccagatagtgatggtggagcttgcaaatgggtttatttaaaaaggatggatgagctaatgtcttctcctccgcaacaagctggtctctcttgtggtttagactcaggagagtatgtttttatgaacaccagagttcatttgaaccatgcaaatgggttggatgaaatgaaggataatcctgacaatacagaatctactggcgaagaagattctgatgggcctcaagcaaagaaaagaaagaagagaaggggcagtggcgaagcttcttctttcaggttacttgctgattccattcagaaattcagtaagatatatgagaagatagaaaatagtaaaaggcagcagatggtggaactggaaaagatgaggaaggatttccataaagagttggaaaggcagaagaggcagattttagagaatctgcagtgtgagatttcaaaactagagcagagaaatgatgagaacaatgattctgccgaaaatggtacttga

SEQ ID NO: 8640 - DNA, 762 bp, Glycine max
  Peptide Sequence Number=SeqID_125418
atgcacacacaacttgccctagtgttagcgcttgcattattggtagtacatgtaagagcaattaccacacgtgatattgccctgcatggctacatggacacgtgcaggaatgtttcaattccatatccattcggcataggcacttctaaagaaacaggtgagaactgtttcttggaagaaaacttgaatctaacatgcccaaacaacaatttatattcaaggtttaatttgcaagttttagacataaccctaaaaggccattttatggacagttgttttatgtctccatactttgcaataacaccctccaacggagtggccaatgacccttttcttagaactgctagcaatttcaccatttccagcaaagaaaacaagttcataagtgttggttgcgagacttatggcttcctcaatatagcttctacaatggcgtgcaatattcgactggggatagggtgttgtgaagtggatattcctcccaacatgaagaacatcagcatagaagcatatagattcgatttgtcttccaattacttccaaacttgtggtcattcctttgttcccaaacgtggctcctacaactttgatataagtcatttggagaagccgtttaacaccatccctatggttgttgattggagtgttagagatgacctgggatgtgaggcttttaggaaacggtttcgaaaaagtgcatgcatggacaatagctattgtcatgacattgagattagttatggataccaatgcagatgttaa

SEQ ID NO: 8641 - DNA, 141 bp, Glycine max
  Peptide Sequence Number=SeqID_125419
atgttatcggccagcgtttgcaaaaacaattgcgcaatgtcggctgaaaatatcagtcgaggaaatgttcgatcggcgtcatccgatgatgcttccgttttaaacctcgatcgcttaactttcctggccgacgtcggctag

SEQ ID NO: 8642 - DNA, 555 bp, Glycine max
  Peptide Sequence Number=SeqID_125420
atgaataatctcgtaggacagccagtggttgaccaaggattcactttcttggggatgcaatacacttcagcttcctttgcatccgctgttatgaatgccgtgccctctgtaacctttgtgcttgcagtaattttcaggttagagcatataaaaataagggaattacgcagtcaagcgaaagtaattggaaccttagtaacctttgctggggctttgttaatgacactatacaaaggccctcaattcgacctatttcatcattcaaacacaacccaccaacaaggtggaagccacactcagaatcactcacactgggtcgcaggaactctcttcatttgcctgggttgcctggcttggtcttccttctacatattgcagtccataacggtgaaaaggtaccctgcggaactatcactctcatcgttgatatgcttggcgggtgctttgcaaagtgccgtggttgctctgattgcagatcataaccctcgagcatgggctatcggttttgactacagcctctacggtcctctatacactggttgtatctacaagtaa

SEQ ID NO: 8643 - DNA, 455 bp, Glycine max
  Peptide Sequence Number=SeqID_125421
aagagctaaagaagcccaccaataactatgatgagaggttaatcattgacaacggagaagagctaaagaagcccaccaataactatgatgagaggttaatcattgacaacggaggttttggtacggttttcaaaggagtccttccaaataacaaggttgtggctatcaaaaagtccaaagtagtggacaaaagccaagttgagcaattcattaatgaggtggttatcgtgtcccaaatcaaccataggagtgtgaacccaagtatagagcaatgcgcacagaatgatgcaaatgatgaggatgatgcaacagaaacagagtatgcaacagaaaccaaaaaagaaggagaagaaagaccaaaacgaggtagcaaaaggccacgttacctggatgactacgtggccaacactgcatttccaaattcctccaaggcagaaaatgccaaaatccgttag

SEQ ID NO: 8644 - DNA, 462 bp, Glycine max
  Peptide Sequence Number=SeqID_125422
atgggtatgaagtaccaaaaaatacatgcataccctaatgattgcattttgtacaaaaatgagtttaacgaaatgcgcaaatgtcttacatgtggggtatcacgctacatagtgaaggatgacgcctgtagtgacaatccaaccacgaacaacaactttccagcaaaggacccaaggaacctaaggcttggccttgcttcagatggaatgaatcatttcgataacttaagcaccagcgatagttcatggcctgctttgcttatgatttacaaccttccaccatggttgtgcatgaagcaaaaatgcatgatgttgtgtatgatgatatcgggtccaagacaaccaggaaatgatattgatgtgtatctaacacggttgattgaagacttgagaaaattatgggtacatagggttgatgtgtatgatgggaatgtccagcagaccttcaggttgcatgcatga

SEQ ID NO: 8645 - DNA, 368 bp, Glycine max
  Peptide Sequence Number=SeqID_125423
gctcactctctgcaagagagatagagctttctgaggattatacctgtataatttctcatggtctaaaccctaagagaacacatatttttggcgactgcattttggaatgtcacaacaatgacttcactgagttcaacaagaaggaagagcctgctttcagctcttctcaagttcctgcattttcagatggatcagccccttatccttctggcaatattttgagcttttgttactcatgtaataagaaattagtaaaggaggaaggcatttatagatacaggtttgtcccaaacatttctctaagctactgttacttcagtcaagtcaaaagcgccagtggtaatatattgtatatcttgcagaggtga

SEQ ID NO: 8646 - DNA, 1320 bp, Glycine max
  Peptide Sequence Number=SeqID_125424
atgggatcaatgttaagtgagaaaatttcttacactcaagaacctattctctatctgggattggctttcaccgccactttctttgctggtgtattccaagcttctctcggtatattaaggttaggcttcgtaattgattttctgtcgaaggcaacgctggttggattcacaggcggtgctgccgttattgtgtcactgcagcagctgaaagggttacttggaattgtgcactttaccagcaagatgcaaataattcctgttatgatctctgttttcaagcaaagacacgagattgggcacttaccaaagggagttaatccaccatcagcaaacatgctatacttcaatggtccttacttggctcttgctatcaaaactggcatcattacagggatcttatctcttactgaaggaattgcagtaggtagaacatttgcttcacttaaaaactaccaggtggatggaaacaaagaaatgatggccattggtctaatgaacatagctggctcttgttcttcatgttatgttacaacaggatccttttctcgatcagctgttaactataatgctggagcacagacaacagtttcaaatataatcatggctgcagctgttctagtgaccctcctgtttctcatgcctctgttctactatacaccaaatgttgtcttagcggccattatcatcactgctgtgattggtctaatagattatcaatctgcatacaaattatggaaggttgacaaacttgatttcttggcctgtttgtgctccttttttggggttctgttcatttcagtgcctttaggccttggtatagcggttatcatatcagtcttcaagatcctgcttcatgtcactcgaccaaacactttggttttggggaatataccaggaacacaaatattccacaacataaaccaatacatagaagctttaagagttccttcatttctcattttggctgttgagtctccaatctattttgctaactcaacttatcttcaagaaaggattctgagatgggttcgagaagaggaagagcatataaaagctaataatggagctccattgaagtgcataattttagacatgacagctgtcacagccatagacacaagtgggcttgacactttatgtgaacttagaaagatgctggagaagcgatcacttgagcttgtgttggcaaatcctgttggaaatgtgatggaaaaattgcataagtcaaatattttggattcttttggattaaaaggagtctatctcacagtgggagaagctgtggctgacatttcatcaatctggaaagctcagccttga

SEQ ID NO: 8647 - DNA, 333 bp, Glycine max
  Peptide Sequence Number=SeqID_125425
atgcatacacagggaaaggcttctagggatgcaacaaccacaagaggagttgcgcgtcctggtcatgccggtggtgcgctatcctttcatgatcttgatgttacctctttttggaaaacttcgaagcagcaacctagtacaagaaccggtaatgcacctgaccagcttaaagcaaagagaacaatagtcttcttagccaagattaagaatctttgggaactctgggattccactcgacctgatcgcgtcaccggcggaagctgccatcggaatcttccgagtctcgccggaaaagcgagccgccgtgggggttcgaggaggagaatgatttga

SEQ ID NO: 8648 - DNA, 3432 bp, Glycine max
  Peptide Sequence Number=SeqID_125426
atgggggttggtatcagactcccaacagtagaagtgaggtatcaaaatttgattgtggaagctgattgctacattggcagcagagctctgccaaccttaccaaacgttgcattgaacattgctgaatcagctcttggcttatgtgggattagtaccgcaaagaggacaaagctcacaattcttaaaaatgtcaccggcattattaagccttctaggatggcccttttgcttggtcccccttcttcagggaaaacaacccttttgctggcattggctggaaaattggacaatgatttgagggtaaatggagaaatctcctacaacgggtacaagcttaacgagtttgtccctagaaagacttcagcctacattagccaaaacgatgtacatattggagaaatgaccgtaaaagaaaccctcgatttctcagctagatgtcaaggagttggaacaagatatgacctattatctgagctagctcgaagggaaaaggaagctggaatatttccagaggcagaacttgaccttttcatgaaggctactgcaatggaaggaacagaaagcagtctcattactgactatacactcaaaatattggggcttgatatttgcaaagataccattgtgggtgatgaaatgcagagaggtgtatctggtggccaaaagaagcgtgtaaccacaggggaaatgatcgttggacctacaaaaacattattcatggatgaaatatcaacgggtcttgatagctccacaacatatcaaatagtgaaatgcttccaacaaattgtacacctcacagaagcaaccatattcatgtccctactccaacctgctccagagacgttcgatctctttgatgatatcatcttaatatcggagggtcagattgtttatcagggcccacgtgaccacatcgttgagttctttgaatcttgtggctttagatgtcctgaaagaaagggaaccgctgattttttacaggaggttacttcaaggaaagatcaagaacaatattgggcaaatagaagcttaccataccggtatattacagtgagcgagtttgcaaatagattcaagcaatttcatgttggaatgcagcttgagaatgagctttctgtgccatatgataaatcaaggggacatagagcagctcttgttttcaagaaatatacagtgcccacaatgggacttcttaaagcatgctgggacaaggaatggctactaataaagaggaatgcttttgtctatgtatttaagacaggtcaaatagtcattattggtatcatagctgcaactgtgttctttaggaccaatatgcatcaaaggaacgaggctgatgcagcagtttacataggttcaattttgtttaccatgatcatgaacatgttcaatggttttgctgagttaccactcacgattgcaagacttcctatattctacaagcacagagaccaccttttccatcctccttggacttacaccctccctaatttcatcctacggatccccattactatgtttgaggctattgtttgggtacttatcacatactacacaataggattagcacctgaagctagcaggttcttcaagcacttgttgctagtttttcttgtccagcaaatggcagctgggatgtttaggttcatatctggagtttctaggacaatgattattgctaacactggtggatccctcatgctccttcttgtttttttacttggaggtttcatccttcctaaaagttccattccaaattggtggatatggggctactggatatcaccactaacatatggatacaatgcttttactgtgaatgaattatttgctccaaggtggagcaaaccgtcttcagatggtagaaccccgatcggtatagctacgttaaataactttgatgtttttactgagaaacgatggtactggataggtgtagctgctcttgtgggtttcattatcttgtacaatgttctcttcacctttgcacttatgtaccttgatcctattggaaaaaaacaagcaattatatctgaagaagaagcaagtgaaatggaaggtgaaggaaactttagtgaagatcctagacttttaaagccagagcccaacagagagatagcccttcaatcattatcttctactgatggaaacaacacacgagaagtggcaatgcaacaaatgggtagccgaggtaatcctagtggaataagaagtgttgattcaatgcatgaatcagccactggagttgcccctaagagaggaatggttctaccttttcaaccacttgcaatgtcttttgatagtgttaattattatgtggacatgcctgctgaaatgaaagggcaaggagtgacagatgataggctacaattacttagggaagttactggtgcctttaggccaggagttttgactgctttaatgggagttagtggagctggaaagacaactttgatggatgttttagcagggagaaagacaggtggctacattgaaggagatgttagaatatctggcttccccaagaaccaagaaacatttgcacgaatttctggctattgtgagcaaactgatatccattcaccccaagttactgttcgagaatctttgatctattctgctttccttcgattgcctaaagaggtcaataatgaggaaaaaatgaaatttgttgacgaagtaatggacttggttgagctaaacaatctcaaggatgctatagttgggcttccaggtgttacagggttgtcaaccgaacaaagaaaaaggctaacaattgctgttgaactcgtagctaatccgtcaatcatttttatggatgaaccaacttcaggtcttgatgcaagagcagcagccattgtgatgaggactgtgagaaacactgttgacactggaagaacagttgtatgcacaattcaccaacctagtattgatatctttgaagcctttgacgagttgttgttgatgaagagaggagggcaagtgatctactcaggaccattaggaaggaattcacacaagattatagaatattttgaggcaatcccagaggtcccaaaaattaaggataagtacaacccagctacatggatgttggaggtaagctctatggcagctgaagttcggcttcaaatggattttgctgagtactacaaatcatcatctttgtatcagcgaaacaaagctcttataagggagttaggtacacctcctccaggagcaaaagatttgtacttccccactcaatattctcaatccacttgggaacaattcaaatcttgtttatggaaacaatggttgacttattggaggagtccagattataaccttgtcagatttttcttcactttagctgcagctttcttggtggggacagtattttggagggttggaaaaaacaggtttaaattagttgctaccttagttgaataa

SEQ ID NO: 8649 - DNA, 303 bp, Glycine max
  Peptide Sequence Number=SeqID_125427
atggcggaaccatcgaaaaagcggaaaggaacttcgagtcggagtcagcggcattccgggtcacaggaagcaccaattcctccctccattccctctggatcattattctcatcagaggaacagcgtatacggtgttctaatgatgtaaagctccatttggagcttgtaggcctaggatcttcttcatcaatggattcctttgcttcttggaagatgaatggcagcggaatggagaaaggaagagagagagaggagatgccacttcaaggagaagatgagtctagaagaagctcaccaccatag

SEQ ID NO: 8650 - DNA, 246 bp, Glycine max
  Peptide Sequence Number=SeqID_125428
atgggggtgcaaatagaaatttttaaattttcgaatttgggacttctagaacattttggaagcggggttgcttatggaggaagcaacccagctcgcctgggcgagctgggcggcaacctcgtacccccttttcctataaatagacgaagggaggctgttccaaatatccctaatgggggtgggaattggcctggccggcctacaggggcctacgacctggcctacataaagcctggcttgaactga

SEQ ID NO: 8651 - DNA, 417 bp, Glycine max
  Peptide Sequence Number=SeqID_125429
atgtcgccacacgggggcgacatggatgggggtgaaaaaaggaaagagagggatggggtttctcttgcttttggcatagcgggccccggcgggaggcccgcacgacgggctattagctcagtggtagagcgcgcccctgataattgcgtcgttgtgcctggactgaggatagatggggcggttcaggtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctggggtga

SEQ ID NO: 8652 - DNA, 279 bp, Glycine max
  Peptide Sequence Number=SeqID_125430
atgcagagcttgcagaatgtggtccaccagcggccgataatgagcattgaagaatttattcaacaggtggcctggtcaggagttcagccttctcctttgggagggggtgaggcctccgcaactcaggagcctcaatgggatcaacaggaggacattccaaaggccgcagagcctacacctcctaaggcattcactttagagtctgatccagttgttgtacaggttcaggaggatgttacagcagcaaagccctctccatcagagccttttattttttag

SEQ ID NO: 8653 - DNA, 234 bp, Glycine max
  Peptide Sequence Number=SeqID_125431
atggatgagaagagaaagaaaaaattggaggaagttgctcaatctggaagcactaacaccgtgattgatccttcatctcccatcagacgacgtgtgaaatggaagatagcccgcaccaagaaaactaggcaaatgacgtctgaggcagcagagaaattgttgagaagattgattcgttggaggagtaggcctcacagggttcctttgtcgcccatggacgtcaggatgtactga

SEQ ID NO: 8654 - DNA, 1101 bp, Glycine max
  Peptide Sequence Number=SeqID_125432
atgaattgtttcttcttgaaaaacaaatcaaaatccgacgcagaattaccaaagcgaaggaagaagaaaaatcaggtggggaataatggagcaagcaagtcctccaccagctcgccgctaccatcgccaaggagcataaaagaattgtacaaagagaacgaacacaatttcagaatcttcactttgcaagagctggtagatgcaacacatggcttcaataggatgctcaagattggagaagggggattcgggaaagtgtataggggaacaattaaacctcaccctgaagatggagctgatcctattgtcgtcgcaattaaaaaacttaacacgcgtggcttacaggggcataaagaatggcttgcagaagttcaatttctcagcgttgttaaccacccgaatttggttaagcttctgggatactgctccgtagatagtgaaaaaggaatccaacggttgttggtgtatgagttcatgtctaacaggagtttggaagatcatcttttcagtctttctttacctcatttgccttggaaaacaagattgcaaatcatgctcggtgctgctcaaggattacattatctacataacggattggaggttaaggtgatctacagagatttcaaatcttcaaatgtgttattggacaagaaattccatcccaagctttcagatttcggtcttgctagggagggcccaacgggtgatcagacccatgtatctactgcggtagtagggacacaaggatatgctgctccagagtatgtcgaaacaggtcatctcaaaattcagagtgacatatggagtttcggtgtggtactttatgagattctcacaggaaggcgtgctttgaatagaaaccgtccaataggggaaaaaaagcttatagagtgggttaaaaactaccctgctaacagtagcagattcagcaccatcattgaccctcgtctcaagaaccaatattctcttggtgcagctcggaaagtagccaagttggcagatagctgcttgaagaagaatcctgaagatagaccatccatgagtcagatagtggaaagcttgaagcaagcattgcaggattcagaaaccaaaaacgcttag

SEQ ID NO: 8655 - DNA, 1665 bp, Glycine max
  Peptide Sequence Number=SeqID_125433
atggctttaacacttcgctcttcaatttccctcgccagccagaaagaaaccaaactccaaaaacccgatgacgaggttcccaccaaagtgtttaactttgcaaaagccaacccatctttccgtcttagagcaaagagttccatgcaacaaacacatgtcacaggagacaacaacaagaacaaaaacaacaacttcaactccgaagtaacgatgataaacgagaaaagggagaaggttcacgcgccatcggttgcacatagccacaatgattcaatgagagttcccgtgtttgtgatgcttccgttggacactgtaacaatgggagggactttgaataagccgagagcaatgaatgctagtttgatggcactgaagagtgcgggagtggaaggagtgatggtggatgcttggtggggtttggtggaaaaagagggacccttgaagtataattgggaagcctatgctgaacttgtgcagatggttcaaaggcatggcttgaagcttcaggttgtcatgtctttccatcagtgtggaggaaatgttggagactgttgcagcattcctctacctccatgggtgttggaagaaatcagaaagaaccctgagatggtttacacagacagatcagggaggaggaatcctgagtacatctcattgggctgtgattcaatgcctgttctgcgaggaaggactccccttcaagtctactctgattacatgaggagcttccgtcacagattcagagactatttgggcagtgttatcattgaaattcaagtggggatgggtccttgtggggagctgagatatccgtcttatccagaaagcaatggaacatggaggtttccgggaattggagaattccagtgctatgacaagtatatgagagcttccttggaagcatcaactgaggccattgggaagaaagagtgggggaaaagtggaccacatgactcaggccaatacaaccaatttcctgaagacactggatttttcaaaagggaaggtacatggaacacagaatatggacaattcttccttgactggtactccaccaaacttgttgaacatggtgagaaaatccttgtatcagccaaaggcatattcaactcatgtggggtgaaactatctgccaaagtagctggaattcattggcactacaagactaggtcacacgcggctgaactaactgcaggctactacaacacgcggtttcgcgatggatacctaccaatagcacaaatggtggcaaaacatggagttgtgttaaacttcacctgcatggaaatgagggacagagagcaacatgagcattgttcccctgaggggttggttcatcaagtgaagatggcagccagaacagcaggagcagaacttgctggggagaatgcacttgagagatatgatgcaggtgcattttctcaagttctgtcaacaagtaactctggttctggattggctgcattcacttatctgagaatgaataggaggttgtttgagggagacaattggaggcactttgtggagtttgtgaaatgcatgtctgaaggtggaaagagacaaaggcttcctcaatctgattcttgtgggactcatctttatgttggacacatcacaggaattcagaagcagcaagagcaagctcaagaggttgctcttgtgtga

SEQ ID NO: 8656 - DNA, 876 bp, Glycine max
  Peptide Sequence Number=SeqID_125434
atggattctactgggtttgtattcaggaactatttctatttggaactatcagacaaaggtaaagaattatatctgcacttaaatactatgaaagaaactggaataattgatattaatgaaaaagaaaaagaaaacctaaaactgacatctgttttcgagactgaagagaagtctttaaaaatcagcgaatctccagtgagatcagcaaagttcattgctcgggaaaactggattgttgcagctacggatgacaaaaacattcacgtctacaattatgacaaaatggaaaagatagtagaatttgcggaacataaagattatatcaggagtttagctgttcatcctgtcctgccatatgtaatatcagcttcagatgatcaggttctaaaattgtggaattggaggaaaggttggtcttgttatgagaactttgaagggcactcacattatgtgatgcaagtggcattcaaccctaaggatccatctacctttgctagtgcatcccttgatggcaccttgaagatctggagccttgagtcctctgctccaaattttaccctggaaggacaccagaaaggagtgaattgtgttgattacttcataaccaacgacaaacaatatcttttaagtggttctgatgattacactgccaaggtatgggattatcattctagaaactgtgtacagacgcttgaaggacatgaaaacaatgttacagcaatatgtgctcatcctgagcttcctataataataacagcttcagaggattctactgttaaaatatgggatgctgtcacttacaggcttcaaaccacgttgaactttggtctcaagagagtatggagtattggatacaagaaaggatcatctcagtaa

SEQ ID NO: 8657 - DNA, 1386 bp, Glycine max
  Peptide Sequence Number=SeqID_125435
atggctacggcaactgaaggggttgagtacgagagtgatcccgaagaggccgcgagatcgctcgcaatgcggagaaggcgcgaggccagtgatgatgaagaaactgacgccgacgctgacagaagagacgccacttccgatcgccggataactcattctgttgactccgacggcgagggcggcgtggcagattatgatgacgaagaagacttggaagaagaagaggaagcggtggaggaggaggaagaagaggaggtagaagaagaagatttagaagaagaagagaggagtgaacatgaatatgaaggaggtgctaatggcacagtggtgaaagattctgatgatgctgatgtgaaagcccttttggaggaatcagggaatggagatgaagaagagaagaaggagaatgaaccatttgcggtgcccactgctggagcattctatatgcacgatgataggttcagggacaatgccggtgcacgtcacaggcgaatgcgtggtggaaggagactgtgggagtccaaggatgataggaagtggggacatgataagtttgaggaaattactttgcaggaaaggcactataaagagggaaggagaccttctaagggtaattttcgaggccgtggtggtaaaactcgaggtgttgatcgcagtggaggatatgttagaggtaaccggaaagggtatgataacagaggcaatcaaactcaagcaccaaagagtattgtacgagggagaggaccccggaggtacgagcctactagtaagaacaatgattcagcatccctggtgcaaaataaacaatctgggaagcagccagagaaaacatcacatgctagttcgggaaaaacttttgctcctgtctctaattcagagcctgatcctgtgcctgctaagaaacaagtgtttgcatcaagtttgaattatgcatctccccccttttacccttcgagttcttccaacaaagatttaagtgtggcaccaaaaggggatgttcaaacgtgtggtacaggcaggaatgtttgctctggtgttgtgaatgatggttttttggttcaacagaacagtgcacttcttcggggaaagaatgtcgttgatcatgttagcatggagaagctgtatattgatgggcctggcgcaccatctgctggaaaggcttttaacaatatgcatattccaccacctggatcttctggagttaatgcttctcaatctgctcatccaagaggtcacgggaggggtggagcagtgccagtacagatgaattatcagcctgttacctcccataatcaagtaagtaaaattgatccaacacaactccaggctattcagagaactgctccagggcaaacttcaccttctttgcaaacccctgctccacag

SEQ ID NO: 8658 - DNA, 351 bp, Glycine max
  Peptide Sequence Number=SeqID_125436
atgcggggttactgtatggttacccgcacctttcgtcaaccaggggcaaacgagcccgttgacacgcagagactaacatcgtcttctgcaccttttgtcgtcttgacccgtgaagtcagggacagcgagtcaggtagcaggcggagataccttatggtcatccgcacctttcgtcatccgaggggaacaaattcgacggttttactctcgtcttccggaaacattcaagcccgacgacgcgcgagattcttctctactgagcaggggcgatcgagtgcaatggcggagggaagtgtcatggttgtccaactttgtcgctttcaagacactgaagtttttttatgcttctga

SEQ ID NO: 8659 - DNA, 207 bp, Glycine max
  Peptide Sequence Number=SeqID_125437
atggattcatcttgctgtattacaaacaactcagctgaagaagaagggtgtgtgggagagactgaagagagagcacaagagatttttcaaggacagctgcatctggtgcaaagaggtgacaggtcagctggtattgtcaggtcaacttgctttgttacatcgattattggtcgatgtctttgtctggtgtgctcgcacgttggttaa

SEQ ID NO: 8660 - DNA, 915 bp, Glycine max
  Peptide Sequence Number=SeqID_125438
atggacgaacggtacgagactttgaaggagcttggttcagggaacttcggagtggcaaggttggccaaagacaaggagacaggagaacttgttgccatcaaatacatagaaaggggaaaaaagattgatgcgaatgttcaaagggagatagttaaccaccgatctttaaggcatccaaatattatcaggttcaaagaggtatttctgacccctactcatttagctattgtccttgagtatgctgctggtggcgaactcttcgagaggatatgcaatgctggtcgattgagtgaagatgaggcaagatttttctttcagcaactaatatctggagttagctattgtcattccatgcaaatatgtcatagagatctgaaattggaaaacactctactggacggaaatccagctcctagacttaaaatttgtgactttggtttctccaagtctgctttgctgcactctcaacctaaatcaactgttggaactcctgcatacattgctccagaagttttgtcgcgaaaggaatatgatggaaagagaattatgagtgttcaatatgccatacccgactacgtacgtgtctctaaggagtgtaggcatcttatatctcgtatttttgttgccaatcctgccaagaggatcaacatctcggagataaaacagcacctttggtttaggaagaacttgccaagagagataattgaggctgaaagaaggggttacgaggaaacacaaaaggaccaaccaagccaaagtgtggaagaaatcatgcagatcattcaagaagcaaggacaaaaatccacactggtgagcaagctggcacaggaacttcggatgttgtgcgtggtgatgaggctaatgaggaagttgatattaatgaccactttgccaaatacctaacccttgattaa

SEQ ID NO: 8661 - DNA, 2379 bp, Glycine max
  Peptide Sequence Number=SeqID_125439
atggatttcacggagaaggatctattcggcgaagattccgacaacgacaacgggtcccactcctccggttcctcttcttcttcctccgccgcttcctcttcctcatcatcctccgcctcctcttccgcctcttcctccaaagccagcgacgccgccgccgactcctcctccgccagcggcagcgcaagcagcggcgccgaaaacgacgacgagaatggcgacgtcgtagatagcaccaaagtccgcgcccatcaccatcacgactacgaagacaaagatctgtttggctccgataatgaagattactgtaaaaccctcgctagaagtccttaccccattcctgggaaaaatgatagagtttcaacttgggtggctctagcatgtgtggaggaaacggtagaattgtggagagtgaataagatggagtgcaattctatgactagagtattgcctgccatccgcaatgtgcataatcagggtagaggggggtttggccgtggtcgttggcaaaatgatagaggagctggccttcttcctcgtcccggaccttatcctcagaggcagaattttgggtatggaaataggtttcaggatggccgccatgacgagcgatttgtctctgagttgaagctttcaaaaagtgaagaaactctatcaagaaagtgcattgcttttcaggagccttgtgaagttgcctgctatagtcgtgcagaaggcagagaagtatacttcgacgatcgtagcttgcgccatatcactgaggatgttggagctgatttgaatgaaggttatgatacatacattcccaaaaaagacttaggctcacagggatttggtgatcttcttgcttgcattagagacaaaaatatcccgcttcaaaacattcattttgtgacattccgtaacaatcttaacaaggtaattattcattttggattgtttgattttggcattttagaaatttccaagtcaagtggttataaccttatactggcaacagcttatatccgtcacgagccttgggaaatgggagtgcacaaaaggaatggtgttgtctatcttgatgtgcacaaattaccagaaaaacctcaaagtgatttggatcgcaggagccttgcaactgaagatcctaatagagcagatggagaggggatacatcatgttgatgccaatgttgaattttgtgctgtgattaagacaaaattaggagctcaccgcatcttaatgggtgctgagatggattgctgtgattcgactaatgagggaaagagattttatgtggagttaaagacaagttgtgagttaaattatcacaccgaggaaagattcgagagggagaaactgttgaagttttggattcagtcatttctggctggtgttccatatattgtcataggatttagggatgatgcaggtcgtcttgttcggacagaaagacttagaaccaaagatataacacagagagtgaaaatgaagaactactggcagggaggagtctgcttggcgtttgctgacgaggtattatgctggctgtatggaacagtcaaagaagttgagaatccaaaggaatcgaatcgaatcatctcgacgagaagcaaaacaccggctatagttatgtacagagagcgaggaggcgtcggatccaaatcggaggtaacttccgttgatcggaagcgaatcaatgacgtcctcgataaacagctcgaacgatcctcgccgtccacatccagagccgccggcgccatcaacggcaaggaccgctcctcctcttccctcttagccgccgccaaggactcccgctccgcctccgtcaccgcccctatctccaagaattccaacgcttccgacgaggaatctgaaacagacagcgaggagtctgatgttagtggctccgacggagatgacacgtcgtggatctcgtggttctgcaatttgagaggaaatgaattcttctgcgaggttgatgacgattacatccaggacgacttcaacctctgtggattgagcagtcaagtgccttactatgattatgctctggatttgattttggatgttgaatcctctcatggtgacatgtttaccgaggaacagaatgagttaattgaatcagcagccgagatgctttatggtctgattcatgcccggtacatattgacaagcaaaggaatggctgcaatgctcgacaagtacaagaactatgattttggcagatgcccacgagtttactgctctggacaaccttgtattccagttggtcagtcagacatccctaggtctagtactgtgaaaatatactgccctcggtgtgaagacatttactatcctcggtccaagtatcaaggcagtatccttatatgttatattattgaacttgtctga

SEQ ID NO: 8662 - DNA, 378 bp, Glycine max
  Peptide Sequence Number=SeqID_125440
atgatgtctgctaccaccttctcaagcttccacttcacaaataaacgtaccttttacttttctctgtttttattcacctccgctacccttcattcggtgcagactaagagaacgaagaaagcaggcattgtcggaaaatatggtacccgatatggtgctagtctgcggaagcagattaagaagatggaagttagtcagcatagcaaattcttttgtgaattctgtggaaagtatgctgtgaagaggaaggctgtgggaatatggggatgcaaggattgcggtaaagtaaaagctggcggtgcctacactttgaatactgcgagtgctgtcactgtgcgcagcaccatccggaggttgagggaacaaactgagggttga

SEQ ID NO: 8663 - DNA, 2405 bp, Glycine max
  Peptide Sequence Number=SeqID_125441
atggaggaaagcatcaatagaggggaatatcagcctaatttggctaaacagtcttctttgaggttaggtggcagttttaaatcaacactgtctggaagatcaactccacgaaattccccttcatttcggcgacttaattctggccgaacgccaagaaaagaaggaaggagcagcgtaggcggtgctctgtggtttcgaagcaatcgtttacttttgtggttgcttctaatcaccctctgggcttatcttggattttttgttcagtccaggtgggctcatagtgataagaaggaagaattttctggctatggaaccgggccgagaaataccaactcagatgctgaacagattcagcgacgtgatttgcttgctagcaataaatcattatctgctaataatgacactgatgcagatatcgctgggattagtaaaactataaatgtagctttggccaagaacgacaatgatgttccatctcatcgtaaaacaagctcaaagaataggagcaagggcagacgttcttcaaaaggtaaatcacgtggtaagctgaaaccaactacagaaattaagaacactgatatagaggagcaggagcccgaaattcctacaaccaatagtacgtatggattgctggttggtccgtttggcccaatggaggatagaattctggaatggagtcctgagaaacgttctgggacatgtaacaggaaggaggactttgcacgtctggtttggtccagaagatttatcttgatattccacgagctttccatgaccggagctccactttcaatgatggagttggcaactgaacttttgagctgcggggctactgtttcagctgttgtgcttagcagaaaaggtggtttgatgtcagagcttgctaggagacggatcaaggtgcttgaggacaaagcagatctcagcttcaaaactgcaatgaaggctgatcttgtaattgctggttcagctgtctgtgcatcatggattgaacaatatattgaacattttccagctggtgcgagccaagttgcctggtggattatggaaaatagacgagagtacttcgatcgttcaaaggatgtattgcacagagtaaagatgttggtttttctttcggaatcacaatctaaacagtggcaaaaatggtgtgaagaggaaagcataaaactgagatcccatcctgaaattgttccattgtctgttaatgatgaactggcatttgtagctggtattccttcaacacttaacactccatccttcagtaccgagaaaatggttgagaaaaagcagttattgagggaatcagtccgaaaagaaatgggcctaactgataatgacatgcttgtgatatctctaagcagcatcaaccctgggaagggccagctattgcttcttgaatcagtaagctcagtacttgaacaaggacagtcaccaggtgataagaaaatgaaagaagtatcaaatataaaggaaggcctatcttccctggctagaaagcatcgtattagaaaattgttgccgttgatgagtaatgggaaagtagcttcgaatagtatctcaagcaattctttaagcaggaaacaagtgttgcctaatgacaaaggaacaattcaacaatctctcaaacttctcattggttctgttagatcaaagagtaacaaggcggattatgttaaaagccttctaagtttcttagaacaacatccatacacctcgacatcaattttttggactccagccacaacacgggttgcctcactttactctgccgcagatgtttatgttataaactctcaggggctgggagaaacatttggacgtgtgactatagaagcaatggcgtttggtcttccggttcttgggacggacgctggaggaacacaggagattgttgagcacaatgttacaggtcttcttcatcctgttggacatccggggaatcttgttcttgcacagaatctctggtttttactcaaaaaccagtcggcaaggaagcaaatgggggtggtaggaagaaagaaggtgcagaagatgtatttgaagcaacagatgtataagaattttgtagaggttattgctagcatctctcgtcaccttgcatattcacaagtcacaagtgtgatagcagaggtgaagcctgcgattctgatggtgctggttcaggttccttatgctggagttagcatcttgttcaaattggttgcgaatgatgggatgagcttaagggttcttatggcctatcgctacctctttacttctgttttcatgattcctcttgcctactttgtcgataggttgaacattggaacatcagcagggaaggccaaggtggttggcactgtaatgggaataggtggagcgatgatgctcaccttctataagaacattgagattcacatctg

SEQ ID NO: 8664 - DNA, 618 bp, Glycine max
  Peptide Sequence Number=SeqID_125442
atgtcctccacttcagtggactacacgtcttcgccctttggaggaactacatgtccttgccttctgagggctacacgtcttcaccttctgaggactacacgccctccccttcagaggtctacacgtcctcgccttcagaggactacacgtcctcaccttcagaggactacacgttctcagcttcagtgggctaacatgccctcgccttcagaggactacacgtcctcgcctttagagggctacacaggacttcacttcctcgccatcagagggctacacgtcctcgctttcaaaggactacatgtcctcacctttagaggactacacgtcctcaccttcaaagggctacacgccctcgagttcttcggtctacacgtcctccccttcagaggactacacatcctcatcttcataaggctacacgccctcaccttcagaggactacacgtccttgccttcagaggactacccgtctgtcgcaacctacccttcggcgggagggcgacgcggggctctcgggtgcatcttccaagaaaggaaaatgcgcagagtcaccgccatcgtttattcaaggcaaacgtcggaaaaaccggaaaaggtgtggtctacaaactttaa

SEQ ID NO: 8665 - DNA, 3074 bp, Glycine max
  Peptide Sequence Number=SeqID_125443
tgggtgatactgttaaaacttccaattgtgaaaatgatggccagcattctgaagtaaaagattcgcttcttactgaaactcttggtcaaacaactgacagtggtttaaataaggaaaaccccatagtctcatctcctcaagtgaatgggtctactgcagaacatgaacctgcaaaagtgactattggtgaaacaattgactctggtttgaataagggaaaccctgctgtttcatgtcataaaatggatgaacttactgcagaagatgaagctgcaaaagtgactattggccaaacaactgactgtgttttcaacaaggaaaaccctgtggtctcatctcataaagtggatgggcctactgcagaagacaagcctgtcaaagtgccattagtggacatggaaattttgaatacagagtttgcaagaactgcaaacactgtaaaatgtgactcttatatgttgaagtcatcttctcaagtgggtgaagtggttatgtcaggtggttcaaaacccttattgtcaaatgtcaatatatctgctggttctagtgcttgcatggtggagcctgtaactagaaggtatcttcctcgaagaaaagtttcagctctcagagacttcccaactttatgtggacgcaatgctctacatctcagtaaggacaaggatgtgtgtctagaggggatctcttctttaaataacaagaaactgtgtctacagaacctggccgtagatgaaaacaatccattgaaagaagtacgagccttggctgtagatgacagtccattgaaagaagtaggaaccgtggctgtagatgacagtccattgaaagaagtaggaaccgtggctgtagatgacagtccattgaaagaagtaggagccgctgatgtaaaagaaattaaaagtaacatccaggatgagtatggttgcaagagaaagcttgtggacatccttaaaactgattctgaaagtaatgctgcaaagagagtgaagaaaccactggagatcaagagagacaagcatgttacacttcgcgaagaaagtaatcatcgtgttaaaataaattccaaggcagtggtaaaagagcaaaatagggaagagacaaggcctttggttctatcacattctaagcataagttgaaagggaattttaatggatcacgggtctcatcagacaggaaagtagtactaggtttgatggccgaatcagaatgtccttggaggtccggcaaaggttcctccaaatttaagttcagtgatgctaaaaatgaaggcaagaaaaagaaagtagcttctgcattgccagataggtctaaaacagctatcaagagtaaaggtgcactaagttattctgggcagaagcctttgaaaaagaaaaaaggaaatgctacttctgaaggtatgagtgaattagtaatttgggaaaagaaggatagtcttgaccctaatgaaaataatgaagaccttcaaattgttctgaaatcacatgagttcaatgtaaatgttactccttctcattctaatttcactggtgatgagggtgactcaaatgtgacccggaaaaaagtgataaaaatattgcggttgtttcaagttgtttttagaaagcttttacaggaagtagaatcaaagttaagtgagcgagcaaatggtaaaagagttgatttaattgctttaaagatccttaaggagaatgggcattatgttaactcgggcaagcagatactgggcgctgtccctggggttgaagttggtgatgaatttcaatatagggtggagcttaatatagttggccttcatcgtcagattcagggtggcatcgattatgtgaagcacaatggtaagatccttgcaactagtattgttgcgtcaggggcttatgctgatgatttggataatccagatgtcttgatatatacagggcagggtgggaatgtgatgaaccctgataaagaacctgaagatcagaagctcgagcggggcaatcttgctctgaagaacagtagtgaggaaaaaaattctgttagggtgatacgtggttctgaatcaatggatggaaagtgcaggatatatgtttatgatggattgtatgtggttgagtcttatcagcctgatgtgggaccacatgggaagctggtttttaagtttttcctgcgaagaattcctggtcaaccagagcttgctttgagggaagtgaagaaatctaaaaagttcaaaacaagagaaggtgtatgtgttgatgatatttcttatggaaaagaacgaattccgatatgtgctgtgaacaccatagatgatgaaaagccccctccgtttaattacataactagcattatataccccaattgccatgtccttcctgcagaaggatgtgattgtactaatggatgctcagatttggagaaatgttcgtgtgtagtgaaaaatgggggagagattccattcaatcacaatggggctattgtacaagcaaaacctctggtctatgagtgtggacctacttgtaaatgtccttcaacatgtcataatagagtcagccaacttggcataaagttccaacttgaaatatttaaaaccgatacaaggggatggggtgtgagatccctgaattcaatcccttcaggaagttttatctgtgaatatataggggagcttcttgaggacaaggaagctgaacaaagaaccggtaatgatgagtatctttttgatattggaaataactatagcaacagtgctctttgggatgatctttcgactctcatgcctgatgtacacacaacttcttgtgaagttgtgaaggatggtggtttcaccattgacgctgctcagtttggtaatgtggggagattcatcaaccatagttgctcccctaatcttattgctcagaatgtcctttatgataaccatgacaccaggatgcctcacataatgttctttgctgctgataacattcctcccctgcaagagctgacttatgattacaattatgaaatagatcaaattcgtgattctggtggcaatataaaaaagaagtattgccattgtggttctgtggaatgtactggcaggatgtattga

SEQ ID NO: 8666 - DNA, 318 bp, Glycine max
  Peptide Sequence Number=SeqID_125444
atggcttggattcttgatgagtattcaaagtttcatggacattcaccagcagttgtgactgggaagccttttgttcttggaggttcattgggaagagaggctcccacaggattgggagtgatttttgcaacagaggctttatttgctgaatacgaaatggtccccgctctgctgaaacacaaggaaggcaatggagatttgaaggaattctcaggagcagatgaattgcttgttcatgaatgtcatgttctcatcccttgtgatttgggaggagttctcaacaaatattttctaaggagtgttgactttttgttttaa

SEQ ID NO: 8667 - DNA, 531 bp, Glycine max
  Peptide Sequence Number=SeqID_125445
atgatgatgatgaatcaggttaggtgcaaaataccccaattctgcgatgagaatggagcatacgtggtggtgacagattatggcgagggagacagaacagacttcataatgagtccacgtgcctactcaagattgggaagtaacgcagatgcatctgcagaactattcaaatacggtgtagtggatgtagaatacagaagggtcccctgtagatacggtggctataacctcttggttaaggttcatgaacagagcagaaaccctcactacttagccattgtcattctctatcttggtggaacctacgacgtaactgctgttgagttgtggcaggaagattgccaagagtggaggcgaatgcgcagggcatttgggacggtgtttgatgctgagaacccgccacggggcgacataaagttgaggtttcaattgggtggtgatgcacagcagtattgggtgcaatccaagaatgttatctctggtaattgggaagctggagttgtttatgactcagaaattcagcttggttaa

SEQ ID NO: 8668 - DNA, 825 bp, Glycine max
  Peptide Sequence Number=SeqID_125446
atgattagatcatcaacatacaccaacactataatatgtacccccgatcttttaagaggagttgtgaatggagctgccacagtctactttagctatataggctatgactcggcttcaaccttggcagaggagatcaaagatccttttaagagcctgcctattggaattatgggttcaattctcataaccaccatactttattgcttaatggctctatctttgggtatgatggctccttacaacaagtttaattattcttctggagtttgcacagcatccattgctctattcactgagcttggcatcataatcgagttggtcaacatccgcacgctcttggtgttctacttggtagccaatgctctgatataccgtcgatatgtgatcactagccacaccccacctattcacactctcttgttccaatttctcttttcacttggtgctctaggcttctccctttcatggaaattcaatcagcaacagtggggtctcccactctttggtgggctcatgatcaccatcacagctttttaccaccacaaggtgcctcatcatacccatgctgatgatgctgattggtgtgtgccattcatgccctggccacctgccctctccatctttctcaacgttttcctcatcaccactctaaagctcctctctttccaaaggtttgctatgtgggcatgtttcattaccctcttctatgtcctctatggtgttcactccacttaccaagcagaagaagaaactgaaatagggtctaatcaactgaattcaagctcatccaacctacaaactaaggtagaagttcaagtgctatag

SEQ ID NO: 8669 - DNA, 207 bp, Glycine max
  Peptide Sequence Number=SeqID_125447
atgaggatgcgtagccctctaaaggcgagggcgtgcagccctctgcaggcgaggatgtgctgtcctctgatggcgaggacatatggtcctctaaagattgactgtccttttgaaaaaggtgataattcatgcaaccctatcctatcttttgcaaatctctccgggaactccctcagagtgtatgttctgtttgatttagtcacttga

SEQ ID NO: 8670 - DNA, 1710 bp, Glycine max
  Peptide Sequence Number=SeqID_125448
atgggcaagcaaggaccttgctatcactgtggagttacaagcacgccactctggcgcaatggaccacccgagaagccagtactatgcaatgcatgtgggtctcgatggagaacaaagggaactcttgcaaattatacccctttacatgctcgagcagaaactgatgattatgatgatcaaagggtttccaggataaagagcatatcgataaataagaagaaagaagtggcattgctcaaacgaaaacagaaccatgataatgtaatgtctggagggtttgcacctgattacaaccagggataccaaaaggttgtagatgaagatattagcaaccggtcgagttcaggatcagctatctctaactcagagagctgtgcacaatttggttatggtggcatggatgctagtgatctgacagatagtttggctaatttaggtcctgctcagtcagtggtctgggatgccatggtgccttcaaaaaagaggacatgtgttggtcgttcaaagccttcttctgttgagaagctaacaaaagatttatgtactattcttcatgaacaacagtcatatttttcggcatcttctgaagaagatcttctttttgaaagtgatacaccaatggtctctgttgagataggacatggaagcgttctcattaggcatcctagctatatagctcgtgaagaagagtctgaggctagctctctttcagttgataataaacaatgcccaatgagtgaggcatattcttgttctggtggcattctaatgcataatgattccagtcgcttgaagtcttcatctctggaagttgaaaagatcgggaactctactggtcaaggagtgctgcaggaacaacttaaaaggcatgtttttgtacacagtttatggcataatttgtatgacaagtctcaacatgaaagagtacaaattcttggcaatcatgaatccccattgtgctcaatagatttaaatgatgttgtaaactatgaagagtttttgagaatcttgacaaatgaagagcaacagcaattactgaagttacttcctgtggttgatactgctaaactccctgatagccttaaagtcatgttcaatagctctcaattcaaggagaacttaacttactttcagcagcttctttcagaaggagtctttgatatctctttgttgggggcaaaacctgaagactgcaagactttgaaaatacttgcattatccaatctgtcaaagtcaaaatgggtagaacaccataattttctcaagaaatataaaaacaaagctgtaaaatctaatactatgggatctactggtacagcatcaattaatgttttgaacaacagggcatcaactaatgttgcaaatatcaagagaatgtgtgatagcagaaatcaaaactttccagaattgaagacaataatgaggagccccaaaagaatgatcacaaaggctagttttgagtgcaaagaagctgtagaagatggtgcttgctatagtccaaaacacctatttgctttgcctcctgatgctagttctctcttgctggattctttcaactttgttgaggagagtggtgatcaggatctgctgctagaggtgccatctaacacttcttttccacaggcagagctcttgcacccaactttaagccttggtgctcaagccagcactggtagcagctcagtctactcaaatcttgttcaccattaa

SEQ ID NO: 8671 - DNA, 789 bp, Glycine max
  Peptide Sequence Number=SeqID_125449
atgagtgccaccagaggtgccaccgatgcattttctggtgttagcaggcatgtcaacacttctgtaaaaaatgctgttactaacttactactacccgtccactttgattttgctttgaggaagttgggagctaataatgttgaagtgggtgttggatgtggagttggtcttgctgtgaaaccagtggttttgaatcaaattcaatcttgttttgtacatttagtcggtgcatttccacaatccttgcaaagtgctgtaagcacagtcaatactaaccaaagttctgctggaagcatgatgcagttggcaactaaatcaactgatcaagtatctcaaggtcagccagagcctcaacctgtgcaaattggttctgattttgaaaataatccattaagaggcactgcagttggctctgcatttggcagcagaactgagaaggttattagcaactttctgcaaaatccactattgaagggagaaggaggaggacttgatgaagcaattctaagatacattgaaggttgtacgtttgcagtcagaaaggacgatgcttcagatggtaatttttatgttttgaaacaccagcaaatcattgaaaaacttgtggaggaaaatgagaggcttcggcggatactaatggaggacctgaaaataccatctaggaaacttgaagcaagttcttcaggtagaacaattacaagagaattggcaaggaatacggattacaaactgatagtggaagactatcaattcccaagcacacagtgctccccaagtcacttacaatga

SEQ ID NO: 8672 - DNA, 762 bp, Glycine max
  Peptide Sequence Number=SeqID_125450
atgacaaagatgattggacttattcccggcttaccctttggttggggtgcattgccaatgccagaaccctcaaagagtgcccaaagcaaggtccctaccaaccaaatttctgctgaaagcaagatgcaattggcaactaaatcagcagaccaaatttctcaagggatgcaacaggcaactaagtcagttgaccaaatttctcaaggaagcatgacgcagttggcaactaaatcagccagccaaatatctcaaggtcttgtagggccccaacctactacaaagattgatttggcttttgactataaagcattaaaagaggctgcagttgactctgcatctgacacccaaacagagaactttccgcaaaatccatcattgaagggagatggaggaagacttgatgaagtagctggactcgtgcagccagagaacaaactacttcagacggttatgaagcagcggcaaatcattgatgaacttgtggaggaaaatgagaagctttgcaggatactacaagggaaagacctaaaaatgccatctagcaaacttgaagcaagttcttcagattcaaatattcagacatttccttcatccgaagttcaggataagattacggccggtgtttctaggcctcctggagatgctgatggtactttgtcaacttctaaagcagaaaatcagggtatatcaccaacttcaaaagaagaaaatgacggtacattgccaatttcaaaaggggaaaatgtcgataaaaaagagtaa

SEQ ID NO: 8673 - DNA, 531 bp, Glycine max
  Peptide Sequence Number=SeqID_125451
atgaccgcctctcaactcatctccgttagtcccgacgaactccgcttccactttgagttggagaagcaaacattttgcgatcttaaggtcctcaataactccgagaactatgttgctttcaaggtcaaaaccacttctccaaagaaatactttgtgcgacctaacaccgctgttgtacagccctgggactcttgtatcatcagagtcaccctccaagcccaacgggaataccctccagacatgcaatgtaaagacaagtttctcttacagagtacaacagtgaatccaaatactgatgttgatgatctcccgccagatacttttaataaggagagtggtaattcagtagaggagttgaaattgagagttgcatatatctctcctacctcacctgaaggaagctctgaagatgacgcatcaaagaactcgcaaagctttgatacctcttctctggaatcccctcgtgggttgggtccctatgcaaagaaacttcacatacttgaaacagaaaagcttaagaaacctgattaa

SEQ ID NO: 8674 - DNA, 1101 bp, Glycine max
  Peptide Sequence Number=SeqID_125452
atggaagtgcatgagaatggtgggtctcctaggcagagccagagcctctcagagttgcagattgtgactatgatgagcgtgccacccctcaagatgaccgaaccacgagcagttcgcaaagttttggtgagtgaggacaacacaagggccattcatggatgctaccaagtagttatgtattatgagaatttgaaggagaaggagcatggttggtgtctggctggtttgattgtggagtcactagccagggttctgttggatcaccctctactcgctggtcgtcttcaaagaagggaagacaccggtttcgaaattgtggccaatgattctggcattcgactcttggaggcatgctatccgaccaccttgtcacactttcttcacttgaatgaagaacaacaccaccttgtgttctggaaggaaattgatacccagtatcctcagttttctcccctgttttatgtgaccaacttcgaatgtggaggatactcgattggcattagttgcagccttctattggcagaggtttttctggtggaaaatttcctcggaaaatgggctgaaatacacatgaacatgtcaccccaacatgaagaaattcagacaccgatatttcaccaccctcgtttgaaaaatccagagtctctcccacccgatataataagccgcactcaaaggcaaaacggggttcaaagcatggtgttcacaatcactaccgaagatgcaaactttagcatggaactgtggagggaattggccatgctttgcgttaaggaagcagaacaaaaactaagcacaaatttgggttcggagttttctttggtcgtgaaagagtcttcggaggtggccaaggtagaaagttgctcaatgaatggatggagtgtggagggaatgagggtgaagcatgagatgagtgcaagcaggtgggaagagtttggagtgtatgaggtagcattttttgagggaaacaaacctgtgcaagtttcttgctggattgactcggtgagtgatggctatgctatggtagttccactcccctacctcaagcacaaaaatgcatgtgctgtcattgtagtttcaccccctctttcttccctatga

SEQ ID NO: 8675 - DNA, 1449 bp, Glycine max
  Peptide Sequence Number=SeqID_125453
gatggacactacgcacccctatctttccacgaccgtaatgcatatggcgtggctgcagccaccaatcacaactggactgaacatatcatggctacgacaacaacaacctcgccttttgtctttctgaaatgtcacacctcaccgccttgtcacaccgaaacattgttcacccgcacaagttacaaagccataaagcctcaatctcaaactgatgatgtccgagaggaacaagttgtggtcgtgggtgctgggatcgccgaccttgcaactgctctgtcccttcataggcttggagttctgtccctggtgctggagcaggcagagtcacttcgaaccggtggaacttcactcacccttttcaaaaacggatggatggtacttgatgcaattggtgcagctaatgatctcagaactcaattcttagaaattcaaggcttgatctggttcacaatatcagctgtacaggatggtggtgaagtccgtggatgggagggaactacgcgccttcaatttcaaacaagaggatcaaaggtacgtgcagttgagaggagagtgcttttggaaaccttggctagtcagctacctcgggatagcgttcaatattcttcacaattgcaaaggattgaagccagtccaaacggggataccttgttggaacttgtggatgggtctaagctgcttgcaaggattgtgatagagtgcgatggaattcgatcaccaatagctaaatggatggggtttcctgagcccaagtatgttggacttgcatcttatccagatgcacaatattttggaccaagagtgaattacatctacggaagaaggttgcgcgctggctttgttcctgtttctccaaccaaagtttactggttcatctgcttcaatagtccatctcctggtccaacaataactgattcattggagttgaagaagcaagctaaggaactggtgaagaattggccttcagagctattgaacatggttgattctacgccagatgacactgtcattaagactccattggtagataggtggctttggccagccataagtcctgcttctgcaggaagagttgtggtggttggagatgcttggcatccaatgactccaaatctagggcaaggagcttgttgtgcacttgaggattcagtggttcttgctaaaaagcttgccagagccatcaatttggagaacccagtggtgtgttctgttaggaacaatattgtcatacctaagctagtcagtctcgggccattgctggagcatacaaattttacctgtgaggcagaggatgatggcgcagaggagaacgaggagagggataagatggacagcgtgttgggcgtcaaggataacgatgtcgatgtcttacgccaaacactaccattccacgacctctgcatagtaatatcttcttgtgttgctttgttgattggccacaccgcatag

SEQ ID NO: 8676 - DNA, 348 bp, Glycine max
  Peptide Sequence Number=SeqID_125454
atgccggcaccgagaaaaatgcgatgtggtactgaaaaatgtgagaaaagcgaagcgagtacgcaatcttattcctatgcggtgtggccaatcaacaaagcaacacaagaagatattactatgcagaggtcgtggaatggtagtgtttggcgtaagacatcgacatcgttatccttgacgcccaacacctgctacccacatacgatcccctctcccacgttgcccagtgagacttctctcgtctcagttcagctcaaaacgctgtccatcttatccctctcctcgttctcctctgcgccatcatcctctgctccccccccaacaaccactcttcataaatcaaggtga

SEQ ID NO: 8677 - DNA, 2652 bp, Glycine max
  Peptide Sequence Number=SeqID_125455
atggcttcacattgcttccttcgttttcctccttcctctttttccttaaaccccaaatccaaaaggcttccaaaacctcgttatcacccttccattttctcgcgaattcaaaccccaaatcccgacgaagacgacaaagtcccaaatgacaaccgcatcgactttctcaaactctccgtcaccctcaccgtcatctccgcctccctccccaaacctgccgccgctgccaccactaaggtaaagaaacggtcaccgaaaaaacaatccgcgaaaaagcccgaaggtctctcgccggaggagctgaaaacatggacaagtggccttcccgtggtctccgatcgcctcccctacagcgaaatcatcgaactcaagaagagcgggaagctgaagcacgtaattaaacctaattccgcgaaattgaggcaacgcggcgaagcagttcttgtagttttggatgattcgagagtgctgaggacagtgttgccctcgcttgagagccatagcaagttttgggattcatgggatgagttgaaaattgattcagtgtgtgtgaatgcatacacgccacccattaagagtccagagttgcctacctctctgttggcaaacatttgggtgcccccttttgtgcagaaattcattgcttacgttttcgaagagaggcaaacaaagcccaagaaggagtccaagaaggccgcggagtttagggaaatgaggatgcagttgcagagggagaaggaagaggagctgaggaagtcgagggaagagagggagaccatggacaggaacatgaaggctcagaagaaggaggaggggaagaggaggaagagggagatcaggaagaggaagtataaggaatcgttgcgccaggccagtgaccgaaacaagaaaatggcgtatttctggtctgatttggcaaataatagcaatgtggccaatgcacttggggtgcttttcttctacattttttacaggactgtggtgcttagttataggaagcagaagaaggactatgaggacaggcttaagattgagagggccgaggccgaggagaggaggaagatgagggagttggagagggagatggagggaattgaaggtgatgatgaggagggtgagcaggggaaaggagaggagaatgcttatttgaaaatggcaaagcaatttatgaaatccggagcgcgtgtaaggagagcacagaacaagaggcttcctcagtatctagagagaggcgtggatgtgaagtttagtgatgttgccgggctgggtaaaattcggcttgaacttgaggagattgtcaagttctttactcatggagagatgtaccgaaggaggggagtgaaaataccaggtggcatacttctttgtggcccccctggagtgggaaagacattgctggcaaaggcagtggctggtgaggcaggggttaatttcttctctatttccgcttcacagtttgtggaaatatatgtcggtgtaggggcttctcgtgtccgagcactttaccaagaagcccgggaaaatgccccatctgttgtgttcattgatgagctggatgctgttggaagggaacgtggcttgattaaaggttcaggtggacaggaacgtgatgctactcttaatcagctcctggtgtgcttagatgggtttgaagggaggggagaggtgatcactattgcatccacaaaccgaccagacattctggatccagcacttgtgaggcctggcaggtttgatcggaaaatatatatccccaagcctggccttattggccgcatagaaattctaaaggtccatgctcgtaaaaagccaatggctgaagacgtggattacatggctgttgctagtatgactgatggaatggttggtgcagagctagccaacataattgaggttgctgccattaatatgatgcgtgattcaaggactgagattactactgatgacttattgcaagctgcacaaatggaagaacgaggaatgctagatagaaaggaaagaagcagtgagacatggaaacaagtagctataaatgaagctgcaatggctgttgtggctgtgaactttcctgatcttaaaaatatagagtttgtcacgattgctcctagagctggtagggaattgggttatgttcgggtgaagatggattcagtcaaatttaatcaaggaatgctcacacgacaatcccttcttgatcatattactgttcaactagctccccgtgcagctgatgaactttggtttgggagtggtcagttgagtacgatatgggctgaaactgcagacaatgctaggtctgcagcaaggacatttgttcttggtgggctttctgagaagtatcatggaatgtccaatttctgggtgtcagaccgaattaatgaaattgattcggaagccatgcagattgtcaactcgtgttatgaacgtgcaaaagagatcctggagcaaaatagaacgctgatggatgctttggtgaatgagcttgttgagaagaaaagcttaaccaaacaagagttcttccatctagtagagttgcacggctccctaaaaccaatgcctcccagcatacttgacatacgagttgctaagtgtagagaattccaaaaattgatcggtagtggaaaggaaacgagtttgagtagccacgcataa

SEQ ID NO: 8678 - DNA, 798 bp, Glycine max
  Peptide Sequence Number=SeqID_125456
atggcgcacgtgaaccttgcagaatttcattaccaatatattctagcagccacaactacaaagtgtggaagctctcttggaagtaaaatatctttctcgaaaaaatctggcaaaagttcacggacactgaaactgacatttgcgtttctaagatccacacatggttgcaatgtcagattctcggaaacaagaagagctactacaaatagaaccgttccttctaacttgttgaacaattgtggtacacgtatatcagcatcaattcttcttaaaccccacttagaagaatcgatcgatcgagttcaaatatctttcttagaccattcagcaaattacactaacatctcgtttgagctaaccaaggaagggattgatttgacgcttccaccaataactgaggttgtggatgccaagtgtgagtgttgtgggatgagtgaggagtgcacgcctgaatacatagagcgtgtgcgtgacaagttcttggggaagtgggtgtgtgggttgtgtgctgaggcagtgaaggaagagttggagaaaaatggtgggaagaaggaagaggcattgagttcacacatgagtgcatgtgttaggttcaacaaatatggaagggctttcccagttctgttccaagctgaggccatgaaagagatgctcaaaaagaacaaaatggaagggagaagggccaagtccttcaacccaagggacaaaggaggacaaaagaaaggaggcattgcaaggagttcaagttgcattccagcaatcacaagagagatgaacggtctcacattggccaattaa

SEQ ID NO: 8679 - DNA, 588 bp, Glycine max
  Peptide Sequence Number=SeqID_125457
atggcatcccgtttgttcgtcctttgtacttgtgtgatcattttcatggctgccaccaatacttgtgttgttgaagcttccgtgcaattcaaagttggtggtggcttcggttggcatgaacctgcaggcaacaacaatactgatcaattttatatccaatgggctgaaaggaacagatttcaagttggtgatgctcttgtttttgagtaccagaatgactcagttctaagtgtggagaaattggattacatgaattgtgacgcaagtaaccccatcactgcctttgacaatgggaatagcacttttaatcttgataggccagggaacttctacttcatcagtggaaccgatgatcactgcaagaatggccaaaaaatacttgtggatgtgatgcatccacattctatccttaaatctccaccacccatttccctttcaccttcccttccacctgaagggtttccaccaatggctcctccaccttctgatgatcaaaccttagaggcttcatcagcctcagtgctgcttactactatttttatgtctcttttcgtcacatttgttagtgtcatgctgttggcattttga

SEQ ID NO: 8680 - DNA, 1944 bp, Glycine max
  Peptide Sequence Number=SeqID_125458
atgaatccaaagttttataatgcagttaagtccaatgacataaccacatttttgagcctagttaaagagaatggagaaattctccatcagataacagctgattccttgagcactccattacaccttgcttctaggtacggttgcactgaaatagtgtctgaaatagttagattgtgccctgacatggtttctgctgagaataaaaacctggagaccccaattcacgaggcttgcagacaagagaatgttggggtcttaaagttgctgctagatgccaattccacagctatctgtaagcttaatcagaatggcaaaagcgcttgttttctagcttgcagacatggaaatcttgacatgttgaatctcctgctcaatctatctgagatgggggggccagaggccacagggtttgatcaatcttgtatccatattgctgcatcaagagggcacacagatgttgttagagaattgttgaataagtggtcagagcttactcaagtgattgatgataatgggaactcgccattgcatcatgcttgtaatggaggacacagagagattgcatggatcctactaagacgtgatccaaatcttgttttacaatacaacaacaatggctatacaccattgcacctggcagtaatgaaagggaaagtctcagtccttcaagattttgtgtcaagcattgctacatcacttaaccatctcactagagaggaagagacagtattccatttggctgtgagatacggattgtgtgatgctttggaattcttggtacatgtctccaatgggaccaatctattgcattttcaagatcgttatggcaacactgtcttacaccttgcggttctaggcgggcgctataagatggcagagttcttgatcaacaagacaaaggtggatgttaatgctcggaactgtgaaggggtcacagcacttgacatccttgaccaggctaaggacagtgcagaaaataggcaattacaagccacacttatcagagctggtggtagaagaagcatccaatcttcgcctttttcacgggaaacagacaagaccaattctgtgtctcctgtagcatctagcctttcaatgtcatggaggtatacaactaatccagtggaattgccaaatcaaaatgaaatggttgcttatgattgtacaagtccaccacaacttggcagaagcaccaactctagatcaccttcccagcctcaagtgagtgagagaattgaggatacaacctataaatcatattactgctccccaagaaatttagggaaacacaagcaacagaataaaacaaaagctgaaaatctaaatcaactttactatactcagagccggaggaataagcactatgagatgcataaagaggcaatactgaatgccaggaacaccattacaatagttgctgttttgattgctactgtgacttttgctgctggcattaatccccctggtggtgtgtaccaagaaggaccaatgagaggcaagtcaatggtgggcaaaacaacagccttcaaggtctttgcaataagcaacaacatagcactattcacctctctatccatagtcattgtgcttgttagtatcattccattcagaagaaagccacagataagactattgacaatcactcacaaggtcatgtgggtggctgtggcatttatggcaactggctatgttgcaggcacatgggtgatcttgccacatagtccagagatgcaatggctatccgttgtgctactagcagtaggtgggggctctctgggcacaatcttcattggtctcagtgtgatgctggttgaccactggctcagaaaatcaaggtggaaaaagactatgaaggaaagtgtggatgtagctgcagactaccaaaaggaaagtgaaaattcagattttgagagctcttatttacagggttaccattcatactga

SEQ ID NO: 8681 - DNA, 2037 bp, Glycine max
  Peptide Sequence Number=SeqID_125459
atggagaaagaaggagatgcattagtggatcctctcgccagctattggggactttccctctttcctcaaccatctctcccaccctccaaaccctacaactcagaccaagatcttcacatcatccacactcacctcagatccatggccttgcggagtcctgcgaaactgatgcagcaggccaaatccatagtggatggtaaccctcaactgttcaacactgaaaatttgaacgatccaacttctcagaatactaatgttgccgaagaggatggagaatttcgtcgaaacccgagaccagggttagggcttaaacgtccacgcttctctatgaagccaactaaaaagccatctgttgagagtttgctaccaactctggaccttgatagcctcaaggatccggcagacttcttcatggctcatgagcgcttggaaaatgcaaaaagagaaatacagaagcagctgggtggagcctcatttgagtcggatcaggataaggcagccgctagaccacgacaacgtcgaccgggccttttggggaatgatcaattgtcaatcaagtacaagcatcggtatccaaaagaaacctcagatgatgttctgtcctctcaagagacactagggtctcggagtctcgctcctgtgaccgagaacactgacaaaggtgaatcttgtatggcatcattggaaaaagaagtaatagattcatctggtactgaagggaacaagctcgatgaattgttggatggattgcttcattgcaattctgaagatctagagggggatggggcaatgactcttttgcaggagaggttgcagatcaaacccattgctttagagaaattttctgttccagacttcccagataagcaaatggttgatctgaaatctctgcaaggaaacaagtcaaaaccaaggaaggctttatccgatattgataatttgttgaaaggaatgaatatgaataagaagacacctcttaaaaaggctgtacagtgccctgggcagcaattagcttcacccacccctccaagaagtccatttgcttcgttgtcattgttgcagaggcacatttcacggtcaaaacaatcagtggatcctttttcggctcatgaaattgataacttatctagcaaaaactattctctaactcatacggtaaatccagaactcaatcttgctggatctgggaacctgtcaaatgaattgaatgcacacatgattgaagatgttcatgctgttggtaagacaagcacagttttggacacagacagaaatggcaccaatacttctgaaattcccaaggaagactattctgggaagtcatcaaataaatggaatgcaccctcaactgaagatataattgctgttggtgggaatagtttgcctgaggatacagtcagaaatggcaccagtacttctcaaaagttcatcgtggataattcaagggaacctaagtttgatgttaatattgtctcaaatgaacctcatgttgacatggatgtagatgtgggagccagtggtatgggtgacaatgtggacaggtctaatattgaggcacacatgattgaagatgatattgctgttggtaagacaagtacagttttggacacagatataaatagcatccacacttctgaaatttccaaggaagataattctgggaagtcatcaaataatctgaatgtgccctcaattgacaatatagttgcagctgatgggacaagtttggctgaggacgctgccagaaattgtaccagtacttttcaaaagtccatggtggataattcaagagatcctagacttgatgttactattgactcacatgaatctcatgtcgacatgggtgtagatgttggagtcagtggtgtggctgatagggttatggatgacaccaaggacaggtcgaatatcgagtcagaaaatatacagacatttacagcttctatcccaacagatgacacgaatcttaatgtactcaattcactaggtatgtataaactcacctgcttcagagctatatccagaatgcaaatctga

SEQ ID NO: 8682 - DNA, 231 bp, Glycine max
  Peptide Sequence Number=SeqID_125460
atgcaggaacaatcaagtaagggaaaaggaatagctgttgagccagaaagttcaccaccaatttttgttcccacgccatcattgtcacagtcttctgattacgatcctggaaactctacctgtttaactccaaccaaaaggattagttgtcagcaaaccagttctgatttcgattctgatgagcatgcacagtatcagttatcaactaacaaacatatcaaggctgagtaa

SEQ ID NO: 8683 - DNA, 906 bp, Glycine max
  Peptide Sequence Number=SeqID_125461
atggcggaacatcctcacaccgccagcgcagccagcaccgcgcagcccggcagtgttttgcgtgctatctacgacgcgggtaatacgcaaaatctgcccggcaccctgatccgtgaggaaggccagcccggtaacggtgacgtcgccgccgacgaagcgtggaactatctcggcatcacctatgatttctactggcagatctaccagcgcaactcgctggacaataaaggcctgaaactggatggcaccgtgcattacggcagggagtaccagaacgccttctggaatggccagcagatggtatttggcgacggcgacggtgagatcttcaatcgctttaccattgccattgatgtggtcgcgcacgagctgacgcacggcgtgaccgaaaccgaagccgggctgatttacttccagcaggcgggtgcgctcaacgaatcgatgtccgatgtgttcggctcgctggtgaagcagtatcaccttaagcaaagcgccgaccaggccgactggatcatcggcgaagggctgctggcggcgggtattaagggcagtggcctgcgctcgatgtctgcgcccggtaccgcctatgacgatccgctgctcggcaaagatccgcagcctgccgatatggatcactatatcgacacgcgcgaagacaacggcggcgtacatcttaactccggcattcccaatcgcgccttctatctggcagcgaccgcgctgggcggctttgcctgggaacgggccggtcaggcatggtacgacacgctatgcgataaggaattgccgcaggatgccgacttcagcacctttgcgcgctttaccgtacagcatgccgcaaaacgttttgataatacggtggcacaggcgatccagtccgcgtggcacgaggtaggtgtaaggtga

SEQ ID NO: 8684 - DNA, 714 bp, Glycine max
  Peptide Sequence Number=SeqID_125462
atgtcggactccctgacggatggatatgtcagaaagtatagacccgcttatcaatcgcgcgccgctgcgtctgcagtacgcgcgatttacggggggttatcaaccatttatgcggctgaaaagattatcacgccttacggctgcgcgtcttctgtggttgtaacgccgtcacctgactctccacccagccatcatccagccgggtacgcagcagatcgccgcatcggtggtgacgctaaagccgcgcgccagcgtcgccagcggacttacgccttccagctgtgctgccagcccggtagtgccactgctgtaactgctgctgagcgcgcagaatacgtccctgcggctgctgggattgcaggcgctgcagcaggcgatcctgctggcgatgcgccaggcgcaaccgctggtcggccgcctcctgcagacgacgctgcagctggatcagcgtggtttgctggcgtgccaggcgcagctgcggatgctgctgttgcagacgatgctgcagccggactgcaaacggcgcagcagctcgatctggttgcggctcaccagttcggcagcggcagaaggcgtcggcgcgcgcagatcggcaacaaagtcggcgatggtgacatcggtttcatgcccaacggcgctgacgattggcaggcggctggcaaagatggcccgcgccacgcgctcgtcgttgaagctccacagatcttccagtga

SEQ ID NO: 8685 - DNA, 478 bp, Glycine max
  Peptide Sequence Number=SeqID_125463
ccggtgcccgcacgtcgccaataaatttgctgcccagccggctggccggtgcccatcgctgccagaaatttgctgcaccccggctggccggtgcccacaattcgcagcccgtcggcccgccggagcccgaattgctccgaaaacgtcgggagcgactagtttttgcccaaggttgctagcaccttgggcagagtcgccagcaccttggctgggccgaattgctccgaaaacgtcgggagcgactagtttttgcccaaggttgctagcaccttgggcagagtcgccagcaccttggctgggccgaattgctccgaaaacgtcgggagcgactagtttttgcccaaggttgctagcaccttgggcagagtcgccagcaccttggctgggccgaattgctccgaaaacgtcgggagcgactagtttttgcccaaggttgctagcaccttgggcagagtcgccagcaccttggctgggccgg

SEQ ID NO: 8686 - DNA, 2139 bp, Glycine max
  Peptide Sequence Number=SeqID_125464
atggataagttcttctatggcaatgttcagtttgtgcagtcctctgatatgtctgcttggggaggaactgttctttttggcataggtatcactgtcatggtgagagctcaaaccagccaccccttggatccactaactgctgctgaaatatcagtagctgtagcgaccgttcgagcagctggagcaacacctgaggtgagggatagcatgcgctttattgaagtagacctggtagaaccagaaaagcaagttgttgcattagcagatgcatatttcttccctcctttccaaccatcactgctccctaggacaaaaggtggacctgtgattccaacaaaacttccaccaaggaaagcaagactagttgtttacaataaaaggtcaaatgagactagcatatggattgttgaacttagagaagttcatgcagcaactcgaggaggacaccataggggcaaagtggtttcatctactgttgttccagatgttcagcctccaatggatgctgtggagtatgcagagtgtgaagctgttgtaaaggactttcctccatttcgtgaagcaatgaagaagagagggattgaggatatggatctggtgatggtggatccctggtgtgctggatatcacagtgaagttgatgctcctagccgaagacttgctaaaccactaatcttttgtaggactgaaagtgactgccccatggaaaatggctatgcccgtcctgttgatggaatccatgtacttgttgacatgcaaaatatggttgttcttgaatttgaagaccgtaaacttgtcccacttccacctgctgatccactaagaaattatacttctggtgaaacccggggaggagttgaccgaagtgatgtgaaacccttacagattattcagcctgaaggtccaagttttcgtgttaatgggcacttcattgaatggcagaagtggaattttcgtattggattcactcctagggagggtttggtaattcattcagtagcctatattgatggaagtcggggacgaagacctgtggcccatagattgagctttgttgagatggtagtcccgtatggagatcctaatgatcctcactataggaaaaatgcttttgacgctggggaagatggcctgggtaaaaatgctcattctctcaagaagggctgcgattgtttaggctatatcaaatactttgatgcgcacttcacaaacttctatggaggtgttgaaacaattgagaactgtgtttgtttgcatgaagaagatcatggtattttatggaagcatcaagattggagaacaggattggctgaagttcgaaggtctagaaggctgacagatggaaaaatagaagcagagatcaagctcacaggaattctcagcttaggatcacttcaaccaggtgaaactcgaaaatatggcacaaccattgcacctggactatatgcgcctgtccaccaacatttttttgttgctcgtatggacatggcagtagattgcaagcctggtgaagcatttaatcaggtcgttgaggtaaatgtcaaagttgaaaagccaggagacaataatgttcataacaatgcattttatgccgaggaaaaactgcttaaatcagaattggaagcaatgcgtgattgtgatcctttatctgctcgtcactggattgttaggaacacaaggactgtaaaccgaactgggcatctaactggttacaagctagtacctggctcaaattgtttacctttagctggctcagaggctaagtttttgagaagagcagctttcttgaaacacaacctttgggttactccttatgcccgtgatgaaatgcatcctggaggagagttccctaatcaaaatccgcgcgttggagagggtttggctacttgggttaagcaaaaccgatcattggaggaagctgatatagttctttggtacgtatttggagtgacacacattcctcgattggaagactggcctgttatgcccgtggaacgcattggtttcatgcttatgccgcatgggtttttcaattgctcgcctgctgtagatgttccacctaacccaagtgatttggatgacaaagagaatggcttgccagccaagcctattcagaatgggctaattgccaagctttga

SEQ ID NO: 8687 - DNA, 2952 bp, Glycine max
  Peptide Sequence Number=SeqID_125465
atgaataccctgactcagaaaattaatgatctccttaacagagtcacccccatcatgtctccatcaccttcatccacttcatcaccatcttcgccttttttcgagtaccatggcactcctgagaatgagaggcttaccatagcttccttctacatggaaggacgtgcactcacttggttccagtggatgactggaaatggccaatttacgtcgtggtcgaccgacatcggagataaagagagaggtataagcgcaccaaccgccgacgttaacccaggccgcgggcttggcacgtttgcaagaagaaaagcttctcgatgtccatcatcaacccaggtcacgcgccccacccgtgacagtcgtaccgccactccagcactgccccccagaaccggaacccttccacccttgttgcctttgtcgggccatcaggctccaccaccgttgaagcgcctctccccagaagaaatcgcctctcgtcgggagtgcggtctctgcttcacctacgacgagaaataccatagaggccatcgttgtgcctctagggtttttcttctgatagcagaagagggcgagacccctaaccctcatataatagtgcttgacccgcccctcgactcatcagtccaagtggaaccatcagacccgggcccgacccaaatcagtttccattcgttggctggtcagcttgccccagaaacactaagcattcacaatttcatccaacaggagttggtgactctctcgcatttaccttgtcgcacaacctcagtccccttacgggtcatggtgggaaacgggcaacaccttcagtgcacaagcgttccatggctcaaattgttaggtcccatccttacagactataaccccttgtccatgcaattcatccatgaggggcgggtagtagagctcaaaggagatacaaatggtactctgaacatcatcactccgccacattttcggcgtatggcgcgatctcaagcaaagggtgtctattgtcacatatccctttttccggaagcagtgaccattctgcaagatattcccccagccatccaacccatcctgattaagttcacgcacttgtttcaacaaccatggtgcttaccgccggagcgcgacattgatcatcatatccaccttcttccacaatcaactccgatcaacatgcggccgtatcgttacccgcatttccagaagaaaagtgatgggttatggcagttttttgtcgactaccgtgccccgaatgccattaccgttcgtgatcgctttccaattcccaccattgacgagcttttggatgagctcggtggcgccaaatgtttctctaagcttgacctccttcaaggggttgaaccactagcctctaaggtcgatgccattcaacaatggccaacaccgaggatggtcagggcagttcgcagcttcttaggcttggccggattttatcgccgttttattcgcgactatgcttcgatagcagctcccctggtccatgtcaccactttggctgaattcaattggtcaccacaagcccaggctgtctttgaccaactcaagcaagcattatctcaagctcttgtccttgccttgccgaattttgaccttcccttcaccattgaaacagacgctttgggggtaggtatgggtgtagtgttgtcccaaagataccaccccatagccttcttcagcaagcctttcccgcccatgctgctccgtgcctcggcctatgtctgcaaacaattcgcgattacaacagcggtgaagaagtggaggcagtacttgcttggccatcgcttgaccataattacaaaccacaaaagcttgaaagaactgttgacgcaagtgatacagacacccgagcaacacatatccctcacacacttgatgggttatgagtatcaaattcaatatcgcgccggtgctcataatcaagcagcagatgctctctctcggtcgcctttggcttccaaagggcctagccatgattcccacactgctattggagtaccataccacccccaccggcagtcacatgggtactgcgaaaacgacaaaccgcttgctggaaaatttcgaatggtcgagtctacgataggacgttacaaacttcgtatcccaatgtctcgattgccagcatggttgccgccatttcgtggcaatacaataattttggtggtgtgggaaaacttcacggcttgccctacaacttggtttctgaccgagacccttgtttgtgagcaaattctggcaataattgtttttccggagtggaatgcaactgcggatgagctccgcttatcacccacaaagcgacagccaaacgaagccaccggcaccacccccttcaaaattaccttcgggtgtataccctttaactttcctgagtatatcgcagggtcatcaactttggatgttgttgacaaaatgttgaccaatagggaggaaacattccaagcgatacgcaagaaactcctccgggcccaagaacgtatgaagctgactgccaataccaaaaggagagaggtgcttgaacgcataggaccagtggcctatcgtttgaaattatcgaaagaagcccatattcactctgtatttcactgttcattgttgaaaacattcaagggatccccagattgcattctgaaagcagaattaccttcacaatttgttcaacaccaacccatcatttccctcttagctttgctggattatcgtcgagcatcgaaaaacgcaccctgggaagtgttggtgcaatgtgaggggttgccaccagatgatacttcgtgggagaattgggagcaattatgtgaagactatcaccttgaggacaaggttaatttccaagggccaacggatgatacgaaggaagaagaaataactagcagaggcaagaaagacatacaaacaaggatgcagaagcataacaaagggggtacagatagcagttaa

SEQ ID NO: 8688 - DNA, 189 bp, Glycine max
  Peptide Sequence Number=SeqID_125466
atggtcgtttctccgggagcgacgcgtccagctcaagacattaaagaagcgctactaggaggcaacctactttgtttctcaagtcatagtgggacacacctagttgatcatgatcctaagaatttaaataaaacgagcacaagctcggaaggtagtcatacctcacaaaatatatgtatgcgtgtttag

SEQ ID NO: 8689 - DNA, 438 bp, Glycine max
  Peptide Sequence Number=SeqID_125467
atgtcgatggaagctctctttggaaaattgcttgcatatgaacatgagttgattcaacaatctcatgtagaagaaataaaaaagaagagaaaaggaattacactcaaaaaacaacttgctaaaaagaaaggaaataaggatagaaaacagaaaaaggcctacattgcttcggaagacaatgcattcacatcctccgactcttatagtgaagaagaagttgcaaatgtgtacttgatggcagattcaatggatgactcctcaaccattgaagaaactaaggtaaattctgaatatgaagaagtttgggaagcatttaatgaaacacatgaagaagcgcaaaggcttgctgtttcaatcaataatttgagaagcaatctaaaattgcatatcactaaattgacttcaacacaaaatgagttggataaaccgagacaataa

SEQ ID NO: 8690 - DNA, 695 bp, Glycine max
  Peptide Sequence Number=SeqID_125468
atgcttattgctctttctggaaaatgtcaatcatcaatcatatgcagactaggcatctatgagcccgttgaacataataaccccgcactctctcccaacttcgaatctcctgtctacgaggctgaagaggaggaggatgatgaaatcccggaggaacttgctcggttattggaatatgaaaagaaaaccattcggcctcatgaggaagtagtagaagtgattaacttgggaaccaaggaggataagaaggaagtcaagattggggcatcgcttgaggcaactgtcaaacgaggggtgattgaattactcaaagaatatgccgatgtgttcgcatggtcgtaccaggatatgcccggcttggatccccgtattgtggagcaccgtttgcctttgaagcccgaatgcccaccggtcaagcagaaactgagaagaactcgccctgacatggctctcaagatcaaagaggaagtacagaagcagatcaatgcaggttttcttgtcacatcagagtatcctcaatggttagccaacatagtgcctgttccaaagagggacggcaaggtcaggatgtgcgttgactaccgggatttgaacaaggctagtccaaaagatgactttcctctacctcacatcgatgtattggtcgacaacactgcaaagtccaaagtcttctccttcatggacggtttctctgg

SEQ ID NO: 8691 - DNA, 678 bp, Glycine max
  Peptide Sequence Number=SeqID_125469
atgtcctccacttcagaggactacatgtcctccacatcagaggactacacgttctcccctttggaggactacatgtccttgccttacgagggctacacagcttcaccttttgaggactacacgccctcaccatcagaggattacacgtcctcggcttcagaggactacacgtcctcaccttcagaggactgcacggggctacaagctctcgccttcgtagggctacacgcccccaccttaaaaggactactcatcctcaccttcagaggactacacgtcctcaccttcagtggactgcacgccttcgccttaacaggactgcatgttctcacctacagaggactacacaacctcgccttccgagggctaggcgccctcgccttcaaaggagtacacatcctccccttgagagggctacacgccctcgccttcgtagggttacacacccttaccttcaaaggagtacacatactcaacttcagaggactatacatcgtcgccatcagagggctacacgtcctcgcctttagagggctacacgtcctccccttcagaggacaacatgacctcccctttagaggactgcacgccctcgccttaacaggactgcatgttctcacatttagaggactacacaacctcgccttccgagggctagacgccctcgccttcagagga

SEQ ID NO: 8692 - DNA, 375 bp, Glycine max
  Peptide Sequence Number=SeqID_125470
atgcgtctaccggggaaggagagtctgctgatgaaatctcccataaccataaatgagattttggatgttagcatttcgtttctaaatgaccatttagaggaaacactgggttcgacaaaaatagaagaaattcactcaaagtgtatcaatctcgcacagggtaaggattacggtgagtcaggattttggctcaaggtttgtagaatggctagacatgatacatgtcggggtttggtttggctcaaggataaaagggatgccccacattatttccatgacacaaatgcaaaaatgatgatttggaaattttatgcaaaactggtcatgcatgcacctatgcggacactcaagtgtcaaatttttatggtcatgtga

SEQ ID NO: 8693 - DNA, 240 bp, Glycine max
  Peptide Sequence Number=SeqID_125471
atggactttccttccaacctctatttccttgaagccattaaagcaaaggtagcccttagggaagtggaaaacttgggtgaatcagataatttcaacaaagatattctaagagtcatggcttcaccattagtggcaagaatgttttactccatcacttgctttacacgaccaataggaacttggatgagtgaggaatccataggtgttgaaaggatagttaaaggagacataacatgctaa

SEQ ID NO: 8694 - DNA, 489 bp, Glycine max
  Peptide Sequence Number=SeqID_125472
atggaagaaggatatgctaccaacaaaccaccattgttcaaaggagtcaatttgtctagaaagtggagaccacaagttacagcattgagagctttgaagactcttgacaccatgtcccttgaagaacctgttggaaccttaaagggaaaatctcttgctctcagcgcccaaaaagcaaagaaagcaccatcatccgaggaatcctcatccaggccattgtccaaaagtgtatccaaagcactgagtatggaaaactcttctgaagaagaatttgatgaggatgatgagttggctttcatctcgacaaagattaggaagatgtgcaagaataagagtgggtctagattgaagaaatcctccaagaagtgcccagaattggagaagtctaaggacaagtacaagcatttcaagtccaaggacaagaaaagtctcatgagcacttgggaggatttgaacgataccacctctgatgaagaaggagaagagtaa

SEQ ID NO: 8695 - DNA, 252 bp, Glycine max
  Peptide Sequence Number=SeqID_125473
atggagataacccaagctgaggagtgtcctcaactgcaaactggtcatattccagaaaattccacaactatggaaaatttaaatctttggcatgtccaagcagataatgtggaagacatggaagagactagggaagaggagttctccactgtcatttccaagggaaacaagaaaaagatgaatgctaagcaaaaagcttcatcctccaacaagattgccaaccatttttcggttggaaagaaacaaccttga

SEQ ID NO: 8696 - DNA, 339 bp, Glycine max
  Peptide Sequence Number=SeqID_125474
atgctgtcatcagctactcataattcattggtggctctggatgagcttgggagaaggactacagcttcttatgggcaagaatatcttgtgcggaaggtgcagtattgcggattgttttgtactcactatcatcgattagctgttgattatctcaaagatccaaagctttttgtgcttgtaaagttctatctctgccacatggcatgccaagttggtggtggaattgcaggtttatatgaagtcacctttctttacaggcttacccctggtgcttggcccaagagctatagtgttaatgttgctcaaatggacctcaaacttaaggcttgctataaataa

SEQ ID NO: 8697 - DNA, 297 bp, Glycine max
  Peptide Sequence Number=SeqID_125475
atgtaccctcccttgttctctttgaacaacctagtggatgtaccctccactagaattgatccacaagagatgtaccctctcttattctcagtcaataacccaagtagatgtaccctctacttgtaccacaaaggatgtaccctcaaatctgttaagacaaagttcttaggcgggagacacaaaagaattcaggcggttagtccttcgttcttttggaaaagggagaagagagacacaaaaagaattcaggcggttagtccttggcgaattctttttggcaaagggagaagggaatga

SEQ ID NO: 8698 - DNA, 186 bp, Glycine max
  Peptide Sequence Number=SeqID_125476
atgtactttggtcttattcgaacaaaaatctggtcaacagggctgcagtggactgacgacggcgatggtgatgacatctcaggcaacactaatgacggcaatagtgatgacaactcaggcgacactaacaatgacaaagacgcggtggagttcaacacaaaaggcttcgagagtgaaagcttttga

SEQ ID NO: 8699 - DNA, 228 bp, Glycine max
  Peptide Sequence Number=SeqID_125477
atgggttacattgaggtttacagtgtgcaaagaaaaccatggcatgaaaaaggttgtatgattgtgattaaaaaaaatgaaaagagaaaatcgtgggcatggaaaaggttgtatgatttacaaaaaaggaaaaggtgtgtcttgcattcactcgaaagtaaaaatattcaagcacttgttgtgagcttgagactacagggaaatgctaatgtggttcaactcttttaa

SEQ ID NO: 8700 - DNA, 462 bp, Glycine max
  Peptide Sequence Number=SeqID_125478
atgatgctcgccgtatggtctgcaatgatcaggctgaatgaccgaattttgcttcctcggtcttcaaatttagcacaagcctctgaggaggatttgattcttatgtgggcttttcttaccggtcgtcagatcgactgggcccatttgcgttcctttgcaattggtgctggtgcagtgacctcctttgggtatcgtaaagatcgaaatggtcaatggttgaagaaggatgcactccctcctcaagatgaacgtactccttcacctcctcctcaacgtgaagattccgcactcatgaatgaagtcctctctgaattacggggtcttcgttcttatgttggtgaccgcttcgactcgttagatacacattttgctggtatggacattcgcctcacacagcttgaagaggatgttggatacattcgtcaaagtttcgatcttccaccaccacctccgtctacttag

SEQ ID NO: 8701 - DNA, 359 bp, Glycine max
  Peptide Sequence Number=SeqID_125479
acggcaagtccgatgacatgcaagggtaccttatggttatctgcaccttttgtcatctagagacagcgagtccgatgacatgcgggggggcaagcgagcccattgacacacagagactaacgtcatcttctgcaccttttgtcatccagagacggcgagggtaccttatggttatccacaccttttgtcatcccgagacggcgagtccgatgacatgcgagggtaacttagggttttactttcgtcatccagagacatttaagcccaacaacgcacaagattcttctctgctaagcagggacgatcaaggccgatggcatgcagtgactaacgtcgtcatctgcaccttccccgaagat

SEQ ID NO: 8702 - DNA, 390 bp, Glycine max
  Peptide Sequence Number=SeqID_125480
atgccgatctccccctgcggaagtatcagttggtctgtgccatcatggcatagggatcgcgcccacaagacacctagtggacccggaggagtccaacagggccctggggtttccagctttggttacgggcctttgtcagtcctacagggtgcccgttcctccccagcaaggtcatgccatcgtgacgtaggtaaggatcgcgcccgtaatacacccagtggacccggagaagtccaaaagggccctggggtttccagctctggttatgggcctctgtcagttctaggagtacctgtcgcccccagcaaggtcattaggcctgctattaaccggactttcatcgagaagtactacgcccccaggcaggtgcagggcgaggcatcacagtaa

SEQ ID NO: 8703 - DNA, 159 bp, Glycine max
  Peptide Sequence Number=SeqID_125481
atgggttctggcaatgcaatgtggttggactctcatgtcgatctgaatgaatcatcctttccacggagatgtaactccagttacttcggaaatggtaagatctttggcgcaagaacgcaagaggaggggttgatccgtatcatcttgacttggttctga

SEQ ID NO: 8704 - DNA, 387 bp, Glycine max
  Peptide Sequence Number=SeqID_125482
atggaaattctggtcgttgttgttttggttgatgcctatgacacatttgaccgaagatgcgagaagagtagcgcaaggattgtctgttgcacacccgttctttatgtatggctgctgaaagctaggacacaagagataacttggctcccaaagctaaagatttcaagtgaggaagaggctaaagtccctgaggaaagcaaagacgtgcaagccttgaaagtgaaacttgaaaggacacaagtggtcaaggaaaagttcaagacgacagccatcagggtcaggaaggaatgtgatgagctgagggatgtcaatgtggccacggctgaagcattggaacgagaaacgaagagggcccgaaaaaaagaatggggtcgaaacaagttctga

SEQ ID NO: 8705 - DNA, 474 bp, Glycine max
  Peptide Sequence Number=SeqID_125483
atgtcaaatagaaagtatgaatctagttatgaaaaattgaagaaaaaacgaaaagttgaaaagctaagtgaatctcaacgtggtgcccttgataaattttttattattcataaaaatgatgcagaagcaagttcaataggtgaaaatgtgatagaacaaccactgatagatcatactgacaatgaggaaaatgttatagaacaaccacctatagataatactgacaacggtgtagaaaaatcacctagagatgatactgaaaatggtgaaaacgtgatagaacaaccacctataaataatactgacaacacaaatagtcataatttcaatcaagaactagaagacaatattttagaaataggagtagaagggaatgttgagcataataacacttctagtgaagtacctacaaatatttatgacccaggactatggaaaaatattgatggaaaatttagagatttaatgatataa

SEQ ID NO: 8706 - DNA, 303 bp, Glycine max
  Peptide Sequence Number=SeqID_125484
atgttatcgacaacacctgtgttcgccgctgataaatatgagattgccgtagtcgccaaagtgaccggcattccgtggttcaaccgcatggaagtgggcgtcaacgaagcggcgaaaaaactcgacgtcaacgcctaccagaccggcccttctaccccggatccggccgcgcaggtcaaggtgattgaggatctgatcgccaagaacgtcaacgccatcatcgtggtgccgaacgacgcccaggtgctggagcccggtgctgaaaaaagcgcgcgacaaaggcatcgtggtgctgacccatga

SEQ ID NO: 8707 - DNA, 255 bp, Glycine max
  Peptide Sequence Number=SeqID_125485
atgccaatctccccctgcaaaagtatcagttggtctgtgtcgtcccgacatggggatcgcacccacaagacacccagtggacccggaaaagtccaacagggccctggggtttccagctctggttacgggcctctatcagtcctacagggtgcccgtacccccccggcaaggtcacgtcatcatagggatcgcgcctgcaagacacctagtggacccgaagaagtccaacagggtcttggagttgtcaagctctaa

SEQ ID NO: 8708 - DNA, 159 bp, Glycine max
  Peptide Sequence Number=SeqID_125486
atggagtccagtcctggcgcacaaggaaggaaaagaaaaggaggggtatcacaccggtgtaaaccagctggatctcaaactggagaaatagaactccccatggctgggaactcacaatcgatagagaggcttgccacagaaagtccagaagtcgcttga

SEQ ID NO: 8709 - DNA, 333 bp, Glycine max
  Peptide Sequence Number=SeqID_125487
atgcctaccgcatatgcccgcagacagcgacaattggagcgtgttgttaaggatcctcctgcgattgtagaggaattgcacgacaaggaacgacaacaagaagcacctgttgaggatcctcctactaatgttgagggttttccaggcgaatcccatgacacatttgttctgagagattatgaaaatcacattgcccccagaatctggaatggaaagcttaataatggagaggtttgccacaaacatcgatctgctcaaagcatttcgatatggtttccatctcctcagttatggtcacatgtgtctcacataacccatgatctgaaaaactaa

SEQ ID NO: 8710 - DNA, 1198 bp, Glycine max
  Peptide Sequence Number=SeqID_125488
atttgccgatgaagcagtttgtattggtcctgcaatgagcaaagactcataccttaaaattccaaatatcattgctgctgcagagattactaatgcagatgcaattcaccctggttatggattcctatctgaaaatgcgaatttttctagaatctgtcagaaaaatgggatcaagtttattggtgcttccccagaacaaattgagaaaatgggtgacaaagcgaacgccaaagcaaccatgaaggctgcaggtgtgccatgtgttccaggttctgacggtcttattgaatcatatgagcatgcagtgaaagttgctgaagaaacaggatatcctgtaatgatcaaagcaactgccggtggaggtggaaaaggaatgagagctgtctggaaagcagaagatcttaaggagcattgggattctgccattcaggaggctgtagctgcttttggaaacggaggtatgtacatggaaaaattaattgaagagcctagacatatcgaaattcaggttgcaggagatcaatatggtaaagcctgtcacctttctgaaagagattgctctgtacaaagaagaaatcaaaaattgacagaagaaactccttctccgtttatgaccgatgaacttcgtgagaaaatgggtgcggcagcagtaaaagcagctgaattcattggttacgaaggtgtgggaacaatcgaattcctggtggacaaacacagaaatttctatttcatggaaatgaacacaaggatccaggtagaacaccctattaccgagcaggtaattgattatgatttgatcagggaacagatcctgttagctgcaggaactccaatatcaggaatcaattattacccgaaattacattcaattgaatgtagaattaatgctgaagatccatatgctgacttcagaccttctccaggaaaaataacaggattaaatatccctgggggacatggaatcagagtagacactcatgtttactcaggatatacgatcccttctaattacgactctatgattgcaaagctaattactacggctcaaacccgtgaagaagcaattgctaaaatgagacgtgcattggaagagttttatattgaaggagtaaaaacaacgattcctttccacagacaattaatggatgacgaaaattatcttgcaggaaactacactacaaagttcatggaagacttt

SEQ ID NO: 8711 - DNA, 267 bp, Glycine max
  Peptide Sequence Number=SeqID_125489
atgacggggttggggcctgtagctcagaggattagagcacgtggctacgaaccacggtgtcgggggttcgaatccctcctcgcccacaaccggccaaaaaagggaaggatttttccctctgggggtaggaaaatcatgatcgggctagcggacccaaagctatggaacttccccggactgtggaacaaaggagtatcccgaacctacaccgaggtattgacggcgattctcaaatatcgcagaacagaacagaatgggatacgatga

SEQ ID NO: 8712 - DNA, 120 bp, Glycine max
  Peptide Sequence Number=SeqID_125490
atgattcaagttggtaaagatgatccaaaactgtatctaaaggacttggattatatgctaggtttgaccttagctttgaaagtcaaggttgtaccattttcagaagtgtatatgttatga

SEQ ID NO: 8713 - DNA, 331 bp, Glycine max
  Peptide Sequence Number=SeqID_125491
atggcttccatgatggatgccatgctaggaatgaggcgactaatggagaataatgcggtggccgccgccgccgctgctgttagttcggctgccgaagcagacccaactctcccagctactgtgcaccaccctatcccaaacgtggtaggacgagaaagaagcacactggggcacatcagcaacccccattcggggtacaaccgagtagcttacccctatggattaccaactaattacacaccaccagtcctacgtgacgacgctggtcatgtccctccccccatccttgaaggggagcctcctcaacagccgaacgagatccacaaggatc

SEQ ID NO: 8714 - DNA, 583 bp, Glycine max
  Peptide Sequence Number=SeqID_125492
gatccgaaaggagaacgccgaactgagagatgtaaatatagccaccaccaaggccttagaacaagagaccaagagggcccgtagtgaagaacatggccgaaacaaattccgaggggctctgtggagcagtaacagcgagcttaagctccgaagagaggaaagggaccaatcacgagtagacagtttgatcttgaagaatgaattgaggatttgcctaaggtccaagaggagcttgtctcagcggttatgcgagaccgagaccaacatgttagccatcatcagcaagtaccaagaagaattaaatctagccacggcccacgaccacaaaatggcggacgaatatgcccgagtgtatgcgaaaaaggaggctaaaggaagggtgatggactcgttacatcaagaggcaacgatgtggacggaccaatttgctcttactttgaacgggagtcaagaacttccccgattgctggccaaggccaaagcaatggcagacacctactttgcccccgaggagatccacggactcctcagctattgtcagcatatgatagacttaatggcccatataattaggaaccgctag

SEQ ID NO: 8715 - DNA, 903 bp, Glycine max
  Peptide Sequence Number=SeqID_125493
atgttgccggtcagggtatcggaccatggcaggatgcgcgaacgccacagcgcggtgccatcgggcttcacctggaaaaacaccgtgttgatccccaggctgtgcagcttatccagtttggccgtcagcgcctgctgctgctggcgaatacgcagcgccgggctggctgtgacggaggatatcggcggccagtcgaggcgcgacaccgtagtgagccagacgccgcgcactggttcagtctgcgctgcgggtttagccggaacaggaggtttagtcggcgacggaaacggggtgaccagcgattttggcggctccgaggcgcagctggccagcaacagcacggcagacagcagacgggcgacgcgtttaatgtgggtaacagagagacataatgtcaagacattggctaagatgaatgccgccgcggcgctgtcgcgcgtcccgcatcttacaggagttctcactatgcaatacgaagacctttatcgccgcattggccagatcatttttagctgtggccccgacggcgcgcaggtgctggtggtgcaggcggagctgtttgccgatgaggagggcgggcagtttcagtttaactaccttgatgaaaacggcgaaccggactggttcgagccggacgcgcgcgcgattggcgatctcataacggcgggcttccgtgcccgacatggcgagcgttacgaacgcagcgctaccatctcctcgctgtttttacgcgccgcgcgcttgcggtgcactatctggctggcgaccagcaccagcagcgttaacagcccggtggcgataatttcggaacgatgctgcgcattgaacagcattgacgtcagtacgccaacgatgaacaccatggtggcccacgtcagacccgggaacagccacatgcgatag

SEQ ID NO: 8716 - DNA, 144 bp, Glycine max
  Peptide Sequence Number=SeqID_125494
atgacaccatcactttcaccgttgtctgtcggtttcttcatcattgttcaccagtgtcagtacgtgtttgggacgcttgttctacgacgtcatcatctccgtgttctgtcagccagcgtcagtcgcgactgtcctctaaggtga

SEQ ID NO: 8717 - DNA, 576 bp, Glycine max
  Peptide Sequence Number=SeqID_125495
atggacatagtaggtagtaggaatggagttccacttccagtctctaaagagaacacagcagaatatgtttgccaatggcttatagttgccattggagagtgtgatgaggaaccttatattaccatgataatgggttatggttcagtggagaattttaatgaagcatacaacttacttgagaggcaaaagagaaagggatgtatacttaatagaaaagttgaggaagcattgaaaatccttgaagcaatgaaaatggatgcagctcccaatcttacatcctacaatattttaattgacaggctttgtaaggaaggagaacttgaagttgctctgaaagttcaggactccacgaaagaggctggcttattccctaatatcataaccgtaaatattatgattgatcgactatgtaaagcggaaagacttgatgaagcttgctccacatttttaggattggatcataaagtttgcaccactgaatcagtaacagtttgttcactcattgatggcttggccagacatggcaagctgaatgatgcctatatgctttatgaaaaaatgttagattctggttag

SEQ ID NO: 8718 - DNA, 417 bp, Glycine max
  Peptide Sequence Number=SeqID_125496
atgaggggcaccgtgcatgagcctcgagcgaacctaggggcagatcaaaagttttctcataagggtggacccttgggtactagtaccctctccttcagaggaccaaacatcctcctcttcagaggaccaaacattctcatcttcagaggatcaaatatcctcatcttcagaggactacacgtcctcgccttcagagggctacacgtcctcgcctttagaggactacacgtcctcgccatcagaggactgcacgtccccaccttcagagggctacacgccttcgccttcagaggactacatgtcccccttttcaaagggctacacgccctcacccttagagggcgacacgccctcacctttagaggactacacgtcctcgccatcatagaactacactccctcgccttcaaaaggtga

SEQ ID NO: 8719 - DNA, 153 bp, Glycine max
  Peptide Sequence Number=SeqID_125497
atgcaggttagctcccctgggcgagttgagctcgcctggttgagcaaccactgcacgaagagggttaaaaagggggagagggaaggggatggccctaggcctatggtgcattctgagataatggggcatgccacattgcccccattcccttga

SEQ ID NO: 8720 - DNA, 237 bp, Glycine max
  Peptide Sequence Number=SeqID_125498
atgagagcattgattttattggaaatttgtattcctttaggtggatatggcaccctggaagaactacttgaagtgatcacctgggctcaactaggaatccacgataaacccgtttataaatgtctaaataaaatggaagaagcaaaaccaacaatgaaaccaagagaaaatatttggataacccaagaactaccaatgttcattgcctatcaaaatcaaccatttaaggcatcgtaa

SEQ ID NO: 8721 - DNA, 321 bp, Glycine max
  Peptide Sequence Number=SeqID_125499
atgactaatgcaaactgtccgcaagagtcattgcattcagtctcaaacgggaatctaaggtttgacactgcacaaactcttgtgtcaaggttccttcttttttcgaggacgagggtgagagcctcgtcgagtctgatgaaacgaaagtccaaacttggagcagccaacactataggaacgaagctgtggttgttgttgctgctccacgattgcaaaagtattctagttttgatgactagagtggggagaagcctctgcttttgcccattcgaagcttcaaatctcgcttatctgaagaagatattgatgttcaatctctga

SEQ ID NO: 8722 - DNA, 303 bp, Glycine max
  Peptide Sequence Number=SeqID_125500
atggtagaaagggggagatttgatcatatagaggaaaggttgagggctattgaaggaggtggagatcatgtttttgctgacatggtagagttgtacctagtgtttgacatggtcatcccttcgaagttcaaggtgcccgactttgataaatacaaggggactacttgccccaagaatcacctaaaactgtactgtcggaagatgggggcgtatgcgaaagatgaaaagttgttgatgcattttttccaagaaagccttattggagcaactgtcatctggtacactaatctggaaccttcctga

SEQ ID NO: 8723 - DNA, 453 bp, Glycine max
  Peptide Sequence Number=SeqID_125501
gaaagaacacgctttatggcacccttaccaaacgcgcgctagagctagagtaatgagtgaaatagaggaggtacaagagcgaaggaaggtcgacatggaggccatgaaagagcaaatggccacaatgatggaggccatgatgagcatgaagaagatattggaggtcaatgcggctgtagttgccgctaccagcaccgttgttgaggtggacccgactcccccatctagcctcaaccaaataaatcatccaacctcagatatgatagatcagggaggcaaagaattcggaagtacgggcggcccccattttgtgcaagttcaaaacaagcatgccttcccaccatatggcttgcctcccaaatatacaccacccaatgtagcgcacaattccgatgagaatgtcgataactccactcccatactcattgagagccaacaaccttgttggatcaa

SEQ ID NO: 8724 - DNA, 405 bp, Glycine max
  Peptide Sequence Number=SeqID_125502
atggatgatgatggtgtcagagccgagaatgttgctgcaaaggatgttgttgacacccttggtgatgaagtcgcctttcatgtggttgttggtgagatgactggcagagatgtaagattgtcagaaactcccgctaatgaggtctcaaaggtgatgaggacgagtccaacctccaaaggactttgtcactttggtgacaaggcaaggctcacaggtgcgctttccaaaggaggaaagatgcacggagtcgccaccaacgaaggtattagcacctctcacgtcgacaaaagtggggctcttgctcctacgtaccctccatcgaagaggaaatcagacctacgtagttctttcttaagggtgaatcaagcgattctttttacttggaagcttgactttgcgggttga

SEQ ID NO: 8725 - DNA, 477 bp, Glycine max
  Peptide Sequence Number=SeqID_125503
atgcccaatcaaccacaaagacctccccaacatcacccacaaaatccattccctacacagcttagacctagtgcaaatctcaatcccaatgcaaacaccaacccaaggaggaaattcccagagagaaaacccacggagttcaccccaatcctaatgtcgtacgccaacttgctaccatccttacttagcaaccaaatggacatagtaagctcgagaaagctctatcaacctccatttccccaatggtacaatcctaacgctacatgcgcctatcatggtggcgtcccagggcactttgtcgagcaatgtgtagcttttaagcataaactcatcggtgaacccggtgggagaagggaaatgtcaggagttgaaatagataagggatgtgtcgactccaaaacgggagatccatgcttgatgcattcaagggcattgcacgatgtagaaatgttcccaatagctgaggagttgctgtag

SEQ ID NO: 8726 - DNA, 486 bp, Glycine max
  Peptide Sequence Number=SeqID_125504
atggcggttccaaagtcagaaaagatgcaaagacaagatgaaactaacaagaaacaagcggttcctctcggtgtggagaacaacgatggtttgtggtggctaatggtggctgtgggtgatggagaaagttcttggaactttagaaatggatttggaagaaagaaagaagaagaaatgacacatcttctcaaagatagcaacggtcagatcatggacaagtgtcttgtgaagtcgcaaaccaaatttcgagaagatccaatggttaacaaaggctgggcagcgcttctaacacactccaaacatcttctcaaagatctcaacggtcagattatggacaagtgtcttgtgaagttgaagaccaaagttcgagaagatccaacggttaacgaaggctgggcagcgtttttaccgaggcagcttgatgtagctttctctagaagcttcattaagaggcttcctccagaagcttcctcgtggcttctttga

SEQ ID NO: 8727 - DNA, 731 bp, Glycine max
  Peptide Sequence Number=SeqID_125505
tgcgtgatgttcggaggcatgttggcgaagtgctcctctatgcattgtggcttagtttgctggtgcccattggaactaccatgagtcgaggacgtggggatctcacgagccgagtatgtgccaagttcttcggtggtaagagggccaagagagttaattgtagcaggtttccccccattgccatccctaggtacgagtgggtttccatgaaagttaacttgtacccaacttggtttcaaacccatgagtctataaaggagttgaaaaggaaggtcgacatgatgacctcagacgataccaagttgttcatcgtcgagccctgtagcatagaggagcgcgtgtctatgtgggcatcaaaggaagttatgaagggatacgattacaagaacctgaagagtttgagtgttgatgaccaaactcaagtcgacagtgtcaaggttgagatcattaatcttgatggacttgaggtagcgagcgggggagcggaattgggcaacacgattgagtggcccgttgaggtgttagagaaagacaaagttgtggagaaagagaaagaggcggaggttgttcaaaagtcatctgtgactgaaaaggtggcagaggcttccacttggcctggttttaccgtcactatgtcaccacgttggttggggaactttattggtagatggggcattgagatgatcgtgcctagagcattcaacgttgttctcccgatcaggatattgtag

SEQ ID NO: 8728 - DNA, 390 bp, Glycine max
  Peptide Sequence Number=SeqID_125506
atgcctcttctttccctcatttttgtttttccccttctcctcttaaaatcctttctttttctcgcagcccaccaaacttgtctcagaaaaacgacgatctcagaccttttcctttcctttcccgcagaaacccaaaacagtctcagtaaaactacgatcccggtttcgttaaccgttggattttcatgtggtccgcggttcagttccgcacaccctcaccattgggatttgcaagataatattcacggagagagaaaaaggaatcgcaccaagatagtacaagtggaggcttcaatcccttctctacgtttgggaactctattggagcagttagaggaaaaaactggaggaatctcagggaatgctagagatgctgctatcactttctga

SEQ ID NO: 8729 - DNA, 549 bp, Glycine max
  Peptide Sequence Number=SeqID_125507
atggagaaaggcttgagtggaaaaaaccgaggtcctgaatctcaagatgaacaacagattcttagttggtttccaccacgtgctgtcaggtccaactccatcgccaatgattctgagttgttggccacgttgaccatgcttctgcggagtgaaggttcgccaatttccatagactggggagtacagtggtatccccatagcatgctcgggagctcgtctacccacagccccttaggaattattgacgttcttttgtgtagcttgacgaggatgaccttgtttgtggcttctacttgcctattggcttggggatgctccgctgaggagggggtctgcttcaatccacttggtgaaatagtccaccatggtgaggaggaattcgatttggcttttggctataggaaatggttcgagaatgttcattccccacatggtgaaaggccaaggggaggtgatgttatggagctcctcaggcagcgcgtggtggatatggttgaactcttgacattctttacactttttgacatacttggtgcaaactgcccttaa

SEQ ID NO: 8730 - DNA, 204 bp, Glycine max
  Peptide Sequence Number=SeqID_125508
atgttcagaggaaacaacgacgacgagtttgagtttgacggtggcttcgacttcgacaaggaggaggcactgtataaagagttggagaccctcattcattcagagaacactgccccatcgatgatgtttccgttggaggacgccacccatgttcacagtggtgattctgattctgatggtggctccgacaacaacaagctgcag

SEQ ID NO: 8731 - DNA, 333 bp, Glycine max
  Peptide Sequence Number=SeqID_125509
atggcctttgaattttctggaatcaaaagtaactgcaacggggtagccatcataacttatgctggtctagctggacaagatgtgtggaaagaattttaccagtacttcagggaaagcaaatttatccatattatgtccattgattttattatactttccacatttgcaccattctgggtttacaatgatatgacagctcgaaaaaggtctgacaaaggttcttggcttcttcccctatcattgataccatttttagggcctggtttataccttctcctacggccatcattatcaacagtggccatttcacaaactcctgttgagccagagtaa

SEQ ID NO: 8732 - DNA, 285 bp, Glycine max
  Peptide Sequence Number=SeqID_125510
atgggggtgcaaatagcatttgggaagctgggctattctagaacattttggaagttgggttacttaaggaggaagcaacccagctcgcttgggcgagctgggcggcaacctcttcccccttttcctataaataggcgaagggaagttgttccaaaggaaaacccttgccgaggtgcttccgtaatgctttcgagatgtttctgtgagcaaatccatgaaggttttccgccgttcttcaccgttcttcattcgttcttcgttcgttctttgttctttaaccggtaa

SEQ ID NO: 8733 - DNA, 348 bp, Glycine max
  Peptide Sequence Number=SeqID_125511
atgaatgagaccctggatgttagcatttcgtttctaaacgaccatttagaggaaacactgggttcaacaaaaatagaagaaaatcactcaaagtgtatcaatctcacacaggtggggaatttggctttgagtgttttgccttttcctcttctgtttttgtttagtgcgtggcgagaaggtcgtgggcaaggattgacattctcaccctgggtcaaggtttatgataagttgggattttggctcaaggcttgtagaacggctggtcatgatatatgtcagggtttggccagcggttcggggataaaggggatgtcctacattattttcatgatacacatgcaacaatga

SEQ ID NO: 8734 - DNA, 258 bp, Glycine max
  Peptide Sequence Number=SeqID_125512
atggggtttggttggtgtactacaaggttaggaataaatgggttgaggggaatccagtttccacttgcaatggatgatgatggtgtcggagctgagaatgttgctgcaaaggatgttgttgacacccttggtgatgaagtcgcctttcatgtggttgctggtgagatgactggcagagatgtaagattgtcagaaactcccgctaatgaggtctcaaaggtggtagtgatagaggatgccaaaaacgaccgagtttag

SEQ ID NO: 8735 - DNA, 336 bp, Glycine max
  Peptide Sequence Number=SeqID_125513
atgaaacctacaatttcgaagacactgatccacatcaacagagccaacaatggcttggtaggacaaaaaatattgggtttaagtcaagcttggggtagagcttgcaagtacatataccagaaagagacggacttaaagaccacttttgttgttgttgctactaataaggttgggagtgctttgttcaatcgcaagaaaagagggagcaaagttcttaaattagctaaggataaaatggatgtagttgaccttgatgtcggattgggtgttgcccataaggccaatgttagtgttgcctcacccaacaaagatcataggggagatggtcattcttag

SEQ ID NO: 8736 - DNA, 510 bp, Glycine max
  Peptide Sequence Number=SeqID_125514
atgtctaggagctacccttcttattccccccttctcccttcaacttttgacaaagacttctttgatgatgacatggatatgggttggaatgtaaggagggtagtgaagtcctcagagttgctccatcttcctcttgagagtgtcgagatgaattggatagatgatgagatttgggggactaggtccaagtttgacatttctgttatgaacgagttatgcaagacaatgtggcttacttgtgacaggaatggcggccacttctttgtgccccatcggttacactatgagaagaaaaaggttgccttgactctgaggtcggtgaatggtcacaagatctttgagattcttcaaatttcatataagtactacaaagacgaatacttttgggaattgcatttgatggtggagggaaaaatgccacaaaattccctctatattggactgaggatcattactgagatgaagctaatgcctaccatgtcaacaatgatgatttttcagagaacgtga

SEQ ID NO: 8737 - DNA, 747 bp, Glycine max
  Peptide Sequence Number=SeqID_125515
atggaggcattttgtgattctaacaaaccagataagtctgaagttcctgacaaaacagagactggcgaaagggctgggcactgttttggtggtgatggacaggttgacgaaataaactcatttctaaggactcaagcatccatatacagcaaaaatgcggccaatgttcttgtaaaggaaattgtaaaactgcctgggattcctccatccattgtcttggatcaggatcaagtttttctcaatcaattctggagagaattgcttacattggcaggaatgaggcttacacagtggcctaattggtttagcttggctgagttctggtttaataccagctataactcagcccctaacatttcacccttccaagcattatatgggaatgggatagaccctcctctgtcattgaaagggactacaatcccttctaaagttgaagacatgaacaagctgacacaggagagtggatcagatgaagccacaagccagaaaaacatagatgtgtggaacttcaagaatgggatgggtctacatcaaggaactattgcatataaactggagcttcctgagcatagcaatatccatccagtcattcatattttgttgctgaagaaggtcaaaggctcccaaagggattcacagccacttccccctgtgctcaattacaggagacctttccttaatccttatttccaccttgaggacaccatggcacctttggaggggaatattgttttagacctatag

SEQ ID NO: 8738 - DNA, 537 bp, Glycine max
  Peptide Sequence Number=SeqID_125516
atggggctccgaaaaaggggtagagattggagaattgcactaagcaatcactacgcatggctccaaacccgtgggtggaggatgaacgaaaacgcaattcatggggctccgaaacagggtagagaatggagaattgcactaagcaatcactacgcatggctccaaaaaatgggtggaggatgcaagaacaaaaacgtaattcatggggctccaaaaaagggtagagaatggagaattgcactaagcaatcactacgcatggctccaactcgtgggtggaggattcatgaatgaaaatgcatttcatggggctacgaaaaagggtagagaatggagaattgcactaagcaatcactacgcatggctccaaactcgtgggtgcaggatgcatgaacgaaaacgcaactcatggggctccgaaaaaaggggtagagaatggagaattgcaataaggaatcactgcgcatggctccaaactcgtgggtggaggatgcatgaacgaaaacgcaattcagtggggctccgaaaagaggggtga

SEQ ID NO: 8739 - DNA, 195 bp, Glycine max
  Peptide Sequence Number=SeqID_125517
atgagggtgcaaatagcaagaaggcccacttgggccttccaggatgttcctccagaagtgggatacgtaggagaagggaaacacccttaccaaaacgctttgttcacaaaagaactacgtaggtctgatttccttatcacaatcgagggatacgtaggagcaagggaaatacccttgtcgaccacaaaaagataa

SEQ ID NO: 8740 - DNA, 529 bp, Glycine max
  Peptide Sequence Number=SeqID_125518
gaaggccgacatgaaggccatgaaagagaaaatggccacaatgatggaggccatgatgagcatgaagaagataatggaagccaatgcagttgtagttgctgctaccagcgctgttgctaaggtgaacccgatgcccccatctggcctcaaccaaatgaatcatccaacctcagatatggtgggcaaagatttgggaagtacgggcggccccatgatgtgcaaattcaaaacaagcacaccttcctgccatatggcttgcctcccaaggaggatgtcaataagcttcgctcccatactcattgaaagccaacaacctcaatctgatcatgcacacgtctcaacccatgggggaaacacatggaatgccccaccacaatctatatcacccacaaccataccccttgcattccacaccgggttaaaaccctcatgctatggcagaaatgggaaagttggatcatctagaggaaaggctcaggtgccagactttgacaagtacaaggggactacttaccctaagaaccattaa

SEQ ID NO: 8741 - DNA, 300 bp, Glycine max
  Peptide Sequence Number=SeqID_125519
atgaagcgtgcactgattaatattcacaaatttgggatactggtgaagggagaactgccaggaaaccacattacaagcgaaacctcaaagagagttgggcttcgtcctcaaaaggaaacaacaccagaaaatctagccttccatggattcaaacagaaaacgcaattgaaaacaaacgtaaatgagagtagaagaagaagcaagaacgaaattgtaattagaagcagaaaacgtaaaattgcattacgaactcagaagcatcaaagcagaaaaacgaaaaccctaaaacaaaagctctga

SEQ ID NO: 8742 - DNA, 351 bp, Glycine max
  Peptide Sequence Number=SeqID_125520
atgttggctactggatggtggtggaaggtcaaagcattaacgaatataactcatatcctcctcaagctgagtgatgcgagtatccattcctgcaaaccatgtatcaatagcatcaatgcggctgtccaaggaatcaaaacacacaccaacgaaggatgtggtgatggagaacggtcttctgcggcctgtgctggtgcgtctttcttcacccaagaaccatccctctctttgcggtatccaaaagaggagatcacattcgcaccgatagagaaagatctcttgactttaacaaaagcctcagagtcaagaggggacattaaagatgttgtaaagaacaaggtgatcgaatga

SEQ ID NO: 8743 - DNA, 294 bp, Glycine max
  Peptide Sequence Number=SeqID_125521
atggcgcaaaaggctgacgacggcgtcttccggaagacccaaccttttccggaaagtttccggaagaagtgttcttccggaagtaaccaaacgtcttccggaagaacacttcttccggaagacttccggaaaacctcttccgggaactttccggaagaagtggttcatccggaagaattccggaatacgcgcacttccggaagaactttcaaagttccggaagacctttccggaagaaccccttcttccagaatgtttccggaagaaccacttcttccggaagtgattttatga

SEQ ID NO: 8744 - DNA, 426 bp, Glycine max
  Peptide Sequence Number=SeqID_125522
aactatcttatctcttatcatgagcacgtggctaaggtcgaatcgaagaaggtccttgacgtcgacgatgaaggtaagtgcgttaattccatgcaaattgtaccactcgaagtgcctcttgaggtgcttgctccttgctcccagccacctcaacagcactaccatggccacgcagtctttgcctccacaaaacgtggcgttttgggtgtcggaagttgggtatcaaaggaaggcaccaccaacatcttgggagtgagagagaaaggggttgagggatggggaagaggtgagagaggagaagaggaacctgcggggttggggtggaagatgcaaaggagggagaggtcgaagccggggaacttgaaggagaggagtttggcggtgacggcggagcagaagagggaggcaagggtttggaggaagtga

SEQ ID NO: 8745 - DNA, 387 bp, Glycine max
  Peptide Sequence Number=SeqID_125523
atggggagtgccttggagactctgtgtgggcaagcatacgatgcgggacagagcacgatgttgggtgtgtacatgcaaagattatgggtcatcttgttcgtcactgcccttattttgttacctctttacattttgtcacctcccatcttgaggctctttggacagacggctgagatctcagatgctgttgggttccgccattcttgttggcggaacccttattccgtcatcactgctggtgagataccccaaagggttacgccaacacgacttgcgaaatacgtgcatgtgggctacgccaactgcaatgccgagaaatacccatgcatgcatcattcacccatgcaccccaccacatgtacacattgtaataattcatggtcataa

SEQ ID NO: 8746 - DNA, 123 bp, Glycine max
  Peptide Sequence Number=SeqID_125524
atgaatagccgttttcaagtagtgttcgatccaaaatttcaggtgttgaccgaaggaaacacctcgttgcatgtgcttaagaaaatagagcaactcgtgtttcctaaggatgcacaattgtga

SEQ ID NO: 8747 - DNA, 333 bp, Glycine max
  Peptide Sequence Number=SeqID_125525
atgggtagagcggagggggtacaagagaagatgaaggacgacatggaggccatgaaagagcaaatggccacgatgatggaggccatgatgagcatgaggaagataatggaagccaatgcagttgtagttgccgctaccagcgctgtcactaaggtgaactcgatgcccccgtctggccttaaccaaatgaatcatacaaccttagctatggtaggcaaagatttgggaagtacgaatggccccatgatgtgcaaattcaaaacgagcacgccttcccgccatatggcttgcctcccaacttacaccagccaatgtggcgtacactcccaatga

SEQ ID NO: 8748 - DNA, 2214 bp, Glycine max
  Peptide Sequence Number=SeqID_125526
atggatagttacgaagctacaagaattgtgttttcaaggatccaaaacttggatgctgaaaatgcttccaaaatcatgggtttacttctgcttcaggaccatggtgagaaagaaatgattagattagcatttggtccagaagcacttgttcactctgtgattctcaaagcccgcaaggacttgggtttaccttcgaactctccgcccacaccctccactcctccctctccttcacccttcatttctaggcaaaactcaaacacttcttcaagactcagtgtcagtggtatcaacctccctcctcctctcactatcccaaacccttctgcttcatggcctactatgtctgagcttcaaaccgatttggttgctggctcttctacttctttatcttccttacccttctatgctaacggaggctcggatccaattgatgagttccaacttcaagaccagctttctttcctgaatgatggttctaatactagcatttctcacaagaacaacccagatttgttttacccgacttactcagacttttcttcaagtcctactactgctgctgaccctaccctttttccttcctatggttggggagggtctcttcatcgtaggagttgttcagtcaatgatgcttgtttgggcactgaggaccctaattctgggttgggatggaagccttgtctttactttgctagagggtactgtaaaaatgggactagttgcaggttccttcatggtggacttggagatgctgatgctgcaatggttggctctcctagcaagattgagatgatggagcagtgccatgagctcttacgatccaaatctgctcaacaacaaagattggctgctgcttctcagctcatgtcctcttccacttttccatactcccctaagtgcatgaatttcctgttgcagcagcaacagaatgatacccaaagagcggcagctgcagctctgatgatgagtgaggatttgcataaatttggacgatccaggcttgaaagaaatgatttttctttgaacagtcctggcatggtaaacccagcttccaggcagatctacttgactttcccagcagatagcactttcagggaggaagatgtttcaaattacttcagcatatatggtccagtccaagacgtgaggatcccataccagcagaagcgaatgtttggttttgttacctttgtttatccagagaccgtgaagcttattctatctaaaggaaaccctcattttgtgtgtgatgcacgagtgcttgttaagccttacaaggagaagggcaaagtcccagacaagaagctgcagcagcagcaggtagatagaggagatttttcaccatgtggtactcctactggattagatgccagagaccaccaatttgatcttcaacttggaggcagaatgttctacaatactcaagacatgctgtggaggaggaagctggaggagcaggctgatttgcagcaagctcttgagctacaaagtaggaggctaatgggtctgcaacttcttgacatcaagaagcatcaccagcgtgcactctgcactggaagcccaattccttcccccacccattctcctaacatgttcaaccaaaatcttgttccttcttttcacatcacttcagaggccccaaaggctgctcttggattgaacttggtgtatttcttgggaatggaatggattggttttgatttatgctatttgattccagagagtggttcaacttctgctccagctggtactgcgtcagtttctactggtcaacagtcagtcaacatttctgttggcaaggaagtgatggtcaatggcgaggatggatatgatgaaggcaatggcaggcagagctctagtcatgacgattgtgatttgcaagaatggtataaaaattgttctcatttagaatacagggcaccagaatatttagagcataatctccctgatagcccttttgcttccccaacaaaagctactggtcctggaggcttcatggctcccttctccaatggacctaatgaggccattgatgcagatgcctcggctgcatctgccaactccaaatttggcactggcacattacttcctgcagcatcggctcttgacatgggaactttcaaatcctttaactgccaaataccaaggttctcttctggtcatggaactattgggatgtttgctggcaccggtggaccgattggcatttag

SEQ ID NO: 8749 - DNA, 1530 bp, Glycine max
  Peptide Sequence Number=SeqID_125527
atggattttctctcatgtggatctggaccatgctgtcaagcagtggatatgaagtggaagttggttggcaaatgtttgaattcacgtcaagcaaggtttcccagtgttggaaatagaagcgggtcagtgagatttcatgacaataaggagctgcaaagagactttgggtctctgagtgctcttgaagggtccaaaagaaccaattgcaaggcttatagtgaaagttatgatggctatgtgattggtggtgaagaggatgtagcagacatttcaggggtagaagaacctgctactaacaacgttgtcattccaggtctgccagatgggtcaaatggtgctccaataagtagttgcttttgggagtggaagcctaaacttaacgtgcactatgagaaggcagggtgtgagaacgtggattccccacatgttctctttcttcctggttttggtgttggctctttccattatgagaagcaactcagagatttggggcgtgacactagagtatgggcactggattttctaggccaagggttgtccttgccttttgaagatccggctcctcactacaataaggaaggggctacatcaaatggaaatgcttcttcatggggcttcggagacgaaacggaaccatgggcaactaagcttgtttactctattgatttatggcaagatcaagttcggtacttcatagaagaggtcatcggtgaaccagtctacattgtgggcaactcattaggaggatatgttgcattgtattctgcggcacgtaaccctcatttagtgaaaggtgtcacactgcttaatgcaactcctttttgggggtttcttccgaatcctattaagaatcctggcctagcaaaatttttaccatgggctggaacatttcccctaccctctaatgtaaagaggctgacagagttggtgtgggagaaaattagtgatcctgcaagtattgctgaggtacttaatcaggtttatgcagagaattcaacaaatgtagatagtgtattttcacgcataattgaaaccacgaggcatcctgcagcggcagcagcatttgcttcaattatgtttgctccccaggcagaattatctttcagcgaagcgttgtctagatgtcagaaaagcaatgtgccaatttgcctaatgtatggaaaagaagatccctgggtgaagccgctttggggactccaggttaaaaggcaggtgcctgaagcttcatattatcaaattagccctgctggtcactgccctcatgatgaagtccctgaggtcataaatttcttgctacgtgggtggatcagaaatctagagtctgagggttctatctcattgccactgcttgatggcctagacaatctgaaacaagccaatgccagggagttagaatttatgaaagaaggttcaaaaaaatcagtgatggtgagatttttcgactccaaattctccctttgggacaggataagatcttatatcaaccctcgattcaagttgagaaattcggcaaccaaatctcagatttag

SEQ ID NO: 8750 - DNA, 1278 bp, Glycine max
  Peptide Sequence Number=SeqID_125528
atggctttgacggaatcgtgtctcctccttccctcgggttcaggaagaaacaagaacagggttccagaagacaaatgggatatggcctacatagtgtatttcaccctgggcctcggttaccttctcccatggaacgctttcatcactgccgttgattacttctcctatctctaccccgatgccagcgttgaccgcatcttcgccgtcgtttacatgttgatcggcctcgtggggatctccctcataatcttctacagccacaagtccaacgcctatgtgaggatcaacgttggcctcgccctcttcgtcgtttctctcctcatcatccccctcctcgacgccttttatctcaagggtagggtcggcttgtatagcggcttctacgtcaccgccgccgccgttggactttccgccgtggccgatgcgttggtgcagggctccattgtgggctgcgccggcgagttgccggagaggtatatgcaagctgtcgtcgccggcactgctggctctggagtgcttgtttctgccctgaggatatttacaaaagctgtttacccgcaagatgcctctggcctgcaaaagagtgcaaatctctacttctctgtatcaattgtgattgtcttcgtatgcatggttttctacaacatggtgcacaaacttcctgtgatgaagtactataaggaacttaaggttgaggcagtcactgcaaatgaagacaatggtcccctgactggagctgtctggaggtcaactgtatggaatattgtgggaagaatcaagtggtatgggtttggcattgtgctcatttatattgtgactctggcaatatttcctggttacattacagaggatgtgcactctcaaattcttaaggattggtatccgattctcctaattgctggctataacgtgtttgatcttgttggcaagtgtctgactgcagtttacctcctacaaaatgcaaaagttgcaataggtggttgcatagcaagattgttgtttttccctctcttcttaggttgcttgcatggtcccaaattcttccggactgagattccagtgacgatactgacttgcctgttagggcttactaatggctacctaaccagtgtattgatgattctgattcctaaaattgtaaaattgcagcatgcagagactgcagggattcttggatttgggtcatctgaccaagcagtttgtcttaatttgggaactttggtacgtgtcttgtggcttcactcaatcagaagtcaaaactgggatgaatttccttaa

SEQ ID NO: 8751 - DNA, 2631 bp, Glycine max
  Peptide Sequence Number=SeqID_125529
atgttgccaactgtgcctgaattggacaatttgcctgaaaataggttttgttatctatgctatgctcttccttcattaaagctgtgttttctggctcttgcttttgcacccagtataatgtactgtgttattgcaatgtcgtggtgtcccaatgatagctcttatttgcttacctgtggcaaagatagccggactatatgctgggacatgatttctggagaggtgattgcctatgaattgccagctgggaccaattggaattttgatgtgcattggtatcccaggatacctggagtaatatcagcatcttcctttgatggaaaaattggcatatataatattaagggttgccgtcaaaatggtatcggggaaaatgattttggtgcagtaccactgagagcaccaaaatggtataaacgtcctactggtgtgtcttttggctttggaggcaaacttgtgtcatttcatcccagggcatctgctgcaggttctccagctggcgcttcagaggtttatgtgcataacttggtcactgaaaatggtctagttagtcgttcatccgagtttgaagctgcaatacagaatggggaaagatctgaggaggaaagagaaacatggggctttttgaaggttatgcttgaagatgatgggactgcacggacaaaacttctctcacatcttggtttcaatgtacctagtgaagcaaaagatacagttaatgatgatctttcccaagaagtaaatgcgcttggacttgaggacacaactgttgacaatgttggacatgtggctactaatgaaaccactattttctctactgataatggggaagatttctttaataatcttcccagtcctaaagctgataccccagtatctacttctgccggcaactttgctgttgtggaaaatgccaatggttcagagaaaatccaagatgatgtggaagtggaggagagcagtgatccttcatttgacgacagtgttcagcatgctttagttgttggggactacaagggggcagttatgcaatgcatttctgcaaataaatgggctgatgcattagttattgctcatgttgggaatgcttccttgtgggaaagtacacgggatcaataccttaaaatggtccgatcaccatacttgaagattgtatcagcaatggtgagcaatgatctcttgagcttagtgaacaccaggccactgaagttttggaaagaaacccttgcgcttctttgtagttttgctcagagagatgaatggactatgctttgtgacacacttgcttcaaaactcatgggggctggcaatacattagctgcaactctgtgttatatatgtgctggaaatattgataaaactgttgaaatttggtcaaggagcctgtcaaatgagaccgagggaaaatcttatgttgaccttcttcaggatttaatggaaaagactattgttcttgccttggcaactgggcagaagcggtttagtgcttctctgtgcaagcttgttgagaaatatgctgaaattttagcaagtcaagggctgttgactacagcgatggagtatttaaaacttttgggttctgaagaactgtcgcctgaacttacaatcttaaaggatcgaattgcactttctacagaacctgagaaagacttcaaaactactgcttttgaaagttctcaatcacatagtgggtcctattatggtgccgataattccaattataatagtaattattatcaggagccagtaaccactcaagtgcagcatggtgtttctggaattcaatatcctgatagctatcaacagccatttgatcctagatatggaagaggctatggtgctcctactccaccccagcaacctcaacagcctaatttgtttgttccaccacagactactcaggttgtgcaaactccccagccgactttctcaaatactgctgttgcaccaccacctttgagaacttttgatcctcaaactcctcccatgcttagaaatgtggagcaatatcagcagcctacattgggatctcaattgtataatacaaccaatccaccttaccagcctacaccccctgttccatcacaagtggccttgagtcatggccagaacttgtcacaagttgtggcacctaccccaaatccaatgggatacatgccagtctctggttctggtggtgtccaaagacctggggtgggatcaatacaacctcccagtccccctcaagtgcaacctgtgcaaccacctgcagctcctcctcctactttgcagactgctgatacttcaaaagtacctgggcatcaaatgcctattgtcacaactttgacaaggcttttcaatgagacatcagacgcccttggaggttcacgtgcaaacccagctaagaggcgggagatagaagacaactcgaagagacttggtgggttgtttgccaagttaaatagtggagacatatcgaaaaatgcttctgacaagctccttcagctttgtcaggcattagacaatggtgattttggtactgccctacaaattcaggttcttcttactactactgagtgggacgaatgccaatcctggttaggttcactcaagcggatgatcaagacaaggcagagcgcgagactaggttaa

SEQ ID NO: 8752 - DNA, 364 bp, Glycine max
  Peptide Sequence Number=SeqID_125530
atggataaaagcttgaaggtaggagaagatgagtggagggagagggagagaggggaacaaaattttgagagagagaagagggagaatgaggcaacgacaagagacggtgttgttgaggatcctcttacggctgtagaggaatttaacgaagagcagcaacaaccacctattgaagaaggtgttactgatgttgagggttttctaggcggacccaatgacatatcaattttgagagattttaaaaatcatgaacttcctgagcttaagctatcttcccatggaaggaagatgactaagttcggcaggcttgctctagagattgaaggccttgtgactgccagcggactaagtcctttgatcgcat

SEQ ID NO: 8753 - DNA, 218 bp, Glycine max
  Peptide Sequence Number=SeqID_125531
tggtctgggacctaaagaagcaaaagccagtgataagctttgcagattcggttagaaggcggtgttctgttttgcagtggaatcctgatgttgccacacaactagtcgttgcatcagatgaagacagctctccttctttgaggctttgggacatgaggaatacaatttcaccaataaaggagtttgtgggacacactagaggtaatgactcctgttaa

SEQ ID NO: 8754 - DNA, 609 bp, Glycine max
  Peptide Sequence Number=SeqID_125532
atggcgtcgttgctgtatttgtcgatcataggggtgttccatagcttcgagcagcttcatgtcgatgatgctgtcgatatgttggtggaattattggaggtcagcactgcagaggcaagagctgagacaattcaatgtcatggctcttatgttcgattatcctggctgcaagacgtgtatcagacgaaaatcgacgcatgtcactggatcgtagcagtgcgagcatatttgttgcatatgcttggatgcactctctttgctaacaagagtaccacacacgtgcacgtggtattcttgaatgcactgcgtgacttgatgcagagtgggacttacgcttggggcgctgctgcacttgtgcatatgtatgataatttaaatgagtgttggatctatgagcttttcccgtctgttggttccgccatagctgccgaggattatgacgagcggatatcgggtgcatgtcgatggacctctggcaaggcattacctgtgtcgatgtatcataggcatttgaacaaactggcccttgatgttgcacagccaggggatcctcctagaatttcgtcgattcagcaatatgacacatttgttgaacctgatgtgccttag

SEQ ID NO: 8755 - DNA, 636 bp, Glycine max
  Peptide Sequence Number=SeqID_125533
atggcttcatgtagcgcacctccctccctgatgctggtccaccctcaagacctctctcgctctcagagaaccacattctctctctatcctctcctttttaagccctccaaatgcctccacatagagcccaaatccaggacttgccatgccctcgtcgccgctttggctgcagaggtccaagtgcctctaactgtccacgacacggaggaggacgacggttctgatggctccaccgccacctccgccgccaccaccaccaccaccaccaccaagcctaagaaaggcaaggccgcgttgcctcttaagagggacaggacgagatctaagaggttcttggaaattcaacaattgagggagcgtaagaaagagtatgacttgaagacagcaatatctttggttaaagaaacagctaaaaccaagtttgtagaaacagtagaagcccatttccgcctcaacattgaccctaaatataacgatcaacaattaagagcaacagtaaatcttcctaagggaaccggaaaacccgttaaagtggctgttcttactcaaggtaaggtattgatatacatgaatttatgtggcactgcacagataggaagtcatatcattctggattctgaatttttaagcaactaa

SEQ ID NO: 8756 - DNA, 1578 bp, Glycine max
  Peptide Sequence Number=SeqID_125534
atgggcaaagcaagtagtacttgtgctcttctatcccttctcattctttcactctttgtggctgaaatctatggaaatagacaagttcaagctcttaacaaactgcacaagtccaccaagttcagaggaaattcacaaattgataggagtgagtttgaggtagaggagcttgtttatgatgacattgctcactctcaagagggtctcaaagagaaagatagaattgagagtcttccaggacaaccccctgtgagtttttctcagtatggagggtatgtcactgtggataaagtggctggtcgtgccttctattattactttgttgaagctcaacgttcaaaacaaacacttccacttcttctttggctcaatggagagaatggttcgatcttagttctttctgctgatcataaaccagtggcttccgtgatagcaggtcctggatgttcatctcttggctatggagcaatgcaagaacttggaccttttcgagtaaacagtgatggcaaaacactacacagaaatatattttcttggaacaaagttgcaaatgttttattcttggagtcacctgctggagtaggattttcctattcaaacaaatcaaaagattatgataacaatggagataagaaaacagccgcagacaattatttattcttggtgaattggttggagagatatccagaatataaggacagagatttctatattgctggggaaagctatgctgggcattatgtgcctcaacttgcacataccattctctatcataacaaaaaggcaaataagaaaatcatcaacctcaaaggaatcttgattgggaatgcagtgatcaacgaggaaactgactcggacggactgtatgattatcttgctagccatgcaatcatctcagacaaagcagcttatctcaacaaagcttgtcaatcatcatcatcaaagattcaggaaagtgtgtgcgatgcagccggagatgaagttggggacgatattgaatacattgatttatacaatatttatgctccactatgcaagaatgcaaatctcacatccctgccaaaaaggaactcaattgtgactgatccatgtagtgagtattatgtgtatgcatatcttaatagaaaagatgttcaagaggctctccatgccaatgtaaccaacctcaaacatgactgggaaccctgtagcgatgtcataacaaagtgggttgatcaagcttcaacagttcttccacttttacatgaattcctcaacaatagcctcagggtttggattttcagtggtgacacggatggaagggtgcctattacatcaaccaagtattcagttaagaagatgaaccttcccattaaaactgcttggcacccttggttttcctatggagagcataataaagcatttggtgtgacacaggttggtggctatgtagaaatatacaagggaggcctaagattagctacggtgagggaagcagggcatcaagtgccaagttatcaaccagccagagccctaactttgataaaatatttcttagacggcactcctcttcctggtcctcccaaaagaaaggactag

SEQ ID NO: 8757 - DNA, 1644 bp, Glycine max
  Peptide Sequence Number=SeqID_125535
atggcttctcagtgtcaattggattcattattgcagaaatgcacctctctgattcgcatgaagcagcttcaagcccatctcataaccaccggtaaattccaattccacccttcccgcaccaagttcctcgagctctgctccatctcccccgccggcgacctctccttcgccgcccaaattttccggctaatcgaaactccctccaccaacgactggaacgccgttctccgaggcctggcccaaagcccagaacccacgcaggccctgtcatggtaccgcgccatgtcacgcggtccccaaaaggtggacgctttgacatgctccttcgccctcaagggctgcgcgcgcgcattggctttctccgaagccacccagatacattctcagcttcttcgttttgggttcgaagttgatatcttgttgctgaccactttgctggacgtgtacgccaaaaccggtgatcttgacgctgcacagaaggtgtttgataatatgtgcaagcgagacattgcttcgtggaatgccatgatttctgggttggctcaaggaagccgccccaatgaggctatagctttgttcaacagaatgaaggatgagggatggaggcctaatgaagtaactgttcttggtgcactctctgcttgttcgcaattgggtgctttgaaacacggccagattattcatgcctatgttgtggacgagaagctagacaccaatgtgattgtttgtaatgcggttattgatatgtatgcgaaatgcgggtttgttgataaagcttattcggtgtttgttagcatgagctgcaacaagagtcttatcacgtggaatactatgatcatggcgtttgcaatgaatggtgatgggtgtaaggcactcgagtttttagatcagatggctttagatggagtgaatccggatgcagtgtcgtatcttgctgcattgtgtgcgtgcaaccacgctggcttggtggaagatggggttaggataagagaagcatgtgatattataaactcaatgcctatggtgcctgatgtggtgctctggcagagtttgcttggggcttgtaagactcatgggaatgtggaaatggctgagaaggcatcaaggaagctggtggagatgggatctaacagttgtggggattttgtcttgttatcgaatgtttatgcagcacaacagagatggcatgatgtggggagagtgagggaggccatgaaaattagggatgtgaggaaggtgccgggatttagttatacaacagagattgatggtaagatacacaagtttgtgaatggtgatcagagtcatccgaattccaaagagatttatgcaaaactggatgagatcaagttcagggcaagagcctatggatatgcagcagagactaatcttgtgttgcatgatataggagaggaggacaaggaaaatgtgcttaattatcacagtgagaagttggccgtagcatatggagctggtgaactagcaactgtagtatacttgttccaaatcatcacactgcttggtatagagatagatttgtgtttgtccaaagtcagacacgaactggatgacccaggcatcatggcatttttgctcgatccacttaagctcatgacaacacaacaacactcttctcattactga

SEQ ID NO: 8758 - DNA, 375 bp, Glycine max
  Peptide Sequence Number=SeqID_125536
atgacgcagaaggcgaatcttttcaagggtaaagcaaagaagaaatcaatacctcccaatcgtcatgggaaagtccctgttactcgtaaaggaaagagattcgtgaagccatccaaggttacaaaggatatggatactgatcgtgaggtgagcaaattcattaaccactgcaatgagatcaaagcagcgactctagcaacgaaggatggtgggcaactaggcatcattaagccgccacaagagccagcaattgtcatagttgattgttcgatttctgaagtaactgaggaagctctattttatcaattcaacaaaagtgattatgtcaacttccgtttcacctattacatgatgctaggcttatatacacgttaa

SEQ ID NO: 8759 - DNA, 2052 bp, Glycine max
  Peptide Sequence Number=SeqID_125537
atgccttcttctcacattcttttctccctcctctctttcctctccatcataatcactaccttctcttcatccacacccaacaccatcactctccatctctctcccttattcaccaaccacccctcttcaagttcacacccattccacaccctcaaactcgccgtctcaacatccatcacaagagcccaccaccttaaaaaccacaaaccaaacaagtcactcgaaaccccagttcaccccaaaacctacggaggctactcaatagacctcgaattcggaaccccgtcacaaaccttcccctttgttctcgacaccggtagcaccctcgtctggctcccgtgctcctctcactacctctgctccaaatgcaactccttctcaaacacgccaaagttcatccctaaaaactcgtcttcttcaaagttcgttggctgcaccaaccctaaatgcgcctgggtcttcggcccagacgttaaatcccattgctgcaggcaagacaaagctgcttttaataattgttcccaaacatgccctgcctacaccgtccagtacggcctcggctccaccgcgggttttctcttatccgaaaatctcaactttcccaccaaaaaatactccgattttctcctcggctgctccgtcgtctccgtctaccagccggccggaatcgcggggttcggtcggggagaagagtcgctgccgtcgcagatgaacctcacgagattctcttactgcttactctctcaccagttcgacgattccgcaacaataaccagcaacctcgtcttggaaaccgcttcctcacgcgacggaaaaaccaacggcgtcagctacacgccgtttctgaaaaaccctaccacgaagaaaaaccccgcgttcggcgcgtactattacatcactcttaaaaggatcgtagtaggagaaaagcgcgtgagggttccgaggaggctgttggagcccaacgtcgacggcgatggtgggttcatcgttgactccgggtcaacgttcacgttcatggagagaccgattttcgatctggtggcgcaggagtttgcaaagcaggtgagttacacgcgcgcgagggaggctgagaagcaatttgggttgagtccgtgttttgtgttggcgggtggtgctgaaacggcgtcgtttcccgagctgaggtttgagttcaggggtggcgcgaagatgaggctgccggtggcgaattatttctcgctggtggggaaaggtgacgtggcgtgcttgacgattgtgtctgatgacgtggcgggttctggtgggacggtgggacccgctgtgatattggggaattatcagcagcagaatttttatgtggagtatgacttggagaacgagagtaaagaagtagatgatgaaccaaatgttgatgatagggattatgatgatgataatggtaacggttatgttgaagaattagcaattggaagactaaaattctttcatttccggctctgcaaaagttttttatggggggatacaactgatgaaaggagggctcattggatttgttgggaaagaatatgttctccaaaggagattggagatttgggattacgacaagcttgtcatgttaatgatgcttttatgatgaaagtggcttgggagctttgttctaaaaatgatgctttgtatcaaatttctgtttgggataaatttgtaactgggtgtgaaggaaatgtggaagatgatgagttgatttggagagatagcgataaaggtgtgttagatatcccatcagcttacaggatgattgctaatttagatggtagacagattattcctatctttaatctgatgactttgaagtttttgtgtccattgtctaaaaaggagccagaaccaatgatgcattgtcttcgagactgtgaggagcttggagacgaattgtacaaagctggtggttataatcaccatcacacggaagcctctatgttgcgttggaggccacctaatcttggttttgtgtgcctgaatgttggtggagcttggactgtccatggccccaaagctgcgtgtggagggtgttag

SEQ ID NO: 8760 - DNA, 351 bp, Glycine max
  Peptide Sequence Number=SeqID_125538
atgcagaagcaggaggtatccttagatttctacacaaaggtgctgggatttgttctgattgagaggccccaagctttggactttgagggtgcatggttgttcaactatggagttggtatccacttggtgcagtccaagcaagaagatcagaatttgccttcggatactgaacacttggatccccaggacaaccatatatcttttcagcgtgaatctggaagcaatggagaaaaagttgaaggagaaggatctgaagtacatgaaaaggactctggagggagaagatggatcaaattttcttcgatgacccagatgggttcatggtggaaatatgctactgcgagaatatga

SEQ ID NO: 8761 - DNA, 2067 bp, Glycine max
  Peptide Sequence Number=SeqID_125539
atggaggctttgctgcaattcgcaccgatgcagagctccgttgatgagggtttctggcaccgtttgtcttctttgaagctcaacaagcttggcattgaccattctccaattcccttattcggtttttatgcaccgtgctctcactctcaagtatcaaatcatttaactgttttagctgagtctttaccttctgaattgagtgaggcatcattaatccctgaacccagccgcggcaaccggaacaggtgttctgttccagggatactttacaacactaatactgtggaaagcttccatgcacttgataagagtgacctgttgaagaaagaggcagcaaagatatgggatgacattctaactggaaaagctgtggaggactgttcagtactttcaacattccttgttatttcttttgctgacttgaaaaagtggactttcaactactggtttgctttcccggctctgatgcttgatcctcctgccactgtggttaatctaaagccagcttctcagtggttcagcgcagcagaggctgaatcactctctgcagcttgtaacgagtggcgtagctcaaaatcaaaaacagtcactatagatccaaactcacgtgctactgttaggcttctgaaggactgggaagcatgtcagagcaatgctcacaaggtctcttactttactttaactctgatcctttttggattttatgacccatgtcatctaccaaataatcctggatggcctcttcgcaacttcttagcacttatttctgcgaggtggaatctcaactctgttcaatttttctgctacagagagaaccgtggttttgcagatatgaggttgtcccttgttggtgaagcactgataacagttccacaagggtggaaagacactgtgcctagtgcagttggatgggaacttaataaggggagaaaagctcctaggtgtataagccttgcgcagtccatggatccaaccaggttggccatatctgctgcagatttgaatttaaagctgatgaggtggcgtgctttgccttctttaaacttgaatgccttatcttccatgaagtgtcttctcctcggagctggaacacttggatgccaggttgcgcgcatgcttatggcatggggtgttcgaaaaattactctagttgacaatggaagggtggctatgtctaacccattgaggcagtctctttatactttggatgactgtcttaatggtggggaatttaaagctacggcagcagttgaaagtcttaaacggatatttccagcagtggaagcagaaggcattgttatggctataccaatgcctggacatccagtacaaagccaggaacaggacagtgtgcttgatgattgtaaacgtttgtgtgatttaattgatgctcatgattccgtttttttattgactgatacaagggaaagtcgatggctcccaacacttctctgtgccaatactaacaagattactgttactgctgcactggggtttgatagtttcttggttatgcgccatggagctggtcctttatctgcggatatgccagtaaataatgcaaatggaaaacatagattgggctgttatttctgcaatgatgtcgtggcaccaaccgattcaacatccaaccgcactttggaccagcaatgtactgtgacccgaccagggctagctcctattgcttcagcccttgcagttgaacttttagtagggattttgcatcatcctcaagggatatttgccgaaggtgatattaacaacagtgtcactggagctactgagcaacctcttggtattttgcctcatcagattcgtggttccctttctcaattttctcaaatgacccttataggttactcctcctccagctgcacagcctgtagtcatacagttgtatcagaatatcgaaaccaaggaatggagttcatacttcaagcaattaattatcctaccttcctagaggatgtcactggactgacagagttgatgaaatcggccacctcgttgtcattggattgggacaaggagatagacgaggaggaggactgtgttgaaattcaataa

SEQ ID NO: 8762 - DNA, 512 bp, Glycine max
  Peptide Sequence Number=SeqID_125540
gcgaaaaattcgatgaagcaaaaaatgccggagctgatttggtgggtggagaggatctgatagaacagataaaagcagggttcatggagtttgataaactaattgcttctccagatatgatgcctaagatatatcgtcctgataacttttctgttgctagcctagggaagattctgggaccaagaggactgatgccaaacccaaaagctggcactgtaacaccaaatattccccaggctatagcagaattcaagcagggaaaagttgaatacagggcagacaaaactggaatcgtgcacttaccttttggaaaagctgactttccagaagaggatcttcttgtaaacttgcttgctgcagtaaaatcagtagaggctaacaaaccttcaggtgctaaaggtgtgtactggaaaagtgctcacatatgctcggccatgggaccttcaatcaggtatttcactcttcaaccgcctgtgttcattgtactcaatacaattgctatggccgagtaa

SEQ ID NO: 8763 - DNA, 1356 bp, Glycine max
  Peptide Sequence Number=SeqID_125541
atgtctgagtcccacaatggtgcttctcacactcaccttgatgatgtcaaacgcttcgtggcaaattgcgttgactgccaggtcaccaagtacgaaactcagaaggtggctggcctcctttgcccgttaccggtgccgtctcgaccctgggaggacctatctttagatttcatcattgggttaccggcgtatcagggacacactacgattcttgtcatagtggatcgcttttctaaaggtgttcatttgggtaccctgccgacggcccacacagctcacatggtggccaccctgttcatcaacaatgtcgtgatgcttcatggaatccccaggagtctcgtttctgaccgcgatcctttattcgtaagcaagttttggcgcgaattgttcaaagctagtggcacacaactcagaatgagttcagcttaccattcacagagtgatggccaaactgaagctctgaaccgtgtcattgagcaatatttacgcgcattcgtccatcgccggccgggattatgggggaaactcttaccttgggttgaatggtcccataacagctcttggaacgcgagtactggtagcacaccttatgaaataaccttcggcagaaaacctttcacttttccggcctacattacgggatcatccaatctcgacgccgtggaccagatgatggtagaccgtgatgagacttttcagctcattcgcaggaagctcctcaaggcccaggcaacaatgaagaagcacgcagacgtccaccgtcgtgaggtcacctacaaggagggtgattgggtccttttgaagctcaaaccacatcgacaatcaactgtgaaagggtctccaaacactactggcaagttgaccaagcgattttttgggcctttccaggttctgcaacgcattggtccagttgcatacaagctgcaattacaagagacctcacagatacatcctgtgtttcattgctccatgatgaagccatttcgcggacctcctgatcaactgcccaagctagagttacctacagattctgatgaagactcctcagtggtgtttccattggccatcctcgattaccgacgtgcctcccaggatgcaccgtggcaagtacttgtgcaatggcgtggtctctctcctgatgatacttcgtgggaggattggccgaccttatgtagcacgtaccaccttgaggacaaggtggtctttcaaggggtgaaggatgttacgaatccagaatcagagaacacatcaacaaaagcagagcatgagggtaacatagcgaaacaggaggtgcaggtagaagtcaggcccaaaaggagaattgttaagccttctcacctgaatgactacgtctga

SEQ ID NO: 8764 - DNA, 996 bp, Glycine max
  Peptide Sequence Number=SeqID_125542
atgggctgctctcaggatgctaatttttataagggttctttgtgctgtcagctaattctatttttcatctggcttcctactttccaagatgtgacagcacgggaaatacatgctgaccacagaagaatttcttctctgctagagttagctaaggaacctccttctggagaatctgctctctttgaccccatagaaatatcacctgctgtattaccgaaattcccatatcccactgagtcttggccaccaatgtaccctactttcccaactagatatgaaccagttttaactggaaaatgccctgtaaacttttctcactcagatatatcaagtatcctagataaaacagcatctgattgctctggacctttggcagcccttgttgggaatgtaatatgttgtcctcagtttagtagcttgatccacatcttccagggtttcttcagcatgaaatctgatcatttggttttgccaaatgcagttgctgatcattgtttttctgatatcattagtattctagccagtagaggggcaaatagtacaatccccacactttgttccataaaatcatctaattttacaggcgggtcatgtcctgtgaaggatgattctacttttgaaaaaacagttaacacaagtaagttacttgaggcttgcagcactgttgatccacttaaagagtgttgtaggcctgtttgccaacctgcgataatggatgcagcactacagatttctggaagacaaatgatgattaacaatgatgaaaatatggctggggaagtaaatcacactgactatcttaacgattgtaaaagtgtggtttattcatatctttccaaaaaactatcatttgaggctgcaaatactgcattccgaatactatctgcttgcaaagtcaacaaaggtatattgtttaactgtttcattcttaatgtaatatattttaagtttagagaggttgtcagtggcatggccaatcatctcattcgtgaataa

SEQ ID NO: 8765 - DNA, 393 bp, Glycine max
  Peptide Sequence Number=SeqID_125543
atgttgcgtggaggtggagtgatgacaaatatttatgagctttgtgacgttgatttgaaagatttcagcatacaaggctgtttacttcgaagcttgcctggtgatgtgatatttgacaattcatcaggctttagctttacatgtgatttgagtgataacattgctgcaccctggccttcttcatcatcttcatttgcatctatgtcactctgtgcacctgagatgtcattacctgctctcccaacttcttctcagacattaaaaaataatggttgtacttctgatggagtgggattgcttgtgcttattttttcatctttcatcttcagtacactgttacaagcagatgctagattagccgctaaagtttactatggcagcaacagagactga

SEQ ID NO: 8766 - DNA, 252 bp, Glycine max
  Peptide Sequence Number=SeqID_125544
atgagttacatatctttcaaaaagaaggggaaaaaagttattgtcctttccaacctgaagccaagaaatatgcgtggtgtcaagtcctgtggaatgctgatggctgcttctgatgcaaaacatgaaaatgttgaacttctgttccctcccgaggaagcaactcctggtgaaagaatttggtttggaacggaagatgaaaaggataatcaacctgatgctgccactccgaatcaggcaatcgctcttccttaa

SEQ ID NO: 8767 - DNA, 1245 bp, Glycine max
  Peptide Sequence Number=SeqID_125545
atgcattgggaaagagttgggttatctagggaaggtgtgggaaggcgggaaagagaggaattcaatatttttgtgagtgatatggagcttgaagacattgctatagtgggtagaagattcacatggtatagaccgaatgagagggctaaaagtaaaactaatcgggtccttttacctagggagtggcttaacacttggctgaaaaacaagcaacatattcttaataggaggatcttaggtcattgtgcagtcttgttgaaggatgattccattgattgggggccaaaacctttcaaaacccttgattgttggctagaagataggaggtttggtgcatttgtcaaagaaacttggggggtggagatccaaggttacggtgcatatgtcctaaaagaaaaactaaaattgttgaagttgaaggcgtggaataaaaatcaatttggtaatatccaaaagagacaaaagctcattgaggaggagatgaattgtcttgataagaaggaggaagaggacaagttttggacaagttggctgatgatgaaaaggctaagcgcattgaactacaagagaaactatgggtggttatgggcgataaattggaggagaaagaaatattcgttgaaggggttaagggtgaaggaaccagtgggagttaaagaaaaggtgaagagatttttctgtgagaaatatagtgaggacatgaggaaattaaggaggcgatttaggattgtgttctatgagcatggtgtgcttcctagaaggtcaaactcctcattcatctctctcattccaaaggtagagaatttgttgcacttaagggagtttagaccgatttctatagtgggggtaatgtacaagatcccagctaaaagattagctaaattattgcctaagattattgatgagaggaaaaacacattccttagagggagatttttgctacatagtgcccttgtagcaaatgaggtaatagaagaagttaaaagaaagaatagtacatgcttgatttttaaagtagattgtgagaaggcctatgactcggtgaattgggagtttctagtttatatgttgaggaggttggggttttgtcataaatgggtgatgtggattagagaatgtctagctacaagctttgtctcaagtcttgtaaatggtagtccaactagtgaagtgaagttagagaaggatcttagacaaggagatcctttagcccaatttctcactactattaaggccatgggctaa

SEQ ID NO: 8768 - DNA, 705 bp, Glycine max
  Peptide Sequence Number=SeqID_125546
atgaactgtaacattaatattccaatgataccgactaccaagtatggcatagaatgtttattttgcaatttgtgcagctcaacatcaataacaggattgaacaataatgagtatcagataacaagagcaaaggctgactttatgaagatgcctttcccggacaataattttgatgcagtatatgcaattgaagccacctgtcatgcaccagatgtttatgcatgctacaaagagatctttagagtgttaaagcctggccaactttttgcggcatatgaatggtgcatgactgaagctttcgatcccaacaatgaagaacaccaaaagataaaggaagaaattgaggttggtgatggacttcctgacattagattgaccacaaagtgtgttgaagctctaaagcaagcaggttttgaggtaatctgggagaaagatcttgcagttaattctccagttccttggtactttcatttggatgcaagtcacttctcacttagtacctttcctctaacatctattggacgatttttcacaagaagtctgataagggctttagaatttgttcgactagctccaaggggaagtctaaaagttcaagaaatcttacaaagggcagcagatggactacttgaaggtggaaagaaagagattttcacaccaatgtacttctttttggctcgaaagcctaattttggtggtcaataa

SEQ ID NO: 8769 - DNA, 897 bp, Glycine max
  Peptide Sequence Number=SeqID_125547
atgaatttggcatcaggtgttggtggaaagattgaaaaatctcaaattttgtccgcagttgagaagtatgagaagtatcatgtttgtcatggaggccaagaggaagagagaaaagctaattacactgatatggttaataaatactatgatctttctactagcttttatgagtttggctgggggcaatctttccattttgcccacagatggaaaggggaatctcttcaagaaagcattaaaagacatgagcacttccttgctttacaacttggcctaaagcctggacaaaaggtcctggatgttggatgtggaattggggggccactaagagaaatttctcgattcagctcaacatcagttacaggattgaacaacaatgagtatcagataacaagaggagaggcgctcaatcgcattgctggagtggacaagacttgcaactttgtcaaggctgacttcatgaaaatgccattccaagacaatagttttgacgcagtgtatgcaattgaagccacctgtcatgcaccagatgcttatggatgctacaaagagatctttagagtgttgaagcctggccaatattttgctgcatatgaatggtgcatgactgatgctttcgatcccaacaacgaagagcaccaaaggataaaggcagaaattgagattggtgatggactccctgacattagattgaccacaaagtgtgctgaagctctaaagcaagcaggttttgaggtcaagggtctagaatatgttggatttgctccaaagggaagtctaagggttcaagaattcctagaaaaggctgcagatggactagttgaaggaggaaagaaagagattttcacaccaatgtatttctttttggctcggaagcctgaatcaagtgactactaa

SEQ ID NO: 8770 - DNA, 160 bp, Glycine max
  Peptide Sequence Number=SeqID_125548
tcccaggcgccagatagaggcagcaactgcatcaagagttcaagagcatgaagcacgtgatgttgctccaatgaagttggcaggcaagaaactctttgcggtgatgcagcttttcacgtttggatacagttggcgccttaggattatgctgcctcactga

SEQ ID NO: 8771 - DNA, 546 bp, Glycine max
  Peptide Sequence Number=SeqID_125549
atgagatggactaagaataatggatgtataatagtatcatgtttgaagaagttgatatgtattgaaaatgagaaagatgctggcgtgaaaatagaacacgttgattgctttgatgcctttaatacttctcagttgtttgctacccgtgataaagttttgtgttgggctcgatcggtggctcatgaaattggatttgttgccgtgataatgaggtcagacacaaatattggtgttagaggaagagcctcatttctgttaatagcttgtgaaaggagtggtgagtataggcctaagaagaatgatttggttagaacatgcactagcagtagaaaatgtgaatgcccgtttaagttacgtgcaaaggcaattttgggaggagaaggatggatggaaatgaagggtggaggttgcacaacagctcgcctaggcgagctcaggttgcccaggcgagctggttacttcagccctaagctttctggtggcctaggcgagccagaggctagcttgggcgagccagaggctagcttgggcgagccaggggcatga

SEQ ID NO: 8772 - DNA, 501 bp, Glycine max
  Peptide Sequence Number=SeqID_125550
atggcatttttgggagaaacaagcagtcagaccattgtcaactctagattagcttttatttttccaaatggatcaattattcacaatgaatctggtgtttatttccaaagttccactccaatacccattagagtacctaatgattatggttttgaaacactaaaaagcaaaatacacgatacccttcaactaacgaacgatcaatatttggatgaaatttactaccgacagtcattcgtggatataggtaaccaatttgccttttggtctatgcaattgaaaaatgatgatgatgttaatacaataacaccggatgatatattaaacttacttcaagccactatgactcctactcatgatgcactgttatattacaacgggaggtggaacatgtcatgccaagatgactttgtgggttactcattcacaggaaaaaatccaaaaagatttaacattccttcagaatgtagcatcgatggactcaaggatgtgatcaagcaa

SEQ ID NO: 8773 - DNA, 210 bp, Glycine max
  Peptide Sequence Number=SeqID_125551
atgaacattgtgtttggaatgaaatccaatctgagccttgatgcttgggacaaacccatgctggaaggccaagagaagaccagattttgttacaaatcagatgctttgaatgagactccgacacagattcgtccaagttattgctataataactgtgcccaattggagagattgttatattgctttctggaatccgggctgggtgattaa

SEQ ID NO: 8774 - DNA, 249 bp, Glycine max
  Peptide Sequence Number=SeqID_125552
atgggtatcagatggagcaatagtcagagagctccatcaagacctggaggccctcttgatggtgcgaatggtcgccctggcagatgtggggaggacggtgggcgcggtggccatggtgaagatagcatacttgaaaaaggaaaaaaagacccgtgcaacaaccatgaacatgaaacatcagaaaggagggatgtaaaaggtccagctggtttacaatggtgcagagataaccatgaaatcatcaattga

SEQ ID NO: 8775 - DNA, 993 bp, Glycine max
  Peptide Sequence Number=SeqID_125553
atgtcagagacattcatattcacactttctctggttatgctatgtgctgcttcagcttttgcagcagttccacacaggttgcccgaagtttacctcaagaatggtaactttgaggagaagccaaaccccaaatacctcaagaaaacgagactgattgggaaatatgctcttccaaaatgggagatcagtggtcatgttgagtatatctcaggggggccacaacctgggggagcctcaaggacttgtgctcaagatgagcttttaaggatctcagtgcctccacaatctggagatgttcctttgcggaccctttacagcctcaatggagatgttattgcttggggattccggccaacttcttctgttgccaaagtgatactccacaaccctggaattcaagaagaccctgcctgtggcccactcttggatgccgttgctatcgcagagttctgctctccaaagcctgcaagagctaatttcgttaaaaatccggggtttgaggagggtccattccctattttcaactctacaaacggtgttctgcttcctcccgaacaagaagatcatgtgtctccactccctggttggatgattgaatccctcaaagccgtgaagttcatagatgcaaagcatttcgatgtcccatttggacagggagcagtagagcttattggcggcagggaaagtgtcattgcccaaattctcagaacagttcccaacaaagtttataacatgaagttgacaattggagacgccagaaacggttgtcatggatcaatgatggttgaagcatttgtagcaaaagataccctcaaagttcccttcaaatctgagggaaagggtaaattcaagaccgtgagtttcaagttcagagcgattgaaaacagaacaagaatcacattctatagctctttctaccatacaagaattcatgactacggatctctttgtggccctgttattgatcaagttatagtgtatcctgtcgcctga

SEQ ID NO: 8776 - DNA, 1602 bp, Glycine max
  Peptide Sequence Number=SeqID_125554
atggcaggaggaggagctgcaccacaacccaagcaagatgagcatcaaccacatccagtgaaagatcaattaccaaatgtttctttctgcattacaagtcctcctccttggccggaggcgatcctacttggtttccaacattacctggtgatgcttggcacaactgttctaattcccagctctcttgttccccagatgggaggaggaaatgaagagaaagcaaaagtgattcagactctactgtttgtggctggcataaacacatttttccaaacattctttgggactcgtttgcctgcagttattgggggatcctacacctttgtgccaacaaccatttcaatcgttctggctggtcgctacagtgatgttgtgaatcctcaggagaaatttgagaggataatgcgtggaacacagggtgcccttattgttgcctcaaccctccaaattgttcttggcttcagtggcctttggcgcaatgtagtgaggttcttaagtcctctctctgctgttcccttagttgctctgtcaggctttgggctatatgaacttggttttcctgtgcttgcaaaatgtgtcgagattggactgccagaaatcatcatcctagtagtattttcacagtacattcctcatatgatgaaaggagaaaggccaatctttgatcgctttgcggttatattctcagtagcaattgtgtggatttatgctcatcttcttacagttggtggagcttacagaaattcagcacctaaaacccaaattacttgcagaactgatcgtgctggaattatagggggtgcaccttggataagaatcccttatccttttcaatggggagctcctacatttgaagctggagaagctttcgctatgatggcagcttcatttgttgctctagtagagtcaactggtgctttcattgctgtgtcaaggtatgcaagtgcaacacctattccaccttcagttcttagccgtggtgttggttggcagggagtgggagttttgttgtcagggatatttggaacagggaatggatcatcagtttctgtagagaacgcaggactattagctttaacacgtgtgggaagtagaagagttgttcaaatatcagctggattcatgatctttttttcaattcttggaaaatttggagctgtttttgcttcaattccagctccaatagttgcagctttatattgtcttttctttgcctatgtaggttcagcaggtctcagtttccttcagttttgcaatttaaacagcttcacaactaaattcatcttaggcttctctattttcatgggcttctccataccacaatacttcaatgagtacacagcatttaaaggctacggtcctgtacacacacgagccagatggttcaatgacatgatcaatgtgccatttcaatctgaagcatttgttgctggtatgttggcacttctcttggacgttacgttgcgcaagaaagacaaccaaacccggaaagatagaggcatgcattggtgggacagatttcgttcattcaagacagataccaggagtgaagagttttactctctaccttttaatctaaacaagtttttcccttctgtgtga

SEQ ID NO: 8777 - DNA, 348 bp, Glycine max
  Peptide Sequence Number=SeqID_125555
atgggcgagggagagctagcaaattcacacgcagtagtgattgatcttcaatgtgttgtaatcctccactttcctacacccctctttgtcgtcgggtgtggcaaaagcaataacgtgacgccgagggtgggtgcccatatggacaaagatcgaaatttcgatgctctcatagctgaaacgcaagttagagtgaagggtctaatcggaaatagcgtggtcgtgccagcagaggagcatggctatgcagcgtccgaagatgtagaagcgcgtcttctgctgctttgcaaccagatagcatcgttttcgaaggcttgttttccggcaagattgggagagagccatgcttag

SEQ ID NO: 8778 - DNA, 237 bp, Glycine max
  Peptide Sequence Number=SeqID_125556
atgtggaagaatgatgaaaacagtggcaatgggaagaaactgaaggcaccctcaaagaaaaataaaatgaacagaacaagtccaagggagacaacttgtcagcaacgtaatgcaatgcagctggtgttgggaaggtttcttggcccaagacccacaccacatggaggccaagaaaacgtgaaaaaggagtgtgaagatgttgaagaaaaggaaaaggagagagccagctcttcctaa

SEQ ID NO: 8779 - DNA, 513 bp, Glycine max
  Peptide Sequence Number=SeqID_125557
atgatgtttaacagagtcccagatggcaactctttgtcttcttggtgtggatggcatactgaccacggttcactgacaggtctgacttgcagtatgtttacgagagatggtgtagaaattgcttgccctgatagtgctgctggcctctatattcgaacaagaaataatcaaattgtcaaagttgtctatggaaaagatgatatagcatatcaaattggtgaaaccactgaaatactttctggaggttatctttgtgcaacacctcattgtgttcaggctcctaagggggaggagtcctctggtattgagcgctcgacatttgcgttattcatgcagcctgactgggatgaaaagctcaattttcccgaggaagttcacattcataaagagatgatacggcccgaacctgctgcctccttggtattaaaagagcttattccatcaaatgctgcccttacttttggagagtattcagagatgctgctcgacaaatattaccaccaaaaacagtaa

SEQ ID NO: 8780 - DNA, 180 bp, Glycine max
  Peptide Sequence Number=SeqID_125558
atgggaatgagaatgaaactgttattccgagggcaccgcggaatagaaggctctccgcctctaagtgttccctttctcattcagagacagcctcacactttaacactctcccgccaagtaaccttttccgtcatgcaattattacctctttcaaactttgaatttcaattcttaacttaa

SEQ ID NO: 8781 - DNA, 438 bp, Glycine max
  Peptide Sequence Number=SeqID_125559
atgaggccaagaatgacaataaattttgactgccgttgtgccatcataggcaaaacaacatttggtcaaatatcactggccaagactggaaaacatcgcaaacgcaacattcaaaggctcaaccaaaccaaaccaaactcaaacaaaatcttcaagaaactaagcactaagctccaagaaaccacacatccagatctcagtgaaaatcagaaattctcattgctgaaattggagttaaaaaagcctacgaagagtcagagaactaaaacctcagactgctctggcaatgtcagaatcaggagtttgagaagggcgagagagagaaaatttgcagtgaaactcggcagaagggaattttccttgcacgttagaagccaacactctgattccaggtggggaaacatgatagagcgcaaagaagaaaattcagagaaatga

SEQ ID NO: 8782 - DNA, 201 bp, Glycine max
  Peptide Sequence Number=SeqID_125560
atgaaaaagatgttcaaatcatggaaatgcgtctccaaggtgagttggatcttgatggttcaccgaggccaaggcatgcttgatgcaatcctacccccaaggacattggataaaagactccaagaaaattgggccaaagatgtaagagaagaccttaggattctcgtgaaccttagggtagatttcgaacccatgggctaa

SEQ ID NO: 8783 - DNA, 2685 bp, Glycine max
  Peptide Sequence Number=SeqID_125561
atgagcgtgatttcacgaaacatatggccggtttgcggaagcctctgctgtttctgccctgcgttgcgagagcgatccagacatccaattaagcgttacaagaaattgctcgccgatattttccctcgcacaccggatgaagaaccaaatgagcgtatgatcagtaagttatgcgaatatgcctccaagaatcctctccgcgtccctaaggcatattcgagtcttgtggatgaaaaaaacatgattgggagggaagaccccactaaaggtggtcagttagatttcccggtgaagattaatcatcagcaaagccagcctttgtttgcaagtagcttgcttagcatcatacagattcttcttgatcaaccacggcaggacgaagtgcagattttaggttgccaaactctgtttgactttgtgaacaatcagagggatggtacttatatgttcaatttagatgggttcattttaaaactttgcaatctagctcaagaaatgggagatgatgccaaagtacaacttttgcgggctgctggccttcaagtcctttcatccatggtttggttcatgggtgaattcactcatatctcagctgaattcgacaatgttgtttcagttgttttggaaaactacggggatgtcaaacaagattctcaaaatgagaatgcaatgaggctttattcttggagagtggtagtgaatgacagaggagaagttaacgtgcctgtggataatgccacgaaccctggattttggtcacgggtttgcatacaaaatatggcaaagttagccaaggagggaacaacagtacgacgtgttctggaatccttgttccgctattttgatgataccaatcgctggtctccagaacatggccttgctctttctgttctgcttaacatgcagtctataatcgaaaattctggacataatacacatttgttactatccattttagtcaagcaccttgatcacaagaatgtcttaaagaatcctaaaatgcagcttgacattgttggtgttattacccatcttgctcaacaaacaaggtctcaacaatctgtggctataattggtcctgttattgataccatggctgtgttgttggaaaacatgtctaatattactgttatggccagaaccttgattgctgcagcattccctgaggcattatttcatcagttactcctggcaatggtccatgcagaccatgaaaccagggtgggtgcacaccgcatattttctgttgttcttgtgccatcttcagtttgtccacaaccttcctcttcaggaacccccatgacaaaggcagctggtattcaaagaatgctctcacgaaatgtctctgtgttttcttcttcatctgcactctttgagaaattggagagaaagcaaaattccttgtcagaagatagtcatacagatggaaatgttaatgataactccattttgaacagattgaagtcaacttatagtcgtactactagtacaagaaaatctgctatgatcagtgctgaatctacagataacaagaactcaaaggttcataattcttctatgatgaatagattgaagtctagttacagccgtgctactagtgcaaagaagccacaaatacccacaaccgtggaagaaaatactacaaatacttcaaataaacaacaggtattacccattaggctgagtagtcatcagattaaccttttgctatcatcaatctgggcccagtctatctatcctctaaacacatctgaaaattttgaagcaattgctcatacctacagccttgtcttgctagttgctcggagtaaggttgatccattcctgcaactggttaatgatagcaagttacaagcggttattgatacagataggcagccaagtaaagtttatggatcaaaagaggatgatgaagatgctttaaaggcactttcagcaataaggttaactgagaaccagtctaaagaatcatttgctaccatgatagtgcagagtctgggaaaatcatctaatgaatcatccatcttaagagaacagcttctgaatgatttttcacctgatgatgcctgtcctttgggagcccagttatctgctgagacaacaggaaatatgtaccagtctggactaaaagaagataaacttcctgatatggttgatatctcattatttactattgacgatgacattccaccttgtggtttggagagccaagctaattctgatccacagcaacagccttcacaaaatctaagcctgctgagtgttgatgacattttgggttcagtttcggagacaacacatcaagtaggacggatttctatttcaacaccgtttgacatgccttacaaggaaatggctctccattgtgaggccctcctcatgggaaagcagcagaagatgtccactttcatgggtacccatccaatgcagggatatttttcatttaggattcctgctcctgaatacaaccagcaaaaggacgagtcctcaaattccagtgttcaacagactttaccttcgagtggaaatccgtttttggattcaaacttcgactcgaattcataccacacattgcctgacacttctccaaggctttgtgcaacagcataccagcatcaggctgccttctttcaactgccagcatcacgcccgtatgataatttcttgaaagcagccggatgttga

SEQ ID NO: 8784 - DNA, 627 bp, Glycine max
  Peptide Sequence Number=SeqID_125562
atggagggtgggaacaacagcagcagtaacaacaaccctgaggagttggcggtggggtgcttgctttcgatcaggacaacgttgggcgacgaattcgaaggccaggtcgtcaccttcgatcgcccctccaacattctcgtactccaggagccttccaaacctagccctcgtcgaaatcttaggttgctcaaagccaattacatcaaagacttcacctttctcggccatgcccaagaccctcttgatcccaacacctgcttccttgacctcaccgctctccaacaaagggaagatgttgctgttagacaagcggaggctgatgctgagaggattggggttggtgttaccagcgaggcacagagcatctttgatgctttgtccaaaacgcttccagtccgctgggacaagacagtcatagttgtgatgaatgaggtgcgtgtcagcagtccttatcactctgaatctgttgttggaggtactcctgctgcaaatgaccgggtgaagaaagtgttgtggtcacagttgaggttgcatttgcattttgatcagaaaaactgcaagaaattgagggcaaatcttgactttgagaggaagaggttgcaacttcgcagttctggtggtcagtaa

SEQ ID NO: 8785 - DNA, 915 bp, Glycine max
  Peptide Sequence Number=SeqID_125563
atggtggttgcatgcaatggtgcacatttcctactaaagcattattcacaacctcgcgttgcttctgacataatggtaggactaattatggggaacataccttttttacgtgaactatatgaagaattcaacaagacctttggatttatcattgattttggcatgatgtgttacatgtttgctttgggtatagagatggatccttacatgctcttcaagagaccaacaaaggatgctcaagttgcttatgcagcaatattgtgcactttcatcatatgctgttccatgacaccactcttccgttacttcacacaccaacatggattagcattcaccctctccctctctgctcttgtctccagcacggcgtctcccgttctcacgcgtctaataaccagcctcaaaataggaaaatcagacattggaagccttgtcataggtgccgggatgcactcggatttcctctgctcattgcttctttcagttggctacattttcatgccatcggatgcttattgcattggcactaaaaaagacaagactctgctgaccatcatcacagtgagcattgtaattgtagcacagacgatgttcacagcggtggtttcgccagtatttatggcatgggtgaacaatgaaaaccctgaagggaaacccatgaaaggatcacacctgatactgtcaattgccttcgtggtaatgatttgtgcctcctcaactctatacgactatagtccggttctaagtgcgtttatgacagggatatgtttacccagggagggtagagtttccaaatgggttgtcagcaaaatcaactctctcttgacaaccatcttctttcccgtcttcttcttgtggatggggtatgtggctgatatcaccaaattcgaccctggagaccctacacgtggctaa

SEQ ID NO: 8786 - DNA, 2673 bp, Glycine max
  Peptide Sequence Number=SeqID_125564
atgcagcattcacaaccacaaattcaacaaccggttcagaagtatcctgttcctcaatctcaagttcatgcacaactgcaacctaatgctccaattcaacatcactctcagctccccgtgcctcctcaccagcctgtgactcctaatgtccagactccagtgcaaaatgcaatgtcgcattcagtgacagggcatcactcttatccccaacctctgcctcacccaaatatgcaacccagagtccctcaacatactatgcacatgcatcctcaaagtgggcatcaaccccaggcccaacatcctgtccagatgcagaatcagtttcctccacaaattccaacagcacgtcctaatcaatctcatgctatgtttcctaaccagcaacagccagctttgttgccttcttcagttcagggccaaactacccctcctttgcaacaacagtcactatatacccataatcaacaacctgggcaaatcaaccaacgtcctactttgccacctgttcaacaaatacctcagcagccgtttgcacaacaccaaatgcctatgccatctcatttacaaccacaaggtccagcacattcatttccaaagcatgcatatccacaggcacagggaaatactgcaggaaggcctttagttcccaattatgccggacacctacagccatttgcacaatctgccaataccattccagttagacctgggcaaaatggtgctggctacctgcctgaaaatcagaaattgttggttggggccaataatcaagtacagttgccttctgaattgcagtctagggcaccagaatcaattgaaagacaaggtaatgttgttgagcaacaaactgactctgcctctgggaaacttggtaaagtttttaaagatttggacaatgtgtctggatcatcaaatgaattgaaatctgaaaaagttgaagcagatttgcaaccaacagaggttggaaataagcaaaatagtgaagatccagactctctgaagacttcagtcccaaataccaatgcagtagaaaatggtgattctgtgaataagaatcttgggatggcggaggctgctgaaagcaattggaagccttcaagtggtgcaacgcctggggttcaaaatgatagtaatgagcattctgtccaaggcaatgaatttcaagatggacatctgccaaagatagagacgaaactccctttgtcagaaactgataaattgcataatgatgacaatcctgaaccatctgtctctcaaagcaatggcggttttgctaagctgtctcactcagccgctttcactgatcagagtaagcatcagcaaccaataattaattatggccctccttctgtccagcagagatcttctgcaatgttagcatcgcaattgccacatccaacagttccaaatcagccactctcttcagtgcactcttcaacccttattaggaatcatggaactgcccctgctcttcattcaggacagctcttaaccgagaattttccaccaaccatgcttaagcaaccacaagattctggcattcagtttaataatccagggcgaagcttgcaacctcagtctcttggacccccaccaccatttaaccaagtacatgggcctcctttccatgctggagcatctaatttgtctcgtcttggagggcctcaacttggtgccccacttcctggagatatgcatggtcgaatgactgccaacttaccaccacatgctcctgaaggttttggtttgcaggatgaaaggttcaaacctttgcatgctctaaatcaacaaaatattgagagaagagagtttgatgatgatcttaagaaattctctaggctgcctttgaattccgagccagtttctaaatttggaaattattcattaggcactcatgaagctggaaagagaccagttggtattcatgatgatgtcattaagaaatcaggttctgctcttcatcctggttattttggaccaggtcctggatatgcgagacatcatatggatggtatagctccaagaagtcctgttagtgaatatgctgagatgtcctcccggagattggggctgcactctggcagtcttgttggtaagtcaggtatagatgattttgatgacagagttgcacgtcgttttggtgaattccgtgatagtcggtttcctcatttgcccagccatttgcgtagagatgattttgatggttttggtaactttcgaatgggtgaatatccaaggagtggtgattttgttggtcaagatgaatttgctggccattttcggaggggtgaacatttgggtccacataacttccccagacatttgcagcatggggagcctattggttttggtgcccaccctggtcatatgagagcagttgaacttgatggttttcgtagttttgaatctttcagcaaaggtggccgaccaggtcatccgcaacttggtgagcctgggttcagaagcagcttttcacttactggatttcctaatgatgctggatttttaacaggagatatcaggtcgtttgataatttgaggagaaagaaggcttctagcatgggttggtgccggatatgtaaagttgactgtgaaacagtagaagaaccctcaatggatgagggaaacaagacacacaatactggtattgagggtcgtggaaataagcattga

SEQ ID NO: 8787 - DNA, 2502 bp, Glycine max
  Peptide Sequence Number=SeqID_125565
atgggtacggagacagtttggaattcccaaagcaactggaacactgtttggggttcaatccgcgactgcatcaccttccaatccgatgatgatgatgattctgaatccacccccactcctttccttcttcactccccttctccagattccccaccttgcgagatcaaaattacttttgcggagaaacacgagctcagacaaatctacgttcgaagcacggctcgcgtctacgagatttactatgcgcccaattcccgcaccaacaacgactatctctctacagtccgttgcggctttgctgttagagacgatcaggttcttcgtttcccttctattcaaaatctgagcgacgataacattaataagtctgaagatgattgggttgaagtcaaagttcctgattctccttcgcaaaccaagccctaccccaattccgccaaaacctctgtgtcccaggatctttatgaggctacagcagagattaatgatgcaaatccttgcatttctgttactcttcgtctgctctcgcttcagagcaaaggccgtgtttatgttgatgagatttatgtgtttgctgatcctgttgagtcagctgattcagaaagccatattgaaaactcatccagcagttccctcatggctatgtttctaccttcaatgcaattatctaagacaacagagctcagcaatctaaatgctcttagaaaggaaaaccaacattttccgggggatggtttggaagtaactctcccaagtgattctgtaattaaaactcagctgaaaggaaacactagcataactgatcctcaagaagtgaagttgaatgaggtaaaaggaggttgggtgggtccatcccagccagatgcactctcagaagatgctagaatagagagcaatcatgctgcagtaccctcacaaactgataaaatggacaacactttcagtgttgtaccctcaaaaattgccgaaatggagaacaacgatactgctcttccctttcaatttgctaaaaccaaatgtaattgtagtgctattccgtcacaaggttctattcctgagagcaatcatggtgattgtttgggtgacaatgttgaaagggccctggaacagcttctatcacgcatggacaggatagaagaaatctgtcttggctttcaagagaaaatggtaatgcccatgagcagcattgaggcaagacttcagcaagtcgagcagcaactggatactctgactaagaaatttcagacttctgctttgccatcttgtcctagaatttctgctcttgatgcttcttgtattgaatcagatgccaactcttgtgaaaattgtcctgattatactgtcaccagggaaaatgaatcagatgagaaaaatttacacacagaggtaccatatgtctctgctctcatgtctgattcagaaaatactactcaattgctcccaggtcttgtagttacagctcctgagtttcttgatggtgaggatgaagaaggtgatgcatcaggacaagaaacaaactcttcgaaagataaaggaaagcagtcaactgatgatgctatatgttctgctttagctaattttttgttttctttttctctagagtctccagagtataccaaacgtttaagtgttaaagcccctgagttttcaaatgaagatgatgatgaccatgagagtaatagtgagatagcaaaaaatgacccagttcatctcacagagagtgaggaatttagtcacatccaagtgttggcttcatcctatactttggaaaatagtgagaagatagacccagattctaatgataaattctcgaaaaagactgcccaagaatctgaagaaaatgaccagctttacagtgcagaaggagatcaagatgaggcgtgtgtgaacactggttgtattgacagctttgaagaagacaaaagtggaaaaatcaatgatcagaaaagtgacatttcagatgagttgctcgacaatcagacccccttgggtcatagtatcaccgaggaaggaccatctgcaggaactgaacttactgttgcagcagaggtccctagaaaaacattccatgagaacatcatagagaatgttcttggatttgcacttgcttcctctgttgtagattttgaaaacccaatattggatgtgaaattcatttctcagagaagtagtaccgagcgtttccttgaagaccttctagtgggaacacaagatcaaaagaccagttcaagcgatcaatctctcaaggaaagcaatgatgatctttctgttaaggaacaactgaaaagcaatggtgatgtctcagttgaggagcagtctaatttgatttcaatagaagatggggaactggtgattccagctagcgatagccattttgctgtggacaaagacttgtgtacttcttcgataactgcatctgtgaacaatgaagttgataatctgccgctgccggaggatcataaacgaaaacgtgatcaaataactgggtcaagtttcatatga

SEQ ID NO: 8788 - DNA, 183 bp, Glycine max
  Peptide Sequence Number=SeqID_125566
atgatagtggacattattgaagatgtcaatccaagacatcttaggcctctaattgctgaggaggatgtgaacaaggcacaagatgagttcaaaaataaggaaaaagaagtgtgtaaggcaccacttccagcaatggaagataagccaaaggaagatgccacaaaggtgatggacaacccctga

SEQ ID NO: 8789 - DNA, 291 bp, Glycine max
  Peptide Sequence Number=SeqID_125567
atggatgatgttcatgttgatgatgtcattgtgatgatgctatttcctgatgaatggtcacgttacattttagagttgagtcagcaacgaggcgggtcattacatgtcttggagagggttaatgacaatgcttacaaaattgatttaccaggacaaatgcttcccaagaaggagggaatgatgaagacattgaagctcaagatcggcacaaggactagatggaccaatgactggagccagagccagaaaggaagaggacacccgacaacaagttgtaacaacaattgttga

SEQ ID NO: 8790 - DNA, 676 bp, Glycine max
  Peptide Sequence Number=SeqID_125568
atgactataagcacacaacatcaggccattaaggctataccaacagatgccatagttcatcttcctcacccatgggatccctcgcaagaagttgaacctccaaagagtgaatttcaaaagaaggtgcatttgtggatgcctatcacaaaactattgccagtgcatccaactgatcataatctaacccaagaaaaatgcttatctcttggcaaccttcatgctcagatgtatgcaagagatcagcctactacttaccctccttgtctgcacatctcaagggccactaatgtcaagatagttgttgacaaggtgtgtccatgtctccctgtttgggatgctgctaaaaacaaaggctttaggaagttaggaccttctagaaccaactcctatggacggacactcagaaagcgtccacttctggttatgatggaagggataatgttgagcattgtgaaatcactcaagtgttacatacagttaagaagtatcactttgatgatgcttgcgtctactttacaaagcatgttgacaactacttgtctaagaagcatgccaaaagaggatgttgtcgttgttgctatgaaagaagatgttgcctccgcccaagatgaagtatatgctaaagttatggatgacaccattgtacgtggggtcatcattgatcttaccaacactg

SEQ ID NO: 8791 - DNA, 2835 bp, Glycine max
  Peptide Sequence Number=SeqID_125569
atgaccaaccatgcatgttattcctgcctccttgcaaggttggtgcttttcttggctctttttcaaggcacttctgcccaaacacaagctcaggctcttctcaggtggaaacagagtctccctgcccaatccattttggactcatgggtcatcaactccactgctacaactctaactccatgctcatggcgaggtatcacttgtgattctcaaggcactgtcactataataaacttggcttacactgggcttgcaggtacccttctaaacttgaacttgtctgttttccctaaccttctccgtcttgatctcaaagaaaacaatctcactggccacataccacaaaacattggggtgctctcaaagctccaattccttgatctttccaccaactttctcaatggcactctgcctctttccattgccaatctgactcaagtttttgagcttgatctttcaagaaatgatataacagggatattagatcctcggttatttcctgatgaatctgataggccccaaagtggcctcattggtatcagaaatctcctcttccaggacaccctgctaggtggtagaattccaaatgaaatagggaacataagaaacttgactctgctagctctagatgcaaacaacttctttgggcctattccttcatctttaggtaactgcacacatttaagcattcttagaatgtctcaaaaccaactctctggcccaatacccccaagtattggtaacttaaccaatctaaccgatgtgcgctttcaaattaacaacttaaatggtacggtgccacgagaattgggaaacttgtcatcattgattgtgttgcatcttgctgagaacaaccttgttggtgaattaccaccacaagtgtgcaaaagtggcagacttgtaaattttagtgcagcatacaatagtttcacaggcccaataccaagaagccttagaaactgcccagcattgtacagagttcgacttgaatacaaccggctgacaggttatgcagatcaggattttggagtttatcctaatctcacttacatggacttcagctataatagggtggaaggtgacctctctgcaaattggggtgcttgcaaaaacttgcaatatctcaacatggctgggaatggagtaagtggcaacattccaggtgagatttttcagttggaccaactgcgggagcttgacctatcctccaaccaaatatcaggagagattcctcctcagatagtaaattcctctaacttgtatgaattaagtttgagtgacaacaaactctctggtatggtaccagcggatattggaaagctttccaatttgcggtccttagacatctccatgaacatgctgttgggaccaatccccgatcagataggggacatctacaacttgcagaatttaaatatgagcaacaataacttcaatggcacaatcccctaccaagttggaaaccttgcatctttacaagattttttggacttaagttacaattcactttcaggacaaattccttctgatcttgggaagctttcaaatttgataagcttgaatatctctcacaacaacctgtcaggttctatccctgactcccttagtgaaatggtgagtttgtcagccatcaacctctcctacaataatttggagggtccagttcctgaaggtggcgtattcaattcttctcatcccctggatttgagcaacaacaaagatttatgcgggaatattcaaggtttgcgtccatgtaatgtttctctcactaaacctaatggtggatcaagtaacaaaaagaaggttctgatcccaattgctgcttccttgggaggtgctctttttatttctatgttgtgtgttgggattgttttcttttgctacaagagaaagtcaagaactcgaagacagaaaagttcaattaaaagaccaaatccattttcaatttggtactttaatgggagagttgtgtatggagacataatcgaagctaccaagaactttgacaaccagtattgcattggggaaggagcgttgggaaaagtttataaagcagagatgaaaggaggtcaaatatttgctgttaaaaagttgaagtgtgatgaagaaaatttagacgttgaaagtataaaaacctttaagaatgaggtagaagccatgtctgaaacacgacaccgaaacattgttaagctttacggattttgctctgaagggatgcacacatttttaatttacgagtacatggatagagggaacttaactgacatgctgagagatgacaaggatgcattagaactagattggcctaagagggttgacattgtcaaaggtgtagccaatgctttgtcctatatgcatcatgattgtgctccgcctttaattcatagagacatatcaagcaagaacgttttactgtcctccaatcttgaagctcatgtctcagattttggaactgcaaggtttctgaagcctgattcgcctatttggacatcatttgccggcacatatggctatgctgctccagaacttgcttatacaatggcagtgaccgagaaatgtgatgtgttcagctatggtgtttttgctttcgaggttcttacgggaaagcaccctggtgaacttgtttcctacatacaaacttctactgaacagaaaataaacttcaaagagattttagaccctcgcctcccgcctcctgtcaagagccctattttgaaggaattggcattgattgccaacctagcactttcgtgtctgcaaactaaccctcaatctcgaccaactatgagaaacatagctcagctccttgcaatggatactgcagatatgagatga

SEQ ID NO: 8792 - DNA, 216 bp, Glycine max
  Peptide Sequence Number=SeqID_125570
atgtcgatggaaggacataaaaagaagttggctgaagatgtaactttgaaggtcttggtaggaaaagtttttgaagaaattattttggaatctctaaagactttgtttactaagaaggtgcagaggaaagctgcagaagaggctaccatgttcgatgttgatggtgagctaatgcctgatgaagtcactgctcaaactaacaaggagaaggcttag

SEQ ID NO: 8793 - DNA, 288 bp, Glycine max
  Peptide Sequence Number=SeqID_125571
atggttcctaatggtccgaaggcaagcaaaggcggctcgtggcgatcaccggtggtcaatcgtgatggaggaggaggttgggggaggggcattacaactggcgtcatggacgaaactcctaaggtatccaatgtagccatagctgaggaagttgaacacaatgctatagaaacttcatctaagttgtcaacaacttcaaataaggctacttctagagacaagggagaacttgatgtcgtcatcgtctactccaccaattcaagccctactcctctgaactatgcataa

SEQ ID NO: 8794 - DNA, 312 bp, Glycine max
  Peptide Sequence Number=SeqID_125572
atgtcatcttcttgtatggtttccttcctttcaagatggttctctatcttggcctttcttctagactcagctagtgattctttggttgccttagccaaggcaacaacttctttcttgcttatgggaggagaggttggtttgggtgctagttatggtggaaggaccatggagggtgaagggattggatatcaagcaagtagtttagaatctgtgtgtgaccatgtgggagctggggtagaatacattagtgaattatggatgagcaagagagatgaacagagaattgtgaagttacagtggatccaaacctaa

SEQ ID NO: 8795 - DNA, 1251 bp, Glycine max
  Peptide Sequence Number=SeqID_125573
atgtatcgaggggttcccgttgcatgcaggacgcgtagcaagcggggaagggtggttggaagtggtttaataatgggccagaagaagaaaaaggtgcatgaccatgaacctgtgtctttgaagcgtgtaagggtatctgaacgaggttttgattgttcgggagggcatgctggtgaccctattgtaatcggtgacagtggtgatgatgtcagtgaggctgaagaggggttgaggcatactgagaagaggtttctggtagaaaaggaatggaagagcgaggagggtaaaaggtgttctgtatttgttgataaagttgataactttggcaatgatgactatgcttgcgtacctgaaaaccgggtaattttgccggatgattcatatggggataatcagagtgagaaggaacattgcgcggataaaagtggttcagatgattcttttttgtgtttaacggagagtgaggatggcgccaccagtgatgaagattttcaggttgattatgatgagaatgattgctgctcgagcagtgaggacagtgattcttcttcttatgatgatgatgagagagggggatacagcaagacggtgaaggagagggtgagaaaggtggagggtgaaactgaaagtagtggagtttgcaaaagaaaaggtggaaggaaagataatgaagagggggagcaatggattggtgctgactgtgctagtgcaacctctagtaaatctgagatttataagcaggaagcaaggaatgcagcacagaaacatgaatcaaagagagtcaaaagtgccaatgttgatgcagaagtctttggtgatcactggaaaagttcaggttgctctatgccttctgaagctgaagcactagagcataggaagaaaagagatacaggtcatcaaagtgcgtcattgcagaaaaaaacagaatattcaactatgatcaagaagaatcttgatgaccatgaaggaaaaaagcatcatcacgtcaaaggagattcagctaaagttgtgacaaaaaaagacaggaagggaagaaagcataaatatgggtttaatagcaataaatgtgagaaggtacgggtggtggatgatgaaactggtgacaaagatgagctgcatgaagtcctaaggatgccatctagaacaaaaaaccgatgttttaaattatttaatgaatgcttttggggcaagaatgattctgttaaagatgattccaatcagttggaagaaaaggatgatgattttggttag

SEQ ID NO: 8796 - DNA, 2955 bp, Glycine max
  Peptide Sequence Number=SeqID_125574
atgcatatatgccatagatactttgaaagtgatagaaacgatggatatggtatttatatctttgaagtgaacaaatgtaactactgccaaacaaataagcagtttctgaacattaaaatgaacaatcatacatgttatgcctgctttgctattccagctacgttgctgctcgttttgatggttctttttcaaggaactgttgcccaaacacaagctcagacacttctcaggtggaaacaaagtctccctcaccaatccattttggactcatggatcatcaactccactgcaacaactctaagtccatgttcatggcgaggtattacctgtgattctaaaggcacagtgacaattataaacttggcttacactggacttgcaggtacccttctaaacttgaacctgtctgttttccctaaccttctccgtcttgatctcaaagaaaacaatctcactggccacataccacaaaacattggggtgctctcaaagctccaattccttgatctttccaccaactttctcaatggcactctgcctctttccattgccaatctgactcaagtttttgagcttgatctttcaagaaataatataacagggacattagatcctcggttatttcctgatggatctgataggccccaaagtggcctcattggtatcagaaatctcctcttccaggacaccctgctaggtggtagaattccaaatgaaatagggaacataagaaacttgactctgctagctctagatggaaacaacttctttgggcctattccttcatctctaggcaactgcacacatttaagcattcttagaatgtctgaaaaccaactctcaggcccaatacccccaagtattgctaaattaaccaatctaaccgatgtgcggcttttcaaaaactacttaaatggtacggtgccacaagaatttggaaacttttcttccttgattgtgctgcatcttgcagagaacaactttgttggtgaattgccaccacaagtgtgcaaaagtggcaaacttgtaaattttagtgcagcctacaatagtttcactggcccaattccaataagccttagaaactgcccagccttgtacagagttcgacttgaatacaaccagttgacaggttatgcagatcaagattttggagtgtatccaaacctcacttacatggacttgagctataacagggtggaaggtgacctctctacaaattggggtgcctgcaaaaacttgcaagttctcaacatggcagggaatgaaataagtggttacattccaggtgagatttttcagttggaccaactgcataagcttgacctatcgtccaaccaaatatcaggagacattccttcacagataggaaattccttcaacttgtatgaattaaatttaagcgacaacaaactctctggaattataccagcagaaattggaaacctttccaatttgcactccttagacttgtccatgaacaagctgttaggaccaattccaaatcagataggggacatctcggacttgcagaatttaaatctgagcaacaatgacttgaatggcacaattccctaccaaattggaaaccttcgtgatttacaatactttttggacttgagttacaattcactttcaggagaaatacctactgatcttggaaagctttcaaatttgataagcttgaatatgtctcacaacaatctgtcaggttctatccctcactcccttagtgaaatgtttagtttgtcaactatcaacctctcctacaataatttggagggtatggttcctaaaagtggcatattcaactcttcttatcccttggatttgagcaacaacaaagatctatgtgggcaaattcggggcttgaaaccttgtaatctcactaatcctaatggtggatccagtgaacgaaacaaggttgtgatccctattgttgcttccttgggaggtgctctttttatttctttggggttacttgggattgttttcttttgcttcaagagaaaatcaagagctccaaggcaaataagttcattcaaaagtccgaatccattttcaatttggtacttcaatgggaaagttgtgtatagagacataattgaagctaccaagaactttgacaacaagtattgcattggggaaggagcactgggaatagtttataaagcggagatgtcaggaggtcaagtatttgctgtaaaaaagttgaagtgtgattcaaacaacttaaacattgagagtataaaatcctttgagaatgagatagaagccatgacaaaaacacgccatcgaaacattatcaagctttacggattttgctgtgaagggatgcacacatttttaatttatgagtatatgaatagagggaatttagctgacatgctgagagacgacaaagatgcattagagctggattggcacaagagaattcatattatcaaaggtgtaacgagcgctttgtcctatatgcatcatgattgtgctccacctttaattcacagagacgtatcaagcaagaacattttgctgtcctccaatcttcaagcccatgtctcggattttggaactgcaagatttctaaagcctgattcggctatttggacatcatttgccggcacatatggctatgctgctccagaacttgcttacacaatggaagtgactgagaaatgtgacgtgttcagctttggcgttttggccttagaggttcttacgggaaagcaccctggtgaccttgtttcatccattcaaacttgtactgaacaaaaagtaaacttgaaggagattttagaccctcgcctctcgcctcctgccaagaaccatattttgaaggaagtggatttgattgccaacgtagctctttcatgtttaaagacaaaccctcaatctcgaccaactatgcaaagcatagctcaactgcttgaaatggagattgcagacatcatataa

SEQ ID NO: 8797 - DNA, 137 bp, Glycine max
  Peptide Sequence Number=SeqID_125575
cttcagatgaaatgggtccaagatggagagtagtcctaattggcagagaacaacctccatgtaagagtaagaggggaataagagtgattttcaggaacaagctaggagatgctccacgttgccacaattatctgtga

SEQ ID NO: 8798 - DNA, 2196 bp, Glycine max
  Peptide Sequence Number=SeqID_125576
atgaagaaagaacctattgaaaatttggagtttgagaaggagttagatatcttgtggggtgaaatggatatgttgcttcgaggtgaagaaattgggtctcaggttgataatattggaacaaatgaagcaagagaaaatgaagaaaattcagcgtcgcagtgcaagcatgatactatttttaatgaggaaattgggatatactgcagatggtgtggttggattgccactgaaatcaaatatatcactccaccatttgtggattctgaaagatgttgcagaagggtgtcatctggtggagggaacacctcacagtttgatggggatctgtttaatgatcctggtgatgactcagaggcagtttggtctcacaatgaaggcacagtttgggaccttattcctgacataaaacaaagcttgtatcctcatcaacaagaagggtttgagtttatttggacaaatttggcaggaaccactgaccttgccaaattgaagagggttgacccatgtagtgaaggtgggtgcattgtttctcatgctcctggaacaggaaagacaaggttgaccatggtttttcttcagacatatttgcaatcgtttccaaagtgtctacctattatcattgctcctgccaacatattgcttacatgggaagatgagttaaggaagtggaacataggaattccattccataacttgaacaattctgaattatcgggaaaagagaaactcattaatgaagttgactggtctggcaatcaaaagcagaataaggatgccatacgtatggtgaagttgtgttcatggtacaaagagaagagcattctattaatcagctacaatttgtatgagaagttagcaggatccacggctgaaggtgatgggaaaaaagagaagaaaaataataagatgaaaaaaaagaagaaacgtgcaaggccaagggagtacattgaaagtggaatgggaaaggttctgcgtgactatcctggtttgctagtacttgatgaagggcacactcctcggaatcagaatagttatatttggaaggttctttctgaaagtagaactaagaagcgaatccttctttcggggacacctttccaaaacaattttttggaactttacaatattttgtgcttaatgaaaccatcctttcctgacagcataccacaagaactcaagaagttttgccaaagtagacaaatgcaggaaaggaaagatgtgagctgggattgggaacctgtttcgtctggaaatacagctgatgagaaaataaaactgctaaaattgctgatgaatccctttgttcatgttcacaaaggtagcattcttcaaaagaaccttcctgggttgagagattgtgtgctggttttgaagccagacattttgcagcaagaaactctagagagcattgaatattctcaaagtgcactgaactttgaacacaagttggccttggtctctgtccatccatcccttttcctcaactgctctctgtcaaaaaaagaagaatctgttgttgacaagggtaagttggaaaagcttagattgaacccttatggaggggtcaaaaccaaatttctgtttgagtttataagactatgtgatgcagttaatgagaaagtcctcattttcagccaattcattgataccttatgcttaattaaggaccaacttgagtcagccttcaattggtctgtggggacagaagtgctgtatatgtatggaaagcttgaccataagcaaaaacagtccctcattcgtagtttcaatgattcaaatagccaagcaaaggtgctgcttgcttctataaaagcatcttctgaaggcattaacttaattggagcttcaagggttgtgcttcttgatgttgtttggaatccctcagtggaaaggcaagctatttgtcgagcatatagacttggacaaaagagggttgttttcacatatcatcttcttgcacagggcacccctgaatgcacaaaatattgtaaacaagcagaaaagaaccggttatctgaacttgttttctcaaatagaaatgctgaaagtcataagctcaagagtagtggagtaatgcttgaggatattgaggatagagttcttgatctcatggttcagcataaaaaactcaaggatatgtttggtgaatgtctggttcaaccaaaggagagatatttggagactttgggcccttga

SEQ ID NO: 8799 - DNA, 300 bp, Glycine max
  Peptide Sequence Number=SeqID_125577
atggctactccacccagcgttcctcctcctcctcctactaatgtagcatcacagtcatcgtctaccttgaaatggacaagaaaagccacacgactaagatcattggcgactagaccagctagggcagagagacaggtcgatgtgacatacgagaattggaagcaagtccctactgctcagaaggatttgatatgggaggatattcagagatccttcgtgggaggtatctacgttgtaatcatgagtttcatcaatgttgaatttttgcaggatgtgcgaaaaaaggcacaggccatctag

SEQ ID NO: 8800 - DNA, 828 bp, Glycine max
  Peptide Sequence Number=SeqID_125578
atgggttataggcattttgacacagcaaaaatatatggttctgagccagcactgggcaaagctttaaatgaagcaatctgcgaggaagaagtagagagagaagacattttcttaacatccaaactgtgggggagtgatcaccataatcctgtttctgcattgaaacagactcttgagaatctgggcatggagtacctagacatgtacctagttcattggcctgtcaagttgaagccatgggttaactaccctgtacctaatgaagatgactttgaaaagttggaccttgagaccacatgggcagggatggagaaatgcctagaaatggggttgtgtaggtgcattggggttagcaatttctctagcaagaagattgagtgcctattggattatgcttctacacctccagctgtaaatcaggtggaaatgcatcccatgtggaggcaaggaaggctgagaaagacatgtggggaccacaaaatccatgtaagtgcttattcaccacttggtgggccagggaatgcatggggatctacagctgtggttaatcaccctataatcagatcgattgccttcaaacacaaagcaactccagcacaggttgcattgaaatggggactatcaaagggctctagtgtgattgtgaaaagcttcaatcaagaaagaatgaaggaaaatataggatcgtttgatctgaaattggataacgaagatatattggagattgagaaattggaggaaatgaagattatgaggggagaatttcacgttaatgaaaccacaagtccctacagaacaatccaagaactttgggatgatgaaatttga

SEQ ID NO: 8801 - DNA, 1044 bp, Glycine max
  Peptide Sequence Number=SeqID_125579
caaccgcgtcatttcatgcacctcgattcaaactctttccctaattggtgcttcttcgaggacaacatgctccccgtcgaagtcatcgacaacggcctcacctccctcgccagcggctgccctaatttgcgccgcctccacgtcatcggcaccaccgagatcggcctgctcaccgtcgccgaggagtgctccactctgcaggaactcgaattgcagcgctgcagcgacaatgttctgcgcgggatcgccgcgtgtgggaatctgcagattctgaaactcgttgggcacgttgatgggttctacgattcggtggtgtctgatattgggttgactattcttgctcaggggtgcaagaggctcgtcaagttggagcttagtggctgtgaggggagctttgatgggattaaggctattgggaagtgttgccaaatgttggaggagttgaccttctctgatcataggatggatgacgggtggctcgccgcaatttcgtactgcgagaatttgaagactttgaggtttcagtcttgtaagaagatcgatcccaatccgggtatggaggagtatttgggttgttgccccgcgctcgaacggttgcatttgcagaaatgtcagttgcgggataggaagagtgtcgtggctttgttttcggtgtgcagggctgttagggaaattgttattcaggactgctggggattggataatagcatgttcagtcttgcaatgatttgctggcgggtaaagttgttatacttagaagggtgctcattgctaacaacagaaggtttggagtctgtgattcattcgtggaaggatcttcagagccttagagtagtgtcatgtaagaatataaaggacaatgagatctctcctgcgcttgcaaccttgttcaccactctcaaggaattgagatggagcccagataccaaatcacttcttccatccagtgttaaggggataaccatgggaaagaaaggtggtgtacttgaagaaaccatgctaccgttatctgtgggccagttatggcactttaagatgctttga

SEQ ID NO: 8802 - DNA, 1659 bp, Glycine max
  Peptide Sequence Number=SeqID_125580
atgaagagggagaaggagaaggagaagggcgtggctgtgacaagccctgtgagtggcgaagacagcgatgataagcaacgcccttcctttccctccgtcagattctcttcccgcaacgcttcctccaaatacgatttcgtcaaggtgaaggtgtggttgggtgataatgcggatcactactatgttctctcccgatttttgctcagcagaatgctaacggtaaccaagattccaaaccacgttgctatcaaaattgctctcgaattgaagaagctgctcacagataacagccttctagatgtctctcaatctgacttggaagtcaacctatttaagaaatgttccaagagggtgctatttgtgcagcttatggagcggcggggatatggagaagaatacataaatcgttacaagatgatgacgagatttcatcatcaaagagttccgttagtaatccttgtttgtggaactgcttgtgttgggaagtctactattgccacccagcttgcacagaggctaaatttaccaaatgtattacagacagatatggtttatgaattgttgcgcacatcaacagatgcaccattggcatcgactccagtatgggctagagacttcagttcatcagaggagttaataactgaattttgcagagaatgcagggttgttcgcaaaggtttggctggtgatctgaaaaaggcaatgaaagatgggaagccaattataatcgaggggatacatttggatcctagcatttatttagtggatgatgacaataaatcaccctctggtgtacattcagaaaataaagagataaatccagcatttatgacattggatgataatgctactgcacaaataaaagacattcatgtgggtagcagtgatgagagtaatggtggctccaggattttgagctctgatgaaggagtatctgctgaccaggttgatgtagtatcaaattccatggcatccatgggcctaactgaaagcatccctgaacataaagttgcttctcttagggaactggagacagacaaaactactattagtagggcgaagtcaggtcccaaaccaataattgtgcctattgttttgaagatggctgaatttgaccataaggcattacttgaggagtggatctctgctcggacatttaatgacaaatgtccagacctggataatgagaagcttatagccaacttgaaaaccatacaggattatctgtgctcattcacatcgcaggggttgactgtggtcaatgtatcggcaacaacatttcctcaaacattggattggctgcatggttaccttcttcagattagtcctctatcccttttcttcagaaatgactttaaatttctttcagtgcatcgagcaaggttattcattaggggaaattgcacaacatatgataaagagagtgtattatttttgcactgtactagtatgagaattcacagatggtttctagattcaacttcactttgtaaatggatgatgctggagaataacttatcaaatcaaaaggttaggaagatcatgttcaaagctatcaactcaactgatcgccagccctattacggtcttgctttgcaatatatgatcattgatgatatcttattttgtgagcaggatcatggcttggggaaaagatag

SEQ ID NO: 8803 - DNA, 1677 bp, Glycine max
  Peptide Sequence Number=SeqID_125581
tacttcaacatctccggaaactccttcggaacctcactaccggcctctatttggaatgctactaatcttgcgatcttctctgctgcttcgtcgaacatcactggtcaaattcctgatttcatagggtgtcaggcattgtataagctcgaactgcagggaaattccatcaacggtacgattccttgggacgttggacactgccagaagttgattttactgaatctgagtcgaaactcactcaccggtatcattccctgggaaatctcagctctcccttccatcaccgacgttgatctctctcacaattcactcaccggaaccattccttcgaacttcaacaactgctcaacgctcgagaatttcaacgtcagcttcaactccctcaccggtccaattccgtcgaccggcattttcccgaacctacatccttcctcctactccggcaaccagggcctatgcggcggcgtgttggccaaaccctgcgcagccgacgccctctccgccgccgacaaccaggtcgacgtcaggcgacagcagccgaagcgaactgccggtgcaattgtgtggatcgtcgcggcggcgttcggaatcggcctcttcgtgctcgtcgccggaacgcgctgctttcacgcgaactacaacaggcgtttcggcgacgaggtgggaccgtggaagttaacggcgttccagcgtttgaatttcacggcggaggacgtgctggagtgtttgtcgatgtccgataagatactggggatgggatccacgggaacggtttacagatcggaaatgccaggtggcgagatcatagcggttaagaagctgtgggggaagcagaaggagaatatcagaaggaggagaggggttctggcagaggtggaggtgttgggaaacgtgaggcacaggaatatcgtgaggttgttagggtgctgcagcaacaaggagtgcaccatgctgctatacgagtacatgcccaatggaaacttggatgattggttgcatggcaaaaataaaggagataatttggtcgccgattggttcactaggtataagatcgccttgggcgtggctcagggaatctgctatcttcaccacgactgtgatcccgtcatcgtgcatcgcgatctcaaacctagtaacatattattggacgctgagatggaggccagagtcgcagattttggtgtcgccaagttgattcagaccgacgagtccatgtctgtcattgccggttcctatggctacattgctccagaatatgcttacacccttcaagtcgatgaaaagagtgacatttacagctacggagtggtgttgatggagatcctaagtggaaaacgttcggttgatgcagaatttggcgatgggaacagcgttgttgattgggttaggtctaagataaagtctaaagatggcattgatgacatattggacaagaatgcaggggcagggtgcacctcagtgagagaagagatgatacaaatgcttagaattgcattgctttgcaccagtagaaacccagcggataggccttctatgagggatgttgtgttgatgctgcaagaggccaagccaaagaggaaattgcttgatggtgttctaggtcgatgtgctggggacaatgtggttgttggtggtgacattcctttgccacaaaagccaattgcggatcaatgttaa

SEQ ID NO: 8804 - DNA, 621 bp, Glycine max
  Peptide Sequence Number=SeqID_125582
atggccagaaaattccatgaagcacctattatttgtctctctcctttattcttgatttcctatgacttgctcgcatcgccattagtgactgctgtgaggagaggatcttctgattcaaaattggtgtcctcctcgtctaccctcactccagaaaccaaaactaccatggaagacaaaggccgtggtgctggtgaaagtcgaggcatcgtcaagcaacttcgactcgagaacttcatgtgccattccaaacacgagaccgagttcggaaaccacgtcaatttcatcaccggtcaaaacggaagtggtaagagtacaatcctagctgcactgtgtgttgcatttggctgtcgagccaaagagactcaaaggacttccactttgaaggatttcattaaaactggcgccactgatgctgtcatccaagttgaaattcaaaatgaaggggagggtgcttttaaacctgaaatatatggtcctgttatcatcgtagaacgtaggatatctgaatcaacaagttctgctacattaaaagaccaccaagttgacaacacattaattttcatgagatatagggcccatccggtctccaaacatcactatgaagtcaagcaaatggactag

SEQ ID NO: 8805 - DNA, 1171 bp, Glycine max
  Peptide Sequence Number=SeqID_125583
atgaaaccttttcttctctttctcatcacattctccttcctctgccaaacacacctactcctagttctctctgccacaacccccttgtccctccaactcatcgccctcctctccataaaatcgtccctcctagaccctctcaataacctccatgactgggacccctccccctccccctccaatccccaacacccaatatggtgttcctggagagccatcacatgccactccaagacatcacaaatcaccaccctagacctctcccacctcaatctctccggcactatctccccccaaatccgccacctttccaccttaaaccaccttaacctcagtggaaatgactttaccggcagtttccaatacgccattttcgaactaacagaactgagaacactagacatcagccacaattccttcaactcaaccttcccaccgggtatatcaaaactcaagttcctcaggcacttcaacgcctacagcaacagcttcaccggccctctcccccaagagttaaccacccttcgtttcctcgaacaactgaacctgggcggaagttacttcagcgacgggattccaccaagttacggcactttcccgagactcaagtttctagacatagccggtaatgccttggaaggtccactccctccccaactaggccacttggctgaactagaacacttggaaattggatacaacaatttctcaggaacactaccctcagaactcgcattgctctataacctcaaatacttggacatctcaagcactaacatttcagggaacgtgattccggagctgggaaacctcaccaagctggagacacttctgctgttcaagaacaggttaacaggggaaataccatcaaccataggaaaattgaagtcccttaaaggccttgacctctcagacaacgaactcactgggccaatccccactcaagtcaccatgctaaccgaactaaccacgctcaacctaatggacaacaacctcacaggagaaataccacagggaattggagaactacctaagctcgacactctgttcctcttcaacaactcactcactggaaccctccctcagcaacttggctccaacggcttactgctgaaactcgacgtttccacaaactcactcgaaggtccaatccctgaaaatgtgtgcaaag

SEQ ID NO: 8806 - DNA, 441 bp, Glycine max
  Peptide Sequence Number=SeqID_125584
ctgtatgcagtgcagtggcatctgttagtcacatgtattttatttcttagccgggagggctttcgacgagcatgcttgcggatggacctcaaatgtgatggcacttcaatgggagatgttgtgaagctaatgaaagtagtgtggatgagttttccacttggaatatttattacagttgtagtatgcctttttgtcttctggtggcaacaaataagttattctagtccacatgggcaagctatcttgatcaatggttttgcatgcattttggagctcctggctgagccggtgtatattctttcacagaacttggtcttgcttgaattacggctgatggttgagactgttgctactctgtcgtggtgcttgacaatgtattttctaattgtgaagcaaactggaattgtaagagctttagttatactgagccatatattttga

SEQ ID NO: 8807 - DNA, 456 bp, Glycine max
  Peptide Sequence Number=SeqID_125585
atggagatggaacaacgtcatcatctgaaccttgtttttttcaatcaagcaagaagacacttccaaaggaaacaaaagaacatcaacatccaaggtgatgagaggacattttcacagttcaagaaatctacatggaagagctttcgtcatttacagctagctcttagcatgagcagagagcatgtgtccgtgcatgtcttttcccaactatgtacaatgaaaacgataatgggcataaagggaatcttaagtactgatgaacatttcctacgtatgaaggggatcctaaagcgaagggagcgttatggtaaggcacatgtctgtgaagtgtggagtggggctaagaaaaacattggcagaggcagaggccacgccacagttcacagcagtagttgggacccaattggggcattggcttgctggagagtgctctcgtgggcaccacaacccctttga

SEQ ID NO: 8808 - DNA, 870 bp, Glycine max
  Peptide Sequence Number=SeqID_125586
atgttttgcaggcggcttggggctcctgacagtatcagtagcagtttgcaacaatcccttctcagggtttcttcttctacttctagtcatacccgcaagatcaaatcatcattaaagcacgtctatttgtcttcttctcacaataatatgaatctctccccgttacctaatctctccccgttaccgtcttttttcccagacagccatgcccaaaatgatggtgatggtgatgccatttttgggcccgttccttctgactctgatgttgaaaatgctctcattactcttcaacaggtctttgggtctgcttcacgccagtatgttaggaacgtagatgaagtagatcatgtcacaaatacttctttagttgaccaagttttttcagatggatcagagacagactggaaagaaccctccctctcttcatataatccaagaatgttacaaactgatgtttttgataaagttactttcgcagttcatttattgcagagtgatgcatgtgttcagaggatggtaaaatcattatcatcagataaatctctttgggatgctgtgctgaaaaatgaatctgtacgggagctaaggagcacaataactgcagagagagatcggagctcaaatgaaactgttgacaatgaatccccgaatacaaaaaatgtttttatgcggatatctgatgctgcaaaaggcaaactcatggaagcaattcagaaaattatgaagatgatgaagaatttgtttcaaagtacacgtcactggaaatatgcaggaaaatctaatttatccaaagataagctgagagtttctgtcatgctttccataatgatcttcctaatggtggtggtggatcgtttctatttaatctaa

SEQ ID NO: 8809 - DNA, 888 bp, Glycine max
  Peptide Sequence Number=SeqID_125587
atggttctgactcagaagcttcacgaagccttcaaaggcaccgtcgagaggattactggcccccgaaccgtttccgccttcaaagaaaaaggagttctcagtgtctctgagttcgtcaccgctggcgataatctcgttgccaaatgccccacctggtcctggctctcactagctgttgatttgtgtgttctgttttccaatagggaatcgggtgatccaggcaagaggaagccatacttgccacctgagaaacagttcttgattactagaaatgttgcttcatacttaacagtgccttgtcttcggagagctgcatctgttgaagaggaatatgaagctgctggaggggaagttctactcgatgatgaagataatgatggctggctagcaactcatgggaaacccaaaggcatgtattatttgtattggactggaggcttcctagaaatcagcaaaaagggttctattaagcaaattcattcctacatgggagctgaagagggagaagatattccagatatggcagagtttgacgatacttccaatgttgaaaatgatcctgccactcttcagtccacatatctagttgctcatgaacctgatgacgataatattcttcgaactcggacttacgatatcagcatcacacttgttactgatttagtgattccatgttcaatcttgtggcagtcaaggatgcttttgcaaccagaacttgttcttgaagatgttagtcaagaccatgcacgcaaaacggtaacaattgaggaccatcctcacttgccagggaagcatgcatctattcatccatgtcgacatggagcagtgatgaagaaaatcattgatgtgttgatgtcacgcggagttgagcctgaagttgacaagtaa

SEQ ID NO: 8810 - DNA, 1569 bp, Glycine max
  Peptide Sequence Number=SeqID_125588
atgtctccttcacgatgtgttgttggtcttctggaacaatgctcaagcatgagagagatgaagcaaatccacggccacgccatcacccacggcctcgctcgattcgccttcatctcaagcaaactcctagccttctacgcccgcagcgatctccgctacgcccacactctcttctctcacatccctttccccaacctcttcgactacaacaccatcataaccgcgttctccccccattattcctccctcttcttcatccagatgctaaacgccgccgtttcccccaactcccgcaccttctccctcctcctctccaaatcctctccctctctccccttcctccatcagctccactcccacatcatcagacgcggccacgtctccgacttctacgtcatcacctccctcctcgccgcatactccaaccacggttccacacgcgctgcccgccgcctgttcgaccaaagtccttacaaaaacgtcgcatgctggacaagcctcgttaccggatactgcaacaacggcctggtaaacgacgccaggaacttgttcgacgcaatccccgagagagagagaaacgacgtgtcgtacagcgcaatggtatctggctacgtcaagaacggttgtttccgcgaggggattcaacttttccgtgaactcaaagaccgaaatgtgaagccgaataactctcttttggcgagtgttctcagcgcgtgtgcttccgttggcgcgtttgaagaaggcaagtggatacacgcttacgtggatcaaaacaaaagccaatgttattatgaacttgagctcggaaccgcgttgattgatttctacaccaaatgcgggtgcgtggaacctgctcagcgggtgttcggtaacatgaaaaccaaagacgtagcggcgtggagcgccatggtactgggcttggctattaacgccaagaaccaggaggcccttgagctgtttgaggagatggagaaagtgggcccaaggcccaacgccgttactttcatcggcgttctcaccgcgtgcaatcacaaggacctgtttggagaagcacttaagttgtttggatacatgagtgataaatatgggattgtggcgtcgatagagcactatgggtgcgtggttgatgtgttggctcggagtgggaaaatagaagaggcgttggagtttattaagagtatggaagtggaaccggacggagtcatatgggggtctttgttgaatgggtgtttcttgcataataatattgagttggggcacaaagttggaaaatatttggtagagttagagcctgggcatggtggaaggtacgttcttttgtcgaacgtgtatgcgactatggggaagtgggaggctgttttggagaccaggaaattcatgaaagacagaggtgtgcctgctgtttctggttcgagtttcatagagattcatcaaaccgtacacaagtttcttgttcatgataacaaccaccactgtggttcgtatccggctgaagtctatcgagtgttaaaccaccttggtaacaaacttgaggattattctaaatcaaatgaaattattgttttttga

SEQ ID NO: 8811 - DNA, 756 bp, Glycine max
  Peptide Sequence Number=SeqID_125589
atggatccagatcagggctcttcaaaagcccggaagctcaagtttaaacccaggaatctcaaaccagtccgaactcccaaaaccgaagcggatgataagcagaaggaagatagcgcagtgcctcgagctctctcgcgtcgacaagatcaaaattatgcttgcatgatagaagttactgatgatgatgatgataccactgatgcatctgccaggaaaatcaaaagagagtacaaggaaccatgggattatgaaaactcatactatcctactactcttcctctgaggaagccaaattctggagatccagaaattcttgatgagaaagaatttggtgaagctgcttctagtgcggagtatgatgagaatactgttaattctgctgcagaactcgggctcttgaagaagagtcagcaacaaaggatgcttttctttaagtttcctactctgcctttggtcaagcagactaacaaggggaaggagaaaattggtaaatcaacagtatcgcaagaggccacaaagtcaaagagtgccttggaagagttgccaaggggatatatgggcaaaatgctggtgtacaagagtggagcaatcaaactaaaactaggagaaactatgttcgacgtgtctccaggttcaaatagtgtatctgtacaagatattgtggcggtgaacactgcacagaaacagtgttgtaatcttggcgagcttaggaaaagggttgttgtggttcctgatcttgattcaattgaactgtaa

SEQ ID NO: 8812 - DNA, 768 bp, Glycine max
  Peptide Sequence Number=SeqID_125590
atggcaaagagttacaaaaatttgcaggcaaaactccaagaactccaatctatactcgatgaagcgttgctgcttggccccgacattcagtcccaggactccatctccaacgacatcaaacacaaactcgctttcataggaaacctgttaactgccgaagttgcttctcatcatccatcaaaaccccatcatttgcaccacatttcagagaggttatccacaatggagagggattttcatcattgggactctttcagatcactcccctgtaatgattttgacaaagattctatttgctcttgcaccgattcgtgtctcaacgatgatgaaactgatttgattgcttttgaagacccagaaaagcttttgcttgattctaattgtgagaaggctatggtggaatatagtggtgctgtggctgaggcaactggctatgttgatgaagagaaacaaaggggagaaatgaataatggatctaacaagttggcatcttttgattatgaagacgcagaggacttttttgaagactttgccggagacaaggaacttgcggaatttgatggtgctttacttagaaaaactgagaaggagggtaagaaggataatgatttggaaagagaagaaagtagaaacagtacatttggggagagatgttctacactggctgctggagttgtcattggcatgatattgatgggcttcattatggtaaatatttctgcttgctttcattatgtacaagaagcaagctatgccattccaacttag

SEQ ID NO: 8813 - DNA, 2343 bp, Glycine max
  Peptide Sequence Number=SeqID_125591
atggacgccgtcgactcaaccccaaatccccctcccctccctacctacgatccatcagagtatcacaacccgccgcaacatcaatcggaaaccgggcaaaacggtaacggcaccaacctcggaaaaccatcggagaacggcagtcaggtcgctgccgacaacaacggcttgaatcctcagatttcgaagccattgctatccgaaggattgacgcggagcggcaccgacagggatcaatccggcggcgaggaggagaccaccagcaagcgccgccgccgcagtcggtgggacccgcagccggaatcgaatgaacagagcggcggcgattcggggaccggaccgaagaagaggaagtctcgttgggccgatgacgaccctaaaccggtgattcagcttcctgatttcatgggcggtattgaattcgatcccgagattcaagctttgaatagtaggcttcttgagattagtcgaatgttacagtcaggtttacccttagatgatcgccctgaaggtgctcgttccccttcgcctgaacctatatatgataacatgggcattagaattaacactagggaatatcgtgcgcgtgagagattgcaaaaggagaggcaggaaattatatctcagattataaagaagaatcctgcgtttaagccacctgtggattataggccgcccaagcttcagaagaagctttatataccgatgaaggaataccctggttacaatttcattggacttattattggtcctcgaggtaacacccagaagcggatggagaaagaaaccggtgctaaaattgtgattcgtggtaagggatcggtgaaagagggtaggcttcagcagaagagggatttgaaacctgacccttcggagaatgaggatttgcatgtgttagtagaggctgagacgccggagtcacttgaggctgctgcgggtatggtggagaagctcttgcagcctgtggatgaggtattgaatgagcacaagaggcaacagcttagggagcttgctgcgttgaatgggacgatcagggacgaggagtattgcaggttgtgtggtgagcctggtcatcgccaatatgcatgtcctactaggacttcaacgtttaagagtgaagttgtgtgtaagcattgtggggatggtggtcatccaagcatagattgtccggtgaagggtgcgactgggaagaagatggatgatgagtatcagaatttccttgcagagttgggaggttcggttcctgaatctgcaacaaagcaaaccagtacattggcaattggtgcaggcacttctggaagcaatcctccttgggctaacaattctggtactgcaggcagtgcacctcaagctggcttaggggctgctgcaattaagaaggaaattgatgatacgaatttgtacatagggtacttgccgcccactcttgatgacgatggcctgatccaattatttcaacaatttggtgagattgttatggcaaaagttatcaaggatcgaatgtcgggtttaagtaaaggatatggttttgtgaagtatgctgatattacaatggcaaacaatgcaatcttggccatgaacggttatcgccttgagggtcgaacaattgcagtgagagttgctggtaagcctcctcagcctgttgtacctcctggaccaccggcatctgctgtgccaacttatcctgttccaagtcagccacttggtgcatatccatcccaacagtatgctgccggtggccccattgggactgctcctcctgggagttacggtggtaccccagtgccatggggaccccctgttcctcctccatatgctccctatgctcctcctccacctgggtcaactatgtatccacctatgcaaggtcaacctatgcctccttatggggttcaatatccccctcctgtgccgactggccctcccggtgccccatcccagcctgcaacttctagtgaagtgcagcagagttaccctcccggagtgcagtctgacaacagtacctctactcagtctataccagctaatgtatatggtaattcgggacctccaatgccacctcaacctacatatcctgcatcttatggatatccaccttactataatgcagttcctccgccacctcccccttctgcccccatgcctgtttcaacttcagatcaatcccacaacattgcaaatgtgccttgggccagtaattctctagtcccacctcctgcttcatcggcagacaatcaatcccagagcattggaaatgtgcctagggccgcaaatccatcagtgcctcctcctgcttcatcagctgattcagagtatgaaaagttcatggcagagatgaaatga

SEQ ID NO: 8814 - DNA, 159 bp, Glycine max
  Peptide Sequence Number=SeqID_125592
atgcgtataaagcaaatcgtgcttgaaaggaaatcagaacctagtgtgcgcgaactcgcgatgacagtggcgcgacgacggtggtggaacaggcttgggacggcgacggtggacctgagtgggtttgcgcttgggttgtgccgtgcgtgtttcttttag

SEQ ID NO: 8815 - DNA, 840 bp, Glycine max
  Peptide Sequence Number=SeqID_125593
atgcagaggtcagtgaagatcctttcggtgtttgtggggccatgttttgtggccgagtgtgcatacaagatatggtggtacgcatccggagcctcacagatccccttcttaggaaacgtgtacgtgagcgatgcggtggcgtgcatactggaactgtggtcctggctgtaccgaaccacggtgatcttcctagtgtgcgttctgttccgtttgatctgccacctccagatcctgcggctgcgcgacttcgcgagattcttccacgtggactccgatgtggcgtcggtgatgacggagcaccttaggattaggaggcacctgcgaatcataagccacaggttccgcgcgttcatcctactcgcgcttttattggtcaccggaagccagctggcgtgcttgcttgttacaactaaacatacgcaagatatgaatatttacaaaaccggtgaacttgcgctgtgctcagttacactcctttctgcgttgtgcatcttgttgcgtagtgcgacgaagataacacacaaagcacaagcgatcacggggcttgctgccaagtggcacgtttgcgcgacgttggattcttttgatggagttgtaacggaaggtgagacaccaatggctcctcaaagttcccatgaaacagtgtttcctaatgtgggaacggatggggaatcagagactgatgaagctggtgatgaagaagatgaaattgacactaccaagttaatcccatcctatgcttatagcaccatctcatatcaaaagcgacaagctcttggtaactacttcaattcatttctcacacacccattatattttcttaactacatacatgtctag

SEQ ID NO: 8816 - DNA, 213 bp, Glycine max
  Peptide Sequence Number=SeqID_125594
atggccggcagcaccagttcgcgcacgaagccggacggtgacaactgcagcaacgcgcgcaccattgcaacgacgtcctgcaggctggtcaccgccaggcggcgatcgcggaaaccctcgcgcagtgcatcggcgatgccgttgagtgcgaacttggatgcgccgaacgccacttccgggcggccactgcgcggcagcgccgaggtcgagccg

SEQ ID NO: 8817 - DNA, 519 bp, Glycine max
  Peptide Sequence Number=SeqID_125595
atggacgccgatgattgcgacgcccagtgccaggcccaacgcagtgacgacgatacgcacgccccaggcctgcaggatcatgcgcagcgagagttcattgagcatgcgcgggtgcaggcgcctgcgcagccagacgcctgccagcatctgcagcgtggcctcgaggccggccggcagaaaatactgggtgccggcgaactggtatcgggccagcaggctggcacccaggcaggccaggccgccgcgccagccgccgagcagtccgctgaccagcaggatgtcgaagccgaggtgcagcttgaccacgccctgggtgtagcgggccacgaaccaggcgttgaacaggtagatcaggcccagcgccacgcccacgtacaggcggcggccttcaatggcatggccagcgcgacgggtggcgatcagcagcacgccgatcatgccgatcaccgccgtggcctgcagcaggtacagcggcaggctgggcagggcgctgtccaggacctgggccgagacccgtga

SEQ ID NO: 8818 - DNA, 253 bp, Glycine max
  Peptide Sequence Number=SeqID_125596
gtcgactctagaggatcccacggccatcatcgatgagtgcaaagagaagctaaatctagcagcgactcacgagcaaaggctagaggatgagtacgccaagatatcagtagaaaggagtcaagaacttccccgattgctagccaaggccaaagcaatggcggacacctactccgcccccgaggagatccacggacttctcagctattgtcagcatatgatagacttaatggaccatatgattagaaaccactag

SEQ ID NO: 8819 - DNA, 342 bp, Glycine max
  Peptide Sequence Number=SeqID_125597
atggacaataaatgctctgagctaggagtggcaagccctaggagaatgggagctgggactgaaggtgggagagcagatgcaaatgtagatggagttgatgtggaaggagttgaagaagggggagcagaagaagatggtacctcagatcatttgcccctaaatttgtgggttcctcgaaaagagaccgaagggtcatccaggttccaacaattctttttaacatatgccaaattaatggctgggctcaagctctcaaaagtcaaagagtcagaggtgactcctcgggccttgcacaaggcagtgatgagggcaggaaaacctagcctcgaggagtcatgctga

SEQ ID NO: 8820 - DNA, 549 bp, Glycine max
  Peptide Sequence Number=SeqID_125598
atggccctggattgcttctttgcagtttggtttgtagtaggaaatgtttggatctttggaggtcacacttctccttctgatgctccacaattgtatagctgtatcggatatgcaatgccatttatactttgtgcaactatttgttgctgcctaccttgtataatttctgttttgggcattcgagaggatttttctcagaatagaggagcaacagtagaatcaattaatgcgttaccgatattcaagttcaaattgaagaacaatgaaaatggtgatgaccaggatgtcaatgcagctatagatgaaggtggaattttggctgcagggacagaaaaggagcgaatgatttcaggagaagacgctgtttgttgcatttgcttagcaaaatatgcagatgatgacgagcttagagagttaccttgctctcactttttccacgtaatgtgtgttgacaaatggttaaagataaatgcaacctgccctctttgtaaaaacgaagttggtacgagtaatggagggtccccttcagcctggaactccagtacgtag

SEQ ID NO: 8821 - DNA, 1371 bp, Glycine max
  Peptide Sequence Number=SeqID_125599
atgagaacttcgtgggcggattctgctgacaactctgccattggttctggcatcaccaatgcctcggcttgcccttcccggggagcttatgtaccgccacatcttcggaaccgggcattgtcgtcagaggttcctctggcggcagcgtcacacccggcggtggctctggggaatgaccgggttaatcatagtggtccagctcctcatcagggtggtggttactttaaacctgatcacgggcggcagcagcagcaaggatatggttctggttttcagagtggtggtggcggtggctggaatggtagaggggtggggagggaccgtgggaggcgtgaggcgaacccttttgagaatgttgaagctgaggatcaatcttttagtgagcaagagaatacggggattaactttgaggcatatgatgatatccctgtggagactagcggggagaatgtgccactgcccgtgaattcattcgcggaaatagatttgggtgtggcattgaatcagaatatacagagatgcaagtatgtgaaaccaaccccggttcagaggtatgccattccgatttctcttgcggggcgagacttgatggcctgtgctcagactgggtcaggaaagacagctgccttttgcttccctattataagtggaatcatgagggagcaatatgctcaaaggccgcgtgtggctcgaactgcttatccgctggcacttatcctctcccctacaagggagctttcatgtcagatacatgatgaggccaaaaagttttcttatcaaactggtgtcaaagtggtggttgcttatggaggagcaccaatcacccaacagttacgggagcttgagagaggcgttgatattctggtggcaactccaggacgattggtggatttgcttgagagggctaggttgtcattgcagatgataagatacttggctcttgatgaggcagatcggatgctggatatgggttttgagcctcaaataagaaagatagttgaacaaatggacatgcctcctccaggcatgagacagacgctgttgtttagtgccacatttcccaaagagatacaggctcttgcatcagattttctttcacgttatgtgtttctggctgttggaagggtcggttcaagtactgatctaattgctcaaagagtagaatatgtgctcgagtcagacaagagaagccacctcatggaccttcttcatgctcagagggaaactggagttaatggcaagcaaggtctgacattagtttttgtggaaacgaagaaaggagctgatgcattggaacactgcttgtgtgttaatggatttcctgcagctagcattcatggtgacagaacacaacaatggccaggggcttga

SEQ ID NO: 8822 - DNA, 207 bp, Glycine max
  Peptide Sequence Number=SeqID_125600
atgggagaaacattttataagcttttcaattatggacaaaggatcagcttggaagtgaagacagagcatatgcattgcaattttagcaagaggcaagaggagtatgacttggaagtgaagatgggagaagatgtcataccacatagggacaatacgaagaaaaggtcggggagatataaggttggctcagtggttgggaaagggtga

SEQ ID NO: 8823 - DNA, 219 bp, Glycine max
  Peptide Sequence Number=SeqID_125601
atggtggtgttggagggggagtatggtgcaggggagtggattgagattacgccagattgggagtcgcgggttgaaccaagagagaaactaaaggatgacatggcagtagtgaaggatgtcggcgagggctgtcgaggagaggtggtggtgggagatgtggtcgtcggcaatgagataggtgttggggacgacgagaatggagaaagaggaacgatctaa

SEQ ID NO: 8824 - DNA, 671 bp, Glycine max
  Peptide Sequence Number=SeqID_125602
atggatgttacttccctgggttcaaatagcaatacccaaaccgaccaacaccctttgttgatggagcagccagaaacccataacggtcatcagcatgtaattgacattacaaggaatggtgaagctctaactacgtcatctcgtaatgatcaatactctgaaatgcatttaccacagaatgaagatcaagcagctggggatgcacaaaattccagtcatcaaacatcatcatcttctgcacccagattaaactctagaaattcagcttcattgagaagaggtgagggatatggtcatcatggaaggagtccattgaattctggactgtggatttctgttgagcttgttgtcactgtgagtcagatcatagcatctatcgtcgttttgtcattgtccaggaatgaaaatccccaggccccattatttgcatggattgtgggctatgcatctggttgtgttgccacacttcccattctctactggcgttttcgaaaccgtaatcaaagcaatgaacaagatacctctcaagcatctcaaggatcttctggaagcaatcctccagatcgttcttataattccatccatgtttctcatgtctcagatgaggagaatggtcatgctacacgatcagcctcaagaaacactataatgcctggagcctttacttctag

SEQ ID NO: 8825 - DNA, 333 bp, Glycine max
  Peptide Sequence Number=SeqID_125603
atgggggattacttcatgatgcccatggtagctggatgcgagggtaccttcttatgcatcactaccatgcttacttatgctaatattgtggagcatatcagggaattcttaaaaaaagtggagggtggagttcaaaatcaacaacatagtgccttccaattttcccaaactcaacaacatcttgaagggaaagaaagactagtgccttccaattttaccaaactcaacaacatcttcaagggaaagaaagaccctaacaaggaagtcaagaactccaacaacattatccttattattactttcaagaactatagttccttccccaaattataa

SEQ ID NO: 8826 - DNA, 453 bp, Glycine max
  Peptide Sequence Number=SeqID_125604
atggagaaagaaggtgttgggcttgaaatcactactgagctaaggttgggccttcccggtggggaattacctgacaagaacgagaagatgaagaagagggtgttctcggagattaatcaaggtgatgaaaacagctcctccgaagaagatcgcaaaatccaaaccaaaaaccaagtggttgggtggcctccggtgtgttcgtaccgcaagaagaacaccatcaatgaaaccaaaatgtacgtcaaagttagcatggacggggctcctttcttgcgtaaaattgatttggctatgcacaagggatattcggagctagccttggccttggagaagttcttcggttgctatggaattggtaggtggtttctttttctggacttactaaataaggaggaggagaagcattgggactcaatatcccgtgagaagagtgtgtatattatgaacacgtaa

SEQ ID NO: 8827 - DNA, 258 bp, Glycine max
  Peptide Sequence Number=SeqID_125605
atgattataaaatttgaaattggcaggataccaatttggtacaatgtgaagctattgacagtggcatggctggtgttgccacagttcgcaggagctgcgaaatacataacggagagacaacatctctatgacaaccaccagcaacaaagaaaaaagtctcccaataacggtggcaaggccaagaagttcttcgaattcgtcacgcccaagaaaaagtcaaatgctgtatttgttgacccatcacatgtgattgtgtaa

SEQ ID NO: 8828 - DNA, 240 bp, Glycine max
  Peptide Sequence Number=SeqID_125606
atggcacgtagaattagcttaattgtcaagattaatgatatagaggatacttggagacttgcaatcagaattacaaaaatatgcttcattcaaaagaatgtaggaggaggtttttgggagatgattttaatggatgaaaagggacacaagatcagggccacaatgaacattttaaatttgacagatggaaaaatcaactcaaagagagaaaaacttatattgtttagaactttgaggtaa

SEQ ID NO: 8829 - DNA, 1056 bp, Glycine max
  Peptide Sequence Number=SeqID_125607
atgggggttaaaatcataatgcctacttcaaaagaagaggattttgttaccattgaaggcatttcagtcaacagcgtgaattcagcttcagagaagatacaggctataattgatgagacagttaatagtcgaaatcttgattattcacacttcatatcccttccattggccattcatcctgagttggttaataaactcatcagttttcagcattcaatattgggaattggttcttgcatggatgagaatacctatactgaatctgattccaatgaggatgagggtactactactgacaccaaagaagtggaccaactatccaaggaaaattccggtgttgcagttgagcttaaagctaatgacaacagtgaatcggttaaagttaatcttactaacataccccttgtcagttacgcacctaaagcatccaagtcttccgctccatctgacctgggtattgacaaatccatattcatcaagcctaaaacatttcaccttacagtactcatgcttaagttatggaacaacgagcgaattaagacagcctctgaggttttgcagagtatctcctcaaaagttatggaagccttggataatcggcctctctctataagattaaagggactggaatgcatgaaaggttctttggcaaaagcccgggttctgtatgctcctgtggaagagattgccaaagtcatcattgatgcatatgttgaagctggacttgtcttagagaatgatgctaaacagaaattaaagctacacgccactgtgatgaacgcaaggcataggaaaaggaacaagaacacgtggacaagaaaggttgattcttttgatgcacggggaatattcaagcagtatggatcagaggactgggggcagtatcttattcgtgaagctcatctttcgcagagattttctttcgatgaaaatggatactatcattgttgtgcttcaattccttttcctgaaaatatgcaggagaaggatttaaatggtagcttcaccaaatatactaaacttatctacctgcaaaagaaattgcctggggtttag

SEQ ID NO: 8830 - DNA, 552 bp, Glycine max
  Peptide Sequence Number=SeqID_125608
tggaagttcgatttttctatttctgatgtccgccggatggtttgtaccaaccaagcggatatgaccggaaggcttcttgccggttcattggcattcgaatgccacatcatgcactacttgattatgcgcatcctactccctagatcatccaaccttgcacaggcattgcgatcaaatgctccacttccatatcctcatttgatcaccttgttcttacaacattttaatgtccctcttaactctgaaccttttgttaaagtcaagagatctttctctatcggtgtgaatgtggtctcttcctttggataccgcaaaaagagagatggttcttgggtgaagaaagatgctccagtacaggccgctgaagaccgttctccatcaccacctcttcagagagatgattcttcatctcttatgcacaacattcttgacaggttggatggactccacaccttcgtcagtgaacgctttgactcattggacaaccgtattgatgccatggatgcacggtttgcaagaatggatacacgcatcaccaagcttgaggaggat

SEQ ID NO: 8831 - DNA, 207 bp, Glycine max
  Peptide Sequence Number=SeqID_125609
atgatgggttctgcaccagcacagcagcagatgtcatactatgatcatgttcagacacgcctttgtatacactctgttgctgcttttgctgctatgagagttgtgagtgctgcttggaacgcacctgttgttgctgtccgtagattgcccaatttccaagagacatttgtcaagtttatgtttcatcattactgttgtatgaaatga

SEQ ID NO: 8832 - DNA, 198 bp, Glycine max
  Peptide Sequence Number=SeqID_125610
atggcttgggatttagggtttagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggtttag

SEQ ID NO: 8833 - DNA, 216 bp, Glycine max
  Peptide Sequence Number=SeqID_125611
atgaagaggtctcttagaaagttgggagttctggcggtagagaagcatgagcgtgaccgcagaaacattatgcctttgtcccagctagaggagctcgctcaggctacccagaattctcagagtccttgggagaattgggctcttgccttcttgagaaaaccgccttgcatgacgacgaagaaagcggtactatacccttccctcacgtacccataa

SEQ ID NO: 8834 - DNA, 363 bp, Glycine max
  Peptide Sequence Number=SeqID_125612
atgagaaatttagcacatcggttttcgttcgactcgaatgcaaaaccaacattgttcaggatcctgtatctgagtaatggtagcagtgtaggacttggattgaagagtttatttgtattacacgggaatgctacagcgtctagatcctcagagacaacatacggagggatacttgatgaaacatttatgtccgacttacacttgctgaagagccctccagatggaaccaccaacaaccgacaatgggatattggaaaaccaatcgcggggcagagaagctgcacagaaccatcaaagcaaacccaagcacagatatgttatgtagaggagcttactaaacttatattcagactctatatatag

SEQ ID NO: 8835 - DNA, 5788 bp, Glycine max
  Peptide Sequence Number=SeqID_125613
agaagtatatgagtccatgttaacaagatatagagaaagaggtaggtctagaagcggaaaagcagagaatatttccttgcagcacttgcaaattgctcgtgatgaatatgacgaggaggctacattatttgttttccgcttgaaatctctgaagcaagggcaatcatggagccttctaacacaggcagcacgtcaccatgcagctcagaaagcagttaaatctcttgagacagtggagccacatgtaaaatcagtaacagagcagcatcacattgattaccaattcattggtattgaaggagaggatgaggatgaggatgaagatgaagatgatgtagatcatgatgatgacagtcatgatgagaatgatgatggggagctgagttttgactatgcacaaaatgaatgcgagcaagatgattctacattagagaactcaatgaagccatcccaacaaaccagcatcaataccagtaggcaattaattgcacatgcagctggtgatggacaagtatatggtgatgggaagttgagtagattcagaggcaaagaagtaagagttctgctgcgcattcgttcctcctcccactacccacagaaatccaccatgaatgaaacatccatcaacaacatggagagttatctctacctccatccgagcgagaacccggccactgcccttgtttctccagtcctagattcgactaactaccactcatggagcaggtccatggtcaccgcattaagtgccaagaacaaagtagagttcatagatggcagcgcgcctgaacctctgaaaacagatagaatgcatggagcgtggtgtcgatgtaacaatatggttgtctcgtggatagttcactcggtggccacctccatacgtcaaagtatactttggatggacaaagccgaagaaatctggcgcgatctgaaatcaagatattcacaaggtgatcttctgcgcatctccgaccttcagcaagaagcttcaacaatgaaacaaggcacacttacagtgactgagtatttcacttgtctacgcgtaatttgggatgagattgagaactttagacccgatcccatctgttcctgtaatatcaggtgttcctgcaacgcattcaccattatcgcgcaacggaagctcgaggatagagccatgcagttcctacgaggcctgaacgaacagtatgcaaatattcgttctcatgttcttctcatggatcccatacccactatatccaaaatattctcctatgtagctcaacaggaaaggcaactactgggtaacaccggaccaggtattaacttcgaacccaaagatatctccattaacgctgctaagaccgtttgcgatttctgtggacgcattggtcatgtggaaagtacgtgttataagaagcatggagtgccctctaattacgatgcaagaaataagagtaatggaagaaaagcatgcactcactgcggcaagataggacatacagtggatgtctgttatcggaaacacgggtacccgccgggatacaagccttacagtggaaggaccaccgtgaacaacgtagtggcagttgaaagcaaagccactgatgatcaagctcagcatcacgagtctcatgagttcgttcgcttctcccctgagcagtacaaggcacttcttgccttaatccaggagccatccgcagggaacacggcactcactcaacccaaacaggtggcttcaatctcatcatgcaccgtcaataatccaacaaacccaggtatgtcactttctctcagtgcgtctctcacctcctggatattagattcaggggctacagatcacgtaacctgctccctgcacaatcttcattcccataaacgaatcaatccaatcacagtgaaacttccgaacggtcaatatgttcatgcaactcactcaggaactgtccagctctcgtccaacataaccttacacgatgttctttacataccctctttcacattcaaccttatttcaatatcaaagcttgtatcttctattaattgtgaattaatcttttcttctacatcatgtgtactgcaggaaatgaacaaccatatgaagattggtatagttgaagcaaagcatggtctctatcacctgataccaaaccagttaaccaccaaagctgtgaactctactatcactcatcctcgatgcaatgtaattcccatagatctttggcattttaggttaggtcacccatcagctgaaaggatacaatgtatgaaaacctactatcctcttctaagaaataataagaattttgtctgcaacacatgtcattatgcgaagcacaagaaaatgcctttttctcttagtaattcacatgcatctcatgctttcgatttacttcatatggatatacggggtccgtgttcaaaaccatcaatgcatgggcataaatatttcttgaccattgtcgacgattgttcacgcttcacatgggtacatctcatgaagtctaaagctgaaacgcgacaggtcattatgaatttcattacattcattgaaacacagtacaatggcaaagttaaaatcatcagaagtgataatgggatcgagttcttcatgcatcattattatgcatcaaagggaatcattcaccaaactacatgtgttgaaaccccagaacaaaacggtatcgtagaacgaaagcatcagcatctactcaatatcacacgcgcactcttatttcaggcgagcctaccacctagcttctggtgttacgccttgccacatgccacatacctaattaattgcatccccacaccatacttgcataatatttcaccttacgaaaagctacataagcatccatgtgacatctctaaccttcgtgttttcgggggtctgtgctacattaatacgctcaaagcaaatcggcaaaagcttgatgctagggcacacccatgcatcttcattggttttaaaacgcatacgaaaggatatcttgtatatgatttgcattctaatgatgttaccgtatctagaaatgtcacgttttatgaggatcattttccttactattctgaaacccagcatataaactcagaacattcagctccctctccgggacccttttccggcaagaaccttgacccacaaatagaaaattgctcatcacaacccacaatatcagtaccatcatccaatgaaccttcaaatgagcaacctcttccacatcttaggcgatccacaagagccaaaaacaccccaacatatctccaagactatcacagagaccttgcttcatctacaccaaatacttcagcgattgttcgttacccactaagttccgtgctttcatattcacgtttgtcacctgcacacaggaatttcgtcatgagcatttccttaacagcagaacctacctcatacaccgaagcttctcgccatgactgctggattaaggcaatgaaggtcgagttacaggctctccaatcgaacaacacatggagactcacacctcttcctcctcacaagacagctattgggtgtaggtggatatacaaaatcaagtatcggacagatggttccatagagaggcacaaggcgcgattagttgcaaaggggtacacccaaatggaggggttggattacctcgacacgttctctccggtagcaaagctcaccacggtgcgtcttcttcttgcgatagctgcgctcaaccagtggcatttacggcagctggacgtcaacaatgcgttcctccatggagaacttgatgaagaggtgtatatgcaaatacctccaggactttcggttgacaatccacagctttcgaatgcagatcactccctcttcttgcgcttcacaggagtcatcactacaatactcctagtatacgtggatgatatcatcctcacgggaaacaacatagctgaaatacaaactatgatcaccctcttggatcgcgagttcagaatcaaggatcttggggatttaaagttctttcttgggctcgaaattgcacgcacctctaaaggaatccatctatgtcaacgtaagtatacattggatattttaagtgattcaggaatgctaggttgcaagcccaactcaacaccaatggattactccacaaagctacaagcagattcaggaagtcttctttcagctgagtcttcttcctcctatagaagattgataggcaaactcatataccttaccaacacacgacccgatataacatacgcagtccagcaactcagccagtacatggccactcccaccaatgttcatcttcaagccgcctttcgcatcctccgatacctcaagggtacaccaggttcaggactcttcttcgccgccacaggcactcctcaacttcgagcattcagtgactcggattgggcagggtgcaaagactcaaggaagtccactccgggttacttagtttaccttggttcttctcttgtctcttggcaatcaaagaagcaatcaactgtatcgcgcagctcctccgaagctgaatatcgcgctctcgcttccactacttgcgagctacaatggctgacttttctgcttcaagactttcgcgccacattcattcaaccagcaaccttatattgcgacaatcagtcaacaatccaaatagccacaaatcccgttttccatgaacgaaccaaacacattgagatagattgtcatattgtccgacagaagcttaactcggctctcataaaactccttccagtttcatcatccctgcaactcgcagatatattcaccaaggccctgactggaaatgtttcacatgttgatacaagacctcctcaagaaaacttggataggctttgcaggaattcattctccttcaaggttaggtcagctagccaatctgccccactttttgttgataataagcgtgattctagcgaaaagctgagacagatgcggccaactttatctcggaagttcaattcatatgtgctgcctacaccagttgatgcgaagagttcaatatctatgaggtcaagtaatcaagtacctttgaaaataaagacaaatttaaatgagcctatgaagaatttatggcattcatccccactagaacaaaagaaatatgaaaacatttttggagatgggggattatctggtcctaatgcacagtctgtactgaaggagagtaacagcaatactgcctactcaagattgccacctcctttaatcgatggtaatttatcctctagtcatgattatattaccgcttactctaaaaagatcaaaagacatgccttttctggtccattggtaagtaatgcatggccaaccaagcctgtctcgttagaaagtgtccaattgttttctggacctcttttacggacctcaattcctcagcctccatcatcatctccaaaagtatctcccagtgcttctccccctctttcatcttctcctaaaataaatgagcttcatgaacttccaaggcctccaaccatttccccatccgattctaagcttttaggtttggtgggtcattcaggtccattggtgtcccgaggtccacagctttctgctgcaaattatttggttacatcaaatgcagcatctccattgccgatgcctgcttcagccatggctcgaagtttctctacatcttatcgtggtgctaaagttgcagcaatacatgactcaagaccactagaagaccctaataaatcaacaatttctgaggatattgattctcctcctctgatgcaaattgctttatctactagtcagccatcatcagatggctctgacactgttgctcaggctgtctag

SEQ ID NO: 8836 - DNA, 1020 bp, Glycine max
  Peptide Sequence Number=SeqID_125614
atgagtgggctgaaagagcaccttaaactggcaagagaatacgcggtggaagggctctacgacacctccgtgatcttcttcgacaacgccgttgcacagatcaacaagcaccttaacagcaacagcgtggaggaccctttggtgcgagccaaatggatgaaggtgaagaaagcgctgtgcgaggaaacggaagtggtgaagcagctagatgctgagagaagggcgtttaaggaaacaacacgatcgccatctcaatcctcgtcctttgtttttcaacccttggataactatcccactacctctcctcctcctcctcctcctcatgatcccgacgtctggaggccgcccagtccagacgatgccagaaggcccaccaggcccactgctcgcagcaaagatggggcttgggctgcccgaggttcagccaggcccgcccctcgtgccgcaaagcccaacagcagggtcagcacaggaacaggaaagaaaggaaaggataataataagtatgaaggccctgatggtgagttggcggaaatgctagaaagggatgtgttggaaacgtcccctgctgtcagatgggatgatgttgcaggcctcactcaagccaaaagccttctagaagaagcccttgtacttcccttatggatgcctgaatatttccagggaataaggagaccctggaaaggtgttctcatgtttggacctccaggaactgggaagacgcttcttgctaaagcagttgctactgaatgtggtaccactttcttcaacgtttcttctgctactttggcttctaaatggcgtggagagagcgagcgcatggtccggtgcttgtttgatcttgcaagagcatatgcccccagtacaattttcattgatgaaattgattctctatgcaatgctaggggggcttctggggagcatgaatcatccagaagggtgaagtctgaacttctagttcagcttgatggtgtaaataatagttccacaaatgaagatggtacccgcaaaatagtaatg

SEQ ID NO: 8837 - DNA, 270 bp, Glycine max
  Peptide Sequence Number=SeqID_125615
atggcttgtggaggagtgagagagaaagtgatgaaagagcaaacaatcaactctattctcatggaagaaaccagaagcagcaatagaaacaaaagcattgttatagatattgaacaaggtgggcaagctgcgacatatggggttttattagctaattcgaggtccaaaagcttcatctcaccatattctggagataaagtaaaggtcattgaagtagcgtccatttttagggctagccatcttgttattaagtgcagtttaacgaactaa

SEQ ID NO: 8838 - DNA, 903 bp, Glycine max
  Peptide Sequence Number=SeqID_125616
atggcattgcgaggattgagtgcggtggcggtgacggcgtcaatacgccctcccggtcctcgattcagagtagacagcggcacatcaaggattccctcttccggatgcagaatctcggtgcggtgtaaagctgtcggagaaagccgacaaggttccttggaggaaaccgttgtttatgagggtatttatggcccctggaccattgacgactccgatgttcgagaggtaattttgtacagatcaggattggtaacagctgctgcatcatttgtggtcgctggttctgctgccttttttcccgatactctgaagcagaatgttgatttattgtatgtccttgggtctggtgggttgggtttatcgttgctcttgattcacatatatgtgtctgagatcaagcgcgccctacaagcactatgggggcttggtgttgttggatcggccacaacctacttttgccttgctcaaccagctaataagaatctaatacaatatgttgttgacaacccatcagctgtctggcttgtcggtcctctttttgctgccttgacaggacttgtcttcaaggaaggactctgctatgccaagcttgaagctggacttctcacctttgttattcccatacttcttcttggccatctgaaaaatttgcagactggtttgatggatgatggagttaagcttactttacttgcttcgtggatgactctttttgtgatatttgctggaaggaaattcacccagcccatcaagtttatatcttcattgatcttgggactcatgcttaacatcaaactcaaggatgacatcggtgacaagtctgttttcatgttcaattctcttcctggtgacgagaggaaagccttgcttgagaaattagaacagcaaaaaattcagaattaa

SEQ ID NO: 8839 - DNA, 666 bp, Glycine max
  Peptide Sequence Number=SeqID_125617
atggacatatcatcacaaaacaatgatgttgggataacagaagggaaaaaggaggaggtgtggcaagttgtggaatatgttgatgcttttctccttagtagtggggaacatgttcttgattgtgttcatgtgttgcccaatctgttagaacgtatggtgaataaatacaatagtgggagaaacaagtttggggaagagccaaaagatgacaagtccttcctaaatgttgtggatcacatcttcaagctttccacatgcaatacatgtaacattgccttggaccaaactagttctatcctagaaaaaacaatgtcctttttgtctgccattcccactaagtaccctcctctgggacaggatcaggataatcaagagttcccttttaatttctctacccaaaaaatctccatttttaacaagatcagcactaccatgattgcaactggttacaagatcgaatgttgcatggcttttgccaattttaggcaaggtgattttaaaattgaattgcaaagatttgggcataggaacatgaaaatggaagatgtgtacaaaatgccatgggaatcgctcgaaggagaaattacaacatggaaccaagtgatttggcattgcaccactgtgcttttcaacactgaacaaaggctttatgactctgttccttaa

SEQ ID NO: 8840 - DNA, 1062 bp, Glycine max
  Peptide Sequence Number=SeqID_125618
atgccttcactctcagaagcctaccgatcccaccccgtgcacgttcaacacaagcaccctgacttaaactccctacaagaactccccgagtcttacacttggacacaccatggccatgatgatcacactaattcccctgcttccaacgagagtgtccccgttattgatctcaatgacccaaatgcttcaaagttgatacaccatgcatgcacaacttggggagcgtaccaagtgctgaaccatggcatacccatgagcctcctccaagacattcaatgggttggggagaccctattctctctcccttctcaccaaaaacacaaagcagctcgttcccctgacggtgttgatggctatggcctcgctcgcatctcttccttcttccccaaactcatgtggtctgaaggcttcacaattgttggatcccctcttgagcattttcgccaactctggccccaagattacgacaaatactgtgatttcgtcatgcaatatgacgaagccatgaaaaagctagtgggaaagctgatgttgctcatgttggattctctgggtattacaaaggaagaccttaaatgggctggctcaaaaggccaattcgaaaagacttgtgctgccttgcaattgaattcatacccgacttgtccggatccggatcgggccatgggtctagccgcccacaccgactccacccttctcacaatcctttaccaaaacaacataagcgggttgcaggttcaccgaaaaggcgtcgggtgggtgacggtgccaccactctccggcggacttgtgatcaatgtaggcgacctcctccacatattgtcgaacgggttgtacccgagtgtgctccaccgggtcttagtgaaccggatccagcgaaggctttcagttgcgtatttatgtgggccccctccaaatgtggagatatgtccacatgcgaagttagtgggcccaaataagcctcccctttataaggcagtgacttggaatgagtaccttgggaccaaagcaaagcattttaacaaggcactctcaactgttcggctttgtgcacctagctag

SEQ ID NO: 8841 - DNA, 423 bp, Glycine max
  Peptide Sequence Number=SeqID_125619
atgactttaagggaagacattgttggggagttttatttggagccgtgtacaaaagagctagcgtatgagacaaccactacaaaggacatgataatagaggctattgtcgccatgttttgtgatttgaaaaactccatcaagaatgataatgaaaggattcatgtccttaacagtgcaattcatcccttaactcgttatgttatgaattatcttaaatatgcatgtgagtacaaagataccttggagcaagtattcgagcaaggtcaaggtgtcaacattgaagggattgagattcaaaatcacaaatccgttcatgaagaagtggaagatgtagggacgcccaagaattcaccttttactggtcaattgatgaccatcatggaccttggatgcaaatgtagaaaggaaataaaagttgtatag

SEQ ID NO: 8842 - DNA, 873 bp, Glycine max
  Peptide Sequence Number=SeqID_125620
atggctagagcagttggcttactgggtttgcgagcttgcttaacccaatcaaccatggactctggccacggtttgcccccatcctgggccactcgaaccactcaccaatgcattcagtctcaaaaggacaattatcacaagtaccacaatacagcccaaggccgcatcagaatctggttcgcgattaggcaaatcatgaactctactcctcgcttacttattcaaacaagagatgctgcaacacaactcaatactggaatacacatgcatgttgcagagataccacatgagaaccaactagttatggatgttcacaaaatagatcacggaactgttacatacttggacaagataaatttccttcaaaacaatctgttagcagctcactcagtttggatcgataataatgagatatctcttctttcacgagcaggggtcaaagtgtctcactgtcctgctgctgcaatgcgaatgcttggatttgcaccagtaagggagatgcttgatgctggcatctgtgtctccctgggaacagatggggccccatcaaacaatcgcatgagcatcgactgtacatcaaaccctcaccagaccgtaaagttgcgggagtctcttgctcggatggagaatactgggcagtacacattctataaaataccaagacggggagtttatgctaatggaactacagatccaactgcattgcctgctgaaactattcttaggatggttactgtcaatggtgcaaagtcagtattatgggatgatgaactaggttctcttgaggttgggaaaaaggctgacattgttgtagtggatccttcgtcttggtctatggttcctgttcatgactggtacgaactcattacttaa

SEQ ID NO: 8843 - DNA, 1008 bp, Glycine max
  Peptide Sequence Number=SeqID_125621
atggcggctgcgtttacaagtacaagtgcaacactgagactgtcaaatgttggagagagcagaggtttgcagctgcgtaagtgtaaccctaatcctaataagctgaaggttatgggggggtttggaggttgttctggagtggcagtgggtgtgagagaaagaaaaggaattggaagggttagggttcgggttcgggcgagttcttcgtcggacgaggcagtgagtgcgcagtcaaaagtgactcagaaagtattctttgacgtcagtattggaaatccagttgggaagcttgtgggacgtattgtgattggactgtacggcgacgatgtcccccaaacggccgagaacttccgtgccctttgtactggagagaagggctttggctataagggctccaccttccatcgtgtcatcaaggatttcatgattcaaggaggagactttgacaaaggaaatggaactggaggcaaaagtatatatggtcgtactttcaaagatgagaattttaatttgtctcacactggaccgggtgttgttagcatggcaaatgcaggacccaacacaaatgggagtcagtttttcatatgcactgtcaagaaatcagagtgcaagacagacagtgtgctcacagtcacagcaagtctgaatgcacagcaacaaacaaattcagaaatcagaaccaaggaattgagagagacaatgatatattcaaagagggagagagaatgggatgggttgtatgagattgcacaacccaatttggaaaaccgagctcacaagataaaaaaaatgttgccacaatcttgccccgatccctctgatgagtattctactcgctatctagcttgggagcagacaccttggctggatcagagacatgtagtatttgggcaagttttggaaggcatggatattgttaggttgatcgaatcacaggagacagataggggtgaccgtcctacaaagaaggtgaccatcagtgactgtggtgagcttccaaatgcttga

SEQ ID NO: 8844 - DNA, 570 bp, Glycine max
  Peptide Sequence Number=SeqID_125622
atggagacaaacctttacaccaatgacgacacaattctatgtcgtgtcttccctatatccctcgagggagcaacattgacatggtatggtggactcccaccaagatccatagatagcttcgacaccctcatcgaacgattcagtgtgcagtacgccaccagtaggtctcattgcatgaccttggctgccttggccagtctacgacaagcagacgatgaatccctcagaaagttcattggcaaatttgggcgcacagtcgtccagatccgaaatctcaacactgagataaagttgcattccatgcttctcgcactacaccctagcaagttcgtagataatttgtgcaaaaaactacctggtagcatggatgagccgcacgaacgagccaagggttacatccagatagaagaaatgtccaaattctggaatgaagtctaccaagtcaaacaaaagtgtgaaaggtggaaagcaaacaccaagacctacttgcacaagtcagacaagaggcacaagctagacaagtgccaacctctctccaaaaggcccggtatgagcgttagatacccttga

SEQ ID NO: 8845 - DNA, 861 bp, Glycine max
  Peptide Sequence Number=SeqID_125623
atgggtgcagcggctcaaattctcgcgcgcaaccgcactcagggtgatgctggcacggctgcttttgttaaaattattaacaaagcgccgccagcagccgctgccgcgtatcgatctggtgctgagcgtgccgctgcatcgccgccgcgcctggcagcgcggcatgtgctcagcgcccgcgcccggaaaagcaatctgcgtggcgcgtttcgccttgaaatggcggtgcgcggacgccacatcctgcttatcgatgatgtggtgaccaccggcagcacgcgtacacataggatgcctgtgccgtaccttgtagagcgtcggcgttgggcgtattataaccaggaagatggcacccagattcgcgtattcgttattaacccgggtacgccaaccgccgagtgcggcgtctcctactgccccccggacgcggtcgaagccaccgataccgaactgaagttcgacaagctgtctgcgtatgtcgatgagctgagcgcgccgtacctcgaagatgcggagatcgacttcgtgactgataacctcggttcacagctgacgctgaaagcgccgaacgccaagatgcgtaaagtgtcggacgatgcaccgatggttgagcgcgtggagtatctgctgcaggcgcagatcaacccgcagctggccagccacggcgggcgcgtctcgctgatggagatcaccgacgagggctatgccattctgcagttcggcggcggctgtaacggttgctcgatgattgacgtgacgctgaaagacggcattgagaaagagctgctggccgccttcccggaactgaaaggcgtgcgcgatctcaccgagcatcagcgcggcgagcactcctactactga

SEQ ID NO: 8846 - DNA, 1755 bp, Glycine max
  Peptide Sequence Number=SeqID_125624
ccggtgctggtgatgtgctatcacggcaacagcagtaaaggcgcggcgcagttcctgttaagccagggctttagcgacgtctacagcatcgacggcggtcgccatcggcagcctctgattgaccgattaaaggaaggagagcaccgcatgatgcgcatcacccagtttaaccagccgcgtatggcgcaggcgtttgtcgattacatggcgacgcgcggcgtcacgctgcgtattgagcgcgaaagccactatgtcattgtgctggatgacgacagcaagctggagatggtcgaaaacgaactcgcgcagttcgtgcgcgatcccaaccatccacgctatcaggcggcgagctggcacagcggtaccaccgacagcggtctgcgttatgagcgtggcaatatctgggcaaacattcgcgaacgcgcgggcccgctcacgctgaccatcatgatcgcctgcgtggcggtgtttatcctgatgcagatcgtcggcgacgatgtgccacgcgctgctgcacttctcgctgctgcacattctgttcaacctgatgtggtggtggtatctcggtggtgcggtagagaagcgcctcggcagcggcaagctgttcgttatcatgctgattcagcgctgctgagcggctggatgcaggcgaaattcaccggtgtgctgtttggcgggctgtccggcgtggtctatgcgctgatgggctactgctggctgcgcggcaagcgcgatcccgaaagtggcatttatctcgagcgcggcctgattggcttcgctattgtatggctggtgattggctggtacggcgcctttggcctgtcgatcgcgaacgctgcgcacgtcaccggtttgctggagagagatgtgaagcagacgcaacgtcatgacgccattatcgatctggtccggcgtcaggggtatgtcagtacggaagagctggtggatcactttgaggtcagcccgcagactatccggcgcgatctgaacgatctggccgatcaaaacaaaattcagcgtcatcacggcggcgcggcgctgccttccagctcggaaaacaccgcgtggcaggatcgcaaaatgatgtggtcggcggaaaaggcacgcatcgccgagcgcgtggcgagccagatcccggacggagccacgctgtttattgatatcggcaccacgccggaagcggtggcgcatgcgctgctcaaccataacaatctgcgtattgtcaccaacaacctcaacgtggcgattttgctgatggccaaaccggatttccgcgtgatcatcgccggcggagaagtgcgcacgcgcgacggtggtatcatgggggaagccacgctcgattttatctctcagttccggctcgattacggcattctcggcatcagcggtattgatatggacggttcgctgctggagttcgactatcacgaagtgcgcaccaaacgcgccattatcgagaactcgcgctgcgtgatgctggtggtggatcactcgaagtttggccgtaacgccatggttaaccttggcaacatgagcctgattgattacctgtgcgcatcaatgcgcacctgtgatgcaccaggtcatcgcgcttattgtaaggtcgccattgatggcgaccaggccgcagcggcacgccttttttcactgcttcttcatttccctgtcgcttttttcagcgtccgcggcttaacttactctttcagatttgcgcttgcccgtgtttaccgtttcggatgcaaagggatgcactat

SEQ ID NO: 8847 - DNA, 273 bp, Glycine max
  Peptide Sequence Number=SeqID_125625
atgaagggtagagttaacctagggttagaaggtgagagtatggtgttgacttatgagaaaggttgggctgtgccagagagaaaaacaaatgaccaaagtgaacaaaaagtcatttctagggatttgatttgggcaagattggatgaggggaagtgtggttttcgaaatctgcactttatgcagaattttgctgtgaaattgtgcagcagaattttgcataagtgcagaaaaatactatgttttgctggttgtggaaagagtagtgcagaatga

SEQ ID NO: 8848 - DNA, 4335 bp, Glycine max
  Peptide Sequence Number=SeqID_125626
atggagaatgatagcagcttacgagtaagttcttcgattaggagagatgcaagtgacattttttctccgtcctcatttgaagaggacgatgaagaagctctaaaatgggctgcacttgacaagctccctacttacaatcgtttaaagaaaggcttgttaatcacatccaatggtgaggtgaatgaaattgacgtcacggatatgggaacacagagaagaaaggaagtgttggagaggttggtaagagatgctgaagaagacaatgaaaaatttctgttgaagctgagggaaagaattgatagagttggggttagcattccaacaattgaagccaggtttgagcatctgaatgttgaggcagaagcttatgttggcagcagagccttacccacatttttcaacttcattgttaatacagtagagagttatttgaattatctacatattctttcaagcaaaaagaagcatgtgaccattcttaaagatgttagtggaattgtaaaaccttgtaggatgacattgcttttgggtcctccaagttctggaaaaaccacactccttttggctctggcaggaaagcttgatccagatcttaaggtttctgggagagtgacatataacgggcatggaatgaatgaatttgtaccccagagaactgctgcctatattagccaggatgatgttcatattggagaaatgactgtaagggaaaccttggctttctctgcaaggtgccaaggggttggatcacgttatgacatgctatctgaactgtcaagaagagagatagtgacggatattaagcctgaccctaatattgatatctacatgaaggcaatagcatctgaaggccaggaagcaaaccagatgatgacagaatatgtacttaagatcttggggctggaaatgtgtgctgatattgtggtaggggatgaaatgttgcgtggtatatctgggggacaaaggaagcgtgttaccacaggggagatgttggttggtccaacaaatgcactattcatggatgaaatatcttctggcttggacagctcttcaactgttcaaattatcaagtgtctcagacaaatggttcacattcttgatggaacagcggttatctcactattgcaaccagagccagagacgtatgaactttttgatgacattatcctcctctctgatggccaaatagtataccaaggacctcgtgaattcgtccttgaattttttgaatctaagggtttcagatgtcctgagaggaaagctgtcgctgacttccttcaagaagtgacttcaaggaaggatcaacaacagtactggatacacaaagatgagccatacagttttgtttcagttaacgaatttgccgaggcatttcgatgcttccatgttggtaggaagcttggagacgaactagcagttccatttgataagacaaagaaccacccagctgcattaactactaagaagtacggggtaaacaagaaggagcttctgaaagctaacttctcaagggagtatttgctaatgaagaggaatgcatttgtttacatcttcaagctgtctcaacttgcactgatggcagtggtagcaatgacagtattcctgcgaactgagatgcacaaggattctgtggataacgggggagtttacaccggtgctctttttttctctatagtaatgatcttgtttaatggaatggctgatatttctatgacggtagcaaagcttcctatattttacaagcaaagggaccttctattttaccctgcatgggcatatgctattcccggctggatcctgaaaatacctattacattggctgaagtagttgtctgggtatctatcacctactatgtaattggatttgacccaagtgttgctaggtttttcaaacaatatcttctgttgttactacttggccagatggcttctgcattgtttcgtacaattgcggcaattggtaggaatatgattattgctaacacatttggatcatttgcaatagtcacacttctgacgttgggcggtttcatattgtcaagagaggatgttaagaaatggtggatatggggttattggatttcacctataatgtatgagcagaatgctatgatggtcaatgagttcctcgggcagagttggagtcatgttcttcccaattcaactgaatcactgggagttgaggttcttaagtcccgtgggttcttcacacatgcatcctggtattggataggggctggcgcattgcttggatttgttgttctattgaacatcacattcactctagctctcacttatctaaacccacctgagatgtcacgggctgtcatcttcaaagaatctcatggcaataggaataaagacagaacactagatgatattcgattatcactcagattaacagggaatgccccaagtagcaacctagagatagggaacttagatgataatgggacagaaagtatgtcttccaggtctgcatcagtgaggccaaaggctgctgttgagtcaagccacagaaggaaaagaggaatggttcttccatttgaaccacattcacttacctttgatggaatcacttactcagtagacatgccacaggaaatgaagaatcagggtgtagttgaggacagattggtccttctgaagggtgttagtggtgcatttaggccaggtgttctcacagctctgatgggtgtgagtggagcaggtaaaacaactttgatggatgtgttggctggaaggaaaactggagggtacattgaggggagcatcacaatttcagggtaccctaaaaatcaagaaacatatgctcaaatctctggctattgtgagcagaacgatatccactctcctcatgttacaatctatgaatccttgctctactcagcatggcttcgtttatcgcctgaagtcaattctgaaaccagaaagatgttcattgaggaggtcatggagctggtggagttgaacttactgagggaagctttggttggtttacctggtgtgagcggtctctccaccgaacagcgcaagagactaactatagcagttgagctagtggctaatccctccataatattcatggatgagccaatatctgggttagatgccagagctgctgcaatagttatgaggacagtcagaaacatagtggacacaggaagaacaattgtttgtaccatccatcaaccaagcatagacatatttgaagcttttgatgagcgaggaggacgagaaatatatgttgggccattgggtcgccattctaaccacctcgttgagtattttgagcagaggattgaaggggttggtaaaatcaaagatggacataacccagcagcttggatgttggaaattacaactccggcacgagaaatggatttgaatgttgacttttctgatatatacaaaaattcagtactatgtaggaacaaagcacttgtagcagaattgagcaagcctgctccaggttccaaggaacttcattttcctacacaatatgcacaaccatttttcgttcaatgcaaggcctgcctatggaaacaacattggtcctactggcgcaaccctccatatactgcagtgagatttttgttcactacattcgtagctttgatgtttgggacaatgttctgggacctaggatccaaaacgaaacaagatctgttcaatgctattggttccatgtacaatgccattctcttccttgggatccagaatgccctttctgtgcaaccagtggtggccattgaacgaacagtcttttatagagaaagagcagctggaatgtattcagccatcccctatgctcttgctcaggttgtaatagagctaccatatatttttgtccaagctgtaacatatggcatcatagtttatgcgatgatcggattcgaatggactgcttcgaaattcttttggtatctgttcttcatgtacttcacatttctatactttaccttttatggcatgatgactgtggccgtaacaccaaaccaacacattgcttcaattgtggctactgcattctatggaatttggaatctgttttcgggatttgttgtgccacgacctagcattcctgtgtggtggagatggtactattgggcatgtcctgtggcttggagcttatatggattggttgcatcacagtttggggatataacaagtgcagttgagttaaatgagactgtgaaagagtttcttagaagatactttggttatagagatgattttgtaggagttgctgcgtgtgtagttgttgggtttgcagtgctatttgctactatctttgctttttctctaaaggtcttcaattttgaaaggcgatag

SEQ ID NO: 8849 - DNA, 2275 bp, Glycine max
  Peptide Sequence Number=SeqID_125627
atggctgaagctgaagattatgggttcctcccagaggaaatggcggtgaatgaaaaccttggctaccctaaagctttcgctaaactctgccgtgaccgcggtttcggtccctacagccatggccctcccttttccttcatcccttatgctttgtcagaagatgaggctgagacagccaaagatttggatgagatatttccgattattgatccgaaagctaaggcgaccagcaagccgaaaatctttgtcagtgtcttgtggaagcagctccgccatcttgggaatgctggctttgaccctgcagtgattcgggtggatggttatggcaatgtgctctattatcatgctgactcagcctctcctctggcttgggatgttgatcactggtttccttgttcaaggggaggtttgactgttcttagcaatctaaggttattacagcggcaagcctgtaagaggaagaaaaacaagctggaattcttggtgccatggtgggatttccaattggggatctctgtgaaccagttcctgatgatgatagttgtatttgcaacttgcaggcacagagccttttcatttttgttctatgaaggagaaaatcaagaattgaatgcttcacaaatagtggattctcattcttttccacaacactttttcgcgctaaaagaagaggtaggcctggctcctgcttcaattgttgaatctcgaagggaaccttgcgatgcattagctttgagacaacttgattacaataagaagccaatgcccatgtctcctgcaatagtagctgcaaggaaaaggaatggcagtctcctgaaagaaaatgaagatccagactttgtgaaaaacccctaccaagcaattgtcatggctagagattccctgaagcaaagagaggaaactacaaaaaagcaagctgaaatacagaagctagatgatgaagtgaatgaaatgaagctcaaaaatgaggaagaaaaactcactattcaagacctggaaatggcacttataaaacgtaggaggaaggcagaaaagtgcagacggttagctgaggctcaatcttcttacaggactatgctagagaagatgatcagagacactatgcaccatgtcatttataaggaacaggtaaggttgaaccaggctgcaagtaatgcactaatggctagacttgaagcacagagggcaatttgtgatgctgcagagaaagatcttcacaagaaatacaaacaaagagatgacatagagaaacagattagacctgaatgggagcaaggaaggaagaggtcaagaatagatgatgccacctatgaagagagagacagtaaacctgctctttatttgcctgggccaagaccaagaacacctttgcgcaaggagctcagagtgtttttagaggaggaacaaaggtcatccgaagttgacttatctgcaaacgaagagcaaaagcgggaagaaaaagtagagcaaaagcgggaagaaaaagtagagcaaaagcaggaagaaaaagtagagaagctgaaaatgccagctaataatgacccagaagagaagcttgaggagcataccagatcaagtgttgcattggatgaagaaaactcaattgagcaaagacttcagaagctcaaaatcagcgaaggcaagaggagttatggcatttcattctcaggtcttcataagacagaaattgaggaagatgaagaaaccagaaagcaacgtggaaaagggaatgtcgagaagtggcttcaaatgcttttagagaatggtcaacaacaagaaggaactgatccacaagaaacaagtgaaaatgcttcttgtggcactgaagaaaaaataatccaacaactgaatcagaagttcccacaaaaggagttgaagatctcaaaagtttcagattctgattataaagagaagcagctgcaacttcttcaagacaggaacggatggacagagaaagaggatagaatagaaaacgaagctagaaatattattccgacaggatacaaaaattactctggagaagcttgcataggtgaaggaaattgcactcctaatgttgaagggatggaaagaaaggaacaacataaaaaggaaaaaagacttcctagatcagagagtgctaggagcttgagacgaattccatcatctccatctttgcttcttgggatcaaaaaaggtgtggactacatttggaagaagccaacggcaagtgatgatgccgatcttgcagcatcaaacagtttcttgaggtcatccatcaagacaatcaagaaag

SEQ ID NO: 8850 - DNA, 378 bp, Glycine max
  Peptide Sequence Number=SeqID_125628
atggctagtgccatggccatatactcggcctctgaagatgacttggagactgtgggttgcttaacttcttgcttttctaggatactagagagggtacaaagaaaaggcagtaacattctagagtctttaagtatgtccaaggcatacttgctttggtataaggcaattccttccttagatctgaccacctcgaatcctaaaaagaatgagttggcctatatctttaatgatgaactgctgatccaaataggatttaattgcactgatttcaacaaggttgtctcttgccaagagcaaatcatttgcataaaccaagataaaaatagaccaagatgcagagattttagtgaacaaggaataatctgccttggacggtga

SEQ ID NO: 8851 - DNA, 458 bp, Glycine max
  Peptide Sequence Number=SeqID_125629
atggttagggttgatgccacttatagagttgagcttgagaaccgcatttcgtggcagctagaccaagcttctctcaaagagctcatgataccctccttcagccacacttgtgggactctcttggatgtggccaagttggttgattgctacctcgatgaggccgctgtggatgccaatttgaccttgtctgagttcattacacttgctggagctcttccaagccatgcaagagccgccgccgatggcttgtaccgagccatcgacacttatctaaaagtgctcttctctgagcaaaccaaactccactgccacatagattggagtggctccttcaatagcttgaggagcccgaatggaggcctcgacccaccaggacgatgcctttcaaagcgtgaaatgaatgctcagcaaatggagataaagaagctgaaggaagatgtttacaggctgcaaagcca

SEQ ID NO: 8852 - DNA, 1526 bp, Glycine max
  Peptide Sequence Number=SeqID_125630
aggaggagccgcgtgacgaaggacaacaaggaggttctgtcgagcaaagcccagagcaactggtggcccgtgccatagcccccgtcaagaaggatttcctccgtcctcctcccgttcgctcttcctctccaaacgacggcgtttccattcccaatgataacaacaagacctctgttctcgccaaggagaagaagtccaagcgccaactcaaacgcgaacgtcgtctggaacaaaagtcagcacgaaacctgtgtcccgaaattgccaaaacaggggatgttagttcatgtccttataaagacaagtgtcgtttcagccatgatttggaagccttcaaggcacagaaacctgctgatctagaggggcaatgtcctttctttaaatctggaggcgcttgcccatatggtttagggtgtagattttcgagtacgcatgaagatggtgtgccttctgccaatctgaatggtcttaagaataattccgaggtgaatgggttgagcaaacatgttcaaaagcttttgtggaaaaataagatgagcttctccaaggcagatgcccaactcaaaagtctaggcctcgtgggaacctctaagtcaaaaaggaatgacttggaaaataaagatgaaggtgacactggttcaaataagtgtgatcattctgattacagtggatcttgtgttgttacctccgactcatgttgtaagttggaatgccctgaagaagttatgaaagatgatgacaatgacatagatggaaaatctgaatctgatgtactttgcccccagaagagaagaaaaattgcagaaaattgtggtcctatggatgcagaaaatgaaggtcatcgcttcatcttcgactctatatgtgtaacttggcttcatactgctgaaacaggtgttagtgttactgagcaaattgttgaaagaagttgcacaaaatctgaacccgaagctggaaccgatgctctaaccccagaaactgatctaagcctgaagctgcactcacgtgaaaagaagctgattgattttagggagaagttgtatctcgcacccttgaccactgttggcaatctccctttccgaagagtttgcaaagtattaggagctgatgtaacttgtggtgaaatggcaatgtgcacaaatcttttgcagggtcaagcctctgaatgggcattgctaagacgtcattcatctgaagatttatttggtgtacaaatctgtggggcatatcctgatactgtggcacgaacagttgaactaatagagcaagagtgtacaatagattttattgatataaatatgggttgtcctattgacattgttgtgaataagggtgctggatcagctcttctaacaaaaccaatgcggatgaaaagtattgtagaagttgcttcaggcacagcggaaaaaccaataactatcaaggtatttgctgtgctaaacactacagagttggacacaatgatttatgtcactcccattaacatcttaatagcttactctctgtcttcctctgttttttggtaa

SEQ ID NO: 8853 - DNA, 486 bp, Glycine max
  Peptide Sequence Number=SeqID_125631
atggttgctcgtggtgcactgattaaagttagtatcaccctggttcaactgaccattctcatttattttagtttgtcattgagtattatgtctcatccttggatatttactgagatcaaggaacagagacattgggacatcagttctggcgagcgtctaaatattctcaaagattttgtgaattttggtcttgaacactggggttctgacacaaaaggggttgagacaacaaggcggttcttgttggaatggcttagctacactttcaggtatatacctgttggtcttttggatgtggttccacaacgattaaactggcgtccaccatcttactatgggcgtgatgagcttgagacactaatggcctcagactctgctgccgattggatacgaatatcagagatgctacttggcaaggttccagatggctttacatttgctcctaagcataaatcaaatgcttacgatagagctgaaaatggttga

SEQ ID NO: 8854 - DNA, 1941 bp, Glycine max
  Peptide Sequence Number=SeqID_125632
atggcggcaaggggagggcagtgcttcgagaagcttcggaggttcgttcggacggtattcttcgtggcggcattggtggcgtcgctgctcgtgacgtcgctgccggtgctggtcgccgtcatggacgtgctcgtcccctgcgttttgatttcgaacttcacgtgcgtcaagtgctacggcttcaaggagcatttgcgtcgttacgctttcaagagctccttgacggatattcctctcgtctcggtcatcagatccttcatcataatctgtgtttattccatttgtgatagcccggctctatcacatggtccttaccttggaactgtgactctgtcttcctttgtttcaattgttctcctttcagtcaaagcttgtgttttcactgtaaactcccagattgaagcagaagctacggtttcctctacaaggcagagactccatttaaagaagtcatggggaatgcctgtcttgttcctctcgtcagttgcgtttgctcttggccatattgtggttgcttatagaaccagctgcagagcaaggaggaaactcatgtttcatcgagttgaccctgaagcggtccttttatgcaaaagtgtttttactggctatcagaaggtccctcggtctcctgttccctctgaagggagaaccccaaaaagtgacagtgaaatgaaacggaggccttttggagcagctcgtgatgaagaactgccaatcagagtacttgcagactcggagagcttattcatcccatgccaaggtcttactctccattacaagctcagcctgcctggttcccctccacttaacatgtcctccgcattttgctccacttcatcaatggctggggggttgccaaaattaaatagacaattgacttttatatctccaaaagtccatcggcaactctacaggagctatagcaatcaattccatggctcatctttatatgctcctcttttagatggtccagtaacttctccccatcttgtggaagaaatccctgttttgcatctagatgaaattcctgaagatgatgaaacatataaatcaaagttggagcaaaatttagaggacattggccaagtaggtattgttttaatacacgggtttggtggaggcgtcttctcttggcgacatgtaatgacacctctagctcggcagagtaattgcacagttgctgcatttgataggcctggttggggattgacttcaagactgagtcgggaggactgggagaaaaaagaactgcctaatccttataaactcgaaagtcaggttgatctgcttttgtctttctgttccgagattggactttcttcagttgtgctaattggtcatgatgatggagggttgcttgctctgatggctgcacagagagttcaatcatcaatgaattctttcaatgttacagtgaaaggggttgtattgttaaatgtgagcttgtcaagggaagtagttccttcctttgctagaatccttctgcatacttcacttggaaagaaacatttggttcgtccactactaagaacagaaatcacccatgtggtgaatcggcgctcgtggtatgacgctaccaaactgacaacagaagttttgactctatataaggctccactatatgtagaaggatgggatgaagcacttcatgagattggtaaattgtcatcggaaactatcctttctgcaaaaaatgcagacttattgctacaagctgtaaaagacattccaatgttggtcatagctggtgctgaagattcacttgtctcgatgaaatattgtcaagcaatggcctccaaatttgtaaactctagactggttgcaatatccggatgtggccatctaccccacgaggagtgtccaaaggcgttgcttgaggctatatcacccttcattaatgataaactcttcttctctgtatataactcgcaaagccaataa

SEQ ID NO: 8855 - DNA, 138 bp, Glycine max
  Peptide Sequence Number=SeqID_125633
atggttgctgtaaagcatatagcaaaggggaccatgccaacacattacacatatacttactggtccaaggctctaagctatgtgcgtgttacctgcggtgtagttaagcttcttgctggctacggcaaatttgcttga

SEQ ID NO: 8856 - DNA, 249 bp, Glycine max
  Peptide Sequence Number=SeqID_125634
atgagggttcactgtaatcaagcaagtcagagacctagcatgatcacagattcacctccactccttatgttcccacgaacccggtccccagtggagtcgccaattgtcgcaacctaccctttggtgggagggcgatgcgagactcatgggtgcatcttccaaggaaggaaaacgcgcggagtcgccaccaacgtttatttgaggaaaacgtcggaaaaaccggaaaaagacgtggtctacgaactttaa

SEQ ID NO: 8857 - DNA, 507 bp, Glycine max
  Peptide Sequence Number=SeqID_125635
atgtcacgaaatgttcgccgaggtggacaaatatgggtacgcatatttccagacaaaccggttacagtaagacctactgaaaacacgtatgggttcaggaaaaggttctcccgaatattggctgataatagcggagcacgcgaactgatgtgtattcgaatcctaggagctagtaatcgacgatatgcttatattggtgacattgttgttgctgtaatcaaacaagcagtaccaaatacgaacttagaaagatcagaagtgatcagagctgtaattgtacgtacttgtaaagaactcaaacgtagcaacggtataataattcagtatgatgataatgctgcagttgtcattgatcaagaaggaaatccaaaaggaactcgaatcttttgtgcaatcgcccgggaattgagacagttaaatttcactaaaaatagtttcattagcacccaaggtattataagacgaaactgtgctatggatacattatttttttgtgaaatagattaa

SEQ ID NO: 8858 - DNA, 132 bp, Glycine max
  Peptide Sequence Number=SeqID_125636
atgcggaaattgattaaggaaaggatggaaaataaggtggctaatttcgtgggtcttaataaggttaagtggtggctggacagaaatatagaaatggcaataactgaagctacagggctccaaatgaggtga

SEQ ID NO: 8859 - DNA, 183 bp, Glycine max
  Peptide Sequence Number=SeqID_125637
atgggtaaacgaccacaattgactgatgaactgagagtattgagttcaatgaatggacccactatgattccatccggtgaagagctggaaaaatcatatgctggggtagacatgctgaaattccttgttgatttgtttcataaaaatttgtttcagctcaatcgtgctccgtgggttatatga

SEQ ID NO: 8860 - DNA, 103 bp, Glycine max
  Peptide Sequence Number=SeqID_125638
atgaccatactagcagactatcaaggaagtgtgaatctcaaagtccagaatatgaaatttgtagagtcagcatctccaaaagcaagcatccaaacaaccaaat

SEQ ID NO: 8861 - DNA, 264 bp, Glycine max
  Peptide Sequence Number=SeqID_125639
atgcatcctccaccatcgagtccggagccccctcgaattgattgtcattcatgcatcctccaccatcaagtcggagccccacgaattgattgcctagcgctgttcgtgcatcctccaccatcttattcgaagccccatgtattgattgtcattcatgcgtcctccgttatcaagtacggagccttcgagaaagaagaaggagagacgggagtcacttatttcaaattgttttgggttgagactattgtgattgagatcaattaa

SEQ ID NO: 8862 - DNA, 364 bp, Glycine max
  Peptide Sequence Number=SeqID_125640
atgggtggtggtgcatggccgttcttagttggtgaagcgatttgtctgatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgaacctgcggaaggatcattgtcgatgcctcacaatcagattgacccgcgaacttgtttattcatctaccgtcgggagggaggggatgaccacggcgccccgtgcgcccggcctcctcgtcttcgcgacaaacacaaaccccggcgcttcgtgcgccaaggaactcaaa

SEQ ID NO: 8863 - DNA, 249 bp, Glycine max
  Peptide Sequence Number=SeqID_125641
atgggtgatgggtgtatttatgaagaggcagagagagacagaagcagagggttcatgtggagtgtgggggcaaagggtagcccacgggtgttttggggtatgtgtatttgtgtaaggacatggtgggaacaaaaccactggtcttcactgttctatgttggtcctcccaatgccaacgttgacatggacccaatctcacaccctcactctcactgctcacaaatagatcaactacattcacctttataa

SEQ ID NO: 8864 - DNA, 519 bp, Glycine max
  Peptide Sequence Number=SeqID_125642
atgtggcggagactcttctcttcttcaaacctcaaatccctacacacagcactctctccttctcgtccccgactcgccgcccctctcctcacccgccacgtgaccgctcattcaggtgcttcttccgtcaaaaggagggttgaagatgtcgtgccaattgctaccggccacgagcgtgaggagattcaggctgatcttgagggaagggatattcttgaaataaaccatcccgtcggcccttttggcacaaaggaaacaggcaccaacacaatgtataaaattggcataatctctacacctaaagtcattcacgaagcacctgctgttgttaaatcttactttgacagaaggatagttggatgcccaggagatgaaggcgaagatgagcatgatgttgtctggttttggctggagaaaggcaagcctaaagaatgtccagtgtgctcacagtattttaagctcgaagtggtcggacctggtggtgatccttatggacatggagatcatgatcaccattga

SEQ ID NO: 8865 - DNA, 1488 bp, Glycine max
  Peptide Sequence Number=SeqID_125643
atggtaagtgagtttaatgttcctgaagaaggagacccaacaatggaaaagtaccaatttcattggctgtatgcaaatggattgctgggtattatattcacctttggccttctctatacttctttgaaaagcagaagagcaaggtcatggttatatgggacagggtggttcagaagtttcattgcagactatggagtgcctttcatggtggtcgtgtggacagctctatcattcatagtaccaagtaaagtgccttctggagttccaagaaggctcacttctcctcttgcttgggaatctacatctttacatcattggacagtaatcaaagatatgggggaggtttctctggcatatatttttgctgcttttattcccgccttaatgatagcggggctttacttctttgaccatagtgttgcttcccagatggcacagcagaaggaattcaatctcaggaaaccttctgcataccactatgacatattgttgctaggattaacgacattgctttgtggattaattggcttacccccttcaaatggagttctgcctcaatcccccatgcacaccaagagcctggctgttctcaagaaacagttgatccgaagaaagatggttaaaagtgccaaggaaagcataaggcagaaagctagcaagtctgaaatatatgggaagatgcaagcagtgtttatagaaatggatagctgtccagataatcatttagtggtcaaagagttagaggatttgaaagaggttgtcctaaacggtgaagacaaagggctcaacaataagagtacctttgatcctgagaaacacattgatgcatatttgcctgtcagagtcaaggagcagagagtgagcaatcttttacaatcactcctagttggagcatcagtgtttgctatgcctgccataaaaaagataccaacttcagttctctggggatattttgcttacatggccattgatagtcttccaggaaatcaattctgggaaaggatcctacttctttttgtaacacctagtaggtggtacaagttgctagaaggggatcatgcttcctttgttgagtcggtaccttacaaatacatagtcttcttcacactcttccaatgtgtatatttcttggtttgttttggagtgacatggattcccatagctggaatactgttccccttgcctttctttttgctgatcacattgaggcagcatatactccccaagctgttcaagcctcaccatcttagggaacttgacgcggctgaatatgaagaaatagttggtgctccagcactaagtttcaataaatctttcagggaagtggaatcacccctagttggatcaaaggaaataggcaatgcggaaatattagatgagttaactactaatagaggggagttgaaggtcagaactgtcagctttggtgaagaaagaaattgccaggtttaccctgatgaaaatggatcgccactcacagatttttag

SEQ ID NO: 8866 - DNA, 624 bp, Glycine max
  Peptide Sequence Number=SeqID_125644
atgagttgcttttcgtgctttgtttctcgtgggaaagatgtgagaagggttgaaattgacaatggctctcgatctgctacttcttcttctgaggggaaggggaagaagagtgtgagtaacaaaggaactagtacggcagcggctagttttggttttcgcgaactcgcagaggcaacgaggggtttcaaggaagtgaacttacttggggaaggtggttttggaagggtttacaagggtcgtctttcaacgggagagtatgttgccgttaaacaattgattcatgatggtaggcaaggttttcatgagtttgtgacggaggttcttatgttgagcctgctgcacgattctaatcttgtcaagttaattggctactgcactgatggagatcaaaggcttttggtttacgagtacatgcccatgggttcactcgaagaccatctttttgaattccttggatctgtaattgagactccgtccactactgcaactgctatgggtcttgtggttgtggcatgtgtcatacatcctcttgtcatctttgacttcgcaatagcggctatcttgctttttgctactcacttcagtggttttggggtctgctacatgccgctatttgggatttga

SEQ ID NO: 8867 - DNA, 1104 bp, Glycine max
  Peptide Sequence Number=SeqID_125645
atgggaaactgtttcagaaagaccaccaataatccacgcccttctcccccagtatctgcgaccagaaacttcagaccagacacgaatcttataaattacacgttggatgagttgaaaagtgcgaccagaaacttcagaccagacacggtcctaggcgagggtggttttggacgtgttttcaaagggtggattgataagaacaccttcaagccctcaagagttggtgttggaatccccgtggctgtgaagaagtctaaccccgatagcctccagggtctacaagaatggcagagtgaagtgcaatttttggggaaattctctcatccaaacctggttaaacttattggctactgttgggaggaaaatcacttcctactcgtatacgaatacatgcaaaagggaagccttgaaagccacctcttcagaagtggcccagaacctctttcatgggatataagactcaagatagccataggagccgccagaggtctagctttcttgcacacatcagaagagtctgtcatctatagagacttcaagtcctctaacattttgcttgatggggattttaatgcgaaactatcagactttgggttggcaaagtttggccccgtcaatggaatatctcacgtaaccacgcgggttatgggcacctatggttacgcagccccagaatacatggctacaggtcatctctatgttaaaagtgatgtatatggatttggcgttgttctgctagaaatgctaacaggtagggcagctctagacacaaatcagcccgcgggtatgcagaatttggtggagtgcactatgtcatgtctacatgacaaaaagagactgaaagagataatagacccaaggatgaacgagcaatattcattaagggctgcatttcaaatagctcaacttgttttaaaatgtttagaaactgacccaaagaaacgaccgtctacaaaagaggttttgggaaccctagaaaaagctcgagccataaaatacaaacccaaaggaaagaaagtctgtcaaacaagtcagcgtcggtcaccatcgattcattacaacaatggctaccccaaatcacgaactaattctcctccacaataa

SEQ ID NO: 8868 - DNA, 627 bp, Glycine max
  Peptide Sequence Number=SeqID_125646
atgggcgaaattttgggtcttgaggtggcggagggcctggggaactacattccaactcctatccatttgatggaggccaagaaggaatatgaagtggaccatctgaccacacccaccgggaccagtttctctcagttactattcggagatcacgacgacgattacgatgaatgtgcattgggactagctgtggaccagtcttacacccgttcaccttttttctcaattcacaaggcaccccaactgctttgttttgccaaccatcaataccaaggtgacgttttgcttcctgaaaccaacgtaacccctcaaaatctgtcatcacttctagtgacccctcttctgctagcacttcctcctgcaaccacaccaacaccgccttcaattccttacctaagtctaatgaaggaaaagctcggggaacgaattgcagcgttacaacagcttgtttctccctttggcaagacagatacaacatcagtgcttcacgaggccatcggttatataagatttcttcatgaccaagttccggtcctatgctctccttacttggaaagttctccttcctcgtaccatcaaaatcagcatgtgagtccaatcccatctttcatcaaaatcagcatgtga

SEQ ID NO: 8869 - DNA, 684 bp, Glycine max
  Peptide Sequence Number=SeqID_125647
atgcagataaaatggatttgcccaactgctcctacccgtcctgtggcgatacttggtggttttccctgcactgcatggtttgatgtgggagaactttcagaagatggtccagatgattgggagggtttagatgcctcagcagcacacattgctaacttgttgtccacagagccagctgatgtgaaagttggtattggaggcttcagcatgggtgcagcaatagctctgtactcttcaacttgttttgccatgggaaggtatggaaatggcattccataccctctcaacttaagaacagtggttggactaagtggttggcttcccggatcaaggagcttaaggaacaagatagaagtgtcacatgaagcaagaaggcgagcagcttcattacccattttgctgtgccatggaatcagtgatgatgtagtcctttgcaaatacggagaaaaatctgctcaatccttatgttcagcagggtttcgatatgttgcattcaaatcttatgatgggcttggtcattacacagttcctagagaaatggatgaggtttgcacttggcttagttcaaggctgggacttgaaggtgcggtgaaagaacgagctgcaattcccttgaaaaggatgttggacaatgatgttgccatgctttcgatcaactatgcagcagcaagcaataacgtttga

SEQ ID NO: 8870 - DNA, 564 bp, Glycine max
  Peptide Sequence Number=SeqID_125648
atggcagcacctcaactttcaggtgactggtattgtggtgcagctaactgtggtgcacacaattttgctagccgttcaagcttcttcgagtgtgctgctgtcaataatgactcagctgctgacacctcacgctcaagagcctttggaggcgctgggactgcatggaaatctggtgattggatattcaatcggtcagaaggttctgaagaggttaaatcttcaggtttgacaagtgagcttattcctaatcttattgagccagtagacccaataccttcttctgggtccatccagagattcctaaacaaagctgctgatgaaggcttggtaataattcagtctccaaaggggaggcgtgctccaccatcatgtaaagagaaacaaaatgttgaggaggggcaagtgatttgttatattgaacagcttggtggtgagctgccaattgagtctgatgtgtcgggagaggtcatcaagatcctacaaaaggacggcgatcctgttggatatggtgacgcacttgttgcaatattgccatcatttcctggaataaagaagcttcaatag

SEQ ID NO: 8871 - DNA, 273 bp, Glycine max
  Peptide Sequence Number=SeqID_125649
atggcaacatcattgtccaacatccttttcaagggaattgcagctcgttctttcaccgcacctgttagtttcatctcattccacccaagttggaggggaagaaaaggagagtatttggtggaatggaatagattccattccatcagtaactggccaacatttccacaagttttcattaagggggagtttattggtggatcagatattgttcttaatatgcatcagacgggtgaattgaaggaaaagcttaaagatattatgtccaagcagtaa

SEQ ID NO: 8872 - DNA, 462 bp, Glycine max
  Peptide Sequence Number=SeqID_125650
atggacgcagaagaagcacaaaaacaattaacacattataatttcaaggaagcagaattgtcagataagaataagttggtggtgaagaagacagaaatgtgcaggagattcaggaggggcgtgtccgttcacggacgcacctctcatttccttcattcatccacactactcccaaacccatacagactgaaagaagacaagcaagcttggtcacaagtagggaaacttcgctactcttctccagaatccaagagaatgcgaacttctgcagctgctccaagtgatggctgctgttatgcagaacaatggataatgcaaacttctgctgctacaaatgcctcaactagcactgtggcaactaagaatgaaccatcatgtcctgttaagctcatattcaaaaacaatgatctacaaaggatcagtggcatctatgctgagcaaactggctggactagtgaataa

SEQ ID NO: 8873 - DNA, 666 bp, Glycine max
  Peptide Sequence Number=SeqID_125651
atgcaaagatttactgttagggtagctgaattgagtcctatcactattctgagatatgcggatcaaggccaggttgcagatggaatccttcatgatgttcatttaagtgagccaactatgggagagaaacttgctgctctcagtttgccagataagaacaaattcaggagggataaagagcaagattcttctgacccaactaagcctccaagtgcagactctgtacatgttttgcttgggcaagcattaaatgctgatggtcgcacccttctgctagattgcttgtatacgcaggatgagaaggttattacaaagtcaattgcacagttgaacccatcaaacgtcctcaaattcctacaccctctcatatccattaatgagtctaggggtgcaattttggcatgtactcttccatggctaagtgtcttgttctacagcatgcaactgattgaatctagagtttggacttttgaatctgccgttcatttgtcaagttgcgtagacattcattacacaggggttgctgatgaagaagtagatgaaggtcaaacagtgccagttatctatgaggatgacagttcagaagaatccggggatttggaaactgatgaagcatttgaagtattcagtgatattgaagaaagtaacgatatgatgagcgagtga

SEQ ID NO: 8874 - DNA, 306 bp, Glycine max
  Peptide Sequence Number=SeqID_125652
atggcatcccataggcaaagctatgaagctggtcaaaccaagggccgaactgaggaaaagacgaatcagatgatgggcaataatggggagaagactcaggaaatagcccaagctgcaaaggataagacccaacaaacagcccaagctgcaaaggagaaggcccaacagaatacagacgaaggaatcggcccagtcagggaaggacaacaccaaagggttcctgcagcagacaggggagaaggtgaagggcgctgcccaaggtgctacagagactgtgaagcaaacccttggcttgggccagcatga

SEQ ID NO: 8875 - DNA, 969 bp, Glycine max
  Peptide Sequence Number=SeqID_125653
atgtcttctaaaaattttgttcaaccggttattcctcattttgatggtcactataatcattggaatggtgtggcaacaccaagtgatgacgtagttcttacatatgcacaacaaaaagagtatgaagtgatgaaattgaaagacttaaaagccaaaaattatttgtttcaagccattgatcgttctatccttgaaactattttttgcaaagatacttctaaggaaatttgggattcaatgaagaaaaaatatcaaggctcctcacgagtgaaacgtgctcaacttcaagcattgagaagagactttgaagtccttcaaatgaaagaagtacatgaacaaaagatgaacagaagttcaacaatggaggagcacgcattgaaagcttctaccaatactcattccaacaactctagaggaaggggtagaggtagaggtagaggaagaggacgtggagatcgaggaaatagagattttagcaataattccaaagacaataatgatcaatttcaaggcaatgaaaaagggaaaagttcaaattttatcgaggagaaaaaagtggaaaccttattgatggctgttgaagatgcaaaagacagcgagacaaaaatctggtatgtagagactggttgtagtaatcacatgagtggaatgatgggaaaaggtgatattaaaataaaagccaggaatggttttgtagaaacaacttctaatgtgctccatgtccctgacttgaaaagcaacttgttaagtgttggtcaattgcaagaaaaagttataaaaatgaattcaggcaggttattcccactaaagattgaaagcattcattctagtttaatggccaaagatactgtttctacttggtcgtggcattatcgttatggtcatttgagttttagtggattgaagacccttgaacaaaaaaacatggtgataggccttccacaaattactgctccttctcgtttgtga

SEQ ID NO: 8876 - DNA, 1374 bp, Glycine max
  Peptide Sequence Number=SeqID_125654
atgacatcagagaaggcatggagcggaagaaaaccaacagtggaccacttcaagatatttggatgcattgcttatgcccatattctagataagaaaatatcaaagcttgatgataaaggtgaaaaatgtatctttcttggtgttagtgatcaatcaaaagcatataaattgtataatcctgccactaaaaagatcattattagtcgtgatgttgtttttgatgaagaaagattttgggaaaataacatagatgaaacaaagcaaattcttgcaaactttgatgaagataatgaagatgaagagtttcagacaagggacctagaagaacaacgaattccagcaatcacagttgaagatgaaagacctcaacgagcaagaagaaggcttgcatggatgtctgattgtgaggtaacaggaattgaagatcccattactcattctgctttgttttcaaattgtgaccctacaacctttaaaagtgctatcaaagaagaaaaatggagaaaagtgatggatgatgaaattgattccattgaaagaaatgatacttgggagttgtgtgatcttccaaatggacataataccataagagtgaaatgggttttcaaaacaaaactgaaagaaaatggtgaaatggataaatataaggcatgcttggtggccatggcacaaaatgcagggcctatatttcaactagatgtaaagtcagcattcttacatggttatttggaggaacaggtacatggagaatcctatagaaatgcatttacttgtgctaaaagaattctttgctacttgcaaggaacaagagaatttgagttgttctataagagaggtgaaaatttcaatctgttgggattcactgatagtgattatgctggagattcagatgacaagaaaagtacttttggctatatttttatgatggggtttgcagcgatctcttggtcatcacggaagcagcccattgtcactttatccacaacaaaagcgaaatttgtagcagcttcagcatgtgcttaccaagcaatttggctaaggaatattcttgaagaagttcacttcaagcaacaaggtccaactctcatctattgtgataatagttccaccataaagttatcaaagaatcctattatgcatggaagaaacaagcacatagatggagagagcagcaagtggatagagaagagaaacccaagttcagatgatggggcaaagaagacgactgaggccactggtcagacaaagaagcctattaatgaagacatcaatgctagtgctgatgccttcatcaagaacttcaggcagcaacttctcattcaaaggctccaatccatagagaattacgatcaaatgcttgcaaggggccactag

SEQ ID NO: 8877 - DNA, 1248 bp, Glycine max
  Peptide Sequence Number=SeqID_125655
atgaagagcctcagatattgttccacttcaacatttatcattatcttcattcacataaatatacttgtcactcatgcagaaggggttgatcctgtcatccagctcccacgttccggattgaaaagaacccgaaccagatctaaatgggttctttctgtcggtgattatggtgcaaaaggggatggccttcataatgacaccgaggccttcctggaggcttggaaaatcgcttgttctctatctggatttataagtgtggtttttccatatgggaaaacttttcttgtccatccggttgacattggtgggccttgtcgatctaagatcactttgaggatctcagggacaatagttgcaccacaagatccagtagtgtggcatggtttaaatcagcgcaaatggctatacttccatggggtgaatcatcttactgtagatggtggggggaggatcaatggaatgggacaggaatggtgggccagatcttgcaagatcaactccacaaatccatgtcatcctgctccaacggccatgacttttcatagatgcaaggatctgaaagtcagaaatcttatgttgataaatagccaacgaatgcacttgtcattcactaactgtatgcggattgttgcatcccatctcaaagtgttagcacctgctttcagccctaataccgatggaatccacattagtgcaacaaagggagttgaggtcagggatagtgtaattagaacaggtgatgactgcatctcaatagttagaaattcttcacgggtctggatcagaaacatctcttgtggtcctggccatggcataagcttgggaaaatcaaagaaatgggagaaggtgcaaaatgtaattgtcgatggagtttatctttacaacactgataatggggtgagaatcaaaacgtggcagggtgggagtggttttgcctccaagatcacattccagcatatcttgatggagaacgtgtctaatccaataatagtagatcagtactactgtgattcacgaaatccatgcaaaaatgaggaacttcagccactgaagaagcaatcaaattttcctgtagtgatgcctttccatgtgaaggattatatctcgaaaatatttttcttgcatcatgcttcggaggaaatactagctctttctgctggcaagctcatggctctgcacggggtttcttacatccttctacctgtctctcaagcagtgacgatcgtattagacagaatgttggggtaa

SEQ ID NO: 8878 - DNA, 1758 bp, Glycine max
  Peptide Sequence Number=SeqID_125656
atgcgacggagaccgcgcacctccttcctcgtctccttactctccattctcaccttcgcttcattttccctttacctctctcgcaatgccatttccacttggcgcccctactccgacctcagaaaattaaacgccgtcaccaaccacctcgtccttcacaacagaaacaaaaacaacatcttcaacaatcaattctcacgccaaacacggcgggtgtcctccatcaaggacaccttattatccaccgtctccgttctcatccccgactgggagattctcgtcatcgtcgcgccaaacacgcccttatcctcctccgacacaccccactgcctcttccccaacaatgccagctctccggccaaattctccggcgtcctccccttcaccaaccgcaccaccttcaagtgcgacctccccgagccggttcgccgccgccgcatgttctcccagcccatgctcgtgacatcaccaacctcggagaccgagttcccgtcgccggcaccggagctcctgaagtggaactttctcgtgtacgagtccttctccacggaaaacgacgtcgtcgtgttcgccaaaggggtcaaccatcgcaacggagacaaccgctccccggaggaactccgttgcgtgtttgacctcggtagcggtgtccttaacgtcgccgttacgagctccgtccaagaagtgttccgttgccctcacccagatccatccgaattagatttcgattctcattatggcttacccaatagaatcggaatctcccttgagatcgtttcagaaaacaccgtcgtcccgtcggtcgcatattacattcccaagcccgggctcaagcccaagctcatgacgaatgatctatccgtacaagcccggcccaaatatttcttatgcgcatgcacgatggtttacaacgtggcaaaagtcttacgggaatgggttatgtatcatgccaaagtcggcgtggagaatttcatattgtatgataatgcaagtgatgatgatttgtatgccgtgatcgacgagcttcgaaaacaaggttacaacattagcacgttgttttggatttggcctaagacacaagaagctggattctcccacagtgttgtgtactccaaatcgaaagaactgtgcagttggattatgtacgtggacgttgacgagttcgtgttttctccctcatggggacatgaaactgaaaatagtgttgttgttccttcgttgaaaaagttattggcgagggaaataataaagggggggactagggtgggacaagtttcgatgaggtgcatggaattcgggccttcggggcaacggcggcacccggaggaaggagtgacgcaggggtacacgtgtcgtaggaggggggaacagaggcacaagtcaatggtgttggtggaggcggtggaccccagtttgaggaacgtgatacatcattttcaagtgaatgaaaggaaagggttcatgtcgaagcaggtgagtgtggaggaagggttggtgaatcactacaagtaccaggcgtgggatgagttcaagagtaagttccgaaggagggtgtctgcgtatgttgtggattggaagcaggaaattaaccctaattctaaggataggactcctggcttgggcttccaagcaatagaacccaaggattggacccataggttctgtgaggttagagaccagaggttgaaatccttgacccgtgcttggtttcgctccgtcacgcccaacggctacagaatggcttggcaaacaaattga

SEQ ID NO: 8879 - DNA, 1122 bp, Glycine max
  Peptide Sequence Number=SeqID_125657
atgggcgaggtatctgaaagtaccacgacgaagaggaagaagaagggacgcccctctcttttggatcttcaaaagcgatctctcaaaaaagaacagcaaaatcaccaccagcagcgacaaagcaacaactccaattcagccaattcccacaacaacaagaacaagaccaacaaaaacgctgttccccacgacgacgacgaggacgaacgcaaggagaagaaacacaagctcctggtcggtctcaattcccatctccagaacccaacattatttcccaattcccaacccttcaattccgatcccaacaagaggcgcaagactattgaccctctccaaacggattggaaggttccgaaagcgactgacagtaaacatggttcgcagggagagtccggtcccactacgcctttgccagacaaaaagctcttgctgtttatccttgacaggcttcaaaattgggtatttgatgttctgtactgctcacaaccttctcgcagaaaggacacacatggggtgttctctgagcctgtggatccagaagagcttcctgattatcatgacatcattaaacacccgatggattttggaactgtgaggaagaaattggatgatgggctatataccgacttggaacattttgagatagatgtgttcttgatatgctctaatgcaatgcaatataattcctcagataccatttaccatcgacaggcccgagccatgcaagagattgcaaggaaggactttgagaatctgagacaagatagtgatgatgatagtgaaccacagcccaaaattgtgcagaaaggaaggccaccaggcaagcactcaagaaagtcactgggacttggtatgcctccttctgagcgtgttggtcctgaatcttcttctgatgcaactctggcttctggtgcggatattggtagtggctccaacggttataatctaagaaaagtacccagcaaatttcagcccacagattcatctgccagggcctacaacagcacttttaacagtggagggtatactggctgttctgattgggagaatgaatttccaggtcagtatctatatccgcactttctcattgtcccattccttctggattcaactagggactaa

SEQ ID NO: 8880 - DNA, 615 bp, Glycine max
  Peptide Sequence Number=SeqID_125658
atgtatgacatcaactcgtcattggctcccagttttaactatataataaaattgatggtgtcgattttagattttgtaaagctgatgacccaggcccaaatcaatgtccttcgagcatgtagttacttcacgtatctatgtgcttcaccaactgaacctttgcttggatctaatattaagaaatcaacactgcttggttcgtcactttttcttggtcatacagaatgcaatgacttgcatctaagcccaatcatcgcacgtgcgcaccatgaccacccaaatccacctttgtgcacacgcaacaacaccgacccaaccatcactaaccatcgcatcatcatgcataactccaccctcaccacctatgtagttgtcggtgatgataggtgtcacaattttcacatgttggcgaggatgaggggtggagaaaacatcattttggaggcgttgggtgatgtcattgagcattgtggcaaggttcaaggagaaggagtggccactaatgacgacttcctaggcacggtgaacgcgtgcaacgacaacaagtttcatggtttcagtgatctttctgtgtgggttgagagggaaaacattgaattggagaatgaggtttag

SEQ ID NO: 8881 - DNA, 249 bp, Glycine max
  Peptide Sequence Number=SeqID_125659
atgtatttcacgatttatgctattgccacagtagtaactgttgctgaaattttgaaaaacaacagacttgctgttgaaaagaaaatcaggacatcaactgttgacataaaggatgactctagaggtcgacctgttcaaaaggccaagattgaaatagtactagggaagacagcaaacttcgatgagttgatggctgctgcagctgctgaagatggtgaaaatggagatgttgaagagcagagtgcatga

SEQ ID NO: 8882 - DNA, 186 bp, Glycine max
  Peptide Sequence Number=SeqID_125660
atgacactaatgaagccgaatttgctcaaggatttggtcatgattgttctggcaccgttaacaagaacgaggtcatacaacttcatggctcagcctcatgctgctttgtattattctcaaagaacaacaaagggtggatttttgattggggaagcctcgggggtgtcagacactgcacaagggtaa

SEQ ID NO: 8883 - DNA, 724 bp, Glycine max
  Peptide Sequence Number=SeqID_125661
ggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggcaaaacgagagagagccgacgaacggtagcctcttttggccaaacatagtagaagaagaaagggataccggattgattgcaaggccactctgccacttacaataccccgtcgcgtatttaagtcgtctgcaaaggattctacccgccgctcgatgggaattgcgcttcaaggcgtctcgtagggctaatccgcctcacgaggggtcaccaacggcacgtgcctttggggggccgaggccccctactgctggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactgg

SEQ ID NO: 8884 - DNA, 205 bp, Glycine max
  Peptide Sequence Number=SeqID_125662
atgaggctgggggccctcaagacagcgtggtcgtacgagttggggttagcagctgcatcgatagtaccatcgatcgtagtagacagcttggtcgtccaccctatgaaacaaggtcgttccaaagaggtgccagttggtagtagtagccatggagttgcagctggtagtacggagctggtcgtcccacctagtaatagaggctggg

SEQ ID NO: 8885 - DNA, 2160 bp, Glycine max
  Peptide Sequence Number=SeqID_125663
atgtcgaaggcaactctttctcgaatcaaacctcgtcaacacccgaaaggctcctcctctttgcctccccgcatcaactacctcgtttccgacgtcatccgaatccttaaaacccaccaatggcaggattccctcgaatctcgcttcgccgaatccaaggttgtcgtttccgacgttgcccatttcgtcatcgaccgagtccacgacgcagaactcgctctgaagtttttcgattgggcttcgacccgacccttctcttgttctctcgatggggttgcccactcttctcttctcaagctcttggccagcttcagagtgttcccggagatcgagttggtgctggagaacatgaaagctcaacacttgaaacctacccgtgaagcattcagcgctttgattcttgcatatggagaatccgggtcgcttgatagggccctccagttattccatactgttcgtgaaatgcataactgtttgcccactgttgtcgctagcaattcgttgctgaatggtttggtcaaaagcgggaaagttgatgttgcgctccagctgtatgataaaatgcttcaaacagatgatggcactggtgctgttgtggataactacaccacctccatagtggtgaagggattatgcaacttggggaagattgaggaaggtaggagattggttaaggatagatgggggaagggttgtgtgccacatgtggtgttttataatatgattattgatgggtattgcaagaagggtgatctccaatgtgctactagaactctcaaggaattgaaaatgaagggggttttgccaacggtagaaacttacggagctttaattaatggattttgcaaggcaggggagttcgaagcagttgatcaacttctgacagaaatggctgcaaggggattgaatatgaatgtgaaagtgtttaataatgttattgatgctgagttcaagtatggtttggtaactaaagcggctgagacgatgagaaggatggctgagatgggttgtgggccagatattacaacttacaatactatgattaacttttcgtgtaagggtggaaggattaaagaagctgatgaattcctagagaaggcaaaagaaaggggattgctgcctaataagtttagttatacccccctcatgcatgcttattgcaaacaaggggattatgttaaggcagcaggtatgctttttaggattgctgaaataggagaaaaaccggacttggtttcttatggtgcttttatccatggagttgttgttcatggggaaattgatgttgcactgatggtcagagagaaaatgatggagaagggcgtgtttcctgatgctcaaatttacaatgttttgatgagtggtctctgtaagaatgggaggtttcctgccatgaaactactactttctgaaatgcttgatcgaaatgttcaacctgatgtgtatgtttttgccaccttgatggatgggtttattagaaatggtgaacttgatgaggcaattaagatttttaaagtcataattcgaaagggtgtggaccctggcattgtggggtataatgccatgatcaaaggtttctgtaaatttggaaagatgacagatgctctatcttgcttaaataagatgaagaatgtgcatcatgctccagatgaatacacatattccacagtcatagatggatatgtaaaacagcatgacatgagtagtgcactcaagatgtttggacaaatgatgaaacataaattcaagccaaatgtgatcacctacacctctttgatcaatggattctgcaagaaagcagatatgatcagagctgaaaaagtcttcagagggatgaagtcttttgatttggtgcctaatgttgtcacatacactacactagttgggggtttctttaaggctggtaaacctgagaaagcaacatccatttttgagctaatgctgatgaacggttgtcctccaaatgatgctacattccattacttgataaatggtttaacaaatactgcaactagtccggttcttattgaggaaaaagattctatggaaaacgagaggtccttgattttggatttcttcacaatgatgctttcggaaggatgggatcaagtgattgctgcttataattctgttattgtttgtctttgtaagcatggaatg

SEQ ID NO: 8886 - DNA, 3675 bp, Glycine max
  Peptide Sequence Number=SeqID_125664
atggcctctagacgtgagaagggcctttgctttagttgcgatgagaagtaccatagaggccatcgctgcgcctctaaggttttcttcttcatcgcggacgaagaggaaccccctgacccgcctcatataaccctacccacttcggacccagataataacccacccgacaactcacccacccattcagatacatacccggcccaattaagcttaaattccttggcgggacacctggcaccagaaacgctgcgtttcatggctaccatcgccggacacgccgtggtcctcctcgtcgacggcggcagtatgcataatttcattcaacagcaactggtcactcttttgggtctctctccgaccaccacgactcctctacgtgtgatggtaggtaatggtcagcaattggactgcgactcggtctgccaagacgtacccatctccattcatgacacggtcttcgtcgttgacctgcatatccttccaatttcgggagctaacgttgtgcttggggtccagtggctgaaatctttaggccccgtcctcactgattacaatactttgtcaatgcagttcttctacaatgacaagttggtccaattacaaggggatattgatgcttccctgaaccccctgtctccttcccaatttcgtcgtctctgccgcaagcaaggtcctgggttttattatcatattaccctgctccctccatcaccacccacttgccttgaccacattcctgaagctatacgacccttgctctcgaagtacgaagccttattccagcctccacagaccttgccccctcctcgtgctactgatcatcatatccatctcttacctcaagcaaccccggtgaatgtgaagccttaccggtacccccattaccagaaacacgagattgagacccaggtggacgccatgcttcagcaaggcttaattcagcccagtactagcccgttttcatctcctgttttgttggtgaagaaacacgatgggtcatggcggttttgtgtggactacagggccctaaatgccctcacgattcgcgatcgatttccgatacccaccattgatgagcttctagatgagttaggtggtgcttgctgtttctcgaaactcgatcttcttcagggataccatcaaattcgaatgcacccagatgacgtccctaagacagcttttcggacacatcatgggcattatgaattcaaagtcatgccgtttgggctctgcaatgccccttcatcttttcaggctaccatgaacatgttattccgaccatatctccgtcagttcatcatcgttttcttcgatgatattttgatttacagcagctctctcgaagatcatttgcttcatcttgatattgcttttcaggttgaatacttgggacatttggtttcccataagggtgtcgagcctctggcaatgaaggttactgccattacccattggccctcccctcgatccactaaggctttacgaagttttttaggccttgcgggcttctaccgccgatttattaaaggatatgctaccattgccgcaccattagttaaggccacaacgattgacccatttcagtggaccgcggaagcccaattcgcatttgatcgtctcaaggctgccttatcgtcagcaccagtgctggctttgccggattttcatttgccattcacggtggagacagacgctttggggatcggcataggggcagtcttatcccaacagggccaccccattaccttctacagtaagccatttagtacaaagctacttcgttcatctacttatgtcagggagttgttcgcgattacggcggccgtgaaaaaatggcgccaatacctcttgggccatcgtttcaccatcatcacagatcatcggagcctcaaggagctcctcacccaagtgattcaaacgccggagcaacattcataccttgcaagacttatggggtacgattacgagatacagtatcgctccggcagccacaatcaggcagctgatgccctttctcgtttaccagaacatgaggcctctgtttccttattactttcggttcctgctcctcacttcttgactgagctccaccgtcagcttgacgctgaccccacttatcgacaacgccgggatgacattcgcagttctccggcaacctaccctgacttgtcgatttccggtgctttaatcctacatcgtggccggatttggcttcctcgcaattttccattgatacccaccctgctcaccgaatttcatgccacccccactggtggtcatgccggcattaccaagaccttagctcgtgtttcagagagcttttactgggaaggacttcgtgccgacgtcacccactttgtgaacaagtgtgtggactgtcagtacacgaaatacgaaacaaagaagccggtagggttgctctgcccgttaccggcgccccaccgtccttgggaggatctttccctggacttcatcgtcggacttccacccttccaaggtcacacagtcatcttagttgttgtagaccgattctctaagggtattcacttgggcatgcttccccaacatcattctgcccattctgttgttgttctattcattgacatcgtcgtcaagcttcacggggtacctcggagtttagtttctgatcgtgacccactatttgtgagccaattctggagggatctcttcaaattaagtggcgcccacctccgtatgagctctgcctatcacccacagagcgatggccaaactgaggtcctcaatcgtgttattgagcagtacctccgtgtgtttgttcatcgccggccacgatcttggggacgactgcttccgtgggcagaatggtcccacaatacttcttgggttgcagctactggacacactccttatgagctgacatttggaagaaaaccccctcgctttcctgattacctgcaaggctcatctcccattgctgccgtggatgagttgctgactgaccgtgaggaaacttttcgtgtcattcgtaagaaattactaaaggcacaggcctccatgaaagcttatgttgacaccaagagacgcgaggtgacttatgctcttgatgattgggtattactccggctgcgcccttatcgtcaattatcagccagggactctcaggccactaccggcaaattagccaaacggttttatggcccttttaaggttctcgaaaagattggtggggctgcatatcgtttacaactcccagagggtaccaaaattcacccagtttttcactattccttactcaaaccatttcgcggggcccctgatgatgctaagatagccaaactgcctgccacattcattgataatcaacctctcatcactccatcctctattcttgactaccgcaagtccccctctaatcccgagaattgggaagtcttggttcaatgggatggtcttcatctcgacgatacctcttgggaggattgggaccagcttcgtcaacgatatcaccttgagggcaaggtgattctccaagggccacggggtgatagagaagtagaacatgccacacaagcaggagcagatattcacgaagaggtgcaaacagcaacagagcaacaggatacaggggtgctagcagaaaacaagcccaagagaagaatagctaaaccaacatacctcagagattacatttga

SEQ ID NO: 8887 - DNA, 2442 bp, Glycine max
  Peptide Sequence Number=SeqID_125665
atggctgcgagctgggatggagctaatgaccctggcagccagtcagacgatagctttcattttgagaggttgcacattgagcctctttatgatgcctttgtatgtccgctgacgaatcaagttatgcgtgatcctgttactttagaaaatggacagacttttgaacgtgaagcaattgaaaaatggttcaaggaatgtagagagagcggacggaaactggtatgccctttgactcttcatgaactaagaagcacagagctgaatccaagtatggctttgcgtaacaccattgaagaatggactgccaggaatgaagttgcacaacttgatatggctcaccggtcattgaatatggggagtccagaaaatgaaactcttcaggccttaaagtatgtccagcacatctgccgaagaagtcgatcgaacaaacacactgtccgaaatgcagggcttatcccaatgattgttgacatgctgaagagtagcagccgtaaggttcgctgtagagctctggaaacccttagagttgttgtagaggaagatgacgagaataaggaattgttggctgaaggggatactgtgcgtactgtagtaaaattcctttcgcatgagctttctaaagaaagagaggaggctgtctccttgctttacgagctctcaaaatctgcaaccctttgtgagaagattggttctatcaatggtgccattcttatattagtagggatgacaagcagcaaatcagaagatcttctcactgttgagaaggctgataaaacattggagaatctggagaagtgtgagagtaatgtgcggcagatggccgaaaatggcagattacaacctcttctgacccagcttcttgaaggtccaccagaaaccaaactctccatggctacataccttggtgagctggttttaaacaatgatgttaaagtccttgttgctggaactgtgggttcatctctgatcaatataatgaaaagtggtaatatgcaatcaagagaagcagcactgagggcactaaatcagatatcatcatgttatccaagtgcgaagattttaatagaggctggaatactttctcctcttgtcaatgacctttttgcagtgggtcctaatcttcttccaacacgattaaaagagatctccgccacaattcttgccagtgttgtaaactcaggagaagacttttattccattccatttggacctgatcaccaaactctggtctcagaggatatagttcgtaatctactccatcttataagtaacactggtcccgcaatagagtgcaaacttctccaagttcttgttggacttactagttttccaactacagttctgagtgtagtggctgctatcaaaagctccggtgccaccatcagtctagttcagttcattgaggcaccacagaaagatctgcgtgtagcttccataaaacttcttcagaacttgtctcctcatatgggtcaggaactagctgatgcactacgcggctcagttggacagcttggtagtctcattaaagtcatagcagaaaatacaggaatcactgaagagcaggcagcggccgttggccttttagcggatcttcctgaaagggacttgggcctcacaaggcagctactagatgaaggtgcctttgtgatggtcatatccagggtgattgccatcaggcagggagagatccgaggcactcgcttcgtgacaccatttcttgaagggcttgttaagattgttgcaagggttacatatgtcttggcagaagagcctgatgccattgcactctgccgtgatcacaatcttgccgctctctttattgatctgcttcagtccaatggacttgataatgtacagatggtttctgctacagctctggagaatttatcccaagaatcgaaaaacttgaccagattacctgagatgccattgccgggtttttgtgcttctgtgttttcatgcttcagcaaaaagccagtcataactggatcgtgtaggctccaccgagggatatgttctttaaaagaaacattttgtctctacgaagggcaggcagtgcttaagttagtaggtctgctggaccacacaaatgtgaatgtggttgaggcagcacttgctgctttatctactttaatagaagatggggtagatattgagcaaggagtggcgattttgtgtgaagcagagggagtgaagcctatacttgatgtgctacttgagaaaagaacagatactttgaggaggagggcagtttgggcagtggagagattattgagaacagatgatatagcctatgaagtttctggggaccaaaatgtgagtactgcacttgtggatgctttccagcatggtgactatcgaactcggcagacagctgagcgtgccctcaagcatgttgataagataccaaacttctcgggaatctttccaaacatgggatga

SEQ ID NO: 8888 - DNA, 654 bp, Glycine max
  Peptide Sequence Number=SeqID_125666
atggaagcagagcatcatcaccagacctcaaacgctggtggtattattggaggcctttacgtcaaagttatgaccgacgatcaaatggaactgctcaggcaacagatttctgtctatgccaccatctgtcaacagctcgttgagatgcacaaggccgtaactacccaacaggacctcgcagggctgaggctgggtaatttgtactgtgatccgttgatggcgtgctctggacacaagataactgcgaggcagcgctggactccaacacctctgcagcttcaagtacttgagcgtatttttgacgagggaaatggtactccgagcaagcagaagatcaaggacataaccattgaacttggccaacatggccaaatatcagagacaaatgtttataactggttccagaacagaagagctcgttcaaagcggaagcaactcactcccgcactgaatgttgtggaaccagaagtggagacagaagttgaagttgagtctccaaaagagaaaaagactcgtgcagaaggctttcaggttcagccctatgagaattcgtcacctcataggatcaaggatatgtacatccagagtcctgacataggtattaatctttctgttagtctttgtttggataaacttctcaatgaatatttatag

SEQ ID NO: 8889 - DNA, 462 bp, Glycine max
  Peptide Sequence Number=SeqID_125667
atgattgttacgtctgcactgatcatatggaaggcattgatgtgcattactggcagtgaatctcctgttgttgttgttctttctgaaagcatggaacccggcttcaagcggggagacatcttattcttgcatatgaatcgagatcccattcgggcaggggagattgttgtctttaatgtcgatggacgtgagattccaattgttcatcgtgtaattatggtacatgacaggaaagatactggggaggttgatgttctcacgaaaggagacaagaatgatgtggatgacaggctactgtatgttcacggtcagctttggctgcaaaggcaccacgttatgggtagagctgtcgggttcttaccttacgtaggctgggtgaccatcattatgactgaaaagcctattatcaagtatattctcattagtgctttggggctgctcgtgataacttcaaaagattaa

SEQ ID NO: 8890 - DNA, 225 bp, Glycine max
  Peptide Sequence Number=SeqID_125668
atggccaccgctctagaactagtggatcccccgggctgcaggaattcgatgaaagtctcggattcgaaaacttacccgttgaagaacgaagaacggatgaagaacgatgaagaacggacgaaaaccttcacggatttgcttacggaaacatctcggaagcgttacggaagcacctcggcttggattttcttcacggaaacaatttttttcacccaaaacagctga

SEQ ID NO: 8891 - DNA, 1038 bp, Glycine max
  Peptide Sequence Number=SeqID_125669
atggatgtgaagagcatcttcctcaatggtctcattgaagaagaagtgtgtgtagatcaatcaccagcaatcaccaaggtcatgaaggaatttgagatgtctatgatgggagagttgaacttctttcttcgactccaagtcaagaagatgaaacatggaaccttcctaagtcaaactaaatactatattgaactaattaagaaatttggcatggaaagatgcaaagcacttactccaatggcaacttcaacctaccttgacttagataagaaaggtaaatcagtggatgagtcaagatatagaggtatgattagatcacttttctacttaactgcaagtagaccaaatatcatgctaagcgttttcttatgtgcaagatatcaggccaatcctaagggatctcacttaatagctgtcaaaatgataattaagtaccttaagggcacaactaatatagcacttttcactgcaaaacctgagtatatagcagctggaagttgttatgctcaaagtctctggatgaagcaacaacttgaagactttggagtaaaccttgatcacattcctctaaaatgtgacaacacaagtgtgatcaatctaactaaaaatcccatcatgcattctaggactaaagacagaaataagacatcattttctaagaggtcatgtcttaaaagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 8892 - DNA, 339 bp, Glycine max
  Peptide Sequence Number=SeqID_125670
atgcaaaataccctgcagcaacaaaccgaagaaagttcacaacttccaccgaaggtgtccttttccgggcacaagatgggtgatttgagtgatgggcaacaccatggtgggtatttggccgtggttccccggtccagaccggcctgcacatgctcgaaccggcccggttcggttcggtgcgcgcgtcacgggtacgtggtgccaggggagaagaagaggcgcgtggcgagcaaagagatcctgagaagagcactcacaccaccaccaaaacgtttgggccttagatggttgaatttcagaccaaccccaagtagactttctaacatgtccatggcctaa

SEQ ID NO: 8893 - DNA, 357 bp, Glycine max
  Peptide Sequence Number=SeqID_125671
atggataagctcacactaacccgtcaatttgggattcaattcggttccttaggaggtatcgggaaggaattttggaatagtggcagtaagggtgacttatctgtcaacttttccactattacacccaaaaaaccaaactctgctttacgtaaagttgccagagtacgcttaacctctggatttgaaattactgcttatatacccggtattggccataatttacaagaacattctgtagtcttagtaagaggggggagggttaaagatttacccggtgtgagatatcacattgttcgaggaaccctagatgctgtcggagtaaaggatcgtcaacaagggcgttctagtgcgttgtag

SEQ ID NO: 8894 - DNA, 156 bp, Glycine max
  Peptide Sequence Number=SeqID_125672
atggcgattgacctctacattcgggaagtggatggcctaagatttgagctatccatgaaccagtgcagtgataagttgtcagaactggcacatgaaattctaaaagattatcatgtgaatttgatggtccttttgaaacccttaatattaccgtaa

SEQ ID NO: 8895 - DNA, 438 bp, Glycine max
  Peptide Sequence Number=SeqID_125673
atgtacaggctctcctcgtacttcatgtcaagggtggtagctgaccttcaaatggaacttagtcttccctccatatttattcacaccctcttactccatgtcttagtctcacaggacctcggcgcttctgtcatggatcaaaagatgcaaccacattgtcctcactgctcctgctgtgtttcttgcttgctggtgtacatttccatcagctactacaactaccagctctttatcgcgtctcagtatagcaatggcgagacatacccttgttctactggccagtgtcaagttgcggaatttccttctataaagcaaacagggtttcatttcaatttgcaggagcaagtcatggctgcatctgctctagtgataatgatgatagattacagacttatagcctatgttgctcttatgaggattggtgtgacaaagaaatag

SEQ ID NO: 8896 - DNA, 111 bp, Glycine max
  Peptide Sequence Number=SeqID_125674
atgtataaacagaatcagaaggactttctcagtatcattcagctcaaaaagggagcaaaggatgcaattatcattcaagagattcatgcaaagattattactcacagctag

SEQ ID NO: 8897 - DNA, 282 bp, Glycine max
  Peptide Sequence Number=SeqID_125675
atgactatcttagtgtcaatactcccccttccccaaattgtgaaccctaacatctcccttcacagaagctctcacaccccctacgtagtccttttcgcactcctttcgatgtttgaccttcatcccccttggcaccccctcatgtcaacaaccatcactccattaaagcttcacgcgaagccaaggaatggtttgctgcctcaccctttaagtgccacgatggcaagcttcttgtcaccaggcttagtttctggaacatatgttttgtatcagggtaaataa

SEQ ID NO: 8898 - DNA, 1050 bp, Glycine max
  Peptide Sequence Number=SeqID_125676
atggatttagcagcgatcggcgcttttcttgcttatcatcacaacaaggaaagcccggtcattgctgtcttggccgatgcatatgacacattcgacttgaggtgcaaaaagagtagcgtaaggattgtctgttgcacgcccgctctttatgtgtggttggtctcccacgtgcttcatcatgaaggtagacctgtccgtcctctacaaggtcatcgcatgctaccctatgagaggtgcgccccggaggagactatcgcgcctttcgtcgcacggggtttcaatgaaggcaatgcaaaaatacttcagagaatctgcaaggcgtggaatacagtggaaagaaaggataaggagcttagaggaagcagcaatggtgtcatcagtggctatcataaatggctgaaggctaggacacaagggataacttggctcccaaagctaagagatccaagtaagaaagaagttgaagtccccgaggaaagtgaaaaagtgaaagccttgaaagcagagcttgaaagaacgaaagtgatcaaggaaaagctaaagacgacagtcactagggtcaagaaagagtgtgacaagctaagggatgtcaacatgactacgaccgaagcattaaagcgggaaacaaagagggcccaaaaggaagaatggagcaggaacaagtaccgaggggctctatggggtagcaacaacgagctcaagcttagaagggtcgaaagggatgagtcaaggttggaaagcatgtataaggagaaggtaaacctagctgctagtcatgggcagagactagaggatgagcatgcgaaggtatcagctctgcaaatggaaagggaagcaagagaaagggtgatagaatcattgcacggggaggttgtgaaatggatggatagattttctctcactctgaatgggagtcaagagcttccaaggctgttagctagagccaaggcaatggcggatgtatacctggctcccgatgaagttcatgggcttttcgattattgccaacacatgatagagttgatgtcccacataattaggaactgctga

SEQ ID NO: 8899 - DNA, 486 bp, Glycine max
  Peptide Sequence Number=SeqID_125677
ttatacgacctgataaaactgggccctaccggcttcaattcacagccggccaggttcctgtttatccgcagtcaggctcagaaagaaaagcttgcaccgcatctttcttcttctaatcgtgaaaaagcactggcagcgccgctcaacctgattgtggcttacgacacccttttctaccatgaacttacagagcaattcccggcctatgacgcacgcagcttctttgaaaagtcaccagactggatacttcccaccgccaacctcaatgcaaccttgcaagcaggctacctgattattgccgcaagagccctggggctgtcagtgggtcctatgtcaggattcaatgctgccaacgtagatgtaaccttctttcccgatggccaatacaaatcttttttgctgctcaatataggttttactgatgggtctagcacacgaaaacgtggcccaagattagcttttgagaaagcagttcacattctttaa

SEQ ID NO: 8900 - DNA, 174 bp, Glycine max
  Peptide Sequence Number=SeqID_125678
atgggtaatggattcgtgaagatacttcaagaaaagcataagcatgttctgtcggtccctcgttccaaactcaacaaaaccgagcctattgcattcccacattcttctccctcaccccatgtgccactgctagcattccctcttctgcatttccatgtaagaggagggacttaa

SEQ ID NO: 8901 - DNA, 240 bp, Glycine max
  Peptide Sequence Number=SeqID_125679
atggcctatgcccgtgctttagttgcaggatattacccagaatctgtggatgatctaatatgttttgctgatgcatttggagcttcacgtttaaggtgtgtgtttcttgttatgaaacttgttaggcaggaagaaagagtggtaaaaacaaggaaaaaggaaacaaaatttaatattcccaaaaggggaatcctctcagtttccatttactgtttagactacagaagtaatgagaactag

SEQ ID NO: 8902 - DNA, 681 bp, Glycine max
  Peptide Sequence Number=SeqID_125680
atgcctgaccctaagagcaattcacaacccaaaacattagaaaaggcaagaagatggcttcggttagattgttgctggaaactcgtgtctctaccagagcttccaccatccatagaagagcttgcattgaatggttgcaagaaattcaagtctctgctaaagctttcaccatctctagaagagctttctttgaatgaatgcaagaaacttgtgtctctgccagagcttccaccatccttgagagcgcttgatctaagaaattgttggaaacttaacttgttacaccaacaataccttaacaatcctaagtattgtgaaaatgaggattatcctcatagtggcgatgaggatcatcctgattgggacgaagaggattgccctgataagcatttcatcttcccgggggaccatgtcacggacaagtgcagcaagtatgataaaaaatgtgaagtgtatggtcatttcagcaacttgacatttagatttgggttggattttcttcatggattgaattttgataaagatataaaagggtgtggggtcttcccagtatatgccacagcatcagagttaaagctggtcaacagtagcgaatccattgactgggaacaacttggtcctgcgtccaaggggagggaggacttagccagaaataataatcttcctctgattacttcatcg

SEQ ID NO: 8903 - DNA, 807 bp, Glycine max
  Peptide Sequence Number=SeqID_125681
gttttcaaacctagagcccttgttgatcttgatgctgctgtttcatctgctttgttgataaatgaagaccaatgggttggtattttagttcgaccattaaattactccctcaaagctgctgtcttgcatattgatactggtccagggttggagattaaagagttgcacgtaattgagatggaaaccgatgctgatgtgcagaatgatggtgctcagataagaactctaaattctgataaaaaatttgaacgtttgactcttcatgatggtaaaatcaaatttccaaattgggcaagtgacactccttctattctttgggttctggtttgtgccatcagtgacacactcagcagaggatcttcttcagccacaacaaggagagaaagtattgtagatggaatgagaacaatagctctgaaacttgtatttggagcattccacaatcagatattcgaaaggacactagcagtgcattttacatatcctttctatgtgaggacacgtgttactgataaatgcaatgatggtaccctgcttctgcaggtaatacttcactctgaagttaaggctacactggccatttatgatgcctggcttgatcttcaagatggatttgttcatactggacaaactgagggtagacctaattcaagtttcttcccactaatcatatctcccacttccaaagcaggaatattgtttagtatctgcctagacaagtcaaatgcagaagaatttgggagctgtaattctatccattgtcagaggtttctgattggttggcttattctttttcaagttcaataa

SEQ ID NO: 8904 - DNA, 672 bp, Glycine max
  Peptide Sequence Number=SeqID_125682
atggtgaggctcatgaaacaggccaatgtattcccattgaagaaaacactcaagaagttcactttatgggaaatcaacagagacaaggatatactcaaggaggattttcaggcttccagcagggtccttataatcaacaaggacaatggaggtcacactctggcaatcaattcaacaaagaccaaggtaacaatgtcaattcataaaagcactgagtcagcactaaaaaaccttgaggtccaggatgaggatagttttgtatccaagaagaaagctattgaaaagaaaggtactgataaaaacaaagatgatgtgagagaagtgccatatcctgtggtaccttccaagaaggagaaggatcgccatttggcgagattcttagatattttcaggaaattggaaatgaccatgcccttcggagaagctttacatgttgtgcttcaaaagatccttccatccaagcataaagaccctgggagtgtaactattccttgttcaattggagaagtcattgtgggaaagactcttattgattcgggagccagtattaacttaatgccactctccatgtgcagaaggtcgggagagttggagatcatgcccaccaagatgactttaccacttgctgactgctccattaccagaccatatgaagtaattgaagatgtgctg

SEQ ID NO: 8905 - DNA, 1698 bp, Glycine max
  Peptide Sequence Number=SeqID_125683
atggaatgcatcagaaatactctggataggcgtgtacaattttatgaggatgagatacgaaagctcagtgaacagcgcctcatgccagtctggaacttctgcaactttttcattctgaaggaaagcttggcttttatgtttgaaatggctcaccttcatgaagatgccttacgggaatatgacgaactagaactctgctatcttgaaacagtcaacatgactggaaagcagagagactttggaggggcagatcatggtgacgatcaagcagcatttcttaatccaggaaataaagcattgacacagattgttcaagaggactcatttcgggagtttgaattcagacagtatctgtttgcctgtcaatcaaagctcttgttcaagctaaatcgtcccattgaggctgcatcacgaggctattcattcataataagcttctccaaatccttggcattgcatgagcgtattctgccattttgtatgcgtgaagtctgggtaacaactgcttgcttggttataattaaagcaaccacttctaattataatgatggacatgtggcacctgacatagagaaggagttctttcgccttctgggtgacctatattctctagctagagttaagttcatgaggcttgcctatttaattgggtatggaactgatatagaaagaagtcctgtcaacagcgcttcccttagcttgctaccttggcctaagccagctgtctggccttcagttcctgttgatgcatcaacagaggtgctagagaaagaaaagctgattctacaaacaacttctagaatcaagcactttggtatccagaggaaacccctccctcttgaacctactgttcttctacgagaggccaacaggcggagggcttcactttcagctggaaatgtgcctgaaatgtttgacagtcgccagggtccaatggatggatcaggtttcgatgcatccacaagaatgtcaccacaaaaagcacttgcaagtaccatgtcacgtacaaattcttcgccaggaaactttgatagctcaattgaccaaccgatgaggcttgctgagatttttattgctgctgagcatgctttgaagcaaacaatttctcatacagagctgtggaaatcattatcatcatctgaggagtttgagcaaaaatatttagagctaactaaaggtgccgctgacaattatcatggttcctggtggaaaagacatggtgttgttcttgatggtgagatagcagctgtggcttttaagcatggacattttgatcaagctgcaaagtcatatgagaaggtttgtgcactgtatgctggtgaaggatggcaggatttgttggctgaggtccttcccaatttagctgagtgtcagaagagtcttaatgatcaagctggctacttattatcttgtgtgaggttactttctcttgatgaaggattatttttgaccaaggagcgtcaggcctttcagtcagaagttgttcgtcttgctcatagcgaaatgaaggaccctgtacctcttgatgtatcatcattaattacattttctggaaatcctgggcctccattggagttatgtgatagggatcctggtatcctttctgtaactgtatggagtggttttccagatgatataactctcgattcaatgagtcttacattaaacgcaacatataataccgatgaaggtgtaaag

SEQ ID NO: 8906 - DNA, 1164 bp, Glycine max
  Peptide Sequence Number=SeqID_125684
atggcgtcggtccacagcaccgtcgctccccgtaccttcctgccgtcaattcccaagccgagagctcctcttcacgccgcaaagttcgtcgccggcggcgcgcacaactttcggagactgtcgcgcaacctcattctctccggaaacaaacgcgcggtggcggcgaactcggctgcggaggagttcgacgtgatatcggtgcagagcgacgacatcaccgaccagcaggagggcgtggtggtgagccgcgtcgagatggaaggcggagactgcgaattggcgacgcaggtgagcggattcggagccaacgagggcttgctgtcgttggaagggttttcttcatcttcgtcgtcgtcttcgtctctggtcgggaatgagagcgaggaggacatggagaagctaattgatagaactatcaatgctacgattgtgctcgccgctggcactttcgccgtcaccaaacttctcacgattgatagcgattactggcatggatggacgctatacgagatactaagatatgcgcctcagcacaactggtctgcttatgaggaagctcttaagacaaatccagttcttgccaagatgatgattagtgggattgtttactctataggggactggattgcacagtgctttgaaggaaaacctctgtttgagtttgaccgtgcacggatgttcagatcggggcttgttggttttactcttcatggttctctttctcatttctattatcagttttgcgaggagctatttccttacaaagaatggtgggtagttcctgccaaagttgccttcgatcaaactgcatggtcagcactttggaacagcatatattatacggttgttgcactactgcgtcgtgatcctcctatgagtattttaaatgaattgaaggcgacgttttttcccatgctaacggcaggatggaagctatggccatttgcccatctcattacttatggtgtgataccggttgagcaaagacttctctgggtggataccatagagcttatttgggtgaccatactttccacattttcaaatgaaaaatcagaagcaagaaactctcagtctatggtgccttcagaagtgaaatccacatctgtttatcctcctgagatttatgatgcggaatgtgaaaaagctaattatatacgttga

SEQ ID NO: 8907 - DNA, 774 bp, Glycine max
  Peptide Sequence Number=SeqID_125685
atggggggagcaaagagttactcttgttttgcagtaatagctgtggccttggttttgctacttctgaatgtggctgtggtttgcaatggaggcaagacaagcacattcattaggaaggttgagaaaactgaggacatgccccttcatagtgatgtatttgttgccccttctggctataatgctcctcagcaggttcatataacacaaggtgaccaagtgggaagggccatgatcgtgtcatgggtgactgtggacgaaccaggaaagagtctagtgcattactggagtgacgccagccagcacaagagagtggccaagggaaatcatgtcacatatagatacttcaattattcttctggttttatacatcactgcacccttagagatttagaggcaaatggtgatctgggtcaaacttttgattcaaacaagacccttgttcactatgaatcaaaccctcacaaaggacaagctgtgttgtatgttggagacctctcttatgcagataatcacccaaatcatgataacgttaggtgggatacgtggggaagattcgtagaaagaagtactgcttatcaaccttggatatggactacagggaaccatgaacttgactatgctcctgaaattgatgaaacagaacctttcaagcctttccgccaccgttactatgtgccttacaaagcatccggaagtactgaacccttttggtattctgtcaagatagcttcggcacacatcatagttttggcttcatattcaagcttatggtaa

SEQ ID NO: 8908 - DNA, 441 bp, Glycine max
  Peptide Sequence Number=SeqID_125686
tttgtcatttcagtgtgcttttgccttgataggacagggctggtttatcgtattatcacgagggattggggtacggatagtaaggccttgtcttcaaaggccaaggggaaggaaaaagagaaaaaggattcctccaagaatattgttgagaaggaaaatcattttgcaacaaaatgtgatatcataagagcattccttattaaacaatctttctaccttctcttatctatcattgccatacgtcttgagcttgaggttattcctcaagtaaaggagtttttggatgagggtttagttcgtaagagcttaattccttatgcttttttggtgcccaaaataggtattatgaggcaccgaatccctatgataggtggtatgatgaatgtatttagtgatgcaaccctatttgtaaaatcatccatgcatccaacatcttcatga

SEQ ID NO: 8909 - DNA, 351 bp, Glycine max
  Peptide Sequence Number=SeqID_125687
atgagagtgtcacctgctgggaagctgatgcgcctccagactttggggctctgcatttcgctggcgctgggcgtgccgtcgatggcggtgtttgccgcaggcgatattcagttcaacacggatgtgttggatgtgcacgaccgtgaaaacatcgatctgagccagttctctcgtggcggttacattatgccgggcacctacggcatggtagtgcacgtcaataaaaatgatttgcaagagcagcaggtgccgttttatgcgcctgaggatgatccgaacggtagccgagcctgcgtcacgcaagtgttgaccgggcaactggggctgaaagaggatgccctgaaagggtga

SEQ ID NO: 8910 - DNA, 480 bp, Glycine max
  Peptide Sequence Number=SeqID_125688
gcaacggctgccggatcgttacagggatggggtagggtaaatatgcaaggcgccattattgataccgcctgcgctatcgctattgagagccgcgaccagactatcgatatggatgtggtgccgttggcggatattattcgcgatggacaggggcgtagtaaacctttttccattgaactggtcaactgcactcttgaacgcccggatcccacattacccgactggaagcaatttcaggtcacgttcgacggggataatgagggggaattatttggcgtgcggggtgaagcgtctgggatagcgctgcgtattaccgacgagaatggaaatattgccacgccgggtgtgccactgcgcgctcaggacattattaccgataccatgcagcttaattatcacctgcggctggtcgccaatcaacatgcgctgaaggccggcaattatttttcagcgatacgtttcaagctggattatttctga

SEQ ID NO: 8911 - DNA, 1200 bp, Glycine max
  Peptide Sequence Number=SeqID_125689
atggcgcagcggaaactggcgttatgtctatcggacggacattcgcgggggttatgcctgcaatggctcaattacagcgtcgacgatggcggtgatatttacacgccggaaaaaggaatatgccgcggcagtgcgctcagccccaagccaggtatcggaggctgccgagggcagaaactgaggcgttggtgcgtgagtatgaagaccggtggagtgtgtgggcaagccgggggcgccgtaccatggcctgtcctcatggaccctaaaatcgtcagttgcgatgaccagtataagaatccatgctcagccaacgttcagtactactcagctggggtaatgatgatcgatgtactcgcagtagggcagcccaacgccgcaaatacaggcacgttagtacacccggtcggggttcattgcaatacagggaacgcgctcgtcgggaacttgccatttaaaaactgtaaatggctttccgatgatactcaccggccgccgctagtgggcaagtgcgaactcaagtcgccgaactcatggacgctcacgtctgattccgactgctctgtgcggtcgaccttgctgtgggggcactatggggcgggtcctggaggcgaatgcgttgtattcacgaataccatatatccccaggcgcagggggtcgtgaatactccatggggggcaatcactgcaacacaagctgctaacagcgggaatcgtttttgttctaaacccctgccaccgaacgtgacgtgcgaactggacctaccgaacattattgaccatggtgaggtacgtgcgggtgactcgtccaaacgggtcgatgagggacagattaagtgtggtcttacaccgaaaatcgacgtgcttgtgaacggggatcgggacacagagggggttcggatatccacaaccccgctcatcgtgaatccaacaaccgttcggatcaccaccgagatcaccgtgagtaatagtgctgtggcgggagaacacagcgccacctacgtgttcgtgaccggggtgatagttgatctggcaacacgtggtgagatctcgtgggcctacgggaagctgtatgtagtcgacccagatcagtactgggtccagggggtgataaaggcggtatcacactatctggacacgactactggagtgaaagccaaagaatcggctgtgacaatactacagcgtcgggggtgtatgtag

SEQ ID NO: 8912 - DNA, 183 bp, Glycine max
  Peptide Sequence Number=SeqID_125690
atgtcttcacaattttcttatgctggagtaattattacgggatcgataaatagtaataatggaagtgtaggggttgggattggtgctgacggtacggggtctggaaatggggggaatggaactggtgttgtcataaatggccaggagcaatcaggatcttctgttgagcagattaagaaggat

SEQ ID NO: 8913 - DNA, 303 bp, Glycine max
  Peptide Sequence Number=SeqID_125691
atgaaagtgccaagagtggaaaacaagctaagagtttttgctttcaagatgcaattcttatcccaggtttcagagcttaaaagggacttgaatattgtaaataatgcatctgaacagataaggaattcagtcaaattgaaaagaatcatgcagaccattctttctctgggtaatgctttgaaccatggaactgcaagaggttcagctgttgggtttcgattggatagtctccttaaactcactgatacacgagccaaaaataacaagatgactcttatgcattatctttgtaagggtgtttag

SEQ ID NO: 8914 - DNA, 477 bp, Glycine max
  Peptide Sequence Number=SeqID_125692
atgatgctctatttgggccattttgaagacagagattcaactgcaaatgtatgttcttatacagagtacagaatttcctgcattgtgcttattggttattacaccataagtctgccagagaattgtccagctgtgttgttgaatgtgcttgccgaaaagcttccagaacttctagatttccacaaagacctagggagcttggaggctgcaaccaagatacaattaaaatatttggcagaggaaatgcaagctgttagtaaaggactggagaaagtagttcaggaattgactgcatcaaagaatgatggacctgtgtcggagaacttctgccagattctgatggaatttctttcttatgctgaggctgaagtgaggtctttggctcaactttatgccaatgtgggtagaaatgcagatgcattggctttgtactttggcgaagatccagcacgtgtcccatttgaacaaggtacctag

SEQ ID NO: 8915 - DNA, 561 bp, Glycine max
  Peptide Sequence Number=SeqID_125693
atgaagtttgagcaccttgtgcagaatactcaaaccccttcactagctaggattgctaatgggttaatggaggcacaagttaaccacacttttcctagtcagcaaagattgacatacggttactcaattagggaaaaaaagaatcggtcaatgaatagcgtgcaaagatgcttacatgataagtcaatcgttgttgcaacttatgatggagagcacaaccatgcggccattcatgagtcatcttcatccacatctaaaggctcatcaccagtggttaataacttacctctgatgacaagcatattaaatgacaaagaacccatgaacattggcttggctctttcagggtggtctcaaacagatcataggagacattgtgaagatgccatgcaacagaataataataatggtggtagcaacatcagaattgaagaatatgtaagttctctaataaaaaatcctgacttctccatgtcattagctgaagcagttgtccgcaccatcactggccagcaaaagcaacaagatataaaccttaatttggatcttcctgaagagtga

SEQ ID NO: 8916 - DNA, 333 bp, Glycine max
  Peptide Sequence Number=SeqID_125694
atgcaattcatggggctccgaaaaagggttgagaatggagaattgcaccaagcaatcactacgcatggctccaaactcgaaggtggaggacgcatgaacgaaaacgcaattcatagggttccgaaaaagagtttagaatggagaattgcactaagaaatcactacgcttggctccaaactcgtggtggaggacgcatgaacgaagacgcaattcatggggctctgaaaaaaggttgtgaatggagaattgcactacgcaatcactacgcatggctcagaactcgagggtggaggacacatgaacgaaaaggcaattcatggggctccgaataa

SEQ ID NO: 8917 - DNA, 429 bp, Glycine max
  Peptide Sequence Number=SeqID_125695
atggttatccgcaccttttgtcaaccagaggcaagcgagcctgttaacacgcagagactaacatcgtcatctgcacctttgtcatcccgagacggcaagtccgatgacatgcggagataccttatggttatccgcaccttttgtcaaccagaggcaagcgagtccattgacatgcagagactaacgtcatcatctgcacctttgtcatccagagatggcgagtccgatgacatgtggagataccttatggttatccacaccttttgtcaaccaaaggcaagcgagcctattgacacgcagagactaacgtcgtcatctgcacctttgtcatccagagacggcaagtccgatgacatgcggagataccttggaccgttaaaaagcataaaatcaacatgtaactttaccgcttttgcaagaactacgtag

SEQ ID NO: 8918 - DNA, 849 bp, Glycine max
  Peptide Sequence Number=SeqID_125696
atggtgctgtttcaccgtgaaaagaaacgtctgcgcctgacggacgagggtaagcgcttcctcaccgaggtgacgccctttttgcagcatcacgaacggctaaaagagtatgcgcagcatctgcagcagggggacgttgggcggctggatattggatatgtggaggcggctattcactcgcgcctgctgcccgcagcgctggcgcggctggcaccgggggcgggcattgatgtccggctgcatgcgttacgttccgcacagcaaattgcccggttagaggcgggggcgatcgatattgccattgtgcatacgctgccgcacgacgacgcggattttgtgtataagaagatcgcgaccgagccggtgctgctggcgatgccggcctccagtgcgctgaccgcgcccgtggcggctgatttgcacggtcgggcgtggattgccgaccaggaaaatctcaaccctgccgcgcgggcgcgattgctgacagcctgccagcgcgccggcttccagccggatattcgttttgaagtgaatggtccgctggcggcgcttgcctgtgtcgaagccgggctgggtttcaccctgatccagcacagcctggcgcgcatcgttccggataatgtcatcctgctgcccgtgccagagctggcgctggagattgtgctctttgcctcacgcccgccgtggcgccgcggtaagcctgagcggaggtgcgtcagccggcgacatcctgcagcgcttcctgcaaatcgtaccagcggaaaccaaagccggactcctccagccgcttcggcagcacgtgctgcccgcccagcaccagcacggcggattctcccatcatcagtttga

SEQ ID NO: 8919 - DNA, 1209 bp, Glycine max
  Peptide Sequence Number=SeqID_125697
atgccggccatcacgaagccttgcggattcgcgcagcttcagcgccgacaggctgaacagcagcacggcgatggccgccagcacgccgaagatgccgcgccagttcatcacctgcagcatcacgccgcccagcaccggcgcgacgatcggcgccaggccgttgaccagcatcagcagggcgaagaagcgggtcagctcatggccggcgtacagatcgcgggcgatggcgcgagaaatcaccgcgccacctgcgccggcgatgccctgcagcagacgggcgatcagcaactggtcgatggtgggcgcgagggcgcaccacagcgaagcacccagcagcaggatcagcgacagcaacagcgggcgcatgcggcccagtttgtcgctgtaagggccgaaaatcagctggccgacgcccaggccgagcagcccggcggtcaggctgagctgtgcggcggcggtggaggtattcagttcgcccgccatttccggcagggcgggcagatagagatcggtgcacagcggccccagcgcggccaacaggccaagcacgacggcgtgagaaatggcctgctgatacagctcgcgcagcagggacgcatcggctttttgcgtggtaaggatacggtaaccggtgccttcgctcatgacggcgataaactccacccgggcggcgatctcttccgcgctgaaatcgggatacagccgctgcaggttgtggcacacgtggcgaaacagccgcgcttccgcatcgctgagcattttggctaccaccgggttgcgcgtggcctcggcggtcacttccagcatcagcatgtgatcggtttcgctctcgcccggctgctgaaacagcgtgcgcgccgccagcgtgccggcgatcaggttgatgtgatcgccaaggttttccagccgctgcatcttgctggcgatgatgcggttgacgatctcttcgataatcgcgtctttattggcgaaatagcgatagatttgcccgacgctgagctgcgagccctgggcgatctccgccatgctggcggcgtggaagccgtggcggcggaagctggttttcgccgcttcgacgatctgatcgcggcgggcctgcaccttggcttgtttactgtcgttgggggagagcatctgcccgatcctttgctacgcgtgagccgggttcacatttctgggtgtgaacgttcattctcaattgtagtgtaa

SEQ ID NO: 8920 - DNA, 1047 bp, Glycine max
  Peptide Sequence Number=SeqID_125698
atgcagtgcgccgacgatctggctggcgaaatagatagtgtcgacgccctgttaaaatttggcggcgtgctcgcctttgccgatgatgaggatctggaagcgatcgacgtgggcgtagaacggcccggcgcgggtggcgcaggtgccggtgggcagctccggcgcgttatgcaggccaaataccgccgcaacgttatccagcgcgccagcgtcgatcaaatgccgggcaccgaagaaggtctattccgccggctggaagaagatgcacaccgtgccgggcaggtcggcctcacgcgctttgagcaggtgtgcggcgccgagcatcaccgaggtgtgaaagtcgtggccgcaggcgtgcatcacgccgcggttttgcgagctgaagggcacgtcggcgatttcgtcgatcggcagggcgtcaatgtcaccgcgcagcgcgatgatcggccccttgccgctgccaatctccgccacgacgccggttttcagcgccaacggcagcaggcgaatgcccgcctcttgcagccagcgggtcagccgggcggtggtggcgaattcgtgattggaaagctccgggttttggtgcagctcacgccgataggcgatgattttgtctgccaactggctgcgattgcgtctgcatgggggcgtcaacgctggggtaagcgggcgggtttggccgttcgcacattgttcgccggcgcgtggagaggattgacctggaacgggagcttatcgcaaccggtgcatccatttacaccgggctacacggattttttcactctttatcggatttctgtgatcgcggtggtggacaaaatcctgcctgcttgctgtactgtaatcgacacaggtagcgttaagtggtttaatgaatccaaaggcttcggtttcattactccggaagatggtagcaaggacgttttcgttcacttctctgccatcgttagcaacggtttcaaaacgcttgctgaaggccagcgtgtagagtttgaaatcacgaacggtgccaaaggcccatctgccgctaacgttactgctatctaa

SEQ ID NO: 8921 - DNA, 678 bp, Glycine max
  Peptide Sequence Number=SeqID_125699
atgatcggccctctcaatgagtcaatctcatgttttctcacaagggtggacctttgggtactagaacctattgccttcaaaggaccaagcgtcctcgccatcagagggctgcatgccctcaccttcagaggattacatgtcctccccttcagagggctacatgccctcaccttcagaggactacatgtccttgccttcagaggactacacgtcctcgccatcagatggctacatgccttaacctgtagaggactacacgtcctcgcctttagaggactacacgtcctcgccatcagagggctacatgtcctcaccttcagagggcagcacaccctcgccttcatagggctacacgccctcacctttagagaactacgagtcctcgcccttagagggctacgcgtcctcaccttcagaggactacatgtcctcgccattagaggaccacatgtcctcacttacagaggactacacgtcctcgccttcagagggctgcatgtcctcaccttcagaggactgcacgtcgtcaccttcagagggctacacgccctcacccttagaggactacacgtcctcgccatcagagggtcgcacgccctcaccttagagggccgcacgccctcacttcagagggctgcactccctcaccttcagaggactacacgtcctcacctttag

SEQ ID NO: 8922 - DNA, 204 bp, Glycine max
  Peptide Sequence Number=SeqID_125700
atggaatcgattaagagatttcgttcttaccaatcacgaaatcaaaatcgagaaattttagatgaatggaaagagagagagagagagagagagactacgagaaacttcgagctggtcgaggaggagatgcgaaagaagatgtgggcggcgcaggtggtgttcggaattatgagggagcggtttgagacgacggtgacggtgtga

SEQ ID NO: 8923 - DNA, 207 bp, Glycine max
  Peptide Sequence Number=SeqID_125701
atgggagatgagatgccgttagaattagtcgtattggatttagcaagaagatttttattcagcatatttgtggagcttctgcagggttgcggggaaaaagatggcagtggtggtggtttgctcttacttactcgatttggaagcataggaaaaacattattttctccaatacgaaattattttccctacgctgtatcaaatctctaa

SEQ ID NO: 8924 - DNA, 440 bp, Glycine max
  Peptide Sequence Number=SeqID_125702
cttccacggcccagcagcgcgcccaggcacatgccgatgacgtgcacgacttcgtactgctcgcacaactcgcggtagcggcgcgtcaccacgtccatccagtcctcgacccgcacgtccagcaggtcctcgggccggccggcgtggccgggcaacgtcacgccatgggtttccactcccgcgcgcgccagcaccttgtgcagcgagcccatgtcgaattcggtgccgcccaggccatggatcagcagcgctccggtgcgaggcgtcgtcacggcgcgctcccggccacggcgtcgagctgccaggcgttgcgcgtggcggccagcaggcgcgccaggacgtgggcgaaggcgataaccggggccggcgccgcggcgccgccggcgctcccggccggcgggaaagcgaagattggttggcaagtcatggaacacccttga

SEQ ID NO: 8925 - DNA, 1811 bp, Glycine max
  Peptide Sequence Number=SeqID_125703
tgtggagaggatgatgaaggcttttggggaggaagacatgggaactcaggcggggcagatccggtgatggaggaaacattagaagtaatttcaaataagttgagtaaagtacacgatatatgggcagagataggaagtacggatgttgagaagggtgaaaaagtagtcatcaaaatggaaaatattgagaaagatgttcaaaaaggccgaaagcagattgaaaaggaagaagaaagcagggaagagcaaatagaagaggaaaagataggcacaagaaagaaagataaagatatgacgacaaaggagaatgttagagtagggatgcgcaagaatgaaaaagcagcagcaagcaaactatggaaattagggactcaaatggggcttagcaatggatgcgagaaggaagtaattgagaagaaaatggaggagaaggagaaaaaggacaagaagagtaggtatagtagggaggaaaataggggtttgaagaagcacatcgtttgttctaaaagaaacatattggatcattgcccgattgtcttgaagagtgagattatggattggggacctaaaccctttagggagggcaacttgtatgttaaaggagaagttaaagattttaaagggaaatttgaagtgttggaaccaaagttgctttggaatctcaaggagaaaataaaagatgtagtggcaaagatcaatgaggtagatattcaagataaggaaggaaatgcgagtgatgaaagattgataggaaggaaggagttgattagtgaattttggaaggtggcaacaaattatgaatccttgatgcaacaaaaggctaggagtaaatggttaaaagatggaaatggcaatccaaaatttttccacgccatggtggtggaaaaggtgttatcaaaaagatttaaaagggtgttgggaaaaattatcgatgagaggcaaagtgcatttgtaggggggagattcttacttgatggagtcatggtggcaaatgaagtaatggatgaggtgaagaaggacaagaagcaacaatgtcttatttttaaagtagattttgagaaggcatacgactcgatgagatggaaattcctctactatatgttgagtaaattgggtttttgtgacttgtggataaaatggataaaaggatgtttagagtcagcctcgttatcagtccttgtgattggaagcccatcggaaaaaattgttaagcaaaagggattgcaccaaggagattcgctggcaccttttttatacctttgtgtggcaaaaggtttgacagggttgacgagggaagcgatatccaaagatttgttccaaggaatcaagagtgtagtgaagattcaaagagagttcttatggtggaggaatggggatagagggaaaattgcatgggcattgttggccaagtggaaatggagattattttcaaatgaagagtcattagggggaaaggtgattgtgttcaaatatggggaaagttttaagggaggaagagaagaaatcaataagaataggaaatggtcacaagtggatctgtggcaccaaaatcttgtgggaaatgagtcctttgcttctaaatatccaagaatattcacggtctcagaacagaaaatttgtaataggagacatggggtattggtctcaagggtcatggacttggaacttcaagtggcgaagacaatgatgcatcaagccgagaatgatgcatggatttggaaatctgacagctctggaattttctctgttcgaaatgcttatgcggttctggctcatcagaattttgatgcagaggagggaaactttttcaa

SEQ ID NO: 8926 - DNA, 348 bp, Glycine max
  Peptide Sequence Number=SeqID_125704
gtgcaaaggagtttagaggaccctacaatacttgttacaacgtatgaaggagagcataaccatggtcatcaaagagctgaaatatcacttgtctcaaaccaaagagaagcccctccaaaagggtcaagtcctgtttcctcacctacacccacaattcgaagtgctgcttgccccaccgtaacgtttgatttggtcaagtcaggtttggttgaacttgaaagtgcccaaaagtcatctatccagcaatttttggttcaacaaatggctacttctttgacaagggataccaatttcacaacagcacttgccactgccatttcaggaaaaattctagaggcccaatggtga

SEQ ID NO: 8927 - DNA, 360 bp, Glycine max
  Peptide Sequence Number=SeqID_125705
atggcttatcatgaagatcctcaaaaaaatttcatgcaagacttactagtaggtgagaatgacaaactaaacttgtgcaggaaagtgtcttggtttgcaacagtgtggagtatttggctactcagaaatgcaattatttttaacaatgaatctgtagatgtggagaaaatttctgagatggtcaaggaaatatattgtgaagggatatcgaggggaggaggtggtgcaaatagccaaagtcatgctatgactcttaaggaaaatggatttcgatggtggcatgcacggaattttgataacggcaaagaaccgggatgtgctggaattctcttttcattgtttgctttttcgttgggatga

SEQ ID NO: 8928 - DNA, 396 bp, Glycine max
  Peptide Sequence Number=SeqID_125706
atggaatacgtggatacttcactcaatcttaacgttgatccttcttctatgcacatggatggagttttggtggaagagttgcgtcgtctaagttgtgagaacaagaggttgaccgggatgttgacccacttgtgtgagaactacaaggctctgcaaaagcaactgagccaattgatcaacacgaattttgagcaattagacccaattgaatcacgcaagagaaaagccgagagtgatcaatggtgtaccaacaaatttattggtgttaataatgctgaatgcagctccatcaccgaggattcattcagaaagtacaaggacttcaactcctcccctaaggtttccaaagttcttgtcaagactgaagcatcaaataatagcttagtaagttcctaa

SEQ ID NO: 8929 - DNA, 435 bp, Glycine max
  Peptide Sequence Number=SeqID_125707
atgcaccaccttctcttccctaaacaccattgcacgacaaactcaccaccaccatcatcaaatcacacagcaaccgacaacactcaatccaatcctagatcaagggaaaaaaatcaacacacatcaagaaatccacaacaaacccaaatccaaaattccctaactacttatggtagattcagtgttagaaaaaccatatttagtgttgaaacaaccaaattcgatgtcagctttagccgtcttggtgcacgtcgtcatccccaacctcaaccatggagcacgacgctcccgacctcaaccatggaggttccttcctgtatttttaaccctaaccccttcattgatggcattgcttgcggtagaaacaatgttgtctctctagcagctgtgctctgtcacgatggggtggttgatgacaagagcgtggtggtttag

SEQ ID NO: 8930 - DNA, 231 bp, Glycine max
  Peptide Sequence Number=SeqID_125708
atggagaactggcgaacagcgctagacaatcaattcgcggggctccagacacgttggtggaggatgcattgcttggcattcaattcgtggggctccagactcgttggtggaggatgcatgaatgacaatcaattcatggggctccgaataaaagtggagaatggagaattggcgaacagcgctaggcaatcaattcgcggggatccagactcgttggtggaggatgcatga

SEQ ID NO: 8931 - DNA, 453 bp, Glycine max
  Peptide Sequence Number=SeqID_125709
atgattatgaggggtcaagacatttgtagtagtcaagaggagactacttcttccctttcctctagtggtagtgaagatgaagtaagaggtgaagagtctagtgaggaagtctacccccgtgaagaagagagaacatccttgaacctcactatcattccacacccaaaaccttataaacttcaatggctcaatgagcaaggggaaatgatagttaatcaacaagtgaaggccaaggggaaggaaaaaaaggaaaatgattcctccaagcagaatgtcaagaaggaaaataattttgcaacaaaaggtgatatcaaaagagcactccttcttaaacaatctttctaccttttcctatcaagggaaacatcccttagcactttcatacctcttgagcttgaggttattcctcaagtaaaggagttgttggatgagggtttggttcgtagagcttaa

SEQ ID NO: 8932 - DNA, 255 bp, Glycine max
  Peptide Sequence Number=SeqID_125710
atgcggtctctctactttcgggggtggcatttagtctttgttagtggggcgaggagtgaagttcaagttccccttgatcagaggctttatgaagagtcaggaacgactttgaagaagattatagttgttctttttgaacacttgctactagttataagcttgcagctcaactcacgtaggcgacaaatcaagctcacgcgggcaggcaggaatgcgccttctggagctcttcctttgactctcaactcgtactaa

SEQ ID NO: 8933 - DNA, 198 bp, Glycine max
  Peptide Sequence Number=SeqID_125711
atgtcagtgaaaaacctcatcgggtgcctaggagtacatgacaagacagaccacacactgggagaccagtcagggtcacattattttgtgagaatgctccaaccatgggggatcggtacaggcttaaagacacactcaaactgggtgtatttaccctcaaggcctagactcgaaagagtcagggcccctccctcttga

SEQ ID NO: 8934 - DNA, 162 bp, Glycine max
  Peptide Sequence Number=SeqID_125712
atgggtcagctccagcgacaagccttccgcaaagcttatggtaagatctgggacctaaccatggcagaggtctccacgaaggccgttgcctccctcgcccaatattatgaccagcctttgaggaattggaccgcgggaagcaagttgaaaatgaggtggtag

SEQ ID NO: 8935 - DNA, 243 bp, Glycine max
  Peptide Sequence Number=SeqID_125713
atggtggagccgttcgcgaagacgtttctcggcgcggatacggtgctcgggacagagctggtggtgacggcgtcggggagggttacggggctcgctaaggagcctggtgtgcttgttggtgttcacaagaaggaggtgatattgaaggagtttggaaccaacttgcctgatttgggacttggagacagtgtaacggacatgaacttcttgtcaatttgcaagatagtgaaacatgaattttaa

SEQ ID NO: 8936 - DNA, 234 bp, Glycine max
  Peptide Sequence Number=SeqID_125714
atgtccagctccttctattctatagttccttccccctttccttcaccaccagctggagcgcagtcttcgccggtctccagacagaccccaagcgggcacggtgacaagactttgatgcggggttcggaagataggcttgcaacggattcaaccgatcgattccccgtggcatataaagattggcgaagcataaggagttgggcgagatgcaagactttttcctcaaggagttag

SEQ ID NO: 8937 - DNA, 601 bp, Glycine max
  Peptide Sequence Number=SeqID_125715
ggatgctttaaatcagattgcttctgagattgaccgtctacgttatctcggcaacaatctctcttcttgtggttgtgtgatgagaagcacgcacgggcttccttgtgcataccaagggttatgtgagacggaagtcaccatcaaggaagaaatagaggtcatatctaaaaggtttgatgaacttgatgtggctggcaaagtaaatctgaagagtaaacttcgagaaatcgcataccctgatcataactctatgtgccctcctccatcaaagtatgttgatgcttttcattctgttcaaagcagcaactctccagtgaaacgaagtgcatcatgttctcaaccgcgtcagccaacaaggatcatcccgatgttggatcaatttgcgtcattctttcaaggtttcattcgtgacgttgtggatgtgaaagcggacggtaactgtggatatcggtggtcgcatgagtacatgaacctcttcggtggcacagagagatttgaacaattaaagttgtccctacttgttgatggattttcaaaggttagtgtggacaagtggatggatataacagacatgggatatgtgattgcttcacggtataac

SEQ ID NO: 8938 - DNA, 3228 bp, Glycine max
  Peptide Sequence Number=SeqID_125716
atggctaccaacaactttgctaccatgttgcatagaaacaccaacaaaatggttgtgattctagtctatgcagtgcttgaatggctcttgattgcactccttctccttaactctttgttcagttacctcatcacaaaatttgccaaatgtgttggcctccaaccaccgtgtctttggtgttcaagggttgatcacgtgctgcagaaagaacacggcacgcatttgcacaaggatctcgtgtgtgaggctcatgcagctgagatttccaagcttggttactgctcaaatcatcagagactcgcagaaacacacagcatgtgtgaggattgtttggcctctcggccaaaccagcacgaaaactcgtttggaatgaggcacagaatcgctttcatctcgtgggtgagtagtcatggcaaacatgaaaatgaagatgacataatgagaaggtgctcttgttgcaatgagagcttgagcagccagctttaccctccttatttgctgttgaagccttcttggggtaatgaggactacacaggcaaagggtccttgattgtggaagaggcaatagatgatgaaaaagaaggtgataaggaccttgagtttgagtttgagtttgagagaaacaatggagaagaagatcgtgatgatgaaggggtagcagatgagcatcagatactttctgatattgagagttttatcctcagagaggtggcggaggatcgttcgagttctgtttcaaacttgcattcggatgaaaaggatgcagaaaaagatgagaaggaagatgatcttatcatcactgagctggatccaagtggtgatcacaattttgttagtcaattcacttccactatgcagggttcactgtatggagatagatcacttgaagttatcaatatgcattttgagaattatatggattgtgataaccatcgcttggtgcccgtcaagttaatagactctattacctctttgaattttgaatcatacaaattgaaggaggatctgagggagatggagcaaaagactcagactcagacctttgttaatgagtcaccaattgaagcacaatcaagtatcttagaaagggaaggattactcacagtggatgagaaagcagagaaaacaagtgtgagagaacttgagagcttggaaaattgtataactttggaacttgaagggttgaaacagaattcagtagatgaggtacatccacacaggattactgctggagaagctcagacttcgctgaatagtgacaaaagtattgaagcagatactgaagagccagatgatacacaagttgatccgcctcaatcacaagaaccaggctgctctagtgaatgcacagaagatgaatcttcatcaagtgatgatgatgaagtccaaaatgcctttgataaattcattgctcagaataatctaagtaagcctcaaagtttatctaatgatgacaacagtatggaagcagctatgcaagaaccagaaaatccacaagctaatctgcctccatctgaagaaccagcctgctcttgtcaatgcatatcagaagatgaatcttcttcatcaagtgatgatgatgctgaagttcaaaatgcctttgatgaatttatttctcagaatcatctaagtcagtctcaaagtttatccaatgatgatataagtatagaatcagatatggaagaaccagaaaataaacgagataatcatcctccatctgaagaacccgcttgcttatctaacataccagaagatcaatcttccacaagtgaagatgatactgaagcttcaaatgcctttgatgaattcattgcccagaataatctctgtccagataaaacgggtgcaaatgacaccgagtatgctaagatgattgagaaaacaatagcagttgagaaaattgatgaagaaacaagccatgaatcatccaagtgctcagagtcatatgaagtagaagaagagaaacttcctgagactcctagatctgtagatggcctgcattacctgcataaaagagaatcagtagcagatgactctgtggatgggagtgttgcaagtgaggtagaatgtggcgacccggtattaacaatcaacctgctaaaaacggctttaaaaactgaaagaagggctctaagtgctgtatatcaagaactagaagaagagagaagtgcatcagcagtagctgccaaccagacaatggcaatgattacaagactacaggaagaaaaggcagcaatgcagatggaagcgttgcaataccagaggatgatggaagaacaatcagagtatgatcaggaagctttgcagcttttgaatgagttgatgatgaaaagggagaaagagaagcaagaacttgaggaggagttggaagagtataggcagaaggtaatggaatatgaagcaaaagagaaactaagggtgctgagaagaatgaaagatggaagtgtgagaagtagagactcctcctcttcttgcagcaatatgaactacactgatgagctatccattgatcttaaccgcgaggcacaggacgaagataatgtcttattcaaccatgaggagagcagccacattaatgcaactgatgacacagtttctaatatggaggagatggcactagactgtgtaaagcatgtgagtgctcttgatgatacattggcagaatttgaggaagagagggcttccattctagaacagctcaaagcattagaggaaaagattactacattgggagataatgaggaattccttgatgacatcaaattgattgagcattcatcgatgtatggtgacaaagacttgaatgagaactgcaattttagcagtctagaggaaaatggatattctaatgggttttcagatgataaacactctctaatgggttccttggcaaagaagctactgccgtatttagatgcagctgagaatgagactgaggaaacatacacatttcagggacaattggaatctgaatcatctgatatgcaaaactcagttcctatactcgaaatggatagcatgaagacatgcattgaagaggaggttgatcgcgtttacgagaggttacaagctcttgaaacagataaggagtttctacaacactgcatgggttccatacagaatggtggagagaaaggagtggatctgcttcaagaaatcttgcaacatcttcgtgatcttaaggctgtggaacttcgcctgaagaccttgggaaatgatccactatag

SEQ ID NO: 8939 - DNA, 1002 bp, Glycine max
  Peptide Sequence Number=SeqID_125717
atgaaggttcttgttaatcttcaccaagcagttattcctcatctttctaatcccatcatgttatgtgatttcttaacaagatcatatgatgttggtggtgtggtcagtgtgatggctcttagcagcctttttgtcctaatgacccagtatggattggaatacccaaatttctatgaaaaactatatgccctcttagttccatctatcttcatggcaaaacatcgagcaaggtttttccagcttcttgattcttgcctcaagtcacctcttcttccggcttacctggctgcttcctttgcgaagaaattgagtaggttgttgctttcagttcctccttcaggggcattagttattacggctctgatacacaatattttgcgtagacatccttcgatcaactgtttggtgcaccgggaagatggtgttgatgaagggaaaggggatcatagaacagatgaaggaatggctactaactcggataatgcgaagactgttgccatgcccagccagaaatcaggcattgaccattttaacagtagtgaaactgatcctaagaagtcaggtgctatgatctttaaggaaataaagtcaagtagtaaactctttcttggtggtagagttacatttttttccctggtcttctatatttgttttgctgatgatgacctcttggagcagggagttctctttgggaaattgatactattcttcaccactactgtcctcctgcctcacggcaagtttgctttgtctcttgggaatgatttgacagtcagggcaaaaacaactgaagttaatgttggtgattttagtgctggttcatatgcaacaatccttggagcagagatatcacggagggtaaagcaggttcccctagcattcttcaaagcaactccttcctctttattttcagagactgattttgctggttggactttcaaatgtgaagaaacccccaaaatgatcaatgacaacaatgacagcactaaggatttatcgtaa

SEQ ID NO: 8940 - DNA, 669 bp, Glycine max
  Peptide Sequence Number=SeqID_125718
atgcaacatgaacaggttggtgaggatgaatttggatatatgcttgccaatatactcaaggaaaataatgtaaacaatgaagggatgcgttttgaccctggtgcacgaactgctttagcatttgttacattgaggagtgatggagagcgagagttcatgttttatcgtaatcccagtgctgatatgctgctccaagaagatgaacttgatttggacctaatcagaaaggccaagatcttccattatggctctataagtcttataacagaaccatgcaaatcagcacacattgctgcagcaaaagatgctggtgtagttctgtcttatgaccctaacctgaggcttccgttatggccttctgcggatagtgcaagagaagggattctgagtatatgggagactgcagatatcattaaggagttctgtggtagggtcaagggattgaaggtggatgctgttgacaccactggtgctggtgatgcatttgtggctggaatactatcacaattagctgtggatctttcaatacttcagaaagaggatgagttgagagattctctcaagtttgctaatgtctgtggtgcattgactgtgaccgagagaggtgcaataccagctttgcccaccaaggaagctgttctgaatgctatgcttaagcccgtatcctaa

SEQ ID NO: 8941 - DNA, 315 bp, Glycine max
  Peptide Sequence Number=SeqID_125719
atgggaaggcaaccttgttgtgacaaagttgggttgaagaaggggccatggactgcagaggaggataagaagctcataagcttcatcctcactaatggccaatgttgctggagagctgttcctaagctagcaggactattaaggtgtgggaagagttgcaggctgaggtggacaaattacttgaggccagacttaaagagaggccttttatctgaatatgaagaaaaaatggtcattgatcttcatgctcaacttggcaataggcacaagccgtggtcccatgtctcacacctgggagggaaagtaggcgtataa

SEQ ID NO: 8942 - DNA, 294 bp, Glycine max
  Peptide Sequence Number=SeqID_125720
atggaggataggcgaagagtgctagccaatcatttcgggggtctccagattcgttggtggaggatccatgaatgccaatcaatccatggagctccgaataaaagtggagaatggaggataggcaaaaacgctaggcaatcaattcgcggggttccagactcactcgttggtggaggatgcatgaatgacaatcaattcatgggaatccgaataaaagtggagaatggaggagaggcgaacagcgctaggcaatcaattcgtggggctccagactcattgtgggaggaggcatga

SEQ ID NO: 8943 - DNA, 291 bp, Glycine max
  Peptide Sequence Number=SeqID_125721
atgtcttgcgtaaaaattcgcaatacttcaactgtgcatcattcgtatacatccatgcttttcattggttgcattctttccttgaaaaacaaaacgaacttaatcattgttatcaaaaggaaagaacacactttacggcgcccttaccgaacccgtgctagagctagagtaatgggtgaagtagaggaggtgcaaaagcagataaaggccgacatggaggccatgatgagcatgaagaagataatggaagccaatgtggttgcagtttccactaacagcgctgttgctaag

SEQ ID NO: 8944 - DNA, 176 bp, Glycine max
  Peptide Sequence Number=SeqID_125722
tggttctacacggaaaaatcattggtattaatcctaaagatgatgattcaacccttgatacttgtcacgctcctttctccacacacatgcctaaccttaatggagaagaagaagttgatgacgtccatgcaaatcataatgatcatgatgaagtagaattaattaacatcgtataa

SEQ ID NO: 8945 - DNA, 384 bp, Glycine max
  Peptide Sequence Number=SeqID_125723
atgagaattttccttgaatccgttgataaaagagtaggtgatgcaattgtaaataatccttacattcctaaggttgttgttgatggaaaagaggtagaaaaagactttaattcttggacaccggaagaaaatatgcatgatcaatataatgttagtgctaaaaatattttcgcctccattttaaaccttgataagttttattgtgcttctcaatgtgcaaatgccaaagaaatttgggaaatcttggaagtaactcgtgaaggaactactaaggatttaacaaccatgacggtagctacactttttggaaaactaagggagtatgaattagagcttgagaggctaaggatgaagaagaagttgacaagaagaagaagagattag

SEQ ID NO: 8946 - DNA, 237 bp, Glycine max
  Peptide Sequence Number=SeqID_125724
atgattaatgcaaactgtcagcaagaatcattgtactcaatctcaaacgggaatctaaggttcactcatgatgaacaaaacttgtatataaagtactggtcattaatcacaaaccccattggtatatctgtattaagtctcttagcaatcactgtcatcgagtactcgttggtgtcaactagtcctaagtctcagatagacagtgctaaggttagcatgcctactcttcattggtga

SEQ ID NO: 8947 - DNA, 309 bp, Glycine max
  Peptide Sequence Number=SeqID_125725
atggttggaagtgacattgaagctctgaggagttatggattgcctatgaccatgatggttgaccatgacccttatgaattcaccatggccattgttggatcgctgacgttgtattggagggctattgtcatcttattgtggtcgtgctatttaccacagtcgtgcattgcttgtcctcaagcaattattccagttcccaatcaaaacaaattctcccaagtaaaaactcctgcaacaaaaattcctatttattcaacaagtaaaaactcatacaatgaggcattaaaaattcactcaagaattcattag

SEQ ID NO: 8948 - DNA, 195 bp, Glycine max
  Peptide Sequence Number=SeqID_125726
atgatgaatttagttgtgctcttggtgataatgcaaggagctagtagcattaatggtggcatggaaaatgatggtgaaggaataatgacaatgttaacaatgagagtaggggcaacaatttgtgatgttggtggtagtagtaacaatcttagtagtgtggagaatgattgtggtgatgacaaatctgattggtga

SEQ ID NO: 8949 - DNA, 891 bp, Glycine max
  Peptide Sequence Number=SeqID_125727
atgcaacatagatttgacattgtggtattaattgacgaatccaaagacactgggaacatgaatcttgaagagttacaaggaccattagaggctcatgaattgaggatgaatgaaagaagtcttgaaaggtctggtgatcaagcactagaggctcaattgaccaagaaaagagcttcggacatgaaaaagtggaagaaagggaagacaaaaccaataaagagtggttggatttcaaaccaagaaaaatcaaaaggaaaacaaaagaaaaaaagtgatgatgaagcatgcgtggcccaagaagattatgattctgatctagttttattgatggcaaccacctgtgagaatcttgcacagtctaagtattggttccttgaaattggatgctcaaaccatatgacaaaccacaaagaatggttgagtgatcttgataccacaagaacaagcaaagttcaatttccagatgatagaacattgagtgcaaaagcttccaaacaacccaaaaattccttcaagactaatatgcaagtgagagtaacaaaagtgctagcagtggtgcattttgatgtatatgggtcattagaggtgtcttcactaagagactttgcacttgatcacggctatggtacatttaccatgaccatgagaatagtatcactacatgaaaccagtgcacaagcaccttttaaggaggtatttctctcccatgaagatagatcaatacatcggaacattgggaactttgtgcagagggagaaaagtttagatgttgcttgtggaggtaaactcatgttaaaaacccctgttgatgccatcaggatcattgaggataagttctctaacccttataacaactcaggggataggtgtaacgacccgcctcatcgatag

SEQ ID NO: 8950 - DNA, 456 bp, Glycine max
  Peptide Sequence Number=SeqID_125728
atggctgcagtctggatgccactgaatggaattaccatcactgaaatagaaccaagcattttcctatttcgattttaccataatgtggatgttcaacatgtcctcaatggcgggccgtggagtttggataagcacatgatgatcctaggagctatcaagaatggagaagaccctgctcctgttccccttttcagcattcccatttgggttcaagaacacaacctacttgtgggtttcatgtcgcaagtcgttggggaaaaccttagaaatcttaccagaaaattcctagaatacgatgaaaagaacaacgccaatcttctccgttctgtcatgcatattaggcagaacaatggagacggtggattggggtcagacattagacttgataagagaaacaatggtgaaaatggaggccaaaaatggctgcatgaggaaggagacaacaaccactactag

SEQ ID NO: 8951 - DNA, 171 bp, Glycine max
  Peptide Sequence Number=SeqID_125729
atgggtgttaaacaactattgattgaaattccacaaattgttgaaaatgatcttgtagatcaagttgttgatgaggaacaacaagttcctcaagaagatcacgaagcaacattaagaagatctactatggaaagttcagagcaactggagccaagacaagaatttgtttga

SEQ ID NO: 8952 - DNA, 249 bp, Glycine max
  Peptide Sequence Number=SeqID_125730
atgggtatagattggtgcatgggaccaaaatggtttgagacatgtcttttagattatgatccatgttctaattatgcaaactggacttatggatcaggaaaatctaagaaatactcaattgggacaaaaggaagagggctacatctgactacagagaatgaattttgtgaggacaaaccaaattctggtgcaaagttgcatcaactaatggatacaaatcctagagctgatgttgtggcagctggttga

SEQ ID NO: 8953 - DNA, 213 bp, Glycine max
  Peptide Sequence Number=SeqID_125731
atggtggtcaggtttgtgaacaatgacttttatgaagttaagggggaagttgagaagtccgcaatcaaaaggttttatccaaagaaggacaaggctacaacctctaccaataagaatgagctagggtttcagaaagaaaaatggcatcgacaagatatgtccagagaatatgaactgtgctcgggttgcctaaacctcaacagttccaactaa

SEQ ID NO: 8954 - DNA, 816 bp, Glycine max
  Peptide Sequence Number=SeqID_125732
atggtggtgatcgaggacctagaacgattcctcgcgaacaaaatgatgagaacaagcgcatcagggatattgaacttcatggacaggcttttaatctggtgttgcactgaagaaagggttatggtgttcacgatgaacatgaaggagcatgttgacccgaacctacttcattcgggtcgggtcatcgtgcatattgatttccgctttatgatttttcagcgtttaaaacagatggtgatgggagggggttcagggttattagaagatctttgtcgtccaatgaattgccatcattgttctatgttacacttacaagagactgggaaacgtggttttggaattgtggtggctaaagatatcaaggttggggagtttgtcattgaatatgttggagaagctacttacgacttacaagtgttgcctttttggaacatgaaacaacgtggggaaagaaacttctacttatgtgaaatcaaccgagatatggtgatagatgccacatataagggaaacaaatcaagatacaccaatcatagttgttgtcccaatactgagatgcagaaatggataattgatggtgaaacaagaattggcatatttgcaactagtgacatacaaaaggatatttatgcctttggaaagttttggagatgttggtctctcaggaattatgctagcatgactggctggttattctatgtttctaactacatagtaggtttgctccatttggtgcatatcaagattgccattgaggtgttgctgagtgcaagcgtaagttgggtgtccgacctaccaagcctaaactttctttag

SEQ ID NO: 8955 - DNA, 459 bp, Glycine max
  Peptide Sequence Number=SeqID_125733
atgaccatgcttcctttagcactgtcacgcgtgagatcttacgagaagttcaccacggccgtgatcaacgggacactgcagttacttaaaaaagtttgtcatgtttttggctcaagtgcttatgaagttgagtttagaagtcttgcagctgcagcttcagatatcctctgcttcaatctcttcgtcaaggattatggtttcaccgaagaaaatatgaatgataaaggctacggattccagaactcatctatatgtttggtggtcaatattggggtagcttctctactgattgaagcaaccactgctatatttgttgaagttggtgctagcaaagcaaccaggatgatgactattgaagcatcttctaagtattccattgttcacaaactaagcaacaacatcacttcttgcttgtcatcaattgaattagaaaaattcttaatgagaacatctagctag

SEQ ID NO: 8956 - DNA, 318 bp, Glycine max
  Peptide Sequence Number=SeqID_125734
atggtgtccaaagacatgggcgttgttcatgaaaaagcacaagtcgtgcttcccttgttggttgatttttttggcaacaacgtgaatgtgctgaaagtaaggacaaaggatttgacgcttgttcacctttctgatcttgagaacaaaggttctggtttggttgagccaaaagagtgtggcttcgagaaagtggtctttgatggtttggtagggaatgtaagtagagggagaccttcttgtagaggcggtggatctggtcttcgaagcattgatggagaagtggccttgctccttctcgtgatggcttgggaaccctag

SEQ ID NO: 8957 - DNA, 369 bp, Glycine max
  Peptide Sequence Number=SeqID_125735
atgggagatcacttggaggatatgatttgtgaccttggacaagagtcttttcagcaaacacatgcccctatatatgatacattgcaaactgattcaaagaaacctttatatctgaagtgcaacaattccttgatgttgttgttggcggtgttaagtctggttaatgtgaaggcgaagaagatactgtgtctgatgggtatagagtatcagaagattcatgcttgccctaatgattgcatattgtacagacatgaatttgaagaaatgttgaaatgccctaggtgtggggtatcacggtacagagtgaaggatgatgaggagtgtagtagtgatgaaaactcaaagaagggccccgccagcgaaagtgtt

SEQ ID NO: 8958 - DNA, 342 bp, Glycine max
  Peptide Sequence Number=SeqID_125736
atgagacgtcagttgaaagcttataatctctgggagtggagaatgctgaaccaccagctttggaagaaaatcccactgttgctcagaatagatcccatagtgagcaagttgccaaaagagcaaaggatcttaccatcttgctctcaattgtggatgagggagtatgaagccttgaagatgaatgaggctgaaagcataaaagatttcatgaccaaaatgatgaaggttgtgaatcaaatcagatcagattgcaaaatagttgataaactcttggttgtcttacttgaaaggtttgatccaagatttcttcacttgaagagtcaaaggatctctccaagataa

SEQ ID NO: 8959 - DNA, 1181 bp, Glycine max
  Peptide Sequence Number=SeqID_125737
atgggctcaattttgtcagagccacagagacccttcgtgggaggatgtgcgaaagaaggcacaggttgtctagaaacaaaacaattcccttcacgtgttgtctcgtggggttatgaatatctagaaaacaagatgatggaggagaagaaaaagaaaacactagaggaagttgctcaatccgaaagcattgacaccgtgattgatcctccatcttccatcagacgacaagtgaaatggaggatggcctgcacaaagaaaactagccaaatgacatctaaggcaacaaaggaaattgctgacaagattgattcattagaggagcaggtctcacagggttcctttgtcgcccatggacgtcatgatgtactgactgctaccattgggcgaccagaacaccctggtcgtgtgcctgctactaaagccagtgtcacgatcaagcaatactttggatcagctctaaggacctcctgctcgtcttcctccatggctcccaaagacatggagcagctgacgcaacaaattagggaccaactagaggagttgatcacagaaaaaggactcgcattgcctcctgagccagaggttggtccttcaactgctcgtgtcaacacaaaggagagttatgtcgatcccttagggaacgatcgagacatgggtgactcagacaaatgcgggttgtacatcgaagaaaatcttccccgcccggttgccctaggaagactttctgaggggtccacaaccattcacaacattcctttgcttcatgaccaagtcaaggttggtgttgaggaggttagcgatgtagatgccctggttcctatgcccactaaagaggttaagttagtgggtcaggcacataacaactttcttgtttggccaagacatcttgtccggcatttatcagaacaaggagctgagggactggcgaaacctacagataggtctgacaatgatgtcgatgatcccctatatctgataacattgaccatcccacagctttttctgaagccattgcaagttatgtgggatgctaccgtgtttggggtgcataatgacaacttccccttgtacataaagcatgaagatctatctgaaataccacacggtggtgatgctgaacctaagcttggtatccttattctgcttaattatgaattttatggtaaagttgaggagcatag

SEQ ID NO: 8960 - DNA, 297 bp, Glycine max
  Peptide Sequence Number=SeqID_125738
atggatcgagttacatcgctgcttcgtctactgccaaacacatttaggactgttgatgtccttgttacttccagtttcaccttgacaaagataaaaaaacatgctttacggtgcccttaccgaacccgtgctagagctagagtaatgggtaaagtagaggaggtgcaagagcagatgaaggccgacatggaggccatgaaagagcaaatggccacaatgatggaggccatgatgagcatgaagaagataatggaagccaatgcggttgcagttgctgctaccagcgctgttgctatg

SEQ ID NO: 8961 - DNA, 150 bp, Glycine max
  Peptide Sequence Number=SeqID_125739
atgacccgcacgaagaaaactagtcaagtgacatccgagacaacaaaggaaattggagacaagattattccttggaggagcaggcttcacagggcagctttgtcacccatggatgttaggatgtactgcctgttgccattgggtgactag

SEQ ID NO: 8962 - DNA, 846 bp, Glycine max
  Peptide Sequence Number=SeqID_125740
ctcgtggccaccggcgatcttcaacaccgcgttctacagcaatccgcaggtggataaagacctggcggatgcgctgaagaccaccgatcgcgaccagaaagccagactgtataaagacgcgcaggaccgcatctggaacgatcacccgtggattccgctggtggtggagcagctgctgtctgcgaacaataaaaacctgaccggtttttacgtcatgcccgatacctcattcaattttgatgaggcggatctgaatgctggtgttcctgttcgtgcatctgctgccgggcgacccggcgcgcctgattgccggaccggaagcggatgcctcagtggtggcgctgtcgatggtgtcaaagcggccggtctctgccgaaattgccgcgcgcttttttcctactctgtggctgacgctgagcagcatggtgtgggcggtactgtttggcatggcgatcggcatcgtttcggcggtatggcgcaatcgctggccggaccgcatcggcatgacgctggcggtttccggcatctcctttccggcgtttgcgctgggtatgctgctgatgcaggtcttttcggtggagctcggctggttgccgacggtgggcgccgacagctggcagcactacattctgccgtcgattacgctcggtgccgccgtggccgcggaagattatatgcgcaccgcacgggccaaaggggtgcgcgaatcgctggtggtggtcaaacacgggctgcgcaatgccatgattccggtggtcaccatgatggggctgcagttcggctttctgctcggcggctcgattgtggtggaagtggtgttaactggcccggactggccgtctgctg

SEQ ID NO: 8963 - DNA, 693 bp, Glycine max
  Peptide Sequence Number=SeqID_125741
atggtaatcagcccacatctttgctatccagatacgatcgagtccaatggcacgcagacacaaattatggttattatgcaccttttgtcatccagaggcggcgagcccgatgacatgaggagacaacttatggtaatccgcacaccgttttgccatccagagacgatcgagtccggtggcacgcagagagaaattatggtcattctgcaccttttgtcatcaagaggcggcgaggctgatgacttgcggagacaaattattgtcatccgtacaccattttgctatttagagacaatcgagtccggtggcacgcagagacaaataatggtcattctgcaacttttgtcatcaagaggcggcgagcccgatgacatgtggagacaaattatggtaatccgcacactttttcggcatccaaagacgatcgagtccgatggcacgcagagacaaattatggtcattctgcaccttttgtcatctacaggatgcgagcccgatggcatgcgcagacaaattatggtcatccgcacacctttttgccatccagagacgatcgagtccggtggcacgcagagacaaattatggtcattctacaccttttgtcatcaagaggcggcgagcccgatgacatgtggatgacaattatgatcatccggctacatctgttatcacccgagaagcgacgtctatga

SEQ ID NO: 8964 - DNA, 792 bp, Glycine max
  Peptide Sequence Number=SeqID_125742
atggtgaggacgtgcaaccctctgaaggtgaggacgtgcagttgtttgaaggtgagagcgcgtagccttctaaaagtgaggacgtgcagtcctgtgaaggtgatggggtgcaaccctctgaaggcgaggacgtgtagtcctctgaaggtgatggtgcatagccctctaaaggttaggacgtgcagtcctctgaaggtgagggcgtccaaccctctgaacgcgaggacgtgtagtcctctaaaggtaagatcgtttagccctttgaaggtgaggaagtgttgtcctctgaaggtgagggcgcgtaacgctctgaaggtgagggcgcgcagtcctctgaaggtgatggcgtgcaaccctctgaaggcgatgacgtgcaatcctctgaaggtaagagcgtgtagccctctagaggcgatgacgtgtagtcctctaaaggtaagagcgtgtagcactctgaacgtgaggacgtgttgtcctcttaaggtaaggtcgtgtagccctctgaaggtgaggctgcgtagccctctgaaggttaggacgtgcggtcctcagagggtgagggcgtgcaacactctaaaggtgaggacgtgtagtcctctgaaggttagggtgtgtagccctctgaaggtgaggatgtgcaatcctatgaaggtgagggcgtgcaaccctctaaaggcgaggacgtgtagttctctgaaggtaagagtgtgtagccctctcaaggtgaggacgtgtagtcccttgaaggtgagggcgcgtagccctcagaaggcgaggacgcgcagtacttag

SEQ ID NO: 8965 - DNA, 264 bp, Glycine max
  Peptide Sequence Number=SeqID_125743
atgtcacaaaactttacggattacgcaaccatccccttttttttgacttccagaatattacggaacctcacgaattgtttaacgatgctttcttttgatttctggcatgtcacggaacttcacgaattgcctaacgatgggtgccaagtacctcgaagtggtcaaacaaagttgcatgccaccaaacaacggtcctcggacgaaattagggttacaatttattcttctctttggataactgcataccttgtgaaagacaagtga

SEQ ID NO: 8966 - DNA, 204 bp, Glycine max
  Peptide Sequence Number=SeqID_125744
atgtggggttaccttagggttacccgcacattttgtcaaccaggggcaagcgagcccgttgacacgcatagactaacatcgtcttctgcaccttttgccatccaggggcagcgagttttactctcgtcgtccagaagcattcaagcccaacgacgcgcgagattcttttctgctgggcagggacgatcgagtgcaatggcgtag

SEQ ID NO: 8967 - DNA, 384 bp, Glycine max
  Peptide Sequence Number=SeqID_125745
atggtctttaatcggcttcactcgtggattgccacagataagcgcttgtactatgcatatggatcaccggatgacatagagacgtggaagaccttccgaatccaatattcattgcctttagttcggatgcaagcaaagcaaggaaatcagtccctcgcccgagaggagctacctttagagttgcataataggtcttgcttccttaaatggagtttgctctcactatgctttcgtgattccggatggctgctagaatcccttgctattgctattgaatccggtgttgatgctcgaaatcgggttagtggcacttcttttttcacgcttgaactacggggcagactagcggaatggaagttacatccatacggggcctgtacgtaa

SEQ ID NO: 8968 - DNA, 447 bp, Glycine max
  Peptide Sequence Number=SeqID_125746
atggagatgataactatgatagtagacacattaccagtgttctactatgaaaaatggtgggctacacaccttcaagttttcaccgacgaaaggatcaaagtgggtctgaaaagagacaaatttgatcatcctgctttgatgaatgagaaaactggggcaaataaagaggataagaaggagggagaaacccatgctgcgattgccgttcctacatggccaagtttcccaccaacccaacaatgtcattactcagccaataaaaacccttcgccttacccaccacccaactatccacaaaggccatccctaaatcaaccacaaaacccaccttccacacaaccaatgctaaacaccacctctggaacaaacccaaagcaccaaccaagaaatgaattttacagcgaaaagacctatagaattcaccctaattccggtgtcctatgctaa

SEQ ID NO: 8969 - DNA, 202 bp, Glycine max
  Peptide Sequence Number=SeqID_125747
atggatgggattctcatttctagtgtggtgttgttggctgattcacgattcactcgaccggatatgggttttcacccaacaaaactcaatttcgtgcctagcgatgcggatgaggcgccactcgatgtttccatttgcctgcatgcctttggtattggggggtgtgggtcgtttagtggtgtcaagtcttgcgaacgtgagg

SEQ ID NO: 8970 - DNA, 513 bp, Glycine max
  Peptide Sequence Number=SeqID_125748
atgaaattgttagaatccctggatctctcactaaacaacatttcaggtcaaatccctcaaagcttatctgatttgtccttcctcagtgtcctgaatctatcatacaacaacttatcaggcagaattcccacgagcacccaacttcagagctttgaagaacttagctacactggaaatcctgagctttgtggtcctcctgtaacaaaaaattgcacagacaaggaagagttgacagagagtgcttctgttggacacggtgatggtaatttctttggaacatcagagttttatatcggtatgggagttggatttgcagcaggattttggggtttttgcagtgttgttttcttcaacagaacttggaggcgtgcttattttcattatcttgaccacttgagagatctgatttatgtgataatagttttgaagagaactagacgagcttcagacttgagcatcaaattctgttttgtatttatcacgcattattgtcttctactatctgtgctctaa

SEQ ID NO: 8971 - DNA, 228 bp, Glycine max
  Peptide Sequence Number=SeqID_125749
atgtataatacagcctttcttcatttgttcttgcactttcatccattctcattcgtctgcatgtttgtttttgttgcgattaaacagtacagatccgacaaggagtcctatgaaggtactaataccgaggacccagatgtcgattttgagcgactagtaaaaatcgttgaggatgaagaagatgaggattgggggattcccccagagctaaaaagaatggtcgaatag

SEQ ID NO: 8972 - DNA, 225 bp, Glycine max
  Peptide Sequence Number=SeqID_125750
atgacgtctatgccttactttggagtgattcaacaaatcttggaagttgattacagtcaattaagggtgcttgtttttaagtgtaactgggttaatgggaagttcgaccttaataacgtttcttataaggatgagtcattcatcatggtagaaaagcaaaacaagtgttttatctccaagattcgggtagctcaaaatggtcagtggttctacaaggaagaataa

SEQ ID NO: 8973 - DNA, 237 bp, Glycine max
  Peptide Sequence Number=SeqID_125751
atggggctcgggataagatttgtgggtggaggatacacgaacagcgctacgcaatcagttcgtgggactctagactcgatggcaatcaattcgtggggctccagactcgatggtggaggatgcatgaataacaatcaattcatggggctccagataagatttgagggtggaggatacacgaatagttctaggcatgcaattcggggggcttcacactcgatggtggaggatgcatga

SEQ ID NO: 8974 - DNA, 256 bp, Glycine max
  Peptide Sequence Number=SeqID_125752
atggaatcaagcaatgtgaaggacaagtcaagtggaaaaagaaagatgtctagtgaggacacaagaagttacttcgcatggaatttggaaatggagcacctatgtgcaaaggatagagctattggactcggagcagaaaatgcattagatgaagatgatatcatgagtaaagaagcaaatgaagaagaaacaattcacagtgtgagtattgacttagagggatcaagttctgccacaaggaaaaaaattcgcccaa

SEQ ID NO: 8975 - DNA, 234 bp, Glycine max
  Peptide Sequence Number=SeqID_125753
atgaatctggggatcccacggtcatgtggctctgcatgccaccggtctcttgggacacgaggaagcactgggttcaacaaaaatagaagaaaatcactcaaagtgtatcaatctcacacagcgcgtggcgagaaagtcgctagcgcacaggattttgtcagcaatcaaagggagaggaccactttaggttgtggtttcctttttcttgttcacttggtgacaattctgtattga

SEQ ID NO: 8976 - DNA, 779 bp, Glycine max
  Peptide Sequence Number=SeqID_125754
atggggatagcggatggatcaagtttgatgtcaagccttcagcaaggcgtatgggaaaatctgggatttggccatgttggcaccgaccatataagcgttcgaagggatcttaggatgcccgctaggaggaaggatgccataccttttattgggttctatccttctatggcgagaatagcaaaagtggtcaagatcttgaaacaggagctagacaggttgaagcaaaatagaaatggggtagttgggataccaaggaagcgggagtggacctcgttcattgacatcttagcactgttggtgtttggaaccatactatttccaaatgtagacgggctagtggacttagcagtgatcgatgcctttctcgcttatcatcacaacaaggaaagcccggtcatcactgttttggccgatgcatacgatacgttcgacctgagatgcgagaagagcagtgcaaggattgtctgttgtatgcctgctctttatgtgtggttggtctcccacatttttcatcatgaaggtaggcttgagcgtccattagctggttcccccgatggaaagaaggaggggcatgagtgttatgctcgctaccctatgagaggtgcaccgtcggaggacatcatcacgcctttcgtggcacgaggtttcaatgaagccaatgcgaagatacttcagagaattcgtaaagcatggaatatagtggaaaggaaagataagaggcttaggggaagtagcaatggcgtcatcggcggctatcacaagtggttgaagtctaggac

SEQ ID NO: 8977 - DNA, 390 bp, Glycine max
  Peptide Sequence Number=SeqID_125755
atgggttctccacctgcctccactcctcctcctccttctcctcctcctccttcggacgcatcggcttcgccgtctgccgtgaagcggacacgcaaagcctcacgtttacgatcgttgtccactagaccacctggtgttgagagaccagtggtgcatgttgatcctgctaccaggaaggctgatggtccccacaagaagaaattaagaacatatttggggattgtggcgcgttataaggtgggcgtcacctacgagaactggaaggaggtccctactgctcagaaggacctgatttgggaggatattcaggcggaatttgatatcccagaggcttctgatagtaggacgaaaaggaagttactgcagaccgtgggggagggatggaagtag

SEQ ID NO: 8978 - DNA, 378 bp, Glycine max
  Peptide Sequence Number=SeqID_125756
atgacattgcctagcgctgttcatgtgttctcgaccgtcgagtctggagacccgcgaatgtcattgcctagcgctgtttgccaattctccattctccactttcattcggaaccccatgaatgtcattgcctagcgcttttcattcatcctccacccaaagagtttggagctatgcttcatgattgcctaagtgtggaccctctagtgcaatcctccattctccactttttttcggagccccatgaatgtcattgcctagcgctgtccatgtgtcctccaccatcgagtctagagccttgcaaatgtcactgcctagcgctattcgccaattctccattctccacttttattcggagccctttaaatgtcattacctag

SEQ ID NO: 8979 - DNA, 312 bp, Glycine max
  Peptide Sequence Number=SeqID_125757
atggatcgaagttggatgaatgaaagtcgcatcaacccagaatatgaggaaagcgtcgagcggttcttacaatttgcttcagaaagaggtcgaccagatgaagatggaaaatattattgtccttgcatcaattttttgaacggaagacaacaaatactggacaacatacgggagcatatgttgtgtgatggaattaagagaaattatacgacgtggatatggcatggattgcagagtgactcaaagaagccttttgtatccggggtgcaagaattccttgacgctgttgccggtggtgttaagtctggttaa

SEQ ID NO: 8980 - DNA, 111 bp, Glycine max
  Peptide Sequence Number=SeqID_125758
atggccttcagcaacgctctcagatctgccgcgaagcttgtcgcttcttccgaatcctccctctctaactcaggttttaaatatcggtcacggttgcgtcgcatttgttaa

SEQ ID NO: 8981 - DNA, 667 bp, Glycine max
  Peptide Sequence Number=SeqID_125759
atggccatcacaggcaaccttaacttcaacctcaacctagtacttcctgtggcacgccatatggcgtgccctccacgcgtcccgtcgtttctcttcactcgcggtcgaggcgcgtggtccccctcgcttctggtcacgcgcgccatcgacgctaacgagtttctgggggatttcggggcgcgggaccctttccccgccgagcttgaaagctcgttcggggaaaaagtgctgggatacggcaacactgagcacaagattcttattcccaccattactgctctcggtctctcgcagcaggagtgtgctcccgtttcttctgcgcagccccccatctcgctggatgacgcccagactctcattagaaagccttacccttgcatatgcaaagaggctgtttccggattcgaacccatgaccaacaagtcaccaaggcacaactttaccgctgcatcagggctcgccctcaagctcaaggttgtgggttggagacttgtgaatgaggaaaatggacttaaaattcaatgcttgtggaaattgagagattttaaatgtggggttgaactcattaacaggatctctaaggttgtagaggctgagggccatttcccaaatatctacttggagcaaccaaatcaagtgagagcagaactatggacagcttccattg

SEQ ID NO: 8982 - DNA, 150 bp, Glycine max
  Peptide Sequence Number=SeqID_125760
atggcgaagcatgaaagtggtataattgttggggtagaaggagtcttatttcctgttgcgtgtttgctgattttttgctctcctgaatgtgggggttataactgcatagttagtgcatacatctacccttcaatccgtataactgcatag

SEQ ID NO: 8983 - DNA, 243 bp, Glycine max
  Peptide Sequence Number=SeqID_125761
atgaaaaacgaaaaatttcataccgggcaagcctttgtggggactggaagagatgttactcagaaagtgacaaaaaagtgtcaaaaaagaagaagaatagagaaacttgcatgcctggtaagctttcaagcgatgaagaactcttcggaagatgacaagctaaaagtaaaagctagtagcctgcaacagttgaacctactactcagtagtcccatcacacgtgcccctactcttttttgttga

SEQ ID NO: 8984 - DNA, 279 bp, Glycine max
  Peptide Sequence Number=SeqID_125762
atgagtacccaatcatcattcttctctgatgcgggcccatcaaatatgatggcaagaacacgatttacagcagcatttcgtgttcagaagaacatcattgaagttccattgagttaccatagtcaatggaggccatattacccaacttatgttttatttgactacaatggaaccaagcattttattagggtgcgcaaatgtggcactcgatgcttttttgctgatgggctgaaagagtttagaagaacacacgacattaatgacagtgtcattatctga

SEQ ID NO: 8985 - DNA, 1221 bp, Glycine max
  Peptide Sequence Number=SeqID_125763
atgttgagttttctacctgtttgggtgttagcaaaagccaaagagcggggaagcagcaacatgccgaatctcactaagactctccctttggagttgataagagaaattcttctcagattgcccgtcagatctgttttgcgtttcaagtgtgtgtgtaagtcctggctttctttgatttctgatccccaatttgctatttcccattatgacctagccgctgcaccctcccatcgactccttctcagaacttatcgtttttatgttgaatctattgatatagaggcaccgcttaaaaattatttcagtgcggtgcatttgcttctccccccttcatcacccccacgtcccttgcaacttggcgaacataactatcattctgcttgcattgataaccatgagattttgggatcatgcaaagggttcatagttttatactataagagaaacaatgatctcattctatggaatccatccacaggttttcacaaacgattcctaaactttgcaaatgaattaacctatcttctttgtggttttgggtatgacacatcagtagatgactacttactaattcttattgatttatgtgagtctaaaaatgaagagtctgaagatgatgactgcaaacttgaaattgcgattttttcatttaaaacgggtaattgggttctatttgcggagattcatgtttcatataagaatttctattatgatgacttgagagtcggatcactcttgaatggggctcttcattggatggtttgttataaggatagaaaggttcctgtgattattgcatttgatctaatacaaaggagtttattagagattcctctccttgatcatttaactatgaaaaaatatgaagcttatagtttgagcgtaatggatggatgtctcagcgtgtgttactcggtccgaggttgtggaatgattgagatatgggtgatgaaaatatataaagtgcaatcatcttggaccaagtctgttgttatccctacttatggcaaacctcaggatttcttttctccgatatgcatcaccaaagatggaggaatctttggatcaaattactgtggaaaattagagaaatttaatgacaaaggagagctgcttgagaaactcatatatgagagagtctactgtcactccctagtgtttgtcggcaaacaagggacgtacaatgaccttggggaagctagtgaagatgatcaacagtaa

SEQ ID NO: 8986 - DNA, 243 bp, Glycine max
  Peptide Sequence Number=SeqID_125764
atggaagaaggggtagggcttcaatgtcaaagaaagcgagggttcaaacgaaggagcaagcagaaagcgaaaattagtagggttcatgcaagcagaaagcgaaaatcagtagggttcaaacacaaaggtctagggttcaaagcagacaacgaaggagcaagcacaaagagacaaattcgaggaagaacaaggaaggatcttgtcctccctaaggatcctttatatacatgtgaaaaaagataa

SEQ ID NO: 8987 - DNA, 321 bp, Glycine max
  Peptide Sequence Number=SeqID_125765
atggcaggaaacatggggtggggtgtgatagaagaggagggatggaggaagggaccttggacttctgaggaggacaaattgctcattctgactaaaagaaatgggaagagctgcagattgagatgggtgaattacctgaggtcagaccacaagaagggtcaaataacaccacaagaagaaagcataattctagagttgcatgctaggtggggaaacaggtggtcaacaattgcaagaagcttgccaagaagaactgacaatgagataaagaattattggaggactcacttcaagaaaaagataagggctcacttcagctaa

SEQ ID NO: 8988 - DNA, 252 bp, Glycine max
  Peptide Sequence Number=SeqID_125766
atgaacaatattcaagattgggagagagctcgtgttaggcgacttcctgttgctcatcatccttgttcgggttcctggcagaaaccgtgtgtagtttgcagaagcattttgggattggtttgtgttatgaaagatggaggtttttttgtgatagccaagattgttctttttgatggttctataccagtagtagaaactgaagcattggctctttaccatgctaataagctggaaggctggcctaggttttga

SEQ ID NO: 8989 - DNA, 294 bp, Glycine max
  Peptide Sequence Number=SeqID_125767
atggtctttgaccacgagaagtttaacaattgggtggagaagggtgtagctccagccattgaacccagtttaaagctctatgaagatgttttgaatctgggattcaaggttattctactgacaggacggagtgaaaggcacaggagtgtcactgttgataatttgatcaatgctgggtttaaggaatgggaccagctcatactaaggaggaatcttgcaaacaacccattgattccaacctccttttttcgatggacaatagaatctgcttacctgaaatcatcttggcgctaa

SEQ ID NO: 8990 - DNA, 238 bp, Glycine max
  Peptide Sequence Number=SeqID_125768
tctcatggaccctagctcgcccaggctagccattgccctaagtgcccattttcctataaataggtatgctagggaggccaaggagaagttccaaggttcagtgcttgagggaattgagagaattgagagagaagaagaagaaagaagaggaaacgaagttgaagcactgccaaattgcgactatgatgaatctctatgtggttccttgttcggtgcttttcatgcgaccgtcagttag

SEQ ID NO: 8991 - DNA, 285 bp, Glycine max
  Peptide Sequence Number=SeqID_125769
atgaagccgaggtgctgccgaatcgcgactatgttcaatctcaacattgttctttgttcgttgttctttgtgcgacattcggttgcgacaacaggtggagctaatattgaggaggaggaagcaatagatttgaagtcaaatcttcttcaagtgggaggggatgatgcaatcctccctaggaagggaacaatcaccagagccatgagcaagaggctccaagaagattgggctagagctgctgaagaaggccctagggttctcatgaacctcaaggtagatttttga

SEQ ID NO: 8992 - DNA, 384 bp, Glycine max
  Peptide Sequence Number=SeqID_125770
atgtgtgtgatagtgtcatcgacacgcttcttaacattcaaggatctagctgagatgggtatacgagcccagttatatccaaggtctgacgatcttaaaagaatatacaaagaatctacacgtcctgaagcctccattaggtacattacagaagaaactattcaattttgtctagagtacattgaaaaggcaaaacctattgggcctcctgagtctcggcatgatgaaagagtggaaggtaagggttcaggggagttgaatgttataactctgggtctagaggaattgcaacaagttcatttgtatatattgaataacaatactgaagttgtaccatacatagttcatcatgaagccttagtcaaggaagtaacccaaaaatga

SEQ ID NO: 8993 - DNA, 375 bp, Glycine max
  Peptide Sequence Number=SeqID_125771
atgcttccaaaggaaaatacattgcctaaaagttactaccaggcaaagaaggtattgtgtcccatgggtatggggtatcagaagattcatgcttgcccaaatgattgcatactgtacaaacataaatttgaagaaatgtccaaattccctaggtgtggggtatcacggtacaaagtgaagaatgatgaggagtgtagtagtgatgaaaactcaaagagggccccccagcgaaggtgttgttgtatctgccgatcgctccaaggtttaagcgtctttttgctaatggagacaatgttaaagacattacatggcatgcaacagggagaaaatgcgatggaatggtccgtcatccggatttacgttggtagaccttaa

SEQ ID NO: 8994 - DNA, 210 bp, Glycine max
  Peptide Sequence Number=SeqID_125772
atgtggtaccatttttcagtgaaaaacctcgtcgggcgcctaggagtacatgacaggacattcctcacaatggggagaccagtcagggtcacgctgttttgcgagaatgctccaaccatgtgggatcggcacagacttacaggagcactcaaaccggatgacccccaaggcctacactccgaagagtccatcagggcctctccctcctga

SEQ ID NO: 8995 - DNA, 1314 bp, Glycine max
  Peptide Sequence Number=SeqID_125773
atgtggaatctggaacatgattggtactctcccaagagtctcctcagcactcccacccattacgattttccaggtgataggttcattccgaataggagtttgatggatcttgatcaagcccatagtttgctcacaaacagaaccaggaaaattcagaataaagaattcaatgatctgtacagacagatagtggatgagaaactaaatttggattcagaaggaaatccatttaagatgttggtttttaggggaagtccaaaatcaagccgaaaatccattcttcatatcgatgagatgcgagaggaagaagcagcggcattgcaaaacactagcaatcaacattactatcgtagaagactgcctaagaaagaatcaaggatattggatgcaccaaatattagaaatgatttctactcaaacatcatggattgggggaacaacaacattctcgctattgctttggactcagacatgtacctttggaactcagagaataagaatgtatttaagttgtttaaggccactaacaacgattttcctactagtgtttcctggtcagaggataccaaatacttggcaataggatttatgaactcaaaacttcaactctgggatgcagaaacttccaaaccaataaggatcctgcaaggtcatggtcataggatagcaaccattgcatggaatggtcaaattttaacttctggaagccatgacaaatatataatcaatcatgatgttagagcgagaaataatgtgatttctcaggtaaaagcacacaaagcagaagtttgtggtttgaaatggacaagaaggagcaacatgttggcaagtggtggaaatgaaaatcatatttatgtatgggacttggttaaaatgagttcatccaatttcttgcactgttttaaggaccattgtgccgcagtcaaggcccttgcctggtgcccttatgattcaagtgtacttgcttctggaggtggcactgaagatagttgtatcaagttatggaatgtttgtggattagaatggaatagacatcacaaggagcttttaagtggtcatggatttagtacaagtgcacatcacaaccaactttgtatgtggaagtatccatccatgactaaagtgggaggtttggaccgtcacgcttccagagtcctccatctatgccagagtccagatgggttaacagtggtgtcagctggggcagatgaaagtcttcgcttttgggatgtgtttgggccacctgtcaataatacttctgagatctcagaccttgataaccttttgtctctcaaggtgtccccaataagatga

SEQ ID NO: 8996 - DNA, 402 bp, Glycine max
  Peptide Sequence Number=SeqID_125774
atggttcaattgaaagggatgaaagtgaaagaaaaggtgtcacaggaacttgcataccttgccaatgatgtagattttgccatcttagaagggatggttttccagcaagacacacagggagcactgcaactatttaaagggagaaaagaggctagaattctagaagtcactcaacaaaactttggaataatggctaaaagtggtgcagagacagatgaagctgggttggtgaccaagctgttgcaggaaatgaaggaatggcagagagtggaatgtggagttcatgactggaataatgtaatccacttcttttgcaagaagagactgatgcaagatgcagaaaaagctttaaagaatatgagaagcttaggccagtcgccaaaagcgcaaactttctggtaa

SEQ ID NO: 8997 - DNA, 147 bp, Glycine max
  Peptide Sequence Number=SeqID_125775
atgtcgagacgcttacataacgtttccgtgggtgattttgcgaagattttcaaccgttcttcgtcgttcattgttcgttcttcgtcgttcttcggtcttcaaccgtcatgccgtaaccacgttggaaaccaaaaagaggtaaaataa

SEQ ID NO: 8998 - DNA, 621 bp, Glycine max
  Peptide Sequence Number=SeqID_125776
atggttattttgtacaataagggtgacattcttccagccttcaacaatgcagcgcaggcatgcatgcttgcatggaaccatgacttcttctgggagtccatgaaacctggtggtggtggaaggccatctggggagcttctaaagctgattgaaagagactttggttcattaaaaaaattccttgatgagtttaagactgctgcttcagcacaatttggttcaggatgggcatggcttgcatataaagaaagcagacttgacgtgggaaatgttctgaatcctcttcaatctgatgaggacaagaagctagttgtggtgaagactcccaatgctgtgaacccccttgtttggaactactattatccactccttaccattgatgtctgggagcatgcttacttcattgactttcagaatcagcgccgtgattatatatcggtgttcatggataagcttgtgtcttgggatgcagtcagctcaagacttgagcaagccaaggctctaatcgaggagagggagagagaggctgagaggaaaagaagagatgaagagaaaccgacaagcagtgaagccactcctgagatattttctgatagtgacgctgacttggatgtcgaatga

SEQ ID NO: 8999 - DNA, 231 bp, Glycine max
  Peptide Sequence Number=SeqID_125777
atgtgggccatcatcgatgagtacgccaagatatcagcagaaagggaagcaagggaaaaggtaattgattcattgcaccaagaggcaacaatggagaatgaaaagattggctcttactctgaacaggagtcaagaacttccccgattgctagccaaggccaaagcaatggtggacacctactccccccccgaggagatccatggacttctcagtttattgtcagcatatga

SEQ ID NO: 9000 - DNA, 441 bp, Glycine max
  Peptide Sequence Number=SeqID_125778
atggcgatatccaaagcccaagtcaaaggctgttgctcccagctccctgcacctgcaaccctacccctgtacctcctgcacccctacccctgcgtgcctgtgactactgcccttaagtcgccagtcaaaccagtggaagtggcgacatgccacgtgtctcatctgcagcgaatgtgccagtggggttggcagtttgcgtggtctttgcatgctggcccacttgggccttccagattgttcctccagaaggtggttgcttctggaggaagcaacctggctcgcctgggcgagctgggtggcaagctcttcccctattttgctataaatagggggaggagtgaagaaggaaggggttcagccttcttggcacttcgtattcacttgaaattgctgaggaaaattgtttccgtggagaaaatccaagccgaggcgcttccgtaa

SEQ ID NO: 9001 - DNA, 129 bp, Glycine max
  Peptide Sequence Number=SeqID_125779
atggcacgagaatgcttcccaaatgaatatatgatgtggaattgcccctctagtgtagatgaatggcatgaaagttccttttcaaatgcaagaaatgaccccgaggaaacttgcctcaaagagatctag

SEQ ID NO: 9002 - DNA, 456 bp, Glycine max
  Peptide Sequence Number=SeqID_125780
atggcgaggatttctgacaagattaggtctattgatggatcaaaagaaacgcttaagcttgctgttaggatcaccgatctttggttcgttgggactcctgacaaatctgagcaagcggaaatggtttttgttgattctgagggtgatcaaattcatgctatttgtaaatcggatcacctcaagtcttggaaagctgatttgaaagagaattgcacttatgttatgcataatttcaaagttgttaagaatgatgatcaatttagagtgtgcgaacatgagtacaagttattttttattggagtgacggttgttagagaagctgatttgcatgaacttccttttaaggaatttagatttgttgaatttgcaaatgttgttgctggcaattttgtgtctggcctgttggttggtggtctttcggcatgtttcatcgaaaaataccagggttgtttttag

SEQ ID NO: 9003 - DNA, 291 bp, Glycine max
  Peptide Sequence Number=SeqID_125781
atgcaatggtcttgtggcaagcaacgacaactcgcgacggtcaccggtggtcgatggtggaggaggaggaggttgggagtgttgggtgagggtttagggaagaagatggaagcaaaatggttgttttatgttgttggatgtatttgtatcctgcaagactcggccagatattattttaaaaatcctagcggtcaaaaagtgcagatttgggttgcaagactacagtccaaatctgaaggcgatccaacggttactgtatccaggatcatggttttactggaacaagtttag

SEQ ID NO: 9004 - DNA, 396 bp, Glycine max
  Peptide Sequence Number=SeqID_125782
atggaaaagcaaattgggaggaactcttggcagagaatccgaaaagcgtggaatgtagtggaaagaaaagataaggagcttcggggaagtagcaacggtgtcatcgatagctatcataagtggttgaaggctaggatgcaagggataatttggctcccaaagctaaaaggtccaagtggggaagaagttgaagcccctgaggaaagtgaagaagtgcaagccttgaaaatagagcttgaaagaatgagagtggttaaggaaaagctaaagatagttgtcactagggtcaagaagaagtgtaataagctaagggatgtcaacatgactatggccgaagcgttagagcgggaaacaaaaagggcccgaaaggaagaatggagcatgaacaagttttga

SEQ ID NO: 9005 - DNA, 201 bp, Glycine max
  Peptide Sequence Number=SeqID_125783
atggtgctggtagcggctattgcagccgcattgacctccattatcttcttcatgctcatcatggcctccatcatggtggccattggctctttcatggtttccatatcggtctttatctgctcttgcacctcctatacttcgcctattactctagctctagcacgggttcggaaagaatgcaatgagcaatgcaaccaatga

SEQ ID NO: 9006 - DNA, 303 bp, Glycine max
  Peptide Sequence Number=SeqID_125784
atggccaccatgatggaggccatgatgagcatgaagaagataatggaggtcaatgcggctgcaatagccgctaccagcaccattgctgagccttgccttggatatgccactgaagggcaagaagttggtggtatacccctgcaaaacactttggagggccctcagtatcacccacaaccacaccccttgcattccacagcgggtaaaaaccctcatgttatggcaaaaatgggaaagttggatcatctagaggaaaggctcagggccattgaaggaggcgaagattatgcctttgttaactag

SEQ ID NO: 9007 - DNA, 225 bp, Glycine max
  Peptide Sequence Number=SeqID_125785
atgaaagacctttttgttacaaaacttgaaagtaatgaagtgcttcttagtccaatatctcttaaggtggttgagcccttgctttttgactcaaattcttcaagggatggcaccaatcctcctttccaattccctatatggcaattcacaaacaagggaactaagagacaagcaataaccaaagaccaacaaattgaaatgaaagataaactaatagagttttaa

SEQ ID NO: 9008 - DNA, 267 bp, Glycine max
  Peptide Sequence Number=SeqID_125786
atggctttcggggcttccgtaaaatttctgaaaaccttggaaaatccaagtcgaggtgcttctgtaaagcttctgagacttttccgtgaacaatttcgtgaagattttatgccgttcttcgttcttcaaccgaactacgtaggtctgatttcctcatcgcaattgaggatacataggagcaaaagctccgcttttgtcgaccaccccaagagatcgttaatggtacaacaccttaatgtttctctcctttcaaaaaccatgagatag

SEQ ID NO: 9009 - DNA, 324 bp, Glycine max
  Peptide Sequence Number=SeqID_125787
atggcgcctccaggatctattccctcagccaagcagtttagagagttggtagcctggcctgggactcagtcttttcttcacagggaagatgaaggtcccacagctcaggtaccacagaatatggaggatgagtcctctgaggcaactatcccaaagccatttactataaaggaggaggcaggcaacacacagacgacacaggtacctgttgccactcttgagagatctcttgaggccattttagaggccccaacaccagcagtggatccatcttcacctcagtatgaaacaaacccttccactcatgtcttagagataccttag

SEQ ID NO: 9010 - DNA, 279 bp, Glycine max
  Peptide Sequence Number=SeqID_125788
atggcgagtccgattacatgcgggggaaccttatggtcccgcaccttttgtcaaccagaggcaagcgagcccactgacatgcagagactaacgttgtcatctacacctttgtcatccagagacggcgagtccgataggcaagcgagcccgttgacacgcggagacaaattatggtcatccgcatacctttgctatccagagacgatcaagtacgatagcacgcagagacaaattatggtcatccgcacacctttgctatccagagacgatcaagtctga

SEQ ID NO: 9011 - DNA, 692 bp, Glycine max
  Peptide Sequence Number=SeqID_125789
gtcgaactgaccgccgccggccaggtgctgtaccgcgaggccctgacgctgctgcgccaggccgaggacgtgcgcatgctggtgcagcgggtcgacgccggcctgcgcggccgcttgcgcatcggcttcgtggggtcgatgctgtaccgcggcctgccggcgctgctggagtccatgcgggccgaactgccggacgtcgagcacgtgctgaccgaattgaattcgcacgaccagatcgaggcggtgcggcgcggcgaacaggacctgggcttcatccatgccaacccggtgccggccggcgtggcggcgcgcgatctgttggccgaacccttcgtggtgtgcctgccgcaaagccatgcgctggccgggcggcgttcgttggcctattacgagactgtgctgtcgctgtgcgtgggggcgggcttcatgcccgtggtccgccacgaggtgcgccactggctcagcgtggcttcgctggtgtcgcagggactgggcgtgtcgatcgtgccgtcgtgcctgtcgcgcagcggcctggcgggcacccggttcatcgcgttcgagcaccaggcgcgctcggtcagccaggtgatctggccgcaagagggccggtcgccgctgcaggaaaaggcgctggcgctggtcgagcgccagttccccgcgggctgaacgggcgtccgggtgttgtctcctga

SEQ ID NO: 9012 - DNA, 261 bp, Glycine max
  Peptide Sequence Number=SeqID_125790
atggcggaaccattaaagaagcgaaatggcacatcgaggacgtgtagccctctgaaggcgaggaagtgtagtcctctgatggcaagggcgtgtagccctctgaaggcgaggaagtgtagtcctctgatggcgagggcgtgtagccctctgaaggcgaggatgtgtagtcctctaatggcgagggtgtgtatccctctgaaggcgagggcgtgcagccctctgaagttgagggtattagtacccaagggtccacccttatga

SEQ ID NO: 9013 - DNA, 425 bp, Glycine max
  Peptide Sequence Number=SeqID_125791
atgccaccggataggcagtctattaccaatgcctggaaaaaaaaacccaaatttgcacagctatatatctttgacacagaaaatgaagtgcaaaataaaattaatgccatgagccaatattctggaattcagagccatattgtttcaggtttaagtcacatgctcgatcaacacaattctcatgctaaaagttttagaatggccagggatagattggcaggtgatcaagccaataatatcaaattgcaactaatagctgctcgaggaaaagatggtcgtgtatataatatgcctaatgttccagaaattgctgcacttattgttggcgattttcatccaggctcaaaaagagatattattgttgaaactcaaaatggagaattacaaagaatccatgaacttcatgctagctatccaccactaca

SEQ ID NO: 9014 - DNA, 330 bp, Glycine max
  Peptide Sequence Number=SeqID_125792
atggagtggttttttcggatatcgcacccattcgtcacgcggaccgaggagactgctgcgccgagacatccgcctccccctcatcatgaggagttcatcgagccacccatccccgaggttttagtcatgaccgatctccctacgcattcagtggttcactgcgaaggatgtcaggggatggctcaggatttaggagcgattgttgaggatttggagcgggtcatcaacctcaggatggtcattgagggcactgacttacatgacatcatgactcgtagtctgaggagagctagaggtgacaccgcatatggaagtcttaggccgcgctag

SEQ ID NO: 9015 - DNA, 162 bp, Glycine max
  Peptide Sequence Number=SeqID_125793
atgactgccacaagccgcctttgcttgccgtcgggtcaccgcacggagaagaacagtttaattggagcagaatcttcaaaacttaactcgaggatttcgtatagaacaaagcctccaatccttccttcccggtttcttcaagttgagggtcagggaacctaa

SEQ ID NO: 9016 - DNA, 1335 bp, Glycine max
  Peptide Sequence Number=SeqID_125794
atgttggcggtgtcacctttgaggagcacaagagatgaaggagggcaaggagagatattggagagtgtctcaattggaaccgatgattttgctgacctttccgaagggaacttgcttgaaagcatcaacttcgatgatttcttcatgggaatcaatgatgatggagatgtcttgccggatctggagatggaccctgagatgcttgctgagttctccctcagtaccgaggattccgagatagcctcatcgtcagtttcagtggcaaataacaacaatgatgggaataatatagttactactactgaaaaacaagatgatgaggttattattatagcatccaattcttcttcagattcgggttcgagtcaaggggaggagatagtaagcaagagtgatgaatcagaggtggtggtgaatccatcccctaaggaaagtgagaaaggaagaaaatcatcaaatcatgcatcaaggaataataatcaagggaagagaaaggttaaggtggattggaccccagaattgcacaggcgattcgtgcaagcagtggagcagcttggagtggataaggctgtgccttctaggattttggagattatgggaattgactgcctcacccgccataacattgcaagccaccttcaaaaatatagatcgcacaggaagcatttgctagcgcgtgaagctgaagcagcaaggtggagtcaaaggaagcaattgttgggtgcagcaggtgcaggtagaggaggaggaagcaagagagaagtaaacccttggcttgcaccaaccatgggcttccctcccatgtcaccaatgcaccactttagacctttacatgtatgggggcatcacaacatggaccagtctttcatgcacatgtggcctaaacatccaccatactcgccatcgccgcctgcatggccaccacgaaccgctccgtctccgccgtctccggaccctctatattggcaccaacatcaactggctccaaacgcgccaaccacaggaacaccgtgttttccacaacctctgacaaccacgaggaaatacaacgaaaacacgcagagatttgggtctcaaactgttccgggaatcccaccacgccatgcaatgtaccaaattgtagatccaggcattggcatcccggccagccaaccgccacctcgaccccttgtcgactttcatccgtcaaaggagagcatagacgcagctattagtgatgttttatcaaaaccatggctgccactacctcttggccttaaagctccagcacttgatggtgtaatgggtgaattacaaagacaagggattcccaaaatccctccctcttgtgcttga

SEQ ID NO: 9017 - DNA, 1146 bp, Glycine max
  Peptide Sequence Number=SeqID_125795
atggagttatggttggctgaaaaatattttctacttattcttcttagttttctggtatcactctctcctctcttcctcgtaagggcaagagggaggttgggaaagactgcaatattattctctcatgcaaaagaaagcaccaaaaaaactcaacctatatctcttagtcttcctcggtccatcttgtttcggtttctgttccatttcttttatagcagcataagaggagcttacagagaagaagatatccagaaatggaatgagggtgaaattaaagaggataacaaggaaatgactcagtgcaattaccctcaaaacagccatagcatcattgtggagaggcacaaagatagcttgatcagaacatgtcctacatgtggtcttcatgtcaaatgccaagagcagtttgaatttaatgatgctgctggaattcatgacttgcctggacttcctgctggagtgaagtttgatcctactgatcaggagattcttgaacatttggaagcgaaggtgcgctctgatattcacaagcttcatccattaattgacgagttcatccctactcttgaaggcgagaatggaatctgctgtacccatccagagaagttgccaggagttagcaaagatgggttgatccgacatttctttcacaggccttccaaagcatacacaactggaacaaggaaaaggagaaaggtgcacacagatgcagatggcagtgagactcggtggcacaaaacaggtaagactaggccagtcttcatcagtggcaagttaaaagggtataagaaaattcttgtactttacacaaactacagaaaacaaaggaagcctgagaaaacaaactgggtcatgcaccagtaccaccttggcaacaatgaagaggagaaggaaggggagttggtggtctccaaagttttctatcaaacacagcctagacaatgtggctcactcatgaaagacctgtatcctgcaaaactaagtggtgaaggcgtgcatgaggtaactaatcataagaacactggctatgtcgagtactacaataattcttttgtatcatatgatcaaggggaccagcataggtccagcactgcacaattagtatcccatttccctgtccatgatggtgctcctttcattccttga

SEQ ID NO: 9018 - DNA, 852 bp, Glycine max
  Peptide Sequence Number=SeqID_125796
atgtgtggacctagtgtctatatttcagggcccattagagtaaggcccatgaatttgaatattccagaacccaactccagcctcttggcccacaacccaaaacaaacaacaatccaacatcctccgcacctgcgttgcgtgttagaatcgaaactccacagtccagtgagaggaagagaaagcatgaagttcacagactcgccggtgatcgagcttgcggtgaacgacgccgttctgtcgcttcagcaagacaacgggtccatgcacgtgggaaccaccgtgtggccatgctccctcgtcctcgtcaaattcgcggagcgctggggcccaccctctgacaacaacccctacgctcgcgtgctcgacttccaaggcaagcgggccgtggagctcggcacgggctgcggcgtggcgggaatgggcctctacctgttgggcctgacggacctgctcctcaccgacatcgcacccgtcatgccggccctgaagcgcaacctgaaagtcaacaagcccatcctccgcaaggccctcaaacactccgtgctctactggaacaacccgcagcagatcgctgccctaaatcctcccttcgatttcgttatcgcaaccgatgtcgtttacattccggaatctgttccttccttggtttctgcaatggaaaccctcgtctctgacgacggcgtcgttttgcttgggtaccagcttagggcacccgaggcgcacgagcttttctgggaactgtgtcaacaagtcttccacgttgagaaagtcccgcacgagcatctgcatcccgattacgcttacgaagaaaccgatgtttatctgttgaagaagaaaaacaagaaacagtga

SEQ ID NO: 9019 - DNA, 1479 bp, Glycine max
  Peptide Sequence Number=SeqID_125797
atggatgatggagaaatctcaaatgctttccctcaccagaacccttcaactgctgcatctaacaatcagcctcctactttgaagaggaagagaaacctccctggaaatccaggcaacatctttggttttatctctttctgtctctctaccttttctcttctcgtcatcatgataataaatcccgaagctgaagtcatagtcctatcaccgaagactctaatggccacaaacagattcgtgtgtgaaatctgtctcaagggtttccaaagggaccaaaaccttcaactccatcgcagagggcacaaccttccttggaagctgaagcaaagaacaagcaaagaagtaaggaagcgagtttatgtgtgtccagagaagacatgtgtccatcaccacccttcaagggccctgggagacctaactgggataaagaagcacttctgcagaaaacacggtgagaagaagtggaagtgcgagaagtgctcaaagcgttatgctgttcagtcagattggaaagcacactcaaaaacatgtggcaccagagaatacaaatgtgactgtggcactatcttttcacggagggatagcttcatcactcacagggccttctgcgatgccttagcagaagaaacagctagagtgaacgcagcatcaaacattagcaactacagcatcatgcaaaatcccctaggtcctaacatgacaacccaattttcatcatttttcaagccaaattcatgctctgatcaggagccagcaccaggtaaccaaacatctaataagggcctatccctttggatgactcaaacatctcaggctcatgaggcaatggctaacaacaataatttgcatgaatttcatcaacttgggtctgttacaagcccaacagcaatttatggtactagtgggaatccacttgcttcatgctcaaatccaccaccctctaattaccagctaaattgggtgtttggaaataaactctcctccaatggaagccatcaagagttaactagcactgcttcacttccactagtcaataacattgttaaggataacccaaaccttcaactcataagtgtcccttccttgtatagctcacaacaccaatcccatcaagcaagctcagcaaacatgtcagccacagctttgttgcaaaaagctgcacaagttgggacaacttcatcggacccatcatcattattccatgggagcataggtttgaaatgcaacagtccaggccaagatgggaacaaattttgtggcatgtacggttcaagctcagtactcacaacaagtcatcatgggagtgaggcagagaataataataataattattcaggtgatttgtcacaaataccccctacaaaaagacggcacgtacagaatgaggagagtgcatggggacaaactagggactttcttggtgttggtggtgccaaccatttgccacccttcatcaaccaacggatggatttgatttga

SEQ ID NO: 9020 - DNA, 429 bp, Glycine max
  Peptide Sequence Number=SeqID_125798
atggagcaggacaagttgggcgccgtccaaatcaataggtacacaaaatgcaaagcagaggaggaagttcttgtttcaccaaaagagaaggaggggatgaaaatggtgctcaacatggtttctgagaacgccgttatagtgattgcgagaagagggtgttgcatgagccacgtggtgaagcgtttgcttcttggtcttggtgttaaccctgcggtttatgaggtagaggagaaagatgaagagggtgttgccacgcaactggaagcaacaattcgtagtgatgatgggaacacacaacaggggaaggtgcagtttcctacggtttttatagggggtaagttgtttggaggattggataggatcatggctactcatatctctggggaattggttcctatcctcaaaaaagctggggctttatggctatga

SEQ ID NO: 9021 - DNA, 474 bp, Glycine max
  Peptide Sequence Number=SeqID_125799
atggataaccactcgggtatttccgcccgtcagcgtgactcaaaagtcagtatgacagatcttgtgagcgcggaagatgacgtaaatctccgcatgtcaaggggttgtcggacgcgattgacgaagggcgcagaagacgaagttagtctctacgtgctatcaggcttttcgtcttacagacagcaaaaagtttatacggataaccactctggtatttccgcccgtcatcgtgactcaaaagattgtcggccgcgattgacgaagggcgccgaacacgacattagtctctgcgtgctatcaggcttttcatcttacagacagcaaaaagtttatacggataaccactcgggtttttccgcccgtcagcgtgactcaaaagtcagtatgacagatcttgtgagcgcggaagatgacgtaaatctccgtgtgtcaacgggattgtcggccgcgattgacgaagggcgcagaagatga

SEQ ID NO: 9022 - DNA, 612 bp, Glycine max
  Peptide Sequence Number=SeqID_125800
atgccatgcaagaagaaccttaaacaagtgttaaaccatgcttcaaaaacaaacaacaacaacaactgttgcttgttttgccattgtggtgcttcttcttcagcctctccaacctccacactcttcggcatgtcgcatttctcgccaccactatcaccttcctcgtcctcttcaccacctccttctccgttgaaacccagaaacgcggtttctcctatttcccgttacagtgctgtgaatgtgaaccctcatcacgtggtgagttacaaagacgtgttcactgaattggtgaattctttggagcgtttgagtttcaacgagggttcacctgtttccggtgcaaaagcaccgaactttccttggcttgatgtttctctgaactgtgaggaacagcaacagcaacaacaaaaccctttcatagttccttcttttggctgcgaagatcagcagcaacagaaccagtttattttttcaccaccgtccattcagacaccgacaaatgggaagttctgtagcaacagattcatgggcaacgacaacaacaacaaggttgtcggtggtgctgacgttaatggcccagatctggcgtgggtgaatgagttgctgatgtag

SEQ ID NO: 9023 - DNA, 486 bp, Glycine max
  Peptide Sequence Number=SeqID_125801
atgttaccggtaaaattctcagctggcgaggtgtgtgtgcgaaaaaacacacctttctcttgcagttcctgccatccttacaggcctctgtcctgtacctggaagggtgcagccaacattcgaacacgccatgagcgtattcgcatgcatcatcacggctgcaccctccacgacgatactccggacagactgttcctgagtagtggtaccgccgtgggtcacggcggcgtgccttttcgcccggatgtgcaaaagggcagtggcaaatttcccagactaggcatgaacagcgccacactcaggcacgcgacacgtggctgtgtcgcctctgccactggcgacagcactgatgtcgccacctgcaatggcgttttggccatgcagggtggagtcgctggtcaaaccagcgcttccccacgcgtatcaggtacagcttttgcaggtgaaccagcttttgcagtgcagctgaaaacgccaggtccttag

SEQ ID NO: 9024 - DNA, 648 bp, Glycine max
  Peptide Sequence Number=SeqID_125802
atgaatctgaagaacatgaaggttccgaacgttcgaggtggcggggggatctctgcgctgctgaagcttgggattgttggtggaattggtttgtatgcagctgctaacagtctctacaatgttgaaggaggtcaccgagccattgttttcaacttggtgtcaaagacaagtaaaattgatatgttgtttaatgtgcaggtctatcctgaaggaactcacttcataattccgtggtttgagaagccggtgaaaattggacttcgagttcttactcgcccgttgcccaaccaattacctacggtttatcggacccttggagagaattataatgcaagggttttaccttcaatcatacatgaaactttgaaagccgtggttgcccagtacaatgccagccagcttattactcagcgagaggctgttagtcgggaaatccggaagattctgactgaaagggctgctaacttcaatattgcccttgatgatgtgtcaattactagtctgacttttggcaaggagtttactgctgcaattgaagcaaagcaggtagctgcacaagaagctgacagggctaaatttgttgtagaaaaagctgagcaagacaagagaagtgctgtaattagagcacaggtgacgataaatttttaa

SEQ ID NO: 9025 - DNA, 702 bp, Glycine max
  Peptide Sequence Number=SeqID_125803
atggagttaggagttaggagtttctcgaagaaattcatagaggataaggcacaagaatatgaaaacaaaggagagtggatgtatttcatgagtatcctagatctcttaatatatagagtgatccttttccctagcatgattgaccagattgatctggcggcggttgatgcgttcttagcttatcattatcgacgggaaagtcctgtagtatccatcccttctaatgtgtactatactctggacttgagctgggagaagaaaagcactagagtagtcatctgttgtttacctgaactctatgtgtggatggtgtcttgtttcgtgatgctcaatgctatccaaccgttaattgctcgaggatcgaacaaagaagatctcgggttgcaccaacaaattaggaaggtgtgggactcaccaaataggagagacaaagagttaaggaagagagaggagggtgttgtaggcagctattcacagtggttggagaatagggtgcgagaagtcaagctgctgaaaaagacaaatggtgaaggggtcaaaatagatgtacctattgagacagaagaggtcagaaaattgaaagcagaattgcagaaatccatggggacaaaagaaaagttgaagggagtggttatcagggtaaggaaagaatgcaatagactaagggacatcagcatgtcaacaactgaagcattagagtga

SEQ ID NO: 9026 - DNA, 162 bp, Glycine max
  Peptide Sequence Number=SeqID_125804
atgacaaaaggtgtttgtacggataaccacttgggtatctccgcatgtcacctgacttcatgggtcaggatgacagaaaccgtttgtatggataaccgcttgggtatctccgtatgtcacctgacttcacgggtcaggatgatagaaggcacgaaagatgac

SEQ ID NO: 9027 - DNA, 201 bp, Glycine max
  Peptide Sequence Number=SeqID_125805
atgaaggctattgctatttctactctccttaattgttattacactcccattttgatgaaagaagccttctccttaattgcgatttctggaatgcaatatggtctcgctatttcttcttctggaattctcaaggtagtccctaaactcactcgttctaatgggagttgctgtgttaagtgtggaaaattgattattgtttga

SEQ ID NO: 9028 - DNA, 462 bp, Glycine max
  Peptide Sequence Number=SeqID_125806
atgagtacagcaagattcatcaagtgtgttactgtgggagatggagccgtgggaaagacatgtatgctcatctcttacaccagcaacacattccccacggactatgtgcctacagtttttgacaacttcagtgcaaatgtggtgattgatggaagcacagttaatctaggattatgggacactgctggacaggaggattacaacaggcttaggcctttgagctacagaggagcagatgtgtttttgctggcattttccctcctcagcagagccagctatgaaaatatctctaagaagggagaagagctgaagaaggaaattggtgctgctgtgtatatagaatgcagctcaaagactcagcagaatgtgaaggctgtgtttgacgctgcaatcaaggttgttctgcagccatcaaagccaaagaaaaaacgaaagaagaacagaacatgcgttttcctttaa

SEQ ID NO: 9029 - DNA, 909 bp, Glycine max
  Peptide Sequence Number=SeqID_125807
atgggtgccgacgaagactacgactacttgttcaagctggtcctcatcggagactccggcgtcggcaagtccaacctcttgtcccgattcacccgaaacgagttcagcttggagaccaaatccaccatcggcgtcgaattcgccactcgaagtgtccccgttgatagcaagctcgtcaaggcacaaatctgggacactgcaggccaagaaagatatcgtgcaattacaagtgcatactaccgaggagccgtgggtgctttgatcgtgtacgatgtaacccgacacgtgacattcgagaacgtggagagatggttgaaggagcttcgggatcacacagaagcatacgttgtggtcatgctggtgggaaacaaagcagaccttcgacatttgcgtgcagtgtccacagaagaagccacagaatatgcggagaaagagaacatctacttcatggaaacctctgcccttgagtccctgaacgtaggcaatgctttcgtagaagtgctgactcagatatacaacgttgtgagtaggaagactcttgagaccatggatgatgaccctaattcaaaagccttacccaaaggggaaaccatcgttattggaaccaaagatgatgatgtctcagctggcaagtccttgtcggggctggaaacaacggggacaaccgacgagagcggtgaaccggttccggttcggcccaggggtcggagcgagatcgcatccgatcccggttcggaccgggggtggttgtgctggatcgggctcggcggtggtggttgcggttgcggggacaaggatgcggccatggggtttgttgggagcggagacggcggagtaggagacggaggagtaggaagaagaagaaggagaagggttgttcttgttggttttttcgtagatgtggttgaa

SEQ ID NO: 9030 - DNA, 555 bp, Glycine max
  Peptide Sequence Number=SeqID_125808
atgaagacaacaataacattaagtgttcctatcatcaatcttcttgtcttgagcaatctatggataactgcaagtgcatgtcctgaaaattcatctgattcagaaataaggaggaagaggtatgaaagttggctgaaagaatatgcacgaaaatacgggaacaaagatcaatgggaagtccattttgaaatttaccgaacaggattcatgtaccaaaaacatggggatctaccaaaaagcatagattggaggagaagaggtgcagttacacatatcaaggatcaaggccatgttggaagttgttgggcattctctgaagtggaaggcatcaaaaaaataaaaacaggaaagctggtttctctttcagaacaacaactgatagactgtgatagactgggttcctttcttatcctcttgtcccactgccctttgcgtagaaaacccctagtggtccccaagatccaccttagtagtgaacccacctcaaaaccagtaaacccaacaaaggaccagcaaatgaaagtgaagttaagccatattgaagtcattaattga

SEQ ID NO: 9031 - DNA, 159 bp, Glycine max
  Peptide Sequence Number=SeqID_125809
atgcagatgagaggagaacatggctctgaggaactggaaggcaaccagaacgtgaagtccattggaggacagctagtgcaagggggaagggatgggagctttgaagggtcctgctcaagattttgcaatgaagaaactgaacgtcctgaaagacattga

SEQ ID NO: 9032 - DNA, 177 bp, Glycine max
  Peptide Sequence Number=SeqID_125810
atgataccagaaaattacataaccatatttggggtaccttgtgctgcacaaaccacttgcgaaaagatccaagctttagatgttggacggaaagggaataagctgcagaagttaagagaagaaaacaacagcaatgccattgggctgtcacttgctgatcaccgccgcatcttctga

SEQ ID NO: 9033 - DNA, 342 bp, Glycine max
  Peptide Sequence Number=SeqID_125811
atgggtggggcaggatgtgttccagattcgagtagttatggcactgtaattggtgcaatgagcagagtgagaaagactgctaaagcactggatttgatgaagcaaatggtggtccaatatggtttaaccccagacagggaacactgggaaatatggaaggctgttgagatgattgaattcctggagaaagagggtaactctgttggatttgagagttacaagttagtgattgaagggtgctttgagaaacgtgagtacgttttggctgcaaaggctgcaacagggatgacagaaaaaggttttatttataccatatatcagggtcaggcagaaaattattga

SEQ ID NO: 9034 - DNA, 108 bp, Glycine max
  Peptide Sequence Number=SeqID_125812
atgggaaagctaccacatccatatacgggagttgatgtggagtccaaatgtgtgagtggcagtgatgatatttacactggcatgagtgtgaccttttggctggcatga

SEQ ID NO: 9035 - DNA, 198 bp, Glycine max
  Peptide Sequence Number=SeqID_125813
atggtggttcccagcgagatcccgtgtttctttaacagtagcaagaaaatgacacacaataaattctacaacatgcttaaaatcgatgatgaaaagtcagatgtagcattggctttttctttctgtagctgccatacctatgcctgttctgaaattagtattatttatctcttaccgataagcgataatgttaattaa

SEQ ID NO: 9036 - DNA, 678 bp, Glycine max
  Peptide Sequence Number=SeqID_125814
atgattgcaactgcaaagagcataaaaaggcttataaatgcagtcctaacagcgcttccaatttatttcttttcatttttcagggttccccaaaaaataatagagaagctagtcaacattcaatgtagattcctatggggcggtggttcggagcaaaagaaaattgcgcgggtcaattgggaaaccgtatgtctcccaaaagacaaaggaggtttaggcataaaagaccagcggatgttcaacacagcattactaggaaagtggagatgggaaatatttcaacacaatggagagctgtggaccagaatattactctctgagtatggtgggtggagaaatttagatggccatagaagaagcagttaccattcacactggtggaaggatcttcagctgcttaatcaacaacaacagacaatagcactcaaaaggcaaatagaatggagggtgggctgcggagacaagatcaaattctgggaagacacatggaaagttgacgatagaccattaatggtaaaatatgccagtctgtaccaaatttccaatcaacaacagcaaacaatcagccttatggggagtcacaatgatgaaggatgggaatggaactttagttggaggagaaacctatttgacaatgaagctacaatggctgcagaattcatgggtttgaaaggctga

SEQ ID NO: 9037 - DNA, 366 bp, Glycine max
  Peptide Sequence Number=SeqID_125815
atggaggagaatgcagcacaccttttcttcaactgcagcaaaacaatccccctctggtgggaatcattatcctgggtgaaaacaaaggctgctttcccacataacccgaaggaacactttcggcagcacaccattgggaacgctggtggtaccaaggctacaagatggaagtgctggtgggtagccctcacatggaccatatggcatcacagaaataagacagtatttgagaatcagaccttcatcacaagtaaagtgctggatgatgcacttctcctactatggtcatggctgagggccatggagaaagattttacactgcactacaatcagtggtcctctcagctgagagaaacctttgggtaa

SEQ ID NO: 9038 - DNA, 1698 bp, Glycine max
  Peptide Sequence Number=SeqID_125816
atgattgactgcatccctcacccaactacagatgatttgatctctagcatgcatcttttagtcaatatacaagcccaggatattcatgtaggtaatatagtatggctacgtgaaaatgatgaagtgccttgtgaccttgttttgattggcacctctgatcctcaaggagtttgctatatagagggtgttattgagtgtccctatccagataaagacatcaggagatttgatgcaaacatgcggctgtttcccccatttattgataatgatatatgccctttaaccattaaaaacaccattcttcagtcatgcaatgaaaccaaaatgggcatgtgtagaggtataccagaaccaaagctcactgctatggatgccatgattgacaagttgactggtgctatatttatattccaaattgttgttgttctggttcttgggatagcgggtaatgtttggaaggatacagaagctaagaagctatggtatgttctttaccctcatgaaggtccctggtatgaactgttggtcattcctttgcgatttgagcttctttgttccatcatgatacccatttcaattaagcattacagccaactgttccatctctgtcaggtttctctggatttggtgaagagcttgtatgcaaaatttattgactgggaccatcaaatgattgacctagagactagtattccatcccatgcaacaaataccgcgataagtgaggacctgggacaagttgagtacattttgaccgacaaaacaggcaccctcacagagaataagatgatatttagaagatgttgtattagtggcaatttctatggaaatgagaatggagatgcattgaaagatgtagagcttcttaatgctgtttccagtggttcttctgatgttgtacgatttcttacagttatggcaatatgtaatactgtcatacctacacaaagcaaaactggagatatcttgtataaggcgcagtctcaggatgaggatgcccttgttcatgctgctgctcgattgcatatggtttactttaataagagtggaaatattcttgaagtcaagttcaacacttcaatacttcagtatgaagtcctggaaaccttagagttcacctctgataggaaaagaatgtcagtagtgttaaaagattgccaaaatggaaagatccttctcttgtcgaaaggagcagatgaggctattcttccatatgcccatgctgggaagcagacccgacatttcattgaagctgtggagcaatatgctcacttgggattacgtacattatgtttggcttggcgtgagttaaagagagatgaatatcgagaatggtctttgatgtttaaagaggccagtagcactttggttgatagggagtggagagtggctgaggtctgtcaaagagtagaacatgacttggaaattcttggtgtaacagcaatagaggatcgtttacaggatggagtgcctgaaacgatcaaaacactaagaaaagctggaataaatttttggatgctaactggagacaagcagaatactgcaatacaaattgctctgtcatgtaattttatttcaccaggtgattcagatttgagacatgtagcatattgtagttttcttgtatgtatgtatgtatgtcatggagaatctcatttgggtagggctgccccctacaaagatggaagtttgccttga

SEQ ID NO: 9039 - DNA, 651 bp, Glycine max
  Peptide Sequence Number=SeqID_125817
atgttacaatttacttgcaaaagcaagttggcgggattagctgtgattgaagatgaacttggtagttttgcaaatttactacattgtcaaactatgcatctcccatttgtgtatctaggcatcccaattgctgcaagcccccagagtcgaaacttggcatccggtcatccgaaagttcaagcgaaaactctctttgtggaggcacaagagcttatccattggatgaaggatctgtcttgtcaatatgaaagtggtgcatgtcttgagatctttgcaaagaaattttttgtgggggaaaaagaggaatctaggaaaattgcttgggttttgagatcaaaatatggggagtataatgggaaggtgagagagggacatttcatgaaggggtctaaagggtggagtggagggacctgggggggtgtaacaaaagtgagaggacaaagtcattggtttgcgagtaagattaagtggttggtgggggaaggtgaagagttagcactaccatcggatccggcttcacatgaggcaacacttgggtctgatagtagggaacaaaagaaggaaaggaagtccatatggtcattgtggttatatagaaatgatatagctttcaacaacttcaatgaaggaacagatcatggtattggttaa

SEQ ID NO: 9040 - DNA, 1110 bp, Glycine max
  Peptide Sequence Number=SeqID_125818
atggattcttcttctcatcaacaaaacccttgtctcctcatcacagacaaaccaaccccaacaacaagaacctcttctccctcttcctcttcccctgtcccctctcgcaacccccaccagatcaccatcccccgccgtccctcgcagcaccacgccgccgccggagttaccggattccgccggggtacgacgccgctgcaaaaccagagcaccccaaacggcgtccccaaggaaccctcgcaaatcgcggcggcgctccgagctcgagattcgagaagaaaaagattcaacctttgtggaagagagagtgaagaagagaatggtggcgatctggaccatgttggacaggtggtgagtgatttgatcatgtggaaggatgcgtcaaagtcaaccttttggtttggtttttgttctctttgtctcttgtcttcgtgctttactcaaggactcaactttagtgttttctcggccttgtcgcaattggggattctcttatcgggtgtttcgtttttctcgaattcgatttgtcaaagaaacgaggttgaagaaaagagggaaatcaagctgacagaggatgacattttgcgtcttgcgaaattaattcttcctgctctgaattttgcaatttcaaggatgagagcgttgttctcgggagaaccatccatgaccctcaaagtagttcctttccttctactaggagcggagtacggccacttaattactatccggaggctgtgtgccattggatttgttgtcagcttcagtgttccaaagctttattctagctacactgttcagataaaccagagagctgagggcttgaaatcatggttgttggacacatggagtgcttgcactcacaagaagaaagtgatggcatcagcactcatgaccttctggaatctatcttcaataaaaactcgaattttcactgtttttatattgctcgtactattcagatatttaaggcagcatgtggtactacaattagaagacggagaagcaaaagtaggagagaaggaacagcagaaagattcagcgatggcagaaccagaggagaaggaaccacaacaggcattagttgttaaggaacaagggcgccaaaactag

SEQ ID NO: 9041 - DNA, 1616 bp, Glycine max
  Peptide Sequence Number=SeqID_125819
atcccactgataacccattgtttcggactaccactgtggctgttgatgctattacaagagccgttcattcctttaacttcaactgttaccctcccactgttggcttacctgaggctaagagggctgttgcagaccatctcacctctaatcttccacacaagatcatatcaccagagaacgtttttctcaccattggtggcacacaagccatagatataattttaccttccctagcacgtcctggtgccaacattctccttccaaaaccagggtacccacattatgaacttcgtgccactcgttgtcttcttgaaattcgacactttgatcttttgcctgagagaggatgggaagttgaccttgactctttggaagctttggcagatgagaacactgtggccattgttttcatcagtcctagtagtccatgtggaaatgtgttcacgtacgaacatttgaaaagggttgctgagattgcgagcaaacttggaatctttgtgatttctgatgaagtttatgcccatgttacttttggaagcaaaccgtttgtacccatgagggagttttcgtcaatagtgccagttattaccattggttctttctcaaaacgatggtttattcctggttggagaatcggttggatagccttatgtgatcctcaaggaatttttcaaaaaactgggattgtgacgaaaataatcgacaatctagagatcacttcagatcctacaaccatcgtacagggggtctgttattttactacaaagcgcctacctgagaagcgcgttccaccagaacgcgacacgtggcttgactggacaggacgatgtgacaggggtggtcgtgcctgcctgtcaggcgctaccagtcgtgcctacctgccaggcgctaccagtagtggtagggccccaggcgcgaccactagtggtagcctgacaggcacttccactagtgctgagttgaaacgtgttaaagcgctttataccggtaaatatattgcactgcaaatttgtgacgatgaagatgttgaaacaatgattcaaagttttgaacaacaacaagaaatgcctgtcatagaattatgtgttgaagttgatgttgcggggaacaaggacgtgtcaggggccccaccactagtagaagtgcctgccaggctaccactagtggtcgtgcctggggccctaccactactggtagcgcctggcagtcaagccacgtgtcgcgttctggtggaacgcgctcctcaggcatcgatacctggaatccttgagaaaactacagatgatttccattcaaataatcttaatatactgagggaggctgcaaacatattctacgacggatgtaaggagattccttgcttgacatgccctcacaaaccggagggagccatggttgtaatggtggagattaacttttcacaacttgagggcattgttgatgatgtgcaattttgcactaagctggccaaagaggaatctgtaattctttttcctggtgttgctgttggactaaagaattgggttcgggttagtcttgctgttgacctttctgaccttaaagatggccttagcaggataagagaattcagccttcgacatgcaaagatgtcctaa

SEQ ID NO: 9042 - DNA, 1074 bp, Glycine max
  Peptide Sequence Number=SeqID_125820
atggagaatggaagtgagaagtggaattttcaggggaacaagaagctaaatgcttcatccatttctgtgagaggggcatataacatgttgatggagagagtcaacaatagccgagacaagaaacctttggttctgtcggctattgcaaattatctctcttctgatcttccataccagttatcaccagagaatgtttttctcaccattggtggcacacaagctatagatataatcttacctgtccttgcacgtcctggtgccaacattctccttccaagacccgggtacccgcaatatgattctcgtgctagttgttgtctcctcgaagttgaccttgattcccttgaagttctagcagatgaaaactcagtggccactgtcctcatcaattctagcaatccatgtggaagtgttgctgaaatttctaggaaacttggaatctttgtaatttctgatgaaatctatgcccctgtaacttatggaaacaatccatttgttcccatgggggtgttttcttcaatagtcccggtcattacaattggatctttatcaaagagatggttagttcctggttggagaactggctggatagccacatgtgaccctcatggaatttttcagaaaactggggttgtgaaaaaaatcatcagttatttggagatcacaattgaccctccaaccttcttgcaggcagcaatacctgaaatccttggcaaaacaaaagatgagttcctttcaaagaatcttaatatattgaggggggctgcaaacatattctatgatttatgtaaggagatcctttgcttaacatgccctcacaaaccagtaggagcaatgtgtgtcatggtagagattaacttttcacaaattaaggacattgttgatgagatggatttctgtgccaagctagctgaagaggaatctgtccttcttccaggtgtcacggttggactgaaaaattggcttcgaattagttttgctgtccacacttctaatcttgtagaaggccttaacaggataaaagcattttgccttatatatgcaaagatgccacgaagttatgtctcatggtag

SEQ ID NO: 9043 - DNA, 252 bp, Glycine max
  Peptide Sequence Number=SeqID_125821
atggcaattatgtcaaaggtggtgatgggtcttgttctctgcgttcttttggtgtccgcggttttggtccaagatgctgaggcatcaatggtaggccatggagcaatgcagcgtgacacttttcctggatgcagcaaaagacaccccagtaatgtggcctgtcatctgccaatagctaatgattatagaagagattgtgagccaggacaaagatgtcgtcatcaagaagctccaaaggtgatagcaagataa

SEQ ID NO: 9044 - DNA, 480 bp, Glycine max
  Peptide Sequence Number=SeqID_125822
atggcgacaccaacgacgacgaagagaaaaccggtgttcgtgaaggtggatcagctaaaacctggcaccaacggccacacgctgacggtgaaggtggtcagctccaagccggtgaagacggtgaccactcgcggcggtcgatcgtcggtgctcgcggcgcgcccgtcgcgcatcgccgagtgcctcgtcggagacgaaaccggaaccataatcttcacagcacgcaacgaacaggattgtgcattaaacgatatcaatgttgttaattcaaatataaggttaggtcaagtggaccatatgaatgctggcgcaactgtaattctgcgtaatgcaaagattgacatgttcaagggatctatgaggcttgcagttgataaatgggggcgtattgagcctacagaccctgcaaaatttgaagttaaagaggataacaatctttcgttagttgaatatgaattagtgaatgttgttgaagagtga

SEQ ID NO: 9045 - DNA, 441 bp, Glycine max
  Peptide Sequence Number=SeqID_125823
atgcagggttttagtgttgtagaaccctacaccagtagtgagagtgtggaaccttcgctaaccctaaaattttccgataacgaaatggcatccaccgccggcgccgccgcgagatcgattttccgttcgtgttcctctcgccgcgccgcgttccgtctcggctccgaagccaaagcggctcggtctccgttccgcgtcgcttccaaccaacctctctcgcaatctacactcaggtgtcccgttgaattgagcttttgtgtggaatccatgttaccgtaccatactgcaactgcttctgctttgatgacttcgatgctatccgtctctcgccacagctacggttggcttcctgaaggtattgtctgtgctcctactgcattgcaaagagaagactatttgaagatcaagaagcaaggttgggatgacatggacctcttttga

SEQ ID NO: 9046 - DNA, 897 bp, Glycine max
  Peptide Sequence Number=SeqID_125824
atggcctctttttggaaccaactctcattctttttgctcttggtgcttgttatctccccccaaattcaagccagagaaggcaagctcttcagcttgttctcccatttcagaaccatctataatgtcaaagaccctcttgacaaaacaaatgctgaatctccagcactaccaccaggaccaacaccaaaaccagcctcagcaccagaactagaaccagaatcagcaccaacaccagcaccttcagctgaacaagaaattgggtcaacaataccatctgggccagcacctgagcctgaattttttgacagtggagagggttatggcctctatggtagaggctcttatagccaataccctcccaccaaggagactcctaccaccaccacgacctttcaaaatgagcttctcaatgaagacttcaatgatgagagctacaaaactggctaccccaaaaccaatctctacaacaacaacaatgaggagtacaaaaacaatgacaacactaaggaagagtacaggaacagttacattggtggctactccgacgacttcaataggtactccaacaacaacaacaacaacaacaacggcaaggaaaattacaacaacaactacaatggcaaggaaaattactacaacaacaacgacaactatatcagcaatggctatgaagagaagagagaaggaatgagtgacacgaggttcttggagaatggcaagtactactatcatgtgaatagtgttaaagagaattataaccttaatgggtacgaatcagggagagggagcgctaatgaaaacgaaggtaattactatgagaaaagtcagtatccaaatgagtttgacaccatggaagagtacgagaagcagcaggaagaacaaggctacactccttga

SEQ ID NO: 9047 - DNA, 165 bp, Glycine max
  Peptide Sequence Number=SeqID_125825
atgacgtatgggtttaacgagtatgacgacgatcacacgcttaacgcaagatttgcgctaagtgcgcctttgggattctttgtggaccttcttcgggctaggcttgggctggctgttgagcgaggtgtcgtgttggtaaaattgaggaattccaatcattcataa

SEQ ID NO: 9048 - DNA, 435 bp, Glycine max
  Peptide Sequence Number=SeqID_125826
atgattcatagggatcctctagtagagtattggaatgatcttaagagttcccttaggaagaggtacattctctcctactatgaaagggaacttatggacaagctccaaagtcttagacaaggaagtatgagtgttgaagaatatagactacaaatggaggaggaaagaacaagcatagctaggttccttagtgggcttaatatggaagtgagggacaagattgaactccttccatatagggacctagacgagctagtccaattttgtataacaggggagcaacaacttaaaagaaagccttcttcaaaatcttatggctttcgctcttatccaaggaccgaccaagcccaaggaattttgggggttgcaccttcaaaacacaaggaagaaaaaggtaagaccatagagaaatccacccctaagactagctcccaa

SEQ ID NO: 9049 - DNA, 441 bp, Glycine max
  Peptide Sequence Number=SeqID_125827
ggtccgcacttgacggtgaagagcacattggagaatggaggaatcaatcgggaaaataacaaagatcacatttcccagtcaagagggtccgctcttgacggtgaagaaacacattggagaatggaggaatcaatcgggaaaataacaaagatcacatttcccagtcaagagggtctgctcttgacgggtccgcacttgacggtgaagaacacattggaaaatggaggattcaatcgggaaaataacaaagatcacatttcccagtcaagagggtccgctcttgacggtgaagaacacatgaacagcgctaggcaattaattcatggggctccaaataaaaggcgagaatggagaattgcactaggcaatcactacgcatggctccaaactcgttggtggaggaatcatgagcgacaatcaattcatggggctccgaaaaag

SEQ ID NO: 9050 - DNA, 945 bp, Glycine max
  Peptide Sequence Number=SeqID_125828
atggccgcgcgctgcctggcgctgggggcgcatgcggtggtggtgggcggcgccattacgcgcccgcagcagatcacccgccgctttgtcgaggccatcggcgggcgaatgcgcgtcagcgggccgctgctgatcagcacgtcgcgttcgcgcatccacgggccgaatttggccgccagcgccggcggttggcgcaggtacagcacgttgccgcgcgacgttatgttccagcgcgtagaggccggccgccgccaggatgccggcctgacgcagcccgccgccggtcatcttgcgccagcgcagcgcgcgctgaatgaaggcctcgctgccgcacagcagcgatccgaccggcgcgcccagccctttcgacaggcaaatggtgaaggtgtcgcagtattgcacgatctctttcagcggcaggttcagcgccacggcggcgttgaagatgcgcgcgccgtcgatatgcagcgccagctgccgctcgcgggtaaaccgccacgcctgctgcaggtaggcctgcggcaggactcggccgccgatggtgttttccaggctcagcagccgggtgcgggcgaagtggatatcgtcgggtttgatggcggcggcgagcttgtccagcggcagcgtgccgtccgcgtcggcctcgatcggctgcggctggatgctgcccagcaccgctgcgccgccggcctcgtatttatagttgtgcgcctgttggccgaccagatactcgtcgccgcgctggcagtggctcagcagcgccaccaggttggcctgggtgccgctgggcaaaaacagcgccgcctctttgcccgacaggcgcaccgcctcggcctccagcgcgttgaccgtcgggtcatcgccgtagacgtcgtcgccgacctctgcctgagccatcgcctggcgcatggcggcgctggggcgggtgacggtgtcgctgcgtag

SEQ ID NO: 9051 - DNA, 294 bp, Glycine max
  Peptide Sequence Number=SeqID_125829
atgaagatcaagaaaagaacaaaagaaaggaaagaaggattcccgatcaaagatcgaaaggaagtgaaaaggggaaaagaagcaactctcgatcaacgaaaggaagagaatagaaagtctccaaatccagattgccactcagaatcattcttgactggcaatattccaccccacatgaacaaagaggaaaaaaccgaaacacccagcttcctctccaaaaacgctgacctcgagaaaatcctattgattagccccatgtttcccctgcgtgtttgtttgaaagctagaagttga

SEQ ID NO: 9052 - DNA, 384 bp, Glycine max
  Peptide Sequence Number=SeqID_125830
atggttaacatggagtttatctctaatgcaatgatactttcattctcaatactattgttgctaccaagtacatcatattcactatatcaaaagcctgaaaatcatatcaagacagctatttttgtaactgggagttttgaaatgggaccaggatcaattgcaacaaaaacatttgagaatataaagtttccaaaaggtcatgttggaattaagagttttgatgcggaactagttgaccaagaagggaactctataccttcgtatgaaacttaccttcatcattggtttgcaataaagtaccaccaaaatattaccatgtcacctaatcctaagcttcgtcgtcctgaggatgcttttttccaaaagaaacgaaggcacatgtaa

SEQ ID NO: 9053 - DNA, 171 bp, Glycine max
  Peptide Sequence Number=SeqID_125831
atggttgaagagtcattcattaaatctgtcatcaagcacacattcgcaacgtcttcttcattagaagagttggaggatgtggatgcattgtcttccaaagctatgtttagagaatcttttgtcttttcatcttttgagaaattttctaaacttcttcaccatcaagcttaa

SEQ ID NO: 9054 - DNA, 326 bp, Glycine max
  Peptide Sequence Number=SeqID_125832
ggaagcttggaaggattgatggggacccggtgttgagagaaacgaggatatgggctacgtgggagtacgtgagctcagttggaggtgggcaacaggggatggtggtggtacctggagatatgtcgcgggggtcaggagaccttggggacgtcaggcgagctcctggcagtcaacagataaaaggaacaaagaccacaaagcaaggaggcttgtgtggtggctggccagctatgaacttgattgatatgcttaaaaatgaagacatgaggctaagatggtccctggtaatcgattaccaagggggtgtaatcgattaccaggcttag

SEQ ID NO: 9055 - DNA, 192 bp, Glycine max
  Peptide Sequence Number=SeqID_125833
atggagtgcctagagggagcttgggagaccctcgaaggcaacacgaggttccgatttcggggcatgattcgatttacggctacttcattggtgcatccagatgaactcgggtgcatgcttcagcgtacggtggagtggatactacccacgcctacaccataccgtctagtggagccagtccaagtgatcgag

SEQ ID NO: 9056 - DNA, 541 bp, Glycine max
  Peptide Sequence Number=SeqID_125834
atggcatccaggaaaaggaaaagcgccacttccaggcctcaagctcagtatgataccaagagattccaatccttggaagcctggaaccgatacacagataacattctggactggaggatccttccggaaaagaatgttaagatctatcataccgaatttgacgagtttaaggcagagatggagaggcgtaacttacacaaacgcctcgccaatctccaagatggaagcatagatgtagctgtggtgaaggagttttatgctaacttatacagcccggaagaccagacccctaaacaagtgagggtaagaagacatttaatcaagattgatgctgacagcctgaataccttcttagagacccctgtagttttggaggaaggtgagacacaacctacctattccagatttacgaggatgaggattgatcctcaagagttttctacctgtctctacatccctggtaggggtttggttctgaatgtagagggccatccttggaagcttctgaggaaagatctcaccactcttgcacagacatgga

SEQ ID NO: 9057 - DNA, 330 bp, Glycine max
  Peptide Sequence Number=SeqID_125835
atgaaatctaagagcattgattggggccctaagccttttaaggtttttgatggatggttaaaaaataaggattatcagaaggtggtgagggattgttgggctcataatcagcctctggggtggggtggatttgccttaaaatgcaagctaaagactctcaaacaatggctgaaaatttggagtaaagacaatgcaggtgatttgtgtaacaaggtgaagcagcttcaacaaaatttgaatgatctggagaactctatgccacctcagccttctaaccagcaagtccaagagctgaaggaaattcaagctggatctatgggaaaaggctaa

SEQ ID NO: 9058 - DNA, 264 bp, Glycine max
  Peptide Sequence Number=SeqID_125836
atgaattgcgttttcgttcatgtgtcctccaccttcgagtttggagccatgcgtagtgattgcttagtgcaattctccgttctcaacctttttcggagccccgagaattgggttttcgttcatttgtcctccacgttcgaatttcgggccatggggaatgattggttagggcaattcttcattctcaaccctttttcggagccccgtgaattgtgttttcgttcatgtgtcttccaccttcgaatttggagccatgcgcagtga

SEQ ID NO: 9059 - DNA, 348 bp, Glycine max
  Peptide Sequence Number=SeqID_125837
atgggtaaagtagaggaggtgcaagagcagatgaaggccgacatggaggccatgaaagagaaaatggcctcaataatggaggccatgatgagcatgaagaagataatggaagccaatgcggttgcagttgccgctaccagggtggttgctaagacaaagatttgggaagtacagacgcccccctattatgtgcaaattcaaaacgagcatgccttcccgccatatggcttgcctcccaactatacgccacccaatgtggcgtacactcccaatgagaatgtcgataactccactcctatacccattgagagccaacaaccccaaaatgttcatgcacatgtctcttaa

SEQ ID NO: 9060 - DNA, 462 bp, Glycine max
  misc_feature (458)..(458): n is a, c, g, or t
  Peptide Sequence Number=SeqID_125838
atggcagaaatgggaaagttggatcatctagaggaaaggctcagggccattgaaggaggtgaagattatgactttgctaaactagaagagttgttcctagtacccaatatcatcacccctcccaagttcaaggtgctggactttgacaagtacaaggggactacttgccccaagaaccatctaaagatgtattgtcagaagatgggggcatatgcaaaagatgaggaattgctgatacattccttccaagaaagtcttactggggtagctgttacctggtacactaacttggaaccttcccgagtccattctcgaaaggacctaatggttgccttcgttaggcaatgtctgaacaattctgatatggctctggatcggatacaactacagaacatgtgcaaaaaggggcatgaatctttcaaagaatatgcccaaaggtggagggatctggcagcccnaagt

SEQ ID NO: 9061 - DNA, 210 bp, Glycine max
  Peptide Sequence Number=SeqID_125839
atgcagggttacctgatggttacccgcacctttcgtcaaccaggggcaaacgagcccgttgacgcacagagactaacattgtctcctgcaccttttgtcatcttgacccgtgaagtcagggatagcgagtcaggtggtagacggagataccttatggtcatccgtggctttcgtcaaccgaggggaacgaattcgacggtatcaggatga

SEQ ID NO: 9062 - DNA, 331 bp, Glycine max
  Peptide Sequence Number=SeqID_125840
atggctccgaaaaaactttcggcgaagagatctaggagggacgccgcggctgaagggaccagtgccgcccctgagtttgatagccaccgtttcaggagcgccgagcaccagcagtgcttcaaggccatcatgggatggtcgttccacagagagagatgcgtccagctcagggacgatgagtacatgaattttcaggaagaaatagctcaccgacattggacgtcgctagtcactcccatggctaagtttgacccagatatagtcctggggttttatgctaatgcttggcccacagaagagggagtgcgggacatgcggtcatgggtgaggg

SEQ ID NO: 9063 - DNA, 144 bp, Glycine max
  Peptide Sequence Number=SeqID_125841
atgtcaacgtcatcacatcggctcggcggctcctcaccagaatcttactccctgcaccctgccactgtcattctgctcccacgaacaagctcccctcccataggtgatcagcctgggagcccaaaggtgttccctaccaggtga

SEQ ID NO: 9064 - DNA, 384 bp, Glycine max
  Peptide Sequence Number=SeqID_125842
atggttgggatgttgaattgcttggatgttgtggaagcttggagagatttatggggacccggtgttgagaggaacgaggataagggctacgtgggagtacgtgagctcagtgaaggtgggcaactggggatggtgggtttatgtgtgatctgtggatgtggagagttgacttgcaccatcgcccaaccgccacctagtaccacatgtgatgggcgagctcctggcagtcaaccgataaaagaacaaagaccacaaagcaaggaggcttgtgtggtggctggccagctatggatcttgagtaatatttggagtatggcctctggtaatcgattaccaagggtgggtaatcgattacaaggcttaaaaatgaaggcaggaagttaa

SEQ ID NO: 9065 - DNA, 165 bp, Glycine max
  Peptide Sequence Number=SeqID_125843
atggctgcggagttagggcaacatacggtggagctatccaccctcgtcacacgcgccgctaatgataagtcctccgatttgttagcgtcgctaacatatcggcagacttacggttcttctcaatctgttttgttggctcagagcagaaacatcgaaattagctaa

SEQ ID NO: 9066 - DNA, 696 bp, Glycine max
  Peptide Sequence Number=SeqID_125844
atgcctacagaccaacaagcaaaaatttataaccaaattattcaggctgtcaataaaaatgaaggtgggatgtttttcttatatggatatggaggaacaggaaaaacatttatttggaaaacacttgcagcctcattgagagctgacaataaaatagttattatggatgcttctagtggcatagtttctttgttattgcctggaggaagaacaacacattcaaaattaaaaattcatgttcccatatttgaagactcgacatgcaatattcatcaaggaacacaattgactgaattattgaatgaagcaagtcttatcatctgggatgaagcccccatggcttacaaattctgttttgaagcacttgatcaaagtctaagagatgttattaaggcaaaatcaagttctgataaaatctttggtggtaaagttatgatatttggtggagattttcggcagattctgccagtcattcctaggggtagccggtctgacattgttaatgcaactataaattcatcttatctatggaatcattgccatgttttggcactgtcgaaaaacatgcgtttagaagccaatatagatgcaacagacagagaagaaactttagcttttgcacaatggatccttaatattggtgatgggattgttggccagcaaaatgatggttatggttcaattgaaattccataa

SEQ ID NO: 9067 - DNA, 348 bp, Glycine max
  Peptide Sequence Number=SeqID_125845
atgcaggccaaattgtgtgttagtgagaatatcctggttgttccaatccctggtccctgtgctttggtgtcggctctttctgcctcgggtttacctactgacgaatttacatttggtaataagctggctaaactgaattttgtacattatggtattttggagcctaagatgggtgttgtgacgtataattttgtagttggttttcttcctaagcattcgggatcgagaagaaaaaggctcatggtttcagctgatcaaacaacaacacaaatattttacgttcctcctcacaagctttctcagttccttgatgagagttcttcaatttttggtgatgcaaggtactga

SEQ ID NO: 9068 - DNA, 664 bp, Glycine max
  Peptide Sequence Number=SeqID_125846
atggcagcgcgcgcccttggcgtgcctcggcacctgcgcgctcctggcggcggcgtgtgggctccccattcggcccgtcttgaaacacggaccaaggagtctgacatgtgtgcgagtcaacgggcgagtaaacccgtaaggcgcaaggaagctgattggtgggatccccctcatacctgtcgggacccgaaagatggtgaactatgcctgagcggggcgaagccagagggaaactctgggggcgaaagactaatcgaaccgtctagtagctggttccctccgaagttttccctcaggatagctggagcccgcggggcgagttctatcgggccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggatacggctcagccggag

SEQ ID NO: 9069 - DNA, 576 bp, Glycine max
  Peptide Sequence Number=SeqID_125847
atgccgctgctgattccgttctgtcagcagcatccggatgtggaactcagcctgaccttttctgaccgctttattgatctgtttgatgagggtattgatgtcgcggtgcgcatcggcggttcgccagatctgcccgcctcgctcggctaccggccgatgggccgcgagcgtatggtgttttgcgccgcgccggactatctggcgcgcgcaggcagaccgaccagcgagagtgagttgctgcagcatcgggcgattctgtacgagcgcgttgacggcagcaccaagccgtggctgtttaccacggaggatggacatccgcactggcgtcaggtgccttctcgcatggcgctgggtgacgtggatgcacaaatgcaggcgctgtgcgctggccttggggtggcgcagatgccgtcatggctggtgcgtgacgcgctggcgagcggcgcgctggaagtgattgtgccgcagcagcagccggacggtctgccactgtcggtgatttggccgcggcgcaaacagctgctgccgaaggtcgacgcgctgctggcagcgcttgacggcctgcagatcaggtaa

SEQ ID NO: 9070 - DNA, 534 bp, Glycine max
  Peptide Sequence Number=SeqID_125848
atggcaggggttgctggatacgctgctgatggtcggcgtgtcgtcgctgctggcactgctgatcggtttaccgatggcggtgattctggtggtgaccgggcgcggcgatctgttccccaatccgctgctcaaccggctgctgggctggctggtgaacctgttccgctcaatcccgtttttgattctgatggtggcgctgatcccgtttacccgctggattgtcggcactacctacggcgtctgggcggccgtggtgccgctgacgctggcggcgacgccgttttttgcccgcatcgcggagaagcgcggcctggcatcgtcagcggttttaccattacgctggtgacgatgattaatgcctcggcgatggccggtgcgattggcgccggcgggctgggcgatctggcttatcgttacggctaccagcgtttcgatatgcaggtcatgctcacggtgatcgtggtgctggtggcactggtcacgctgctgcagctgtgtggcgaccggctgtcgcgccggctgaatcatcgctaa

SEQ ID NO: 9071 - DNA, 279 bp, Glycine max
  Peptide Sequence Number=SeqID_125849
gtcgactctagaggatcccacggaagacacacccgtgagccctcgtgtcgccctcccacaaaagggtaggttgcgacagttggcgactccactggggattgtttttgtgagggccctatacccgggttcatggaaatctaaggagtggaggaggatctatggtcatgctagaaaattgggggagaagcttgccacccagctcgcccaggcgagcagggttgcttcctccagaagcaacagccttctggaggaatcttctggagggcccaagtgggcctg

SEQ ID NO: 9072 - DNA, 336 bp, Glycine max
  Peptide Sequence Number=SeqID_125850
atgcctaaaagtagtgatgattgcccatccatggatgacatggctcaatggaatcaacacttggtcattttcacctctaaatcatctaaagaacattctgagggcattgctgacaaatggaaatacgtggtagaaagccaatatggacacgatggaatgaaaggtggttcttgtccaaatcatggtgaatcatcaattatgaacacaaaatcaaggtcattggttttgatgaaccattttctcactagtgctaatgcaagttttgcttgtgctaacaattcaactccattagttagcatgttgaagacttgtcatgatgctgccaatgatcaatga

SEQ ID NO: 9073 - DNA, 1353 bp, Glycine max
  Peptide Sequence Number=SeqID_125851
atgaagcaaaaagacgaattcaacgctaaagacctatatgttagattcttagtaagaatggatgatgcttcacaaagaatcaatgctaagctaaacaacaaaatgactggcgaagaaagaaaagctgtaattgatgctgaaactaaagctattcaggctgagaattctgaaaacgggaagtatacagtagtagtaaaagatttcttcaatggaaacgagttttattatttcgtttatcaggattataaagatataagattggtaggtgcacctccttcatcattaggtaaatttggaggtgatactgataactgggaatggcctagacacacagcagattttacggttttcagagtgtatgctgatgctgcgggaaaccctgcagagtactctccaagcaatacacctttaaaacctaaacactttttacctgtttctcttaaagggatcaaacctggagacttttctatgattcttggttacccaggcagaacaaaccgttatttaacttcttacggtatacagcagatggtaaacaaagattatccagcttgggtagaagcttctaaattagcaatggatgtgatgaagaagtacatggataaagacaaggcgactcagcttaattatgcttctcaatatgcatcagtagcaaattactggaaaaacagacaaggaactatcgatgctgttatcaaaaacgggacaatcaccgataagcagaaaactgaagctaatttcaagcaatgggctttacaaccggcaaatatagaatatgacggagttttagatgatatctcaatctattataaacaagtttctaatagaaatgttgaaagaaattatgctacccaactctatagaaatgctaaatacatcagtcttgcttctcaagtaggctctgtacttaagtcatatgctgaacaagatatggcaggaagattagcaatgaaaccaaaagtagaagctgcggtaaaagctgcttatgaaaactttaatactaagttagaaggagaaatgcttaattcaatggttggtctttatcagtcaagagtagataaagatgtagcatctccaactattatggcattagattctaaaaatctttcgaacgttgcttattcatctatttttgctaataaaacctctgtaaccaactttattttaaatccggatcgtttaaagctagacgctgatccacttttaaaaatagctaacggggtcactacagatcaaagctggtttaatgaatccatgcctgagaaaaagttctatccggacgctaactctactatgaggttaacatacggaactgttgataaattacctatcagaacagacagaactacttcg

SEQ ID NO: 9074 - DNA, 585 bp, Glycine max
  Peptide Sequence Number=SeqID_125852
atggataacgattttaagacctgggttgggatcatccattcctttgcaaagcacaaagacaaggtcattggcgacaaggtacagctctcatttgtagagtttgccaagctctgtggcatcccctcaagccgctcctcaaagcagctcagagagcgtatcagcccgtctctgaagcgtattgccagcaccaccatctctttctcttcaaaaagcggcgacgacgcaaaagaatacatcacgcatctggtccagtctgctttttacgataccaaaaaagacattgttatcctgcaggctgacccgaagcttttcgagctctacgagtttgatcacaaggtgttactgcagctcaaggcgatcaacgcgcttaaacgccgtgagtccgctcaggcgctctatacctacattgaaagccttcccaagaacccggcccctatctccctggcgcgcctccgcgaaaggctgaatctgcgctctcctgtgttttcgcagaaccagacagtgcgtcgtgcgatggagcagctcaaagagattggttatctggactatagcgaagtccagaagggacgcagtgtctacttccag

SEQ ID NO: 9075 - DNA, 224 bp, Glycine max
  Peptide Sequence Number=SeqID_125853
tgaaacagaagctctggggaattgggttcatggattttgttggaaagatggcagttgatggaaaagtagctgaaattgagaatcctgatgatgctgcagtagagaacggtggtactggggtggcattaacctggccatttgtctgccacgcccagtttggaactccttttgaaggatctatgcccattctctctgctctttcctgtcaaatatttcaacaataa

SEQ ID NO: 9076 - DNA, 246 bp, Glycine max
  Peptide Sequence Number=SeqID_125854
atgcatgagaacgaatggcacggagcatgtttgctctttgcccctatttgggaacctataggacaatatctaggggtctctaataactactccccaacaattcataactcacacggctgttttctagaggaaaaaccaaaggaaaccggtcaaaatgaaaatctaagttcgggagttgtatttacgcttgaggaaggtattagcacctctcacgtttgtctcaaaggacaacagcctattctttag

SEQ ID NO: 9077 - DNA, 2304 bp, Glycine max
  misc_feature (97)..(97): n is a, c, g, or t
  Peptide Sequence Number=SeqID_125855
atggaggagattgaatcctccagcaagcgcatcgcggatatcaaccgcgtgattgatgaaatcgccttccagaccaacctgctggcgctgaatgcgncggtagaagcggcgcgcgccggggaacagggacgcggcttcgcggtggtggcgtcagaggtgcgacagctggcgcagcgttcggccggtgccgcacaggagatcaaggcgctgatcgatgccagcgtaggtaaagtcgaagccggcagcgcgctggtgcagcgctctggcgagatgctcaacgacatcaatcacggcgtggcgcgcatggtggatatcgttggcgagatcgccgtggccagccgccagcaatccagcggtattgaacaggtgaacaccgcagtaatccagatggatggcgccacccagcagaatgcatcgctggtgcagcaggccaacgcggccagccagacggtgagccagcatgccggtttgctggccgccaccacgctcaatattgccaccattgccaatggtgacatgaccatcatgcagcagctgtcgagccgttacgaacagcagcatccggacgtgaaactacaatggcacgtgatggatgatggcgccctgcgccaggcagtgctggcagccatgaacagcggtgacgcaaaatttgatgtgattaccgtgggtacctatgaagcaccgctgtggggtaaaaaaggctggctggcgccgcttaataacctgccgccagagtatgacagcgacgatctgctgacgccggtgcgcaaagcactgtcctggcagcaaacgctgtacgcgctaccgttttacggggaaagcagcatgacctattaccgcaaagatctgtttgcggcgaaagggctgaccatgccggacgatcccgactggaccgacatcaaaaatttcgcggcgaaactcaccgatcctcagcacggtatctatggcctgtgcctgcgcggccagcccggctggggcgataacgtggccctgctcaccaccatggccaacgcctatggtgcgcagtggtttgacgatcgctggcagccgacgctgaattcgccagagtggcgcgaggtattgaccgattatctggcgatggtgaaacaggacggtccgccggatacggccagcaatagctttggccagatcctgcgtctcaccgcacagggaaaatgcgcgatgtggatcgacagtaccgtcgccgccgggctgctgattaacccgcagatctcgctggtagcggacaagctggcgtttgcgccggcaccgggcggcattacgcgcaacggctcgcactggctgtggtcgtgggcgctggcggtaccggctaactcaccgcagcgcgccgccgccgtggacttcatcagctgggcgacctcgcggcagtatattcagcaggtcgcggataccgtcggctggggagcggtgccacccggcagccgcaactccacctaccagcagccaaactaccaacgcctggcgccttacgccgctcaggtgcgcagcgcgattgaatccgccaccgtcgatcaaccgacattgaacaccgtaccttacaccggtgtgcagtacgtcagtattgctggctttgatcagatgggtaacgctgtcgggcagaatctggcggcgctgctgcagggcaagctgacggtagaccaaacgctggaaaaaaatcagcaggacgtgacgcgcctgcaggtcgcacagcagaacccccgaatgaaaacccctgaagagtattacgcccaggcccgcagcctgtttttcaccgcccaccctgattttcagtccgcgctggatgaactgagtgagagtgatgcgcgcgccgccaatatgtccctgcgtgaactgcgcgcgtggcacgccgagcgcatctatgccgcgtttctgcgtcagaagaagctcgacggcatgctgttctccatccagctggcggaaccggataaagcagttgctgcacaagcgattgaaacctatctgaaatctcacgcggaagcgctgggtatgacgtgggaagagttctgtattaagaacgagtgctattgcaccgcctctggaggtgttgctggatttccacctccagagctgatttacgacaagcgcaacgtagccggtttaccgggcgcgcgcgaaatgattttgcaggagctggagaaacgcgtgcagcgcgtctttccggatctggaggtgcgggttaagccaatggagcgtaacgccatcaaaaccgatatgagtaaaaacgacaaggcgacgattgcgcgtattgttgaagagatgttcgatgaagccgagatgtggctg

SEQ ID NO: 9078 - DNA, 547 bp, Glycine max
  Peptide Sequence Number=SeqID_125856
cttccaggttggttcaaaagatgcagagcaaatcagcatttcaatcggagctagtaagggttgggatctttatcaagcaaatgctactgctaatgcctcaaatggtggaacatatactgctgcagcaacccttaaagacaatacgggcacggctgggaatcgtaaggttgatgcaaatggctttgatgttttaactgcaaccgttaaagatgcaaatggagctgtgacggacggtgcgttgactagaatcgatacggccattaaggccgtagacaaccagcgtagcctgttgggtgcatcacaaaaccgtttcgaatcaactattactaacctgaacaacactgttaacaacctgtcagccgctcgcagtcgtattcaggattctgactacgcgactgaagtgtctaacatgtctcgtgcacagattcttcaacaggctggttcttctgtactggctcaggctaaccaggaaattgctgaaatttctggatgtttcagaaatgacgctatcgattacaattatggaaaaggcaaacatccaccatga

SEQ ID NO: 9079 - DNA, 552 bp, Glycine max
  Peptide Sequence Number=SeqID_125857
atggatcaaaaactaaaaaacggggaaaacatggtttttctattaagaattaagaacaatgacaatgccaagtcagaaagcaaggttcctatcggtgaaaggagagtgaagggaagatggggcatccctcaactcgataatccaattcattccaatagacaggaatggttttgtattaaattaaatctgtctcttccttttctcgtgctcattctgaaccatctctcactttcgcgctctcattctcactatcactcatctttcacgctctcactcatctctctcgctctcgttctcgctctcacttatctccacaccattctcgctctcgctatcatctctgactttcattctcactctcgcgctcttgttcttgctatcactcttgtgctctctttctcgctctcactcacagctctactcactcttgatgcaatcctccctaggaagggaccaatcactagaaccatgagcaagaggctccaagaagattgggctagagctgctgaagaaggccctagggttctcatgaaccttagggtagatttctga

SEQ ID NO: 9080 - DNA, 304 bp, Glycine max
  Peptide Sequence Number=SeqID_125858
caaaaaagaaggagtagagacgagaatcatcatcacggaaagggcaggatggacgaaatcagtgtcttatctttgctttcctcttatctccgatgagagatatttggcaccctttgttgcacaatatgtgaagtcccgagatgtgccgaaaatcaaaaggaagcaggcttacgcgatccgtgaaaattccgtgatggagaaggggttcagccttcttggcacttcgtattctctcgaaattgctgaggaaaattatttccgtgaagaaaatccaagccgaggcgcttccgtaacgtttccgtga

SEQ ID NO: 9081 - DNA, 326 bp, Glycine max
  Peptide Sequence Number=SeqID_125859
cgaagcataaaggttatgtgagtggtagcttgtcggatgaggggaaggttggacttggaggagattctggtaaatcagaaagttctttggagaaaggcttagttgatcgcagtgacgctttagatgttgatgctaaagtagataacatggcgaggtgtttcagaaccaaccagaggatactggtgagaaaggggaataaagatgaactgggtaaaacaataggaagagaacaggaggaacctcccaagttctctaattggccgaatgagagagaagtgagatggaagggttttggagaaagccacgagctgatctggaaaatgtga

SEQ ID NO: 9082 - DNA, 288 bp, Glycine max
  Peptide Sequence Number=SeqID_125860
atggcaaccaaaaaaaatgacaaaaagaagaaaggaattgcactcaaagcctcatcgtctattcatgaggaaaatgacaaagaagacttgaaagaaaataacttagaagaagatgatgatttcagtctctttgtaaagagattcaataaatttctgaggaacaaaggaaatcaaaggagatcaaacttccatccaaagaggaaaggagaagattcctccttagttccaaaatactatgtacgcgatcaacctgggtacctgagagttgattgtcctatctataaatga

SEQ ID NO: 9083 - DNA, 1257 bp, Glycine max
  Peptide Sequence Number=SeqID_125861
atgagagcaaatctctggggctacaatggtcaaagtcctggccctacgattgaagtggttgaaggtgatcgtgtccgtatttttgtgacaaacagactgccggaaagaaccagtgtgcactggcatgggcagcgagtgcccaatggtatggatggtgtcagtggtttgacgcagccagccattgagcctggtaaaacctttgtttatgagtttgaagccagacgccccggaactttcatgtatcacccgcatgccgatgaaatgatgcaaatggccatggggatgatgggcagttggattacccatccgaaaaatccaaagttcatgccggtggatcgagactttgtatttttgctcaacgcttatgatatcgaaccaggtagctttacgcctaaagtgaatactatgcttgatttcaacttgtggacgtttaacagtcgtgcatttccggggatagatccaattgtggtgcggaaagatgaccgcgtgcgcgtgcgcatcggtaatctcaccatgaccaaccacccgattcacctgcatgggcatgagtttgaggtcaccggtacagatggcggctgggtgccaaaaacagcgcgctggcctgaagtcaccagcgacatagcagtggggcaaatgcgtgccattgagtttgtgggcaatgaactcggtgattgggcctttcattgtcacaagagtcatcacaccatgaatgccatggggcacagtttccccacaatgataggtgtgaaacagggtgatttgatgaagaaaatcaccaatctcgtccctgattacatgcccatgggggagacggggatgtctgaaatgacagatatgtctcaaatgatggatatgccattacccaagaacaccttgccgatgatgatgggtaatggccagtatggcccattggagatgggggggatgttcacgactgtgaaagttagagatggacttgccagaaatgactataaaaatcctggtgactataaccatccaagcggcactgtagcgcatgcagttgaaatagacctaactaaggttgaacgacaaaatccgcatgttgaaagtacagttgaagtgaatgtcagaaagccaattaaccattctggcatgctcccacacgtcgatggtcagcaatgcggtatcaccagtggtcaaaggtgtgccagcagcgccggtgttgacgatatcgacagagccatcggcttttttcaccagccaggtccagccagaaccaaagttaccaacggctga

SEQ ID NO: 9084 - DNA, 423 bp, Glycine max
  Peptide Sequence Number=SeqID_125862
atgagtgaatcgatgcacacatgcgggtggcggtgggagccgccatgcccaaccgcgaggacaactaaaattgtttccttagagggtggtgccgcgagggtgtgcatggtggcgcggagcacgtggacgcgaacggaggacaggtgggacttggtggatagcgctgcggttgttgttgacatacatatgcccttgctgcttgtgcataacagtaatagtggagtgtgcgttggagttgaggaaggctccattgcatgttatggagtggtaataagagcgattgttgagatgcaaaatggggaatatattgcaagtggaggggcggtggggttggagaagcggcggcggtggcggcaacgacagtgggggttggagaagctgcggtggcgaatgatttaccagaaacaacaagttttccagtaa

SEQ ID NO: 9085 - DNA, 117 bp, Glycine max
  Peptide Sequence Number=SeqID_125863
atgtctaatactttgccggcccatacgcataccgatttgtctttcatcgctagcagcacatgttattgtctgagtctgagacagtgtcggcatataacgaaaaacgtgaatagataa

SEQ ID NO: 9086 - DNA, 153 bp, Glycine max
  Peptide Sequence Number=SeqID_125864
atggatagtgttgagggtttggatgatgatgatgatgggttggagaagatcatgcttgaagtcttcataccgagtggtaggctgatgctaggtgcacctagcattattgttggtgcaccagcacttaaggaaaaaagactgaaatatccttga

SEQ ID NO: 9087 - DNA, 2869 bp, Glycine max
  Peptide Sequence Number=SeqID_125865
tgctaacagtttccgtgcaaagagcggagtgtacgtgagtcatctctcacagaaaagtctacactctcttctcaatcagtttatccacgcagccacgtgtctccaattggtggcgattacacttgataaagtcgaaaccgcaatgccaaaatctcctcctactttgaacgcatttgcgtgctctgcttcagcgtgcctcgagcggttgcgtaatattgccttgaaggaggaaacgtccacgagcaatgcagatggtgtaaccactccaaccttgttaggattggctaattccttatcgagtctttgctcaggtgctgagttcctatttcaagtagtgcatgaggctattcctgctgtatactttgagtttggtgtgtctgtaccggctgcagaactcgcagttcatgtgcttgactaccttcataagaagcttgacgaagtgtgtcttgtacaaggtggtgaggaggaagcttatcagatggtgctttatatgtatgttgggagcttgttgccatatattgagggtcttgattcctggctttttgaaggaattcttgatgatccttttggtgagatgttcttttttactaataaagaagtctcagttgatgaggctgagttctgggagaagagttatttgttgagaaggctgcagcatagcaagttagattcagaattcttctcttccacgaattatgtcaatgattctgtgccagcatcaaacgacaaggaaatggataggagagattccatctctttgtctagtacagttaaaggaaaagagccgagcattagagaccgtccagcctgtcccttttttattaaggatttaactaaatcaatagtttctgctggaaaatctttgcagctgatgcgacatgtacctgattgctcagtgaattgtagcaaaggaagcaattatgagattggaaataccaaatgtttaaactatggtttatatccttctcaaagaatgactgggttaacgttgcccgaagttttttctgtatcactagttggacttgttggccatggcgaccatgtttgtaagtacttttggcaagacaactggtatgaatctgtatctgtttcatccaatgtatctcatgtaaatgaggaaaaagcagataatgacaatactgaaaaattaattgctccaccttactcagaaaagacatggtataagttcttgattgatacattatttcagaaaagatcagctgatttgaagctaaaatacaaagacataaataatgacacaagagagctgagaggggctagagttattgatgacgaagtgctcctcttgaggtcatacatagaaaatccagttattactgtatgtcaaaaaaacctaggaaagcatggggatgccctgaaaacattgagtttatctcgaaaatttagcttgccttcattaaatgatgagggtttaagaaaggctatatttggtggagaaagtgcagcattttctgatagtgaaggaacgaactatacttttggctttcactttggtgaatctgaataccttcgctcacaggatgacagaaagctgttagaaatgttgtttccttttcccactattttgccttcatttcaggatgatcttcctgtgtcagagctcttgccttttcagagaaacagcagtcttatttcaagagttcttcgttggatgcaaaatgttgacctaagaattactccacttcctctggttattatgcagtactgcctaaccgtctacattcagaaacaggtggattatattggagtgaatatgttgttaaagttgatgaacgaatggagattcatggatgagcttgcagtgttgcgagctatatacttgctaggttcaggattggagtggagttatcttggtttctctgttttctgtgttgatattttgtcttgtgcaggtgatttgctgcaacactttttgactgtaattttcaataagttggataagggtgaagcatgggatgatgattttgagttaaacaccatattacaggaatcaatcagaaattctgctgattgtatgctgttaagtgctccagattcattggtagtgtcaataaccaaaaatcgtgttgacggtgatgaggaagctagcacagctggtgttttgagtactcctcgtcaaagtcatgccaatagctttggaattaatggccttgatatgctcaaattcacgtataaggtcccttggcctcttgaactcattgcaaatacagaggcaattaagaagtacaaccaggtcaagcgtgcaaaatttgtattagataaagtgcggagatggatgtggaagggtaagggatctgctacaaacaacagaaagcatcattggttagtggagcagaaactccttcattttgtggatgcttttcaccaatatgttatggatcgggtatatcacagcgcatggcgtgaactatgtgaaggtatgactgcagcaaagtctctggatgaagtcatcgaagtccatgaggcttacatcttatcaattcagcggcaatgctttgtggttcctgataagctgggggctcttattgccagccgcatcaacagcatccttggcatagctttagatttttataacatacaacagacattaggtagtggtggagctgtttctgcaatcaaagcaaggtgtgagatggaagtggaccggatagagaaacagtttgacgattgcattgctttcttactaagggttttatcattcaaactaaacgtggggcacttccctcatttggctgatttggtgaccagaatcaactacaactatttctacatgtctgctaatggaaatttgatgactgcctccagttctggaagtgttacttcaaggttggggaaggcccctgggtag

SEQ ID NO: 9088 - DNA, 630 bp, Glycine max
  Peptide Sequence Number=SeqID_125866
atggatgccactagaattttggcacaaggagtatttgtgttccttgttattacgtgtgtgggagccgagagcgagcccagaaccattttggttggagactctcaaggttggcaagccggcactaactacacccaatgggccatccaaaatagccccttccacatcaatgacacacttcgtgcagtgttcaagtatccagggaattccacgacgctggctcagagtgtgtacttactaccaaaccagtggagctacataacgtgcgaattcagaggggcaaagctgttgggtaacgcaactgagggtgatggcgagggctttaaggttgaacttaatcagttgaaaccttattactttgcctctgcggaaggcaacttttatgactgcattgctggcctttcaaaggctgctttgaaatatcgagaagtcatcgtttgggagtgttacttgtgcatccagcattttttgctaggacacccagcatgtaggccttcttcttcctcttcctattccaacggctctttgtcttcctcttcttacggcggttcgtcttcctcttcctatggtgcttcttcttcgtcttcctcttcctacggcgcttcttcttcctgtcaccgttcgtgttcgtga

SEQ ID NO: 9089 - DNA, 411 bp, Glycine max
  Peptide Sequence Number=SeqID_125867
atgagttgttccacttcacgaccactagatgttgccaccagctcatcattcaactccacgattcaacctctaaactttatgagacattttgggaatagtgaacccccatcaacaccaaaacacaagcactcagaacccacccccaaacccacagaaaccaaaccaaaccccacactagaaagaagagttcaacttaccttcaatgactatggcgaaaggggaaggagaatttgtggtgtcgcgttgcaaagagggttgaaggggaaagaagagatgtggggtcacgagagggagatgagttgttgcagggaagggagtgggtcgcggagggagcagttgcgggagggaggggcgtcgtgggaaaggaggagggaggtgttagggtttgggaaggaggtgcaaagtcattga

SEQ ID NO: 9090 - DNA, 204 bp, Glycine max
  Peptide Sequence Number=SeqID_125868
atgaacatcaaagggatgactgggacagagggtcctggcactttaaacccccctagcatgcggattaggatttttgtttcttccacttgtgtcactgtgcaaagtctccagggtcctgagtttgttgctgcacctgtgctgcttctagcaattgctgcccggtcaaagaatctgggaaaccattgttccaagaaaaccaaatga

SEQ ID NO: 9091 - DNA, 879 bp, Glycine max
  Peptide Sequence Number=SeqID_125869
atgggaatctgcagaaatatgggtacccaaccaagggtacaaagaaggctaggaggaaacagagctgcactttttgtatatgctatggaaggactagagaacatggcttttgttgctaatgctgtgagcctagtaacttacttctttgggtacatgaacttcagcttaacaaaatctgccacaaccctgaccaactttttgggaactgcatttttactagcactggttggtggattaatcagtgacacctatctttctaggttcaagacttgtgttctgtttgcatgcatggaattgctgggatatggtatcctcacagttcaagcacgcttccaccaattaagacccatcccctgcaaagatctggcaccaacccaaatgagtcaatgtgaggctgctacaggtggccatgctgcaatactttatactggcctataccttgttgctttaggaaccggtggtattaaggcagctttaccagccttaggggctgatcaatttgatgaaaaagatcccaaggaggcagctcaactgtcaagcttcttcaactggttcttgttcagccttaccataggagcaataattggtgttactttcattgtttggattggtgtcaacctaggatgggattggagttttattgtatgcacattaacaattctattcgcaattgtcttcatatgcatgggcaactcattgtaccgaaacaatgttccaaagggaagccctctaattcgaatcatccaggtgtttgtggcagcctttagaaacagaaaacttccgattccagataatacagacaaactacatgagattcatgaaaagcgaggaggggacaattttgaaatccttaaaagaacagatcaattcaggttataa

SEQ ID NO: 9092 - DNA, 165 bp, Glycine max
  Peptide Sequence Number=SeqID_125870
atgagaatacttgtttatgattatttggttgacactgctgcctttgttcaaacaagagaaagcatcaatgagttcttgacaagtgttaaacaacatgacctggcaaaagctaaggttctgagcatattaaacattgggccagctgctgattttgaactataccca

SEQ ID NO: 9093 - DNA, 207 bp, Glycine max
  Peptide Sequence Number=SeqID_125871
atgggtcatccaacaaggtcaatgcactccaccccccatgaacatacacttcatacgatgtatgaacgtggctcaaagcaagtgccaaagaccatggaaggtcagtgcacttcgccccccacgaacatacacaacatccaacgtatgaacgtggcccaaagcaagtgccaaagaccatgggaggtcagtgcactttgccccccatga

SEQ ID NO: 9094 - DNA, 174 bp, Glycine max
  Peptide Sequence Number=SeqID_125872
atgattcaggcaacaggcggaaatacccaagtggttatccgtacaaacacatttctactaccccgacctgtgagaagtcaggcagcatgcggagacgcccaatggttattcgcgcccacacacaattctgccaccccgacctatatgttttgttatccaagcacaatcaagtaa

SEQ ID NO: 9095 - DNA, 279 bp, Glycine max
  Peptide Sequence Number=SeqID_125873
atgacaagcggagacgccttacggttatctgcacctcgtcatttggagaccccaagtctgattgacaagcggagaccaatgtggtcgtctgtgccctttccgaagatgtcagcatcttccggccaagactcttttggtctcacaacatctgctgatcctgacccatgcgtcaggtggcaggcggatatacccaaatatacccaagtgattatccgtacaaagacaacatctgctgatcctaacccatgcgtcaggtggcaggcggatatgcccaagtga

SEQ ID NO: 9096 - DNA, 282 bp, Glycine max
  Peptide Sequence Number=SeqID_125874
atgggtctctatagtcctatagggtgcccgttcccccaacaagggatcgcgcctgcaagacacccagtggacccgaagaagtccaacaggttctacggagtgcctgtcgcccccaaaaagatcatcaggccccctactaatcgagctttcatcaagaagtactgcgtccccaggcaggcgcagggcgaaacaccacagcagcctggggatggccggcagtgggcaacagatgcaccgccatcacctctagagttcatctcagctcatccacaaaaaggttag

SEQ ID NO: 9097 - DNA, 189 bp, Glycine max
  Peptide Sequence Number=SeqID_125875
atgccgacatctccggaaggggcacagatgaccacattggcctctgctcgtcaatcgcacttggggtcactgaatgacgaggtgcggataaccgttaggtgtctccgcgggctaccagctcttgggtcatgggcttttgctcctacgtatcctccaatgaggaactcagacctacgtagttctggataa

SEQ ID NO: 9098 - DNA, 402 bp, Glycine max
  Peptide Sequence Number=SeqID_125876
gacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtgtgtccg

SEQ ID NO: 9099 - DNA, 204 bp, Glycine max
  Peptide Sequence Number=SeqID_125877
atgctttgttcacgaaagaactacgtaggtctgattttctcatcacaattgaggaatacatgttttcctcaaataaacgttggtggaaactccgcgcgtattcctttcttggaagacgcacccgcgagtcacgcgtcgccctcccgccgaagggtaggttgcgacaagtgtgaatcaattctagaagttcgttacttcttgtag

SEQ ID NO: 9100 - DNA, 309 bp, Glycine max
  Peptide Sequence Number=SeqID_125878
atgaaacaaaaaggaaaaagaaagaaagaccgcaaaggtcgacatgttatagttaagaagtataaatcattcgtaaagagcaaacgtatcttctggaaacaagggactgacgctaagagtttattttccggaataaccgagataagaatggatgaattcattaaactgatgaaagaacataacttggaaacgttgggtctaattatcattccttccccgaagcaaaggacagcggaatctcctcaagggagagcgaatagaatgctaaaacccgatttcccaaacaaagggatggggaaggagaagtga

SEQ ID NO: 9101 - DNA, 852 bp, Glycine max
  Peptide Sequence Number=SeqID_125879
atgggtattggttttaccccaccttacttagcacccactacagttggaccagtgattttgaaaggtgtcaactatgcttctggggcaggtggaatcctcaatctcactggaaagctctttggtgaccgaatcaactttgatgcacagttagataattttgctaatacaaggcaagacatcatctccaacattggtgttcctacggctctcaatctattcaaaaggtctatattttcagtagcaatgggttccaacgatttcattaataactatttagcaccagcagtcttaatttacgagaagaatttggcatctccagaactctttgtgaccaccttagtgtcaaggttcagagaacagctcattaggctattcaatctaggtgccaggaaaattattgtgacaaatgtggggcctattgggtgtataccaagtcagagggatatgaacccaactgcgggtgatggctgtgtcactttccccaatcagctagcacagtcatttaatatccagttgaagggcctcattgcagagctcaattcaaatcagaagggtgcaatgtacgaatatgcagatgtctacaacattttaggagacatacacaacaattacgaagcatatggttttgagaacccatattcctcttgttgttccatggctgggcgatttggaggtttgattccctgtggtcctacttcgatcatttgctgggacagatccaagtatgtgttttgggacccttggcatcctactgatgctgcaaatgttatcatagctaagcgcctcttggatggagaaaataacgacattttcccaatgaatgttcgccaactcattcaatatttgacctga

SEQ ID NO: 9102 - DNA, 390 bp, Glycine max
  Peptide Sequence Number=SeqID_125880
atgaaggaagatacaccactaaaggaacatcttgatgagctaaactctattttgatgaagttatgtgacattgatgtcaagatggaagacaaagatctgacaatgattcaattagtctctcttccttcctgctataagaattttggaatcaaacaaggaaatttgtacatccttcaaagatccactgtaacaggctttgtctttactatttcacaatttggaagccatgtgtccaatgattcatctgataattttctgtggcatctgcatctaggccacatgagtgaaaatgtttggatattcagagcaagcaagacttacttgaaaatcaccaggtggaacttcttcaattttgtgagcactatctctaaaggaagcaacatcaaatga

SEQ ID NO: 9103 - DNA, 606 bp, Glycine max
  Peptide Sequence Number=SeqID_125881
atgtttcgagtttttatggtcttgctcttgttcaagattggcttatcaaattatgtaccagcgtcttttgttttcggggattccctgctcgatgtagggaacaacaactatattgtttcactggccaaagcaaaccatgacccttatggaattgattttggaatggccactggtcgtttcagcaatggaagaacagttgcagatgttataaatcagaaactgggtcttggcttttctcctccttacttggctcccactactactggatcagtggttctaaagggtgtcaattatgcctctggtgcaggtggaattcttaacaactctggccaaatttttgggggacgaatcaacttcgatgcacagatagataactttgcaaatacgagggaagaaatcatctccttaattggtgttcctgcagctctcaatttgtttaagaaggccctctttacagtagcattaggctcaaatgatttcttggataactatttgacacccatactctcaattccagagagggtgttggtatctccggaatcatttgtggccacattggtatcaagactcagactacaactcactgtaattttgctaaaaacctag

SEQ ID NO: 9104 - DNA, 267 bp, Glycine max
  Peptide Sequence Number=SeqID_125882
ctaagccaccttactacctcagtcattttgatttaccgttcctgcgtagcttctggcatttatattccgtctgcttgtgggataaggcctctctcttgggtttaactagcggagcagctagaatgcctgaagcgggaggagcgaacgaagtgagaactagatcgagagtccagttttcagtgacttcaaggagcaaagccataggaaataaggcaactctcttgacagaggggcatagcgggtactctaaccataaggagaaggaag

SEQ ID NO: 9105 - DNA, 192 bp, Glycine max
  Peptide Sequence Number=SeqID_125883
atgtcacgagtatcaccatttatgagacgctcagcaataacagcattggcagcatcactaggatggcacctgcaattggcaatcaatctgcgtggtgggatccatcatagtgtggtcatgcgtgttgaaactgagggacgagaagaagggcataaagaaggcctgggcattgagagcgttggtgtcatgaag

SEQ ID NO: 9106 - DNA, 250 bp, Glycine max
  Peptide Sequence Number=SeqID_125884
atggatcccaccacgcagattgattgccaattgcaggcggtggttgtttggttcaagtgtggtgatgatggtttaggtggttttgagaatccgaatagtgcatgctgtcacttggctggtcgatttggaggcttgattccatgcaatcgtaattcaaaagtttgtgaggaccggtccaagtatgttttctgggatacttaccatcctagtgatgctgccaatgctgttattgctgagcgtctcataaatg

SEQ ID NO: 9107 - DNA, 843 bp, Glycine max
  Peptide Sequence Number=SeqID_125885
atgtgttccttttggaaacaacaatcaatgcactggctgaagaaaggtgacatggacacaaaatatttccatgcattagcttcttctcaaaacaaaataaaatatattggttggttggaggatgaggaagggatttatgatccaattatacagaaggtggcacccaaaatatcatatgaagacaatgtgaatttaatgaggtcattcataagagaggaatttaaggaggcaattttccagatgcaacctgacaaagatctagtatcggatggattcagcccatctttctaccagcatttttggagcatctatggagaagatgttttccttgcttgccaatggatccaacaaggggagtttcctttctcagttaacgatatcaatattgtgctcattccaaaagtagaccatcctagaggtatgaaggacttcagacctatttctttatacaacgtggtctacaaaattttggccaaggtattgactaataggttgagtaaagttattgataaatgtgtgtctaaggaacaatatgcttttgtgcttgggagatctattgttgacaatgccttggtagcatctaaaatcatgcattacttcaggaatgttattattgttgttcttggggtgagggaaggtggaggaagaggtatgagtattttccaaatacctcagtctactggggatgagcttcaaaaggaaagcatgggtggaggattagcactatgccaaatgttctgcgggcaagagtttttaaagccaaatactacccaaggtggactttatggaagcggttttagggcacaatccatcctttacttggtagagcattttctcttctaa

SEQ ID NO: 9108 - DNA, 1212 bp, Glycine max
  Peptide Sequence Number=SeqID_125886
atgggttgctgggaggagattcagttaaggcatactattgaagaactcttggttgagtggcacaacaatgctttggagactgccagtgatagagaaacatggagtcctccgcctcaagggttcatgaagtgtaacgttgatgcaagcttcaggcagcaagcaaatttgaatgagggagaagtgtggactcttgcttcaacaatcactttctcgagcatactcggacttcacactatcatttttgaagttgattgcaagatgatagtggatagaatcatcaagagcacaaccatggacaagtctgagttggattcggagcaccgcgcgcgccaccattgggaaaagaggttccggtgctgggggcctagggttagggtttctgagagatgtgggatgctccatgcattgatgagccttatcgcgcgctgttggaagccgttcgggcacggtgacgatgccggtaatgccgccgccggaagagaatgcaaggacggcctcctctggttccgcgacatcggaaagtttgcagccggcgatttctccatggccgtcgtccaggccaaccaggtcatcgaggaccagagccagatcgagtccggcgccttcggcaccttcgtcggcgtctacgacggccacggcggccccgattgctcccgctacgtttgcgataacttgttccgcaatctccaagcgatattggccgagtcacagagtgttgtgacatctgaggccattcatcaggcgttccggcggacagaggaggggtttacggcgcttgtttcggagctgtggagctctcggccgcagattgcgactactgggacgtgttgtttggttggggttatttgtcggcagacactctttgtggcaagtcttggagattcccgtgctgtgttgggtaggagagttggcaacaccggtgggatggcgcgattcagttgtctacggagcacaatgcgaattttgaggctgtcaggcaggagcttaaggaattgcacccgaatgaccccagattgttgtcctcaaacatggagtgtggagagtaaagggcattattcagaaacaccgtctgagctcgcggagcgtcgatcgggtgcgagcgtaaggagacatgtagaactgcatccgtcagtcaggggagcagtcatcgctgcctatcacgcggtggtgcttgccggtgtggagggtctgggtcatgctttgcgccgttga

SEQ ID NO: 9109 - DNA, 294 bp, Glycine max
  Peptide Sequence Number=SeqID_125887
atgaggattcttttgataggccaaggttcaaaaaattccaaggttgtgtctcaatgggggcttttatcgtgggagcccgatcttaatatctggggcatgcgcgacaatgatgatttggaaacaacgtgcaaaattagtcatggccacagccaggtgggcactcaagcatcccatttacggcattgtgatactacggtcgggaatttacacaaacagacccaacgtttcccaattatgttctttcatcagttcaatgaattcatccattcttatctcggttattcaggaaaataa

SEQ ID NO: 9110 - DNA, 711 bp, Glycine max
  Peptide Sequence Number=SeqID_125888
atgaaagaacaccaaacatcacacaaagtgttcgcgcgctccacagagaatcgccatggcagattcaaggattttccgtctaagaagtctaacaaggcacactacaattcatcaaagtttatttcccactctttcttttttcgctttttacatttatattcaatttttcgtgttccttttattctctttcgccagatcacagataagagcttgaatgcggcatttgcatccctttctgaagattccgtggatttatcaccgatctccgagatctcatttgcaaatcacaacgaagatgtcacgaacttcttgttggaagaaccttcctcggtgactttggttccatctgatttaagtcctaaaaaaatcaccgacgcaacggaaattattgggtccgctaattctatttgcaacgatgaattagatagttctaggtttaattctgtggaagctgagattactgtgaattttctcagaaatgttaaagctccccaatttagaagagagcttatggatggcataattgagtatgttataagtgatctccaaacctataccttgccagaggagagagatcagtttgctcatttgctttcgatgaaaagtcgaatgttgtttctgtgtaccttcatttgggtaattggagtatcagttctgcttttcttcactttggatgctcgtggcccttacagaggaccgacgccaacctga

SEQ ID NO: 9111 - DNA, 165 bp, Glycine max
  Peptide Sequence Number=SeqID_125889
atggaagagcttggtttgaagtttctcactaacaacgtggtagtcgatgtcaatgtgtttagatcgctcatggaaagtagggttggttgcgatgtaggtgagccattgaatttcacgagtggtggaagtcaatgcgcgatattcaacttcaatggaggaccatga

SEQ ID NO: 9112 - DNA, 255 bp, Glycine max
  Peptide Sequence Number=SeqID_125890
atggtgagagcaacttttggattgagccttggttcgaaaattcatgcattgcattggagattccttttgtggacgtccatgctgttgatcttagggttcggggtgtcatcaacgacgaggctttgtcataaggcccttcctactaaaagctttatggtgcatcatcatattcctattctagcttctagccttaggtgcaggttgggagaggaggatcttcatcatatcttctgggaatgtgggagtatcgtgtag

SEQ ID NO: 9113 - DNA, 436 bp, Glycine max
  Peptide Sequence Number=SeqID_125891
tccggcgttcaatgcaggacgaagcatatggttgcctggttggttaaacgctgttaatgagaatagtaattctctattcttaacaatagggcctggagacttcttggttcatcatgctattgctcttggtttacatacaactacattgatcttagtaaagggtgctttggatgcgcgtggttctaagttaatgccagataaaaaagattttggttatagttttccttgcgatggcccgggacgaggcgtctgggcatggatgttcttgtttggacatcttgtttgggctactggatttatgttcttaatttcctggcgcggatattggcaggaattgattgaaactttagcatgggctcatgaacgcacacctttggctaatttgattcgatggagagataaaccagtggctctttccattgtgcaagcaagattg

SEQ ID NO: 9114 - DNA, 282 bp, Glycine max
  Peptide Sequence Number=SeqID_125892
atgaaaagatatgactcttcacaattgattttgaatttcaacgttcagatgcactgcttgcttctacaactcattgcttctcaatgccccaccaagaaaaccatgattatgaggggccaagacatttatagtagccaagatgaggttactacttcacctttctatagtgaaagtgaagaagcaaaagggaaagaatctagtgaagaaatctacccccaagaagaagggaaccttttaatggtcagaaggcttctaggaggccaatctagtgacttgaactaa

SEQ ID NO: 9115 - DNA, 132 bp, Glycine max
  Peptide Sequence Number=SeqID_125893
atgatttttgttgaccctgacccgagaagtcaggtgccaggcgggggtttttactctggtcattcggagacattcaagctcgatgacgcacgagattcttccctgttgggcggggacggtcaagttcgatag

SEQ ID NO: 9116 - DNA, 626 bp, Glycine max
  Peptide Sequence Number=SeqID_125894
cactcagccggcgtatccagaaactggaacaggcggtggggtcgccgctgctggagcgcaccacgcgcagcgtcagtaccaccgctgtcggcgagaacctgctgccgctggtgcgccgcatgctggaggaattcgatggatcactgttctcgctgcgcggccgcgaggacacccgcggcgcgacagtgaccatcgcctgcctgccgacggcggcgttctacttcctgcccagcgtgatggcgcgcagtggaacgtggcgaatggagttcggcatcaacttcatgggcgccaacgatccgaatctcgatttcgacgtactggcagaggacccgttcgtgctggcgtgccgtcacgatcatccgctggcgcgcaagcgcaaggtggaatgggccgacctggccgagcaccagttgatcaccgtgcatcgcaccagcggcaaccgcacgctgctggatggtgcgctggcgcgcgagaacctcaagttgagctggcactacgaagtgacccacctgtctacgtcactgggcatggtcgaggtcgtcatcggggtgtcagtgctgccgaatatggtcacgccatatgggggtcaccccaccctggtgacgcgcgcgatcggcaacccagag

SEQ ID NO: 9117 - DNA, 495 bp, Glycine max
  Peptide Sequence Number=SeqID_125895
atgagtaggagggcgcggcggtcgctgcaaaacccagggcgcgagcccgggcggagcggtcgtcggtgcagatcttggtgcctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 9118 - DNA, 405 bp, Glycine max
  misc_feature (384)..(384): n is a, c, g, or t
  Peptide Sequence Number=SeqID_125896
atggagaaatctgaaaagaaaaattttagtgaaaagaaaatgaagaaagcgtacatcacatgggatgacaatgatatggaatcttctgaagattcagaaaatgaagagataaacctctgtctaatggctaaaagttatgaaagcgatgaagaggtaacatcttcaaataacttatccatttcttttgatgaattacaagatgcatttgctgatttgcataaagagtcaatcaaacttgcaaattgttgtggaaaatatgaaaaagaaattaaagatttgaaaaactcacttgcaaaattttcttttagtaaaaataatttagatgtcatattaggaaaacaaagatgtgtctctaataaggctggaataggatataaacctganaaaacaacaaaaatttcataa

SEQ ID NO: 9119 - DNA, 989 bp, Glycine max
  Peptide Sequence Number=SeqID_125897
atggccgctttccagcgcatgctcgcgcagcacgcgggtgcagaagccgtggatggtgaagatggacgccagatcgatctcgtctgcgcccacctgcaggcggcgcttcagtgcggtggcactttcggagccgctctgcagatggcgctgcaggacttcgcgggtcaggcatacatccggtgcttctccctcggccggttccagatcgaccaggcgtgcggccagcgccaggcgctcgcgtatgcgcttgcgcagttcctgggtggcggcgtcggtgaaggtcactgccaggatctggccgatgcgcaggccctgctccaccaccaagcgggtgaacagcgtggccagggtgaaggtcttaccggtgccggcgctggcttcgatgaggcggatgccgtccagcggcagggccaggtagggatcacggctgagggattcgatgccgtcttcggcgatggcggtgctcatgcgttgccctcctggcgtgcttcggcgccgagacaggtcggcataactggcatcggtggcgaacgggtctgcgccgcgcagcagcagctgccaggcgtcgctgctggattcaccccaggtgcggtcgctgccgtgccattgcttccagccttcgctgcgctgtttttctgccggcgcgttgtacagcacccagccggtgtacggggcaaagcgcagcggctcgcgcaggccacgctggcgcagctgcagcagcgcacgcagcgcagcacgtgcagcgggaacgctcaatgccggcagcacgtgcggaccgggaccggcatcgccgccgtcatggaactgcacaagcggcagcgcatcgcccgcagcgttcgccagcagccagtccaggccgtggcggatcactgcattgccattgagtgtgccggcacgcaggcgcaccagcccttcgggatgccgatcggccacgcggccatgcaggcgcacgccatcgatgtccacttcgtagcgacggctttccagtg

SEQ ID NO: 9120 - DNA, 363 bp, Glycine max
  Peptide Sequence Number=SeqID_125898
gtagttgtgtctccagcaaaaccacctccaaagcccgatccggaggtcgatgatccgctttatctgatgacattgatcatcccagagcttttcttgaggccttatcaggttccactacagcggacactggcagatggtggtcatcctacccaaggaacacctagttgtctgtgtaatagacaaaaaggaagtactgagtgtggctactatgtcatgcactggatgtccaccatcattttaggaacttttaggaataactgggaagcgtattttaacgatcctagaccattggagctagagagatcaaaggcgttgcagatccagtgggcacagtattatctccgagttagagatcagacctag

SEQ ID NO: 9121 - DNA, 255 bp, Glycine max
  Peptide Sequence Number=SeqID_125899
atgagtatgcatgcgtgggagcatgtggttgatagcacaaatagaaacatactggatgaacgagcatggtttctagagatatcatcctctttgatatcaaacattgtggcggtagggactaccaatgacaatgtatcatcaaagagaaaaactctagatgaggtttcactgtcatcaagcgagtcggagactcagcatgaccatagatcaacctccacttcctatgttcccatggacccgggtatagggccctaa

SEQ ID NO: 9122 - DNA, 801 bp, Glycine max
  Peptide Sequence Number=SeqID_125900
atggaatttggttatattgttgttcattttaacattcttgatgccatgaaacatccatccgaggatcatactatttttcgtgctgagataattgatcagattcttgatgattatatgtttgattctgtccttcatggtaggaaacatccatttttatctgatctgcatgcttgtcattccttatgcattgaatatgaatctgagtttgaatttgaacctatatctgacttttatgttgagagtgaatttaaatttgagtttggttctaattttttgggtggtgtacctcttgatgctgattttttagagtcagaatgcactaaccatgttgcaggaagtacatatacttctgacttgctttatgaggtacaggctgaggaaccttcttcttctcctaccatggttcctaccacggtccagccaccacccacaccagagtggaagcccttaccagcaaccctcaaatatgcttacttggaggataaggaaaaatttcaagtgttcatctctgcctcccttgatgctgagcaaggggagaagttgttgctagtgctcaagaagcacaagaagggagttgaaaggacgtgcccacttgggccttccaagatcttccaacagaaggcggtgccttctggtggaaccaacccagctcgcctgggcgagctgggcagcaaccaccaccctcttttccctataaatagggggaggagggtaaaacaaaaagagacgtttccgtgggcgattttgcgaaggttttccactgttcttcatcgttcttcgtcgttcttcggtcttcaacca

SEQ ID NO: 9123 - DNA, 951 bp, Glycine max
  Peptide Sequence Number=SeqID_125901
atggaccggcatcatcagtgcaccgcacagccgcatgttccagaggtagagggattcggctgtgacgtcggagccgcaggtcgatgcgattctctccaattgccgcaatcgcctctcgcatcgagcaggaccgatgggataccttcgccagcgtgtgctccgggactcgcggctggattccagctccccccggggacgttgagagtgtaccgaagggccccgctagcagggccctttgtcttgtcagggccgaccctcgccggcggtccactgtccgttccgggcagggtcagagccgtgccgttaccatggccccctgtattcgggcgggtaagcgcaatggacaaggttttcatcgaggggctgacgatcgacgccctgatcggtatctacgattgggagcgacggatccgccaggacttggtgttcgacctggaaatgggcttcgacaaccgccgtcccgcggccaccgacgacatcgcccacaccctgaactacaaggcggtgagcaagcgcctggagcagttcgtgcgcgagtcggagttcggcctggtcgagaccctggccgagcgctgtgcacagatcgtgctgaccgaattcgacgtgaagtggctgcgcctgaagctgagcaagcccggtgcgaacaaggagacaacggatggtggacgcggtggtggcggtacagtggctggaaaagctgcagaacacactggaaccctatcctggcgcctacctggcgttgatgatctcggcgctgctgatcgccgccggcctggccaattgggtcaccaagcgcatcctggtgcgcgggctgcggcgcctgctgcagcgcctaccgggtgccgagtccgggcgtggcagccacctgatgcgggtgatctcgcgcctgtccaacgtggtgcccagccaggtgatcgcctcgggcatcactctgatcgtgggatcctctag

SEQ ID NO: 9124 - DNA, 3932 bp, Glycine max
  Peptide Sequence Number=SeqID_125902
attctgaggagataaaaaccattgagcagtggaaatggtccgaaatgcaaggccttgaacttgttccagaggagggtggtgcagctgcaccttcacaacaccaagttccaagggaaatgaacacttctgaaccacccaacaaagatgttggtgcttcttctgcagcagttactagtaacggtggtggggagaagaaagagaaagagagtgttccctctgttgggtttggagagcttttcagattcgctgatgggttggattatgttctcatgggaattgggacggtcggagcagttgtgcacggttgttctctgcctctctttcttcgcttctttgcggatcttgtcaattcctttggctccaatgctaatgatgtcgacaagatgactcaggaagtggtcaagtatgcattttacttcttggtggtgggggctgctatatgggcttcttcatgggcagttgttgttgttgcagagatttcgtgttggatgtggagcggggagcggcaatcgaccaagatgagaatcaagtatctggaggctgccttaaaccaggacattcagttcttcgacaccgaggttaggacatccgacgttgttttcgcaatcaacaccgatgctgtcatggtccaggatgccattagtgagaagttggggaatttcattcactacatggctacctttgtttctggttttgttgtgggtttcactgctgtgtggcaattggctttggtcactcttgctgttgtccctatgatagctgtgattggaggcattcacaccaccaccttggctaagctctctggtaagagccaggaagctctttctcaagctggcaacattgtggaacagacgattgcacaaatccgggtagtgctggcctttgttggggagtccagagcattgcaggcctattcatcagccttgagagttgcacagaagattggctacaaaactgggtttgcaaagggaatgggattgggtgccacttactttgttgttttttgctgttacgcgcttctgttgtggtatggaggctatctggttaggcaccacgccaccaacggaggacttgccattgcaaccatgtttgctgttatgattggtggattgggtttggggcaatccgcaccaagcatggctgcatttacgaaggccagagttgctgctgcgaagattttccgtataattgatcacaagccaagtattgatcaaaatagcgaatctggcgttgaactagacacagttactggacttgtggagctgaaaaacgtggacttttcttacccatctaggccagaggttcagatcctcaatgacttctccttgaatgtgcctgctggcaagaccatagctttggtgggtagcagtggctctggaaagagcactgttgtctccctcattgagagattctatgacccaacttcagggcaagttctgctagatgggcatgacattaaaactttgaggcttagatggctgaggcagcagataggactagtgagtcaagaacctgctttgtttgctaccacaatacgagaaaatatactgttgggtaggcctgatgcagaccaggttgagattgaagaagctgccagggttgctaatgctcattccttcatcattaaacttcctgatggctatgaaacccaggtaggagaaagagggctgcaactttctggagggcaaaaacagagaatagcaatagcaagggcaatgctgaaaaaccctgcaattcttctcctagacgaagcaacgagtgcattggactcggagtcagaaaagcttgtgcaagaagcccttgaccggttcatgattggcagaacaactctcataattgctcatcgtctctccacaattcgcaaagctgaccttgtagctgtacttcagcaaggaagtgtttctgaaattggaactcatgatgagctcttctcgaaaggtgaaaatggagtctatgccaagcttataaagatgcaggagatggctcatgaaactgccatgaataatgccagaaagagtagtgcaaggccgtcgagtgccagaaactctgtaagctcaccaataattgctaggaattcttcttatggacggtcaccatactcgcgtaggctatccgatttctctacatctgactttagtctgtcccttgatgcatcacatcctagttataggctcgaaaagcttgctttcaaagagcaagccagttccttctggagacttgcaaaaatgaactctcctgaatggctttatgctttaattggctctatagggtctgtagtttgtggatcccttagtgccttctttgcttatgttcttagtgctgtcctcagtgtgtattacaatccagaccacagatacatgatccgtgaaatagaaaagtactgctacttgttgattggcctttcatcaactgcacttctcttcaacacattgcaacacttcttctgggacattgtcggggaaaaccttacgaaacgtgtgagagagaaaatgctgacagcagtgctcaaaaatgaaatggcatggtttgatcaggaggaaaatgagagtgccaggattgctgcaaggctggctcttgatgccaacaatgtcagatcagccattggagatcgaatttcagtaattgtgcagaacactgcacttatgctagttgcctgtactgctgggtttgtgttgcagtggcgccttgcccttgtcctcgttgctgtctttcctgttgttgttgcagccactgttttgcagaaaatgttcatgactggtttttctggggacctggaagctgctcatgccaaggctacacaacttgcaggagaagctatagccaatggacaaatttctggaagtggatatggtgtagctcagtttgcactttatgcttcctatgcacttggtctttggtatgcttcttggctggtgaagcatggcatctctgacttctctaaaacaatcagagtttttatggtcctaatggtttctgcaaatggtgctgctgaaactttaacactggcccctgactttatcaaaggaggccgagccatgaggtcagtgtttgatctccttgaccgcagaactgaaattgagcctgatgatcaagatgctactcctgttcctgatcgtcttcgtggtgaagttgaacttaagcatgtagacttctcttatccaactcgcccggatatgccagtttttcgtgacctcagtcttcgtgcgaaggctggtaaaactcttgcccttgtaggacctagtggctgtggtaagagctcagttattgcacttatacaaagattctatgatccaacatctggtcgggtcatgattgatggcaaggacatcaggaaatacaacctcaagtccttaagaaggcacatttctgtggtaccacaggagccttgtttgtttgccactactatttatgaaaacattgcttatggacatgagtcaaccactgaagctgagataattgaagctgcaactcttgccaatgcacacaagttcatatctggtttgccagatggatacaaaacatttgtgggggagagaggtgttcaactgtccgggggacaaaagcaaagaatagcagttgctcgggcttttgtgaggaaggctgaacttatgcttcttgatgaggccacaagtgcacttgatgctgaatctgagaggtctgttcaggaggctctagaccgcgcctcctcaggaaaaacaactatcattgttgcacacaggctatcaacaatcaggaatgccaatctgattgctgtgattgatgacgggaaagtagctgagcaaggctcacattctcagttgttgaaaaatcacccggatgggatttatgcgcgcatgattcagttacaaaggttcacccacagccaagttattggaatggcctcaggttcaagctcttcaacaagaccgaaagacgacgaaagagaaggctag

SEQ ID NO: 9125 - DNA, 210 bp, Glycine max
  Peptide Sequence Number=SeqID_125903
atggtgatttttcaccatggagatgcagcggaagacaaaggagaagaggtagcttccttgagaagatttcttgagaaaacttccttgagaagcttctttgagaaaacttccttgagaagctatagcttagctacacacacccctctcataactaagctcacctccttgagaagcttccttaagaagattcctaaagaagctagagcttag

SEQ ID NO: 9126 - DNA, 387 bp, Glycine max
  Peptide Sequence Number=SeqID_125904
atggaaaatggcaaagccttatacgttattctgtttactttgctgttaggttcagttcaaattaagtatacagaggcagtgaccaatgccttcctatcaactccaaccatgtcccttttcgtcgccgctatcacttgccatggcctggcatccatggctgacacgaacttgcaaggtccagtcataatattccacctgtcaggaatagttggatgtgaggtactcatctgggttcttcttactgacattttgtggtactctatggtcaacatgcttgcttcactcatagctttcgtatgcttcttcaatcatattcctaacatctttgctgatcatgagatgccaattatagaaatgcagcagccgccagaagaagaagaggtgtag

SEQ ID NO: 9127 - DNA, 357 bp, Glycine max
  Peptide Sequence Number=SeqID_125905
atggccgtaaggcctaaggggattagtgagattgccaaagttttaacttccagagctggtgtatgtaaggaaaaaggatttcagtattataaacaacttccagagtgggtgtatgttaatcatctgtcaaacactatcacacaccgacctaatccccaatcacatgctgcggaacatgatatgagtgtggtgctgcgagtagaagtcacacgaatgacggtttcgttttcggtcaacaagctcaagggaaatggaaaggaaaataatgataatgttaaagttcctttgagtgttgaagacacaaacgacgtcatttacgagctttgtgtgttggcaaagacagattcggataactga

SEQ ID NO: 9128 - DNA, 993 bp, Glycine max
  Peptide Sequence Number=SeqID_125906
atgggtagagctccttgttgtgacaaggcaaatgtaaagaaagggccatggtcaccagaagaagatgcaaagctaaaggactacatagagcaacatggcactggaggcaattggattgcgcttccacaaaaagttggtttgaaaagatgtggaaagagttgtagactaaggtggcttaattatcttagacccaacattaagcatggtcaattctctgaagcagaagataaaataatctgtagcctctttgctagcattggaagcaggtggtccataatagcatctcagttgccggggaggactgacaatgatatcaagaactattggaacaccaagcttaagaagaaaatgatggccatgaatccttcactccaaaggaagcctcaacaaattacccttttatccatccttcaaagttcagcatattcatcaccatcgtcattcagagacagtaacaacatctcatactaccaccctcacggttccttttcctactcgtcaaatcttctgagtggtaacaacacttctgcttctgctaattccttctttcaagcacaagagagtttcattgaccccactcagaagtgccaattcaaagatagcagcaacaatagcatgtttttgtttggtggtgaagccacagccacagccactagttgcagctcttctgatgggagctgcaacaaccagataagccatgtcatagagccagagtttggtgatgcaagttttgttggtggggctaataataatattcacccctacagtggggtgctggaagataataatactcagaagttgatgatgttctccaatgctggtggtagtggtagtgttagtgggtggacagacaaacaaaatggattattatgggaacaaaatccattggattatggtctagatgaaattaaacagctaattagcactaataacagttgcaacaactttttgtttgatgacaagaagacacaagaaagagtcacttacttctga

SEQ ID NO: 9129 - DNA, 1593 bp, Glycine max
  Peptide Sequence Number=SeqID_125907
atggctagaacacgaggtttaggtcgtgtcataagtagacttgtaggcatagatagacatgatgatcatgatgcagctgatgtttccgagtggcgtaggcctactgtctcagcccgtaggcaacgggttcatcagatgactgcggatgcacgtgatatggctgaggacgttgctgacatgactgacgatgtccctgatctggttgcggaggcacctgagatgcgtgcggacgtacagggtgctgatggtgctgaggggtcagatgctgatgatgctactgagggattccctggtgggtcaagtgacccgtcaatgctggcatcatttgcggaccatgaacgtcctgatttgaagttggtgccacatgggagaaaagtgacactgattgggaggccagtgcctgagattgaaggactagctgctgccacaggattaagtccactgatcgattgctcagttattactgacgatcctggactgatatccgcattcatggagaggtggcacggtgagaccagcaccttccacctttcggtaggagagttgacgatcacattggatgatgtgtcgtcactccttcatttgcccatcactggcgcgttgcacagttttcatgctctttctgcggatgaggcgagatttttgctaacagagttgcttgaggtgtctgccgaggaagctagagtcgagacaacactgacacgtggggcatatgtacgactaggatgggttcaagacatttatgagatgagatgtcaggcccggcgtgcaacatacgtgcatgtggttaacctatacgcttttcgggacctcgctcagagtggtggttatgcttggggaattgccgcgctggttcatatgtatgaccagttagatgaggcttctaggaccaccacacgacagcttgcgaggtacttgacactattacagtgctggatctatgagcacttccctagtgtgcaccagtgcgtgacaaatgatacatatcaggagacgtccccacgtgcttcccggtggttgacattgaaggcgcacatgaagggaatcacaggagcaccttacagggcacgttgtgatgctttgaccgtcacagatgtgtcctggttgccgtacacggagcatcggggggttagggcttttgagctgatttcatcattccagggtcagctgagatggggtcctatggtggtcacagctcgaccggagagggtggtacgacagtttggttacatccagagcatccctctgccgcctgttagtgctcgattgtcacacgatgatatagatggcaggtggatgcattttgaggagcacctactacctgcgggtgagctttgtctagtgtctgggcaggcaggtgaccagccgagagatgcaccagctgcagaccctaaggagtacatacagccgcccagcccccagattccagtggcatttgacccccctccacatgtggcgattgtacagaggttggagtgtgtgctcaaccttaggatggtcactgcaggcacagagttatatgagattatgcaggactgtctgacgatcgccagagggggagccagtgctgatggaagtgtcagggctcattag

SEQ ID NO: 9130 - DNA, 336 bp, Glycine max
  Peptide Sequence Number=SeqID_125908
atgggacatgctaggtgcacccagcaacattgctggtgcacccagcaattagaacaatttgtgttctaccggaagaacctttttccggaagaacaaattgttattcttccgaaagaaggtttttccgaaaagtttccagaagaaggttcttccggtagaacaaattgttcatccgaaagaaccttcttccggaagaaggtttttccggtagaacaaattgttcatccggaagaaccttcttccggagaaattaccggaagaacttctggtgcacctaacatgtcccaactggaattcaactcgatatccccaaaagtattcccccacccccactag

SEQ ID NO: 9131 - DNA, 441 bp, Glycine max
  Peptide Sequence Number=SeqID_125909
atgagctatcttaaagtcaatgttccactccggaaaggaggatggattcttgttcaacgtttaagtggtgctgaaagtggcattcaggaggggcaaaactcaccctcggtggtggtggtcttcttctccgcaagccttctccgcgagcccttggacccatttgcattcgaggtaggtggccgtaaccttcctttggttttgttatgcactatagttgtagcatttaggggtagaagacgccggaaaaaatggggaaagcttggtgacggtggtgccttccggaagatccatttggagttcttccggaacttcctgaagaacgtattccggaagatttccggaagaagggttcttccggaagtactgaaacgtctttcggaagtactggtcttccgtaaagtttccggaacacctcttccgaaaactttccggaagaagtag

SEQ ID NO: 9132 - DNA, 588 bp, Glycine max
  Peptide Sequence Number=SeqID_125910
atggccgggaggcatcttcgtgatgcagtgaagacagtgctaactagtgaagaatattttgaatttgatgacattcacattgttatagcagggttaactaatacttattcacagtacatcactacatatgaagagtaccaggtgcaaagatatgaggtcagttggcatacattctggagtttaagaaacttgcggaagcaaataagcatatttccacctgttgtggtggatgcaaccccccttggtgtaaattttggggatgtttgcgctgatgtaccacggaactccaccttcaagagtggtgacttggtgacagcctcgttctggtctgcatgtcctcgtaacgaccttatgactgaaggcacctttgcactggtggaatttctccaagaaaaggatgcttggactcctgcttatgatgatgatgatttcaaactgagttctaggagcaaagcaaccttggaatggaggataccgcagggtgtggctcatggtgtgtacagattaagacactttggtgctgtaaagggcttatttggatcaattcattgctttacaggttcatccactgcgtttgtagtagcctaa

SEQ ID NO: 9133 - DNA, 342 bp, Glycine max
  Peptide Sequence Number=SeqID_125911
atgacatttccttctcgcggaagatggttcttccacggaatccccggaagtgccatatcttccatcttctgctggagtccgcggaagaaacgatcttctgcccgacctccaacagcaccgatacacgcgcggaagaaacgaaccttccgtggaagaaggctcgtcttctacctcgcgcaacgaaaaccagcacagaccaaaccagaccaaacatgtcttctaccctatggctatcaaaagcgattaaaggagaaaaatgagcttcaaatgccggcaatggaggacgacgcgcgcgaagaagaagacctggacgcggggagaagaagaagaactcgttgctga

SEQ ID NO: 9134 - DNA, 201 bp, Glycine max
  Peptide Sequence Number=SeqID_125912
atgcccatggaacatttcttccgcgagtgtcaacggaagaagtttggcaaaaacgctgaagagcatttttgccattttgaaaatttgctgggtgcaccagcaatgctgttgggtgcccctagcaaatcccaacaatatgtgaatgatacatgggttctgattgggctcgagcaaatgttaccccctacacgtgtttactaa

SEQ ID NO: 9135 - DNA, 1605 bp, Glycine max
  Peptide Sequence Number=SeqID_125913
atggagatcgataaggcaattagagagtgtgacgatcgaagacttcagaccaagtacaacaacgctacctatgttgttcagagagctttggctttgtattctattgaggaggttgccttcagtttcaatggaggaaaggattcaacggttttgttgcacatactcagggctggctatttcttgcacaaaaaggggcaaaatagtgcaaatggggatctaaaagattttccaattcgaacaatatattttgagagtccttgtgcattcccagaaatcaattcatttacctatgatactgctgccactttagatattatggagagctatgggttgcaaattgacaccattagcttagatttcaagtctggtttggaggctttgctaaaggaaaaaccgattcgagctatcttccttggagttcgaattggagaccctactgcggttggtcaagaacaattctcccctagttcgcctgggtggccacctttcatgagggtgaatcccattttagattggtcatacagagatgtgtgggccttccttttaacttgcaaggtgaactattgcagcctttatgatcaaggttatacttcaattgggagcatatacgacacagttcccaactcattattatgcattagcaattcttccaataaattcaaacctgcgtatttacttgctgacggaagattagagagggcagggagggctaaaaggccatctacttcaactggtggacaacatcctgcagagagcaatggcctgactagccaggattcacttaaaaacagcatgctcacagcatcaatcattgctgtgggagatgagattctgtttggcattgttgaggatcagttgggaccttatttgtgtaggaaactgcattgcattggttggtctgtgtttcaacattctgttgtgcacaacaatatagattctgtggccgaagaagttgagagacaaaaatctaaaagtgatatggtatttatatatggaggtgtaggtccactgcattcagatgttagcatagcaggcattgcaaaagcttttggtgttcgtttggctccagatgaagaatttgaagaatatctcaggcatattattggtgatcaatgtactggtgaccggaatgagatggctcaattgcctgagggcataactgaattatggcatcatgacaaattgtctgtgcccttgatcaagtgtgaaaatgtaataattcttagtgcaacaaatgttccagagctggaaaagcagtgggactgttggattgaattagcaaaatctagtgatctactagcattgctggaaccatatgtatcaaaggacgtgacaactaatctgtcagatgttgaaattgctcaacctctatcaaagctttgccttgaatttccagacctttatattggttgttaccgcaaagccagatatggatctcttatagtaagcttcaaaggaaagaatgaaaacctttcatggctgggatcatatcattctcatattatctacaaatataagatgcattgggataaagatggagagggcagaaaacaaggtgctgctgtgttgctagaagaaagaacaatggtacaaggaggtgactga

SEQ ID NO: 9136 - DNA, 589 bp, Glycine max
  Peptide Sequence Number=SeqID_125914
atgattgcacgcatctggtccggtgaatccccgctgtggctgctgcttctgccgctctcctggctgtacggcctggtgagcggtgctattcgcctgctttaccgtctggggctgaagcaggcatggcgcgcgccggtaccggttgtggtggtgggtaatcttacggcaggtggcaacggtaaaaccccggtggtcatctggctggttgagcaactgcaacagcgcggtatccgtcccggcgtggtgtcgcgagggtatggcggtaaagcggcgaaataccctctgttgctgacggcggaaaccacgaccgccgaggcgggtgatgaaccagtattgatttaccagcgtactggcgcccctgtcgcggtctcgcctgtgcgcagcgatgccgtccgggccctgcttgccgaacatgctgtacagataatcatcacggatgatggcctgcaacactacgctctggcgcgtgataaagagattgtggtcattgatggcgtccgtcgttttggtaacggctggtggctgcccgctggccccatgcgagaacgggcttcacgcctgaagtccgtggatgcggtgatcgtgaacg

SEQ ID NO: 9137 - DNA, 279 bp, Glycine max
  Peptide Sequence Number=SeqID_125915
atgtcgggatttacacgcgattctcctcgaatttcagccagcccgcatcaattagacttcacactttatgcttcggggtcatacaatgctcaatggaatgccccggggctcctccatgataagcacacgttgcgttcgagtcgtatcctcagaaaaatggaggttgaggaaccttggttgaggctttttgctgcaaaattcctttttgttggtgttttttggtttgtgctaaaggtggtcttcgtcattggaagtgcggtagacaggctttgtggttga

SEQ ID NO: 9138 - DNA, 777 bp, Glycine max
  Peptide Sequence Number=SeqID_125916
atggccccgaggaagcttgcctcaaagaggtccaggaaggataaggcagccaaaggaactagttccgctcctgagtatgacagagtagatagggcgtcggcggtcgacatcactggttacccccatggtcagtggatcccgtttgatgccgacgctatcggccagctcctgggatatccgttggtgttggaagagggccaggaatgcgagtatggccagaggaggaaccagtctgatgggttcgatgaggaggccatcgcccagttactatgtataccggggcaggattttgcccggacttctgcagggaggcgagtgcgaatcatgcgcaccaacatgaccaccctgactcagatatggatgactctactgctcagcaacatcctgcccaccgatcataattccgacctccccatgccgaagtgtcagctggtgtacgccatcctgacgcggatgagcatccatgtggctcagttgatcgctgatgccatctatatttttgcaggtatggcgcctactaggcaccctttcgacccagataagtccaacagggccctgggatttccctcgctgatcacaggactctgccagtcgttcggagtccccgttgcacctaccaaggtaattcggccgcccatcacccgggcttttattgagaagtactgtactcagagacaggctcagggtgatgctccacaggccgcaggcgcgcccccaccacctcatcaggctggccaggctgggtcatttgacatggagcagtatttacggcatttg

SEQ ID NO: 9139 - DNA, 357 bp, Glycine max
  Peptide Sequence Number=SeqID_125917
atggtggagcaggaggagagggaaataaagccgcatcaagaggaaacaatgcttgttaacctgggcactgataaagagaaaaaggaggtcaagttgagcttagctcatcagtgggctaagcgcacatccaccgctaagcgcagcttcattgcgcttagcacaaaggagaatctggcagagaatcaacatcaaggtcgtgcgctaagcagtgcttatttcgggaaaagagccctagaagcagcaagaggagcaacttatgcattgaagcctaggttttgtaaatttagagagattagtgagttggagagtgagcgtgagatgctgagaagaggaggaggaatcccccttcttgtgtaa

SEQ ID NO: 9140 - DNA, 875 bp, Glycine max
  Peptide Sequence Number=SeqID_125918
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgatgttttccagactttcgcattctggcaaccaattgactccacacggatccatgagcataatcagggcattcgtctttcactatcaatccagtggcctactttcagaactttgcttgctatccccataagattggtgtcggctggttatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 9141 - DNA, 656 bp, Glycine max
  Peptide Sequence Number=SeqID_125919
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgataaactctagacagaagcattctcagaagcgtcattgggatgtttcaattgaagtcacagtgttgaacattccctttcatagagcagctttgaggatttcgttggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 9142 - DNA, 526 bp, Glycine max
  Peptide Sequence Number=SeqID_125920
gaatggggtagtcggagtaccaaggaagtttttggagaaagggcaaaggccttggaaaatcaaggcgaatgggctttcttttattgacatcttggcgcttttgatctttggagttgtcctctttccgaatatggaagggttagtggacctagcagcgattgacgctttcctcgcctttcatcatggcaaggaaagcccggtcgtcgccattttggccatgtatgacacgttcgaccgaggatgtgaaaagagcagcgcaagaattgtttgttgtgcactggctctctatgtgtggctggaaggaagaatcaggattctatcctcatgcgaaggatgtccaaatgttcccttgatgggaacaaggggttgtattaattataatcccgtcctcgccataagaccgcttggctaccccatgagaggagtgccatcaggcgaaagcatcacgcctttcatcgcacggggtttcagtgaccacaacgcgagggtactccaaggagttcgcaaggcatgggatgcggcgtga

SEQ ID NO: 9143 - DNA, 177 bp, Glycine max
  Peptide Sequence Number=SeqID_125921
atggcgaagacaagcagctgggctcgcggagaagaagagaagcagcagcgtagaagagaagctcgcgaagaaaaagagaagcagcagcgtgaatgtgttatgacacgttctccagacaagataaagagcatcgatggctcaaaagaaactcttaaaactcagtgtgaggatcagtga

SEQ ID NO: 9144 - DNA, 630 bp, Glycine max
  misc_feature (65)..(65): n is a, c, g, or t
  Peptide Sequence Number=SeqID_125922
cgtgccgttcccgtcgccgacggccatagagacgattttcaactgcgtgccgcccgcgctggcgncggcaatcttggccgccccggcggtggtaataatcgctttgtatttgttcatgattttctcttatccggggtaaacggtaataacatcgccatcaatggcggccgcgccggtgtaaatccggccggggatgtcctgcaaaatgttgaggccgatcaggtggcggctcaggggcttggcgtcggcgataaggcgctccatttcctgatacatttcctcggtgatgccggtttccagcacgccaatatccagccggaaggtgccgggcggatcggcgccgtcggtatggaaccactcgataacgttaatcaggtagccgagcggctccaccacacggcgcactgcgccgatggtgcccttatgccggtgaatgtagaacgcagcggacaccacaccccgcttgacgtcctccggccacgcctcatcccagcgatcgacagagaacgcccacgccagatagggcagcagatgcaccgggcaggttttcgggttccacaaatcacgcaggggaaccggcacgcgctccagctcagcacacgcggcggcggcagcaacttccagcggtga

SEQ ID NO: 9145 - DNA, 348 bp, Glycine max
  Peptide Sequence Number=SeqID_125923
gttgtccgcgacgcgctgaatgatgaggacgtgcgcccggtcgccgatcgggtcatcgtgcaatcagccaaaattgctccgtatgttatcgaggccgttttatacctgtatcccggcccggaggtggcgcccatcctcgacaccgcaaacaaacggctacgcgcctatgtgcaaaatatgcggcgcctcgggcgcagtatccggcgctcaagcatgaatgcggcattgaccgttgaaggcgtcgaacatgtggagattatcaagcctgccgccgacatcgtgctggataaaacgcaggcgggttactgcaccggcgtgaacatcactcccgggcgcgccgatgactaa

SEQ ID NO: 9146 - DNA, 615 bp, Glycine max
  Peptide Sequence Number=SeqID_125924
tgcagtgttcgaaccgttcagatgcctcagagctgaatgctagtattctaaaacgcgccggatttgaaattactcagtccaccaaaaaaggaatgactggtaaaaacaaaatagtagcgtctgtaaaagctactgtgttgggtattggtgggtcaggtggtggagagaccgaggatacccattctcaagaggtaactactactcctctcgaaatcgatattgatgacgttaatgatgtaatagctgcattgaaatctatcaacttcaataaggttatagtgctagaggactttcactatatgccttttgagacacaaagagacttttcaatagcattaaaagctttccacgaaacatcatccataactttcatcattgttggtgtctggttagaagataacagattaattgtttacaatggtgatttaaccggtcgtattatctctgtcaatgccgatgtatggtcagatgacgaattgatgcaggccattgagactggaggacaacttctaaacattaattttaccgaagaatttaaaaaacagattcttgccaatagcctcaaaagtatttacctcgttcaagaagcatgtaggcgagcgtgtgagctaagca

SEQ ID NO: 9147 - DNA, 475 bp, Glycine max
  Peptide Sequence Number=SeqID_125925
aggactacacgtcctcgcctttaggggactacatgtcctcaccttgagagggctgcacgcccttgcctttagaggactacacgtcctcgcctttagagggctacacgccctcgccatcagagggctacacgtcctcgcctttagagggctacatgtcctcaccttcagagggctacactccctctccttcaaaggaccacacatcctcgcctttagaggactacatgtccttcccttgacttctgaggactacacagggctacgcgccctcaccttgagaggattacacttcctcgtcttcagaggactacacgcccttgccttcagaggacttcacgtcctcaccttcgtagtgttgcacgccctcgccttcataggactttacatttgtgccttcagagaactcaaggctaatagtttgcttttatcagttcctaggccaccccctgatattggatggcgaccaactgtgtga

SEQ ID NO: 9148 - DNA, 338 bp, Glycine max
  Peptide Sequence Number=SeqID_125926
cctctggtcgatggaacaatgtaggcaaggaaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 9149 - DNA, 180 bp, Glycine max
  Peptide Sequence Number=SeqID_125927
atgaagaacggtggaaatcttcgcgaaatcgcccacggaaacgggaaaagagggtggtggttgtcgcctagctcgcccaggcgagctgggttgcttccaccagaaggcaccgccttctgttggaacatcctggaaggcccaagtgggcctgattgctatttgcacacccttgtttactaa

SEQ ID NO: 9150 - DNA, 288 bp, Glycine max
  Peptide Sequence Number=SeqID_125928
atgtccgattcggggataaagtatatcaagacgctcgaaattgaacaacggaagctctcgagaaattcaaatggtcataacttttcactcggatggccgaatcaagcgcataacatattgagaccctcgaagttcaacaatggaagctctcgagaaattccaatggcacataatatatcgcgaggcttgaaattgaacaacataagctctatagaaattgaaatggtcataacttttaacacggatgtccgattcagacgcataacatatcgagacgctcaaaattga

SEQ ID NO: 9151 - DNA, 285 bp, Glycine max
  Peptide Sequence Number=SeqID_125929
atggcaagcaaaggcggctcgtggaagtcaccggtggtcaatggtggtggaggaggagcttgggggttggtggttactgataaagagggttttgaacttctggtgcttccaagaataagagctcggactgtaaaaattggtgtcattctcgtaattgtcatgaaggttgtggttgttgaaggagaagggttggtagacattgttgttgtcgcggtgaagaaagtgttactagaggcacagttgacatcgaggaagatggagtgggcctctgatgagatgttgtag

SEQ ID NO: 9152 - DNA, 561 bp, Glycine max
  Peptide Sequence Number=SeqID_125930
gggtccagaagaccaagggcaaggccagctaagactccttctacatcggcagctcgtcatccagcttctacatcagcagctcctcctccagctcgtattgcagcaactccttctaccccacctcctggagagtttcaacatttcaaagccatgcttcgaagcatacatcaagggcagattattttgctgcaaacctggccagggactcagcctcctcttcacagggacgacgaggatcccgccgctcaggtaccacatcagccattagatgagtcatcagagtcttccacccctaagcccttgatcaggaagaggagggtagttgtaactcaggaagccgcagccactcctgaaaagtcccctgaggccactccagagcctccagtaccaatggcaaataccacttctccacagcaagcagcagatccttcaacgcctgaagttcaaaccaccccagtcctgtctccgaacacctctcttgtagctactcctgtactgcatttgactaacgaggaggaggttcagacacaggacacccaggaccaatcacaggatctttaa

SEQ ID NO: 9153 - DNA, 1012 bp, Glycine max
  Peptide Sequence Number=SeqID_125931
ccttgccattgaaggcgtcagaggtcagcgcggcggcggcgctgtcggcgatatcgcgaacatcgataaagctcgacttaccctcgcccgccggaacggcgatctggccatggtcgatgcccgccttccagtagctgtggaaattatcggcgaaccagttggggcgcaggatgacgtgaggcgtgcccgaagcgatgatcttcagctcgatctggcgatagggaatggaatcatcggcatcgacgccgaggacgctgaggaacacgatcttcaccttgcggcgcgcggcctcctcgacaacgggcgtcagcgcgtcgatggcatccagacgaccgccagccaggatgaggaacagacggtcaacgccgtcgaaggcatccgcataagtcgatgcgtcggtataatcgaaacgcacgccttccgcgccgcccgtggcgttgccgctacgcgaggccgccttaacgctttcgcccttggaaagaagcgctttcaccagcggcgtgccgatggtgccggtggaaccgattacgaggtgaaatcgatggcaaatatctatgacgtttatgaggaccgctgccccacccgcatggtgctggacaggatcgccgacaaatgggcgctgctgatcctcgacaagctgcggcgtgatgccgttcgcttcaacctgttacggcgcgagatcaagggcatatcgcagaaggtgctgtcgcagacgctgaagaagctggagcgtgacgggctgatttcgcggcaggcctttccaacggttcctgtcacagtcgaatattcactgacgccgctggggcgcacgctgacggacaccgtggcggcgcttgcccattgggcggagggcaatatggacgcggttatggcggcacagagggcttatgatgagcggacgaccatcgcttccgtcataccggacttgatccggtatccagccagcccaagtccatgggctgaaaagactctgttcgccgcgcagacgcgcatcgactggatgccggatcaa

SEQ ID NO: 9154 - DNA, 417 bp, Glycine max
  Peptide Sequence Number=SeqID_125932
atgccgatctccccctgtggaaggatcacacccacaaagacaactaatgaacccgcagaagtccaacagggccctggggtttccagctctggttatgggctcctgttagtcctacagggtgcccgttccccgcagcaagggatcgtgcctgcaagacacctagtggaccccaagaagtccaacagggtcttggagttgccagctctgattacgggcccctatcagttctacggagtacctgtcgcccccagcaaggtcatcaggccccctactaatcgggctttcatcaagaagtactgtgccctcaagcaggcgcagggcgaaataccacagcagtctggggatggccggcagcgggcaacagacgcaccgccaccacctctagagttcacctcaattcatccacaaaaaggttag

SEQ ID NO: 9155 - DNA, 393 bp, Glycine max
  Peptide Sequence Number=SeqID_125933
caaaataggggaggagcttgccacccaactcgcccaagcgagctcagcttgcccaggcgagctcagctcgcccaggtgagcaaggttgtttcctccagaagcaacagcctcctggaggaaggatctggaaggcccaagtgggctagattgctatttgtacccccctttttactaaatgcaccccttctattttttgctttcgaagaagttacggaaacttatggattgcgcaaaaacacctcttttcgattttcgccacattatggaatttcacggattgcgcaagcctgcttccttttgatttctaacacgtctcgggacttcattcattgtgcaacaaaggacgccaagtgtctcgaagcggccaatcaaaggttgtatatcatcaaataa

SEQ ID NO: 9156 - DNA, 198 bp, Glycine max
  Peptide Sequence Number=SeqID_125934
atgaggattccttttttacaggccaaggttcaaaaaggtgtcgatttcgggccgaacttccatattattccatatggcacgcaagacaatgatgatttgaaaacaacgtgcaaaattagtcatggctacagccaggtgggccctcaagcatcctgtttatggcattgtgatactacggttgggaatttatacagatag

SEQ ID NO: 9157 - DNA, 252 bp, Glycine max
  Peptide Sequence Number=SeqID_125935
atgtgggccatcatcgataagtgcaaagagaagctaaatctagcggcgactcacgagcaaaggctagaggatgagtacgccaagatatcagcagaaaggaagcaagggaaaaggagtcaagaacttcccccattgctagccaaggccaaagcagtggcggacacctaccccgcccccgaggagatccacggacttctcagctattgtcagcatatgatagacttaatggaccatatgattagaaaccgctag

SEQ ID NO: 9158 - DNA, 600 bp, Glycine max
  Peptide Sequence Number=SeqID_125936
atgggggagacacatgaaataccccaccacaatctagctgacttcgagcctcacctcgaatacgccactatggggcaagtagttggtggtgtacccctgccaaacactttggagggccctcagtttcgcccacaaccactacccttgcattttgcggtgggaagagtccctcctactatggtggaaagggagaaattggatcatataaaggaaaggctcagggtcattgaaggaggtggagatcatgcttttgctgacattgcagagttatacctagtgcctgatatcatcattcctctgaaattcaaggtgtccgatttcgataagttcaaggggactacttgccccaagaatcacctgaaattgtactgtcggaagatgggggcgtacgcaaaagatgaaaaactgctaatgcatttcttccaagagagccttactagggcagccgtcacctggatcgaagtgggtctgaaaagaggcaaatttgattatcctgctttgataaatgagaagccaggggaaaatagagaggatgagaaggaggaaggaacccatgttgtgactgccattcctacatggccaaatttcccaccagcttaa

SEQ ID NO: 9159 - DNA, 582 bp, Glycine max
  Peptide Sequence Number=SeqID_125937
atgagttgtggatgtaaaacatccggcgattctgcgcattcttgcggacccaagaaatccgcgaatggttgtgaaaatgtaaatacctgtggtagtgtagtcaccgtagaatctagtcccggacacgatgttggtgtggtaagtctcaccggcgaattagtgaaaattcagatgaaaaagaaaaaattttctgaagaaaactcactaaaaatatacagattagccaatcaaaaagatattgaagtttggcaggaagctagaaaaaaagaagacagcgtaaagatccaggcaagaaagattgcccataatctggggcttgaaatgaaagttactgatgtagagtatcagggagatgcctctaagacagttaataaaagaatacgcctctacattccgaacaaaaatcgacatgaaacagatcggtttcagacaggaagccgcaaaaatcggaggaatcgggtcttgtggaagagaactttgctgttcgacatggcttaccgacttcagatctgtaaataccaacgttgcgagatatcagcaattaagtatcaacccgcaaaaacttgccgggcaatgtggtaa

SEQ ID NO: 9160 - DNA, 633 bp, Glycine max
  Peptide Sequence Number=SeqID_125938
atgaggacacgtagccctctaaaggtgagggcgtgcagccctctcaaggcgaggaggtgcagtcctctggagatgagggcatgcagccctctgctggcgaggacgtgtagtcctttcaaggtgagggcgtgtagccctctgacggtgagggcgtgcaaccctctgatggtgagggcgtgtagccctctcaaggtgaggacatgtagtcctctaaaggtgagggcgtgcagccctctgatggtgagggcgtgtagccctctcaaggcgaggacatgtagtcctctaaaggtgagggcgtgcagccctctgatggtgaggacgtgtagtcctctcaaggcgaggacgcgtagtcctctcaacggtgagggacgtgtagtcctctcaaggcgaggacgtgtagtcctctcaacggtgagggtaactagtacccaagtacccaaggtgaggacttatagccctctcaaggcgaggacgtgtagtcctctggaggtgagggcgtgcagccctctgatggtgaggacgtgtagccctacgttggcgaggacgtgtagtcctctcaaggtgagggcgtgcagccctctgttggcgaggacgtgtagtcctctaaaggtgagggcgtgtaaccctacgaag

SEQ ID NO: 9161 - DNA, 1251 bp, Glycine max
  Peptide Sequence Number=SeqID_125939
ctgcatgccctcgtcttcagaggactacagtcctcgccttcaaacggactacacgtcctcgccatcagaagactacacatcctagccttcagagggctacacgctctcacctttagaggactacacgtcctcgccatcagagggccgcatgccctcaccatcagaggactacacgtcctcgccttcagaggactacacgtcttcaccttcagaaggctgcacgtcctcgccatcagaggactgcacgtcgtcacctttagaggactacatgtcttcgccatcagagggctgcaggccctcaccttcagaggactacacgtcctcgccatcagaggactgcacgtcctcacctttagaggactacacgtcctcgccatcagaggaatgcatatcctcacctttagagggctacacgtcctcgccatcagtggactgcatatgctcaccttgagagggctacacgtcctcgccttcagagggccgcacgccctccctttcagaggactccacgtccttgccatcagagcgctgcacgccctccccttcagaagactacacatcctcgccatcagaggactgcacgtcctcaccttcagaggacttcacgtcctcgcctgcagaggactgcaccccctcgcctttagagggctacacgtcatcgccatcaaaagactccacgtactcgccttcagaggactgcacgtcctcgccttcagaggactcgacgtcctcgcctatagaggactacaagtcctcgccatcggaggactacacgccctcacctttagaggaccacacgttctcaccatcagaggagggctgcacgccttcaccttcagaggactacatgtcctcgcctttagagggctacaagcccatatcttcgaagggcaacacgccttctccttcagaggactacacgtcctcaccttcagaggactgcatgtcctcgcctttagaggactacacatcctcgccatcagagggttgtacgccctcgccattagaggactacacgtcctcgccatcagagggccgcacgttttcaccttcagaggaatgcacgtcctcgccatcagagggctacacgccctcgccattagaggactatacgtcctcgccttcagaggactgcacgtcctcgccttcagaggactcgacgtcctcgcctacagagtactacacgtcctcgccatcggaggactacacgccctcacctttagaggaccacaacgttctcgccatcagagg

SEQ ID NO: 9162 - DNA, 240 bp, Glycine max
  Peptide Sequence Number=SeqID_125940
atggaagagaattccgaatcagctttgtctacgaacaaggaagctataagtaatgcaactaggaatctcatggagagttcgatcctggctcaggatgaacgctggcggcatgccttacacatgcaagtcggacgggaagtggtgtttccagtggcggacggctggaaacggctgctaataccccgtatgctgaggagcaaaaggaggaatccgcccgaggaggggctcgcgtctgattag

SEQ ID NO: 9163 - DNA, 938 bp, Glycine max
  Peptide Sequence Number=SeqID_125941
acaacaagtttccgaagcaagttagggttcgagggcacctgataaaatttgatattgattccctcaacacctttttggagactccagtggttgtggagcaatgggagagctttccttcttactctaggtttgctagactaaggcctgatctgcaggagcttgcagcccaattgtgtatccttgggaggggatttgttctgaatgtcgagggtctactgtggaagctcttgaggaaagatcttaccactctggcccaaacctggagtgctttaccttattctaacttggccccaacatcccatacttctgatcttaatctggatagggccaagttagtctacaggcttataatgaagatgaatatgaacttaggttcacttatttctggtcagatttcactcattgctcagtctaactcctcgcggcttggatttccaaccctgattactaccttgtgcaaggcccgaggagtcacctcagattctcttaccttcaaggctagaagatctgaggccccatctacatcagctgcccctactccctctacatcagctccatctacttttgctcttcctttaccaccaacagctccagttcttccaggtccctccgctcagagcttagagtcttttcctgtctatgctacagagtctgcattaggaccagctcctgagcatgcagagtttgcaggatgtggtccaacaatgaccaattatgagcgtggaggagtttcttcaaaagcccaggagcctcagtcggaccaggaggataacattttagaggcctcggaacccactccacctgagcctttcatttttgagactgatccagtagcagctaccccgcaggtgacacccaagccttccactgtagtgctggacatgtcttcttctcagcctgagtcaactgcaccagcgccagaccttccccttcctcag

SEQ ID NO: 9164 - DNA, 303 bp, Glycine max
  Peptide Sequence Number=SeqID_125942
atggaagccaatgtggttacaattgccgctaccagcattgttgctaaggtgtacccgatgcccccatctggcctcaacctaatgaatcatccaaccttagacatggtaggcaaagatttgggaagtagggacgacccccatgatgtgcaaaatcgaaacaagcacgccttcccgccatatggcctgcctcccaactatacaccacccaatgtggcatacactcccaatgaggatgtcaataactccactcttatacccattgagagccaacaaccccaaactgatcatgcacatgtctcttaa

SEQ ID NO: 9165 - DNA, 510 bp, Glycine max
  Peptide Sequence Number=SeqID_125943
gtagattgcaacaaaggagatcgtgaagagcatacgtacactggaatacagggagcgcctagactgactccggattccagatgtctgttggatcccatatggggagcatcgaccgatctgggacttccatttgatttcatgctattccggtctcctgcactggaggcccgttgctgtgtattaccgaccagagagggtggatgcactactcggatcatatggttccagcaggtgaggtgtgcgttgtgccaggtcagtgtgtcagcgactacatggactggccaggcatcagatcctttgccagatggtaatgctccgcagccccgggtcgtccctcaggccccacagacagatatccctcatgtgccagatctaggagcaccgtcgacatctgtaaggcccgctgtggaggagcctagacatgtagtggaagttttccatgggattgttgagaggtcggagcgccatctgagcctagggatggtcacgccaggctcatcgacacatgag

SEQ ID NO: 9166 - DNA, 201 bp, Glycine max
  Peptide Sequence Number=SeqID_125944
atggttacccgcacctttcatcaaccaggggcaaacgagcccattgacgtgcagagactaacatcgtcttctgcaacttttgccatccaaggacaacgagtcaggtggcaggcggtgataccttatggtcatccgcacctttcgtcaactgaggggaacgaattcgacgttatcaggatgatgttggtcattcggttctga

SEQ ID NO: 9167 - DNA, 363 bp, Glycine max
  Peptide Sequence Number=SeqID_125945
atggaaatccaacgtcttaatcaaaatgaagaaaccgacaaaaagaaaagaagtatagcacttaaagcctcctcatcaatgcaagaagaaaatgaagaagaagaatcagatgatgaagaagacttctcactctttgtgaagaattttcaaaactttgtcaagaaaagaagaatcgagaggccaaattgtccttcaaatgaggaatggcctaagaaaagtgataagaaaaagtatgaagaaagaaggaccaagaagacctacattgcatgggatgacaatgactcatctaacggttccgagaaggagatcaaccttctaaccaaggactatgaaagtgatgagaacatctctcaagaagattaa

SEQ ID NO: 9168 - DNA, 405 bp, Glycine max
  Peptide Sequence Number=SeqID_125946
atggatcgaagttggatgaaagcatcacgcattagtgacgagtatgagaatggggttcaacaattcctgcaatttactgaatgtaatgcaacttctttgggtaggaaatttttttgtccctgtattaaatgtggaaatgggagacgccaatcaataaatgacataagatcacatcttatatgtgatgtgatcattccttcttacacaaaatggatatggcatggtgaatttccaaacatgccaactgtccctcaaactgagtcggttcatgaagacatcggatatcgtatagaagatatgattcgcgaccttgggcaagacagttttcagcaagcacatgcacttttgtatgagaaaatacaaaatgactctaaccaaaactcacacttggacaacttagtatag

SEQ ID NO: 9169 - DNA, 211 bp, Glycine max
  Peptide Sequence Number=SeqID_125947
tgctttaaaaggtcttgatgatgctccacagcctaaatcaaaggctcctgctaggtggattgtcgtcaagatgtccaccatcattttagaaacatttaggaataactgggaagcgtattttaacaatcctagaccattggagccagagagattaaaggcgttgcggatccagtgggcacaattttatctccgagttagagatcagacttag

SEQ ID NO: 9170 - DNA, 369 bp, Glycine max
  Peptide Sequence Number=SeqID_125948
atgtttttctctatttatcatcactacgggccatatggccagatcgacgttgtcagaataatagtgtgcccctttgaaaaggatgaatgccccacccatgtgatatctgctaaaggcttcgtcagtgaggtaaattctctacttgtcttcaccttcggacatcaagaaagccgaactgactcgctggctttgctttgtaagggcttgacctctgatgtatggaagtacgtggttgaagtgaattcctcggaaatgcagccggagggcaatctctcttttgacccggtctgcatatggctatggttcagatacagactaaagactttctttcgtgctttgatctcagtggaagtagagtattgctcctga

SEQ ID NO: 9171 - DNA, 201 bp, Glycine max
  Peptide Sequence Number=SeqID_125949
atgaaagaaccagctctccaaggcgagccagttacttcaagagtaagcatcagctcgcctgggcgagctgccattgacccaggtgcccattttcctataaataggtgtgctagggaggttgaggagaggttccaaggttcagaagtgaagggaattgagagaactaagaaagaagaggaaacgaagccgaggcactgctga

SEQ ID NO: 9172 - DNA, 198 bp, Glycine max
  Peptide Sequence Number=SeqID_125950
atgtcagtgaaaaatctcgtcaggcgcctaagagtacatgacaagacaaaccacgcactaaatgttccaaccatgtgggatcggcacaagctgaaaggagcactcaaaccgggtgtatttaccctcaaggcctacactccgaagagtctgttagggcctcttcctcctgattcaagttcaacccaaaaaacattttag

SEQ ID NO: 9173 - DNA, 426 bp, Glycine max
  Peptide Sequence Number=SeqID_125951
atgcctcgtactcatgacgcgatcctgtattacaacgggaaatggaacatgccaccgcagaacaaatttgttggatgcatgttcacaggaaaaaatcctaagaaatttcaaattccttcaacatgtaccatcgatgaactgaagaatttaatcaagcaagttgcacctaaagggattccccctcttggaattcacgaatcacaaacggtaagacgattgtttttccgccaaccagctcgctttgagtattcagatacggttataaaatatgaaataaatgagctgatgaccaacgaagaactgctgaaggtgttagtacaatctaactactggaaaaaatatggaccagtagaaattttagctgtctttactaaatatgttgtgaaaatcgaagacgaggtcactgggacgtcgctaaacaactga

SEQ ID NO: 9174 - DNA, 165 bp, Glycine max
  Peptide Sequence Number=SeqID_125952
atgggttttcctttgccggcagtcccttaccttgctgaaaatttatctggccaaggttcaaaaaggtctaaggttgtgtttcaatggggtctcttatcgtgggaacccaatcttgacatctggggcgaaacaaatttgggtgtcaaggtgtcgatttcgggctga

SEQ ID NO: 9175 - DNA, 963 bp, Glycine max
  Peptide Sequence Number=SeqID_125953
atgaagcgatgggacatggtatgtctcatggcgatacgcaggctacacacgactcaaggtctgaaatgcccctcatggatcatccggcagtcgtgcatggtggagcaagtgaatccgcaatcacatcccaaggcagtcattcagctcatcagcataagtcatccgaaggagcttcacatgagcactaatacaggagcgctcagagcacgcagtgccattcttgttgccgtcagcttgttattaggcgggtgcgcgaccttctcaaaagatggcggtatggatgaggtacaaaaacaaactcaaccgtacctgaaacaagaatatcaatgggctaagacagaagagtctacacagtcccttcaggaaaagactcaggcattgcttgcacaacctttggatgtagagggtgcagtacaagtggcgctttataacaacaagggtttacaggcgtcgttctacgaactgggcatctcggaagcggaccttgtacaggcaggccgattgcccaatccgcgcttctctatgctttatgcgcgtcatggtggtgagtataagattgagcaggcattcacgttcaatgtcttctcattgattaccatgcctaaagcagtagaaattgaaaaaagacgctttgcccaggcacaagcatcaaccgctattgaagtcctgaagctcgcctatcagacacgtaccgcttattttaatgcggtagccgcgactgaattagccagatatagcgcacaagtgaaagagtccgcagaagccagtgctgagttggctaaacgactgcatgaaaccggcaactggaatcgcctggagcagtcacgtgagcaaagcttctatgcggatgccgcactggaatatgcgaatgcgaaaaattctgaagtgagggcatatgagactttggccaggcaattgggtgtgaaagcttcacagatcaacatccgatctcggaattactaa

SEQ ID NO: 9176 - DNA, 1168 bp, Glycine max
  misc_feature (189)..(189): n is a, c, g, or t
  Peptide Sequence Number=SeqID_125954
atcatcacctactcacgattttccgcgtgccagtgcgtgatgtcattggtggtttggcgttaattctgtataagtattcatcggggatcttttcgaatacaacgttgattcggctgataatcatccataaggacagggatatgaaaataacgcattcaggctataaaaccggcgccgccaccttattgncggtgatgctcgcactggcattaacggggtgtgccaagagcactgtccccagccaaaccgttccggcgaataaaggggtcgatgatcttttcgccaaccttggtgaaccaaagacgcctgtgccgggaaaagagaaagaacagtattttgcccagttgctggccgtgattcaaagccatttgaaagatgcagaagcctactcaggcagaagttgtacattgcgcatcaagctggcgccggatggtctgctgatcagcgttcgggctgaacaaggggagccgcaactttgccaggccgcgataaaggcaatcgtcaatgcgcgtttgcctaagccgccaacggccgcggtttacgaagcggtcaacaacggcactcttcacggcatatgttgccaatacctaccgatacatcattgcgctcacgcgctcgcttcgatctttaaaaccgttgctgcgcatcgtgaccacgtaatagcggtagtggtgtttctgcgcgtactcgcgcaccagctcttcggcaaacaggccgctgaaggtgacggtggtgacgaaggtcagccctttcacttcgtaggtgctgatctcttgcggagtgccgatatacggcggcgggaacacggttttgtggaactggcagcccgccagcagcagggtaaacagcagggcggcggagatttgcgcggttccgccgtcatccatacgaatgaggggttaaatatgcttgtgcgccttgctgcggaaaccgatgccgcagccctgatcgccctggacagcgttgctcagaatgcgccgcagcgcgcggcgcaaatccgcgcctggtgcgcgcagggcatctgttttcttgccgaggaacagggcatggtgatgggctatggggtgctgcactatcacttcttcggctgcggctttatcgagatgttgatggtcggcgagcgctatcgccgccggggcgtcgggcaggcgctgattgcggcgttgaa

SEQ ID NO: 9177 - DNA, 1084 bp, Glycine max
  Peptide Sequence Number=SeqID_125955
atgaaaaacaagattaacgatctccgcagcgccatcgccctgctgcagcgccacgaagggcaatatatcgaaaccgatcgtccggtcgatcccaacgcggagctggcgggcgtctatcgccatatcggcgcgggcggcacggtaaaacgtcccacccgtacgggcccggccatgatgtttaacagcgtgaagggctatccgggatcccgcatcctggtgggcatgcacgccagccgcgagcgcgcggcgctgcttctgggctgcgagccctctgagctggcaaaacacgtcggccaggcggtgaaaaaaccggttgcgccggttgtcgttccggcctcgcaggcgccctgccaggaacaggttttctacgcagacgatcctgacttcgacctgcgcaagctgcttccggcaccgacaaacacgccgattgatgccggcccgttcttctgtctggggctggtgttggcaagcgatccggaagacagctcgctgacggatgtcaccattcaccgcctctgcgttcaggagcgcgacgagctttccatgttccttgccgccggtcgccacatcgaagtcttccgcaaaaaggcggaagaggccggaaaaccgctgccggtgacgatcaatatgggtctcgatcccgccatctatatcggcgcgtgctttgaggcgcccaccacgccgtttggctacaacgagctgggcgtcgccggggcgctgcgccagcagccggtcgagctggtacagggcgtggcggtaaaagagaaagccatcgcgcgggcggaaattatcattgaaggcgaactgcttcccggcgtgcgcgtaagagaagatcagcataccaacaccggccacgcgatgccggaattcccgggctactgcggtgaggcgaacccgtctctgccagtgatcaaagtgaaagcggtgaccatgcgccaccaggcaatcctgcaaacgctggtgggccccggagaagaacataccaccctggccggtttgccgacggaggccagcatccgcaatgcggttgaggaggcgattccgggcttcctgcaaaacgtctatgcacataccgcgggtggcg

SEQ ID NO: 9178 - DNA, 546 bp, Glycine max
  Peptide Sequence Number=SeqID_125956
gcagacacagttgtgtccgatggcaagcagagaccaagtttggtcattctgcacccaagatacgcggagataccttacggttatccgcacccctttgctaggcagacacagttgtgtccgatggcaagcagagaccaaagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatccgcacccttttgtcatccagaggcggcgggcccgatgacaagcagagaccaaacagaacgcttgatagcatgcagaggctgacacagtcttctgcaccttttgttcctccggggacaacaaagtcatttacatgtggaaatttcatggtcactcgcgactctcgtcagccgagaggagcgaaattagtgtcatacactgatttttggggacctttgcttgatgacatgcgaccattctttggtccttgtggg

SEQ ID NO: 9179 - DNA, 324 bp, Glycine max
  Peptide Sequence Number=SeqID_125957
atgggtcatttgctgccgtctcttgtgacggacgtgtggggtgctaataccttccccgcgcgtaaatgcaactcccgagcctttcacttaaaagttcgtagatcgcgtcttttccggtttttccgacgttttcctcaaataaacgtgggtggcgactccgcgcgtattccattcatggaacacgcatcccgcgagtcacgcttcgcctcccgccgaaggaagaaaaaagaaggagtagagacgagagtcgtcatcacggaaagggcaggacggacgaaatcagtgtcctatctttgctttcctcttatctccgatgagaggtaa

SEQ ID NO: 9180 - DNA, 261 bp, Glycine max
  Peptide Sequence Number=SeqID_125958
atgaatgatctagcaattaacttcagagggtccaggaagagcctacaggtggtaggtcctccagggtccattctatcagtagagcagttcattgagaaggtatcctggcctggaaccttactttctactgtgggagagggtgagggcccccagtgctcaggtgcaggagtagagatgagacctgagggggctactttttgtgagccaattgtgccagctatacatgagactattgaagcaggtgactcacaattgagatag

SEQ ID NO: 9181 - DNA, 1357 bp, Glycine max
  Peptide Sequence Number=SeqID_125959
gacgaagaggtgaaaaaagtctaccgtgccgcgcctggcgggatttcgacgacaattgctttcagccagagcatgctgtggccgtcgctggatgacgaccgtgaaaacggttgtatccgtgacaaggcacatgcctattcgcaagatggtggcctggccgtgttgtacggcaatatcgcgctggatggctgtattgtgaaaactgccggtgtggatgacagcatcctgaaatttaccggccgtgcacgtgtctacgaaagccaggatgctgccgttgcaagcatcctggcggatgaagtggtggcgggtgatgtggttgtgatccgctatgaaggcccgcgtggcggcccgggcatgcaggaaatgctgtacccgacctcttacctcaaatcaaaaggcctgggcaaagcctgtgccttgctgaccgatggccgtttttccggcggtacgtcgggtttgagtatcggccatgcttcaccggaagcggcagaaggtggtgcgattgggctggtgcaggaaggcgatacgattgaaatcgatattccaaaccgtactatccacctggcgatcagcgatgaggaaatggcccatcgccgcagcaatatggaggccaagggcaaggatgcctggaaaccattgaatcgtgagcgcatggtttcacctgccttgcgtgcttatgccgccatgagcaccagcgctgcaaaaggcgctgtcagggatcatggtcaacccgagatgacgaagcgtatgcagttgcatgcgcatgtgagccagttgcaggatgaaaacgggctgcaatatcttgaaattgataatccgctggcaaccggcaagattgcgctacaaggcgcgcatgtcatgcaatggcaacccaagttcctgtctgatccagtactgtggttatccagcaacgcgcgctatatcaaaggtcgttccattcgtggcggtacccccatctgctggccctggtttggcgcacacccgacggacagcaccttatgcccgcacggctttgcacgcgtaattccgtggcgcgtcatggacattgatgcgacacagacgggtgctacgcgcattatcctggaaatgcagcaaacgccggaagcgcagcgccagttatcttatccctatgaactgacactcacgattaccattgggcgtcgcttgcgtattgatatggcgactaccaatctggccgagcatccgtttgtgattggcgaagccttccacacttacttcaatgtcagtgatatttccaatatccatatcaccggcatgcaggattgtgtctacatggacaagctgttgagatacgaacgcaatgttgagcacaacgccctggcgttgacggcaaaga

SEQ ID NO: 9182 - DNA, 358 bp, Glycine max
  Peptide Sequence Number=SeqID_125960
atgggccttagtaactttcggaagaagtgcttctggaagttactaaggcggattccggaagaagtacttccggaagtacttcttcaggaatgggccttagtaacttccggaagatgtgcttccggaagatatcttccggaagaagcttcttccggaaacattctggatgacgttcttctggaaagagtttctgagtacttccggaatcacgaattcttcttccggaagaaggttctttcggaaaaagagtcttctggaatgattccggaagaaggttctttcggaaatggttttcgcggaagggcattttcgccacttcactgtttgctgggtgccccagcaataatgctgagtgcac

SEQ ID NO: 9183 - DNA, 278 bp, Glycine max
  Peptide Sequence Number=SeqID_125961
ggatcgcgcctgcaagacaccctgtggacccgaagaagtcaacagggtcttggagttgtcaagctctaattacgggtctctgtcagttctacggagtgcttgtcacctctggcaagggcatcaggccccctactaatcgagctttcatcaagaagtactacgtctccaggcaggcgcagggtgaaacaccacagcagcctggggatggctggcagcgggcaacagacgcaccgccatcacctctagagttcacctcagctcatccacaaaaaggttag

SEQ ID NO: 9184 - DNA, 924 bp, Glycine max
  Peptide Sequence Number=SeqID_125962
atgtatagaacacatacgtgcggagaactaaggggaacagatgaaggtaaaaatgtaatattgtcaggttggattgaacgcataagagacctcggtggtgtaaaattcatagttttgagagatagatacggaaaaactcaagttgtcgttaaccctgattcaccagtttatcctattgttaacaatatttctagagaatatgttattcaagttgaaggtattgtcagaaaaagacctgcagaggcaattacacctgaaccaacaggtgaaatagaaatcgttgcatctgagctaaaaatattatcaaaatccgaacttccaccattctatcccggtgatgatgtttcggaagaaatgagattaaagtacagatatttggatatacgaaatccaaaaatgatgaacaaccttattttaagacacaaacttgcctttgcaacaagagaatacctctcaaataataattttcttgaggtagaaactccataccttacaaaaagtaccccggaaggtgcaagagactttttagtaccgtcaaggcttaaaaaaggaaatttctatgctcttcctcaaagtcctcagcttttcaaacaaatactcatgatatctggtatagataggtatttccaaatcgttagatgctttagagacgaagacttaagagctgacagacaacccgagtttacacaaatagacatagaaatgtcttttgtacatatggaagatgtcataaaccttgcggaaaacctcataagatacatttacaaagctataggtatagagcttccagaaaaattcgacagaataacatacgaggaagccatggaaaaatatggctcagataaacctgatagacgttatggaatggaaatggttgatttaaccgaatttttcaaaaactcagattttaagattatcaaagag

SEQ ID NO: 9185 - DNA, 603 bp, Glycine max
  Peptide Sequence Number=SeqID_125963
atgaatcagcacttcatcctccgcctgcgtccagtggcgcagcagctgcgccaccatataaatcaccgacgggccatacaccagcgactctgccgcgatctcgctggcaaagcggctgcgcatccagtgctgcagggcggagagaaaatcctcgtgctgccagcggctgtagcccagcacgccgtgattcagccgctgctgcaacgcgtcaatgatgcagggagcggtggcgaaatccatgtccgagatggtgaagggcagcagatcggccacgccaaagcggtcggcgacaaagtcccactgcgtgcaccagctgccgtggcgatctaccacccgatcaaaattaaacgcctgcatgtttacaccgtcgcgctcatcagatgggccatttcatctttaaccgactgcacctgcgggccaatgactacctgcagattggtctggttcaggtgcaccacgccgatggcgccgttggctttcagcgcggcatcgtcgaccttgctcatgtcggccaccgacaggcgcaggcgcgtcaggcagttatccagcgaggtgatgttgtcaacgccacccagcgccgcgagaatcgctggcgtgttgtag

SEQ ID NO: 9186 - DNA, 156 bp, Glycine max
  Peptide Sequence Number=SeqID_125964
atgccgaggggcttccgtaacgtttccgtgagtaattacgcgaagattctcgaccgttcttcaacattcatcgttcgttcttcgttttcttcagtcttcaacggtgaaactaaggctaaaatcaactcgcctagtcaagctcgtccacaaaaatag

SEQ ID NO: 9187 - DNA, 303 bp, Glycine max
  Peptide Sequence Number=SeqID_125965
atgacccctacttatgatgccctactgtattacaacgggaggtggaacatgtcacaccaaaatgagtttgtcggttacttgttcacaggaaaaaatccaaaaaagtttgacattccttccggatgtatcatcgatgaactgaaggacttgatcaagcacgttgcacctcatgggatttccccttatggtattcatgaatcacaaacgctgaaaactaacgatgacgtgctaaaggtcttagtacagtctaactactggaaacattttgagccaatagaaattttagctatttttagtaaacag

SEQ ID NO: 9188 - DNA, 294 bp, Glycine max
  Peptide Sequence Number=SeqID_125966
atgcgggatgaaccggaagctgggtttacggtgccccaactgcgcgctaacctagaccccacaaagggtgttggtcgattaagacagcaggacggtggtcatggaagtcgaaatccgctaaggagtgtcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggtga

SEQ ID NO: 9189 - DNA, 355 bp, Glycine max
  Peptide Sequence Number=SeqID_125967
atggctgcggagctagggcgacagatggtggagctatccactctcatcacatgtgccgctcacaataagtcgtccgatacgttagcgttgctaatgaattggaggagttgtcatgagcgacacctgtggcgagagtggatagctccaccagaaacaagctacctaatcgaaagcgtcacaacgtacccttcggcgggagggcgacgcggggctcacgggtgcgtcttccaagaaaggaaaatgcacggagtcgccaccaacgtttattcgaggaaaatgtccggaaaaccagaaaagtgtggtctacgaaatttaagtgtgaaaggttcgggagttgtttttatgcacggggaag

SEQ ID NO: 9190 - DNA, 273 bp, Glycine max
  Peptide Sequence Number=SeqID_125968
atgggtatgaaagctaagtacctaagaaaaaaaggcaagtatggggaaggaatgaatgaaaaagtgaaggttattctatggatgaatgctctcctagaacctaagcttttgaatcctagaaaaaccatgaattgttggcagcctaaccccattacaagcctagaaagttcatcggattcatttttatgtgttcatttctgtatgataggagatgaaatgcaaaggttggaacttgtgttggttgtttatgatggaataagcctaaacacttga

SEQ ID NO: 9191 - DNA, 248 bp, Glycine max
  Peptide Sequence Number=SeqID_125969
atggctaccgtagatattactggctcgaacaacaatgacctcaacaaaccttttaggtttgaagggtatcatttcaaacgttggaaacaaaagatgatgttttctatgaaaaaagttgcctatgttttgaacactgatatttcagtgatgcctaaagatgttgagaaggaagtgaaggataaaatgactatggaatcagctctttggaatgaaaatgattacctatgcaataatttcattctgaatgg

SEQ ID NO: 9192 - DNA, 402 bp, Glycine max
  Peptide Sequence Number=SeqID_125970
atgcgaattcctaacgactattcttttgacacactcaagcgtagaatgcacaacacccttcaactaaccaacgatcaattagtggatgaaatctactaccgacaaccattcatagatgcaggtcagcaatatttttttcaatctctacaattgaaaaatgatgatgatgtttacacaatgggttcccctaatggaattcacgaatcacaattgggatcacgaagggaagtcgtggccaaacccgacttccatgcaacaataactgtcgcaacgtgcccttcgcgggcgagcgaaggcaaggctcacgggtgcgctttccaaaggaggaaagatgcgcggagtcgccaccaacgtttatttgtggaaaacgtcgggaaaaccgaaggaaaccggtcaaaatga

SEQ ID NO: 9193 - DNA, 2265 bp, Glycine max
  Peptide Sequence Number=SeqID_125971
atggtgatacgcatgtcgaaggcttacgatgcaggtgaactgatcttggtctcgaagcacatcagaaccctagattccctcctccgcttccacgcgctgacggttacaagcggccactccacgaaccttttcatggcctcaaagctgatatctctatacgattctctgaacaacgatcccagttcatgttccacactcttccactctcttccctccaaagacacattcctctacaactccttcctcaaatccctcttctcccgctccctcttccctcgcgtcctctccctcttctcccacatgcgcgcctccaacctctcccccaaccacttcaccctacccatcgtcgtctccgccgccgcgcacctcacgctcctcccccacggcgcatcactccacgccctcgcttccaaaaccggcctcttccattcttccgcttccttcgtttcactctactcgcgctgtggccgaatggaacttgcacgcaaggtgttcgatgaaattcccaaaagggacgtggttgcttggactgcactcatcatcgggcacgtgcacaacggggagcctgagaagggtttgaggtgtctccgtcacgtgcatggggttgttgaagatgatgagaagcccaatgctaaaacgtgggagggtgggtttctcgcgtgtgggaacctcggtgctgtgagcgaaggctcgtgtttgcatggggtggttgtcaaaaatggggttgcttcttttatacagtcttcggttttggatatgtattccaaatgcggggttccccgagaagcgtatcggtccttttgtgaggtgattcacaaagatcttctgtgctggacgtccgtcatcggggtttatgcgaggattgggatgatgggggagtgtctgaggttgtttagggaaatgcaggaaaatgaaatacgcccagatggggttgttgttggttgtgtgctttcgggctttggtaattccatggatgtgtttcaagggaaagcgtttcatggagtcattataaggagatattatgtggatgatgagaaagttaatgattcgctgttgtttatgtactgcaagtttggaatgttaagtttggcagagaggatttttccgttgtgccaagggagtggagatggctggaattttatggtttttgggtatggtaaagtaggggagaatgtgaaatgtgttgagctcttcagggagatgcagtggttaggtattcattccgaaacaattggcatagcttcggcaattgcctcatgtgcccagttaggagcagttaatttgggtaggtcgattcattgcaatgtgataaagggttttttggatggtaaaaacatttcagtcaccaactcactcgtagagatgtatggaaaatgtggtaagatgacctttgcttggaggatatttaatacatcggagacagatgttgtatcatggaacactttgatttcatctcatgttcacatcaagcagcatgaagaggctgtaaatttatttagtaaaatggttagggaagaccagaagcccaatacagccacacttgtggtagtgctttcagcttgttctcaccttgcatctctagagaaaggagaaagggttcactgctacataaatgaaagtggttttacactcaatttacctctcggcacagcattgattgatatgtatgctaagtgtgggcaactgcaaaaatcaagaatggtatttgactctatgatggagaaggatgtgatttgctggaatgcgatgatttcaggctatggaatgaatggatatgcagaatctgctttggagatattccaacatatggaggaatcaaatgttatgcccaatggaattaccttcctctctcttctctcagcatgtgcccatgcagggcttgttgaagaaggcaaatacatgtttgccagaatgaagagttattctgtgaatcccaatttaaagcactacacttgtatggtagatcttttgggaaggtatggtaatgtacaagaagcagaagccatggtcctatccatgcccatttctccggatggtggtgtttggggagctttgttaggtcattgtaaaactcacaatcaaattgagatgggaataagaattgcgaagtatgctattgacttggaaccagaaaacgacggctactatataatcatggccaatatgtatagcttcattgggaggtgggaagaagcagaaaatgtgagaaggacgatgaaagagaggtgttcaatgggaaagaaagctggttggagtctgctctga

SEQ ID NO: 9194 - DNA, 1092 bp, Glycine max
  Peptide Sequence Number=SeqID_125972
atggcaaccagaagaactccgacgctaacaaaatccgttttcgccgccgtaaccgcttctaggacctctcgctctcgctcccattccgcgcgacgactcttccccgccatccctcgcgcttcggagaattccctttctcggtctcagattatcgaccccaccaatgtcgcctccgccaagttcctctctcgctctttcactcgcaccttccacgccactaatccctccctccgctccgccgcaagctctcaggtctccatattcgtttcgcactatttcgttaattccgattatgccatcgtggcgcagacggacttcacagatatggcatgggaggggattgttggtgctgttgatgcggcgcgagttagtaaacaacaaattgtggagtctgagcacttaatgaaagctcttttggagcaaaaggatggcttggctagaaggatatttaccaaggcaggattggacaacacgtccgttctacaggctactgaagattttatagctaagcaacctaaggttacgggtgacactagtggtcctgtagtgggctcgcattttagctccctcttggacaattctcgaaagtacaagaaagaaatgggggatgagtatgtgtctgtggaacaccttttgctagcatttcattctgataagagatttggacaacagttgtttaagaatcttcagcttagtgagaaagctttgaaggatgctgtacaagctgttcggggaagtcaaagagtgaccgatcaaaatccagaggggaaatatgaagcattggacaagtatggaaatgatctgactgaacttgctaggcgtggcaagcttgatcccgtcataggtcgagatgatgaaattcggcgctgtatccagatattatcaaggagaacaaaaaacaatcctgttattattggtgaacctggtgtggggaaaactgcaattgctgaaggattagctcaacgtatagtgcgtggtgatgttccagagccattgatgaatcgaaagtggtgtcaagtctcaatgcaggctgattatgtaaaagcttctgaaaaaggtctaatcaagctgctaaaccttgtagtgtcatag

SEQ ID NO: 9195 - DNA, 108 bp, Glycine max
  Peptide Sequence Number=SeqID_125973
atgccacctaagggaagcaaaagcccaaaagcaattatggcttgtacatctagcttcatacatcgatttgctgcaaccgtactttacaagaatggttcctatttataa

SEQ ID NO: 9196 - DNA, 717 bp, Glycine max
  Peptide Sequence Number=SeqID_125974
atgcaatcacagggacttgcactgcctcctgagcttgaggttggtcctttagctgcttgtgtcagcgcaaaggagagttgtgttgatcccttagggaaaaatccagactcaagtgattcagacaaatgcgggttgtacatcgaagaaaatcctccccgcctggttgccctaggtagagttttgaaggttggtgttgaggaggttagagatgcagatgctcctattcctgtacctactgaagaggttaagttagtggggcagacacttaacaccttccttgcttggccgacacatctcgtcaagtgtttatcagaacagggagctgtgggaccagcaaaacctgcagataggcaagatcatgaggtcgatgatcccctatatctgatggcattgaccatcccacaactttttctgaagccattgcaggttatgtgggatgctaccatgttcggggtgtttaatgaagacttccccttgtacataaagcatgaagatctgtctgaaatagcacacggtggtcaatgtcttagcatctctattatacagttgtggattctgcatatgactaagacaagtatgcgagcggggaatgtcgatgtgtatggattcctcgagccacagtccatccagagatctgggcaatcgcaatttgaattagaaagttacatgaagaactggatgcagaattcaaaacgggatgtgtacctaggagcctag

SEQ ID NO: 9197 - DNA, 966 bp, Glycine max
  Peptide Sequence Number=SeqID_125975
atgtcaccatatctatcagagagagttttgaagaagttcaggtgcttacaaaatattccttcagagccacccgacatcctgcatatgagaggtgcaatcaggcttctgaggagtgggagcaaaaggtccattgcattgcagtgtaagtatttacaaagcaaagcgaagcaagcattcactgaatgcgctctatctctctctttcgatctgggtactaaccctaacccgcttcgaaccgtggcttcctcaggctcgcagaacctctctcgaagaaaaccttcttcttcttcgtcttcgtcttctcaacaaacacccgggtcgacccggatcgtttaccgagaatctcggatcccatcggaatccgatttcccgatctggcagcagaactggttcatcgcattgctcttcgtcatggctctcggattcttcgccctcgccattttcctcttcctcactctcgactctgacatcgctccttcttccaccgcctccgcctccgcctccgccgcttcctccgaaggcgtcgaggtgcaggttacttacggcacggttctgaagcttatgcacgagaagaccaaatttcggttgcattctcatgacgtgccctacggttctggcagtggacaacaatcggttactggtttcccaaatgtcgacgattccaatagttactggattgtaagacctgagccaggaacttctgctaaacaaggtgaccccattaaaagtggcacaatcattagattgcagcacatgagaacaaggaagtggctgcacagccatttgcatgcatccccgatatcaggcaatcttgaggagaatccgaatctgacaccggggactattggaagaagtggaaagacttggaagcaggatcagaggattcgccttcagcatattgacactggaggctatctacatagtcatgataagaaatacagtcgtattgctgggggtcagcaggag

SEQ ID NO: 9198 - DNA, 108 bp, Glycine max
  Peptide Sequence Number=SeqID_125976
atggcgggagcagataaagaattggaagaacaacttctcgaagccggtaacaagcttgtagatcctccttcgtcagtggaggagctcctcgcactcctagaatggtag

SEQ ID NO: 9199 - DNA, 1072 bp, Glycine max
  Peptide Sequence Number=SeqID_125977
atgcaagtagagagttgcctgtcaagggttgaacagtccccgactgactctatgcaaaatgcactctctccatcattgaaagcattgattgcagaaaaacttttaaggcactcagatgatgatgtcaaaattgcagttgcatcttgcatcagtgaaataactagaatcactgcacctgaagctccttatgatgatgatcaaatgaaggaggtatttcaattaatagtatcatcatttgaaaatctacatgataagttaagccaaacatatccaaagaggatctcaattcttgaaactgttgcgaaagtgagatcatgtgtggtaatgctggaccttgaatgtgatgtgctgattttggagatgtttcagcatttcttgaaagccataagttgtgccttggtgacttgttggtcatgggttcgaatccggaaacagcctctttgcatatgcaagggtaaggctgcgtacaacatccctcccccataccttcgcatagcgaagagcctctgggcaatgggggaacatcatccagaaaatgttttttcgtccatggaaacaattatgacccttgttctagaggaaagcgaagatatatccttagacctgctgtctccactccttgccagcattaagaaagacaacaaggaagtttttccaatagcccagaaattgggggagagggtccttgaaagctgtgcaaccaagcttaaaccctacttggttcaatcagtgaaatcattgggtatatctgtggatgattatagtgcagtacttgcttcaatatgccaagatacatctgatgacttggagaaaaatgatacatgtgttactagtgagcatgtggaagataagagtgagtcagcaaaacaatcactggaggagtcaacacatgtggttaaaaaagattcaagggaagttacatcctctcagcaagaaaatcccgatgatgtgaataaatctccaaagtcagtcatgagcaatggtgttgcatgtgttggagaagataatgctttagctgattccgagtccattaaaaaaaaagaggatgctgattgttctaatcactctgatg

SEQ ID NO: 9200 - DNA, 1521 bp, Glycine max
  Peptide Sequence Number=SeqID_125978
atgctcgactgtgaaagcaactgcaagatagttcacagttcccctcacgaggaccattctgttgaagctgcaggaccttcagagaatgacaaagagattgatgctaatattatgtcgccaaaggcatgcaatgatgattctgaaattgttgcttctccaccaagtgagagcctctgtgatgaaaatcattccaagaaacttggacaatcaaaaaagaaagatgaccctgtaaaagaagggactgcagaggatgtttcaaaggtgtcagctagtgattcagaagccaagcctaccaggcgctcagtgaaaaaggcacttggtcagaagtctgatgtgaaaaaaactagtgtggtagattcagttaaaaaaggaagtggggctgcaaatgatgcagatgcgaaaaaacactctgccaagaaatctgatgaaaacaaaaagggtagtggtggatcctcttcaaggcagatggagtacaagaaaaagggaggtcgggggaaagctaactctgaagcagatgttgcaaaatcatcggatgtggataaggaaatggtttcttctccgacatctggtacaaaatcaactaaagatggaaagtcagaggagactcccaagacaaatgtgaaaaggaaacgcactccaggaaaagaaaatgactctgatgtgaaggaatatggtgaaaaccttgttggtctacgggtcaaagtttggtggcctaaggatcatgagttttacataggtgttattgattcttttgattctgccaaaaagaagcacaaggtcttgtatgatgatggtgatgaagaaacattaaatctcgtgaaggaaaaatggaaggtcattgaagctgactcagatgcagatgaggaagaacgaagtgatcgtgcagatcttgatgtttccactgatatgtcactgaagaagaaagggaaagcaagtgctggtgaatcaaccaagcaaggaaagatggatgcttcttccaaaagcggtggagcagcagcatccaatggatcaaagggtgcatccacgaagtctagccagaaggccaaagatggcaacaaatccaaaggttccaaggctaatagcaaatctgaggataaagttagtagaaaatctaaggacggcactcctaaaagtggtagcagtaaatctattgttgctgctaaaaaaatgagtaataaattaaaaaatacggatacttccaagacaagtgaatcaaaggatgatgacagcagcaaaccaaaaccctctgccaagtctaagcacgaaaccctaaaaagtggaaaatccaagcaagaaacaccaaaggctgccatttccaaaggaaaacctgttaaaagtggtggaaagactgatgttaatggtactggcaaagtgaaatctggtttattgaagagaaaacattttgagaatgagaactcagatgtttcagcaggagagatagaagattccaagggcaagactgcaagttcatcaaaggcacaaggaagtgagctgaagagtagaaagcgtcggaaaacctag

SEQ ID NO: 9201 - DNA, 2724 bp, Glycine max
  Peptide Sequence Number=SeqID_125979
atggggtctactgataaagaattggaagagcagcttctcgaagccgggatgtatgaaatagacgatcaagttgagagttgcctatcaagggttgagcagtcacctatcgactccatgcaaaatgcactctctccatcattgaaagcattgattgcagacaaacttttaaggcactcagatgatgatgtcaaagttgcagtagcctcttgcatcagtgaaataacaagaatcactgcacctgaagctccttacgatgatgatcaaatgaaggaggtctttcaattaatagtatcttcgtttgaaaatctacatgataagttaagccaatcatatgcaaagaggacctcaattcttgaaactgttgcaaaagtcagatcatgtgtggtaatgctggaccttgaatgtgatgccctgattttggagatgtttcagcatttctttaaagctataagtgaacatcatccagaaaatgtgttttcatccatggaaacaattatgacccttgttctagaagaaagtgaagatatatccttagacctgctgtctccactcctggccagcattaagaaagacaatgaggaagtttttccgatagcccagaaattgggggagagagtccttgatagttgtgcaaccaagcttaaaccctacttggttcaagcagtgaaatccttgggtatctctgtggatgattatagtacagtacttgcttcaatatgccaagaagatacatctaatgacttggagaaaaatgatatatgtgttactagtgagcatgtggaagacaagagtgggtcagcaaaacaatcaccagaggagtcaacacatgtggttaaaaaggattcaagtgaagttacaccctctttaccagaaaatactgatgtgaacatatctccaaagtcggtcatgaggaatggtgttgcatgtattggagaagataatgttttaggtgattccaagtccattaaaaaacaagaggatgctgattgttctaatcactctgaaggtttgaatatatctggtcatgaggtgcataatgatttggacactgaaaaatttgacactagtaaacaaaagccagaacaagctatcaagagacgacgaaagaaatcaagctcttcaactaaatcagctaaaccttccaagagtcatgttgctgctaacgagaaggaaactaagaaattgattgactatgaaagcaacaggaagaaagttcctagttcctctcatgaggaccattctgttgaagaagcaggacctccagagaatgacaaagaagttgatgctaagatttcatcaccaaaggcatgcaatgatgaatctgaagttgttgcttctccaccaagtgatagcttctatgatgaaaatcattcaaagaaacttgggcgaacaaaaaagaaagatagggatgctgagggtgtttcaaaggtgtctggagctgctagtgattcagaagccaaacctgtcaggtggtcagtgaaaaaggcacttggtcagaagtctgatgtgaaaaaaaccaatgtggtggattcagtgacaaaaggaagtggggcaacaaatggtgcagatgctaaaaagcattcagcaaagaaattagatgaaaacaaaaagggtagtggtggaccctcttcaaggcagatggaggagaagaaaaaggttaggcagggcaaagctaactctgaaacagatgtagcaaagtcatctgctctggatgtggacaaggaaatggtttcttccctgcggtctggtacaaagtcaactaaaaatgaaaattctgaggagactcccaagacaaatgtgaaaaggaaacacagttcaggaaaagaaaatgagtctaatgcgaaggaatatggtcaaaaccttgtaggtttacgggtcaaagtttggtggcctgatgatcgtgagttttacaaaggtgttattgattcttttgattctgccaaaaagaagcacaaggtcttgtatgatgatggtgatgaagaaacattaaatcttgtgaaggagaaatggaaggtcattgaagctgatgactcagatgcagatgaggaagaacgaagtgatcgtgcaagtcttgatgcttccactgatatgattcaaatggacatgtcttgtttattgctgtattttgtgattctctttgatgctgtggcttacatggtgtgctttccagctgtttctttatttggtctttatttacattggcatcgttctctgatcctattcaggccaccaaagaagaaagggaaaagaagtgctggtgagtcaaccaagcaaggaaagatggatgcttcttccagaagcagcggagcagcaacatccaatagatcaaagggtgcatccacgaagtctagccagaagtccaaagatggcaacaaatccaaagattccaagactattagcaaacctgagggtgaagttagtagaaaatccaagggtggtagtagtaaatctactgttgctgctaaaaaattcagtaataaatccaaaatcactgatacttcaattgaatcaaaggatgatgacactggcacgccaaaaccccctgccaagtctaagcatgaaactccaaaaagtggaaaatccaagcaagaaaccctgaagactgccctttcaaaagtaaaacatctcaaaagtggtggaaagactgatgttaatggtaagagcaaggtgaaatctggttcatcgaagagaaaatattctgagaatgagaactcagatgtttga

SEQ ID NO: 9202 - DNA, 153 bp, Glycine max
  Peptide Sequence Number=SeqID_125980
atgtcagctagcaggaagctgaacacaggagaaaaaactgtgctttcgtggatgattgaaactggaacaatactacaacatgagaaggtattgtgctctctcttgactcggtgcacatgcaaggaggattatgaagatggagatgaattgtga

SEQ ID NO: 9203 - DNA, 801 bp, Glycine max
  Peptide Sequence Number=SeqID_125981
atggatgaatttatggctgaattggagaggcgtaacttccataagcgcctcaccagtttagctgacaatagcactgacctagcattggtgatggagttctatgccaacctttacagtcctgaggggccttcaccaaaacaagtcagaatacggggccacttgataaggattgatgcagacaacctcaatgtcttttcagaaacacctgtggtgcttgctgagggtgaatctttacccgcttactcaagatactgcaggatgcctactgacattaaggaaattgaggttgctttgtgcatactcggccgagggtttattttaaatgctgaaggtcaccctgggaagatcctcagaaaatatctaaccactcttgctcaggtctggagtgttctcgcatactccaacctggctctgacttcccacacctcggatttgactgtggatagagctaggttaatttttggcctagttactgagcagatcacatcaatggcccagtctaactcctctaaactcgggttccctgctcttatcacaactttatgtaggtccagaggagtcgcttccgacagcttggtctttgaacgtttgagcccgatcattaatttggcctacataaggaaaaactattggaacccggatgatccaacaattattattaggggggctagaagaccaagggcaaggccagctgaggctccttctacattagcagctcctcatccagcttctacatcaggagctcctcctccagctcgtatgacaatagctccttctatcctacctccagcagatttttaa

SEQ ID NO: 9204 - DNA, 188 bp, Glycine max
  Peptide Sequence Number=SeqID_125982
cccaggagcctgtgattgaggagccaccagcaccatcaccatcacgagcagcagcaaaggagaagactactccagctcagaccccacagccatctccaccatctgcacctactcctgaggagactcagctatcaggggatgattggatgattgttttgatcaagttttccgtcattagaagaaaatga

SEQ ID NO: 9205 - DNA, 138 bp, Glycine max
  Peptide Sequence Number=SeqID_125983
atggaagccttggctgaaacgtgtgaggctgatacctctgttttcaatatgcctatactgctggcagtagcccttattggagccacagttggaggtaaggtagtgagagattccctgtacagttattcttgcttgtga

SEQ ID NO: 9206 - DNA, 516 bp, Glycine max
  Peptide Sequence Number=SeqID_125984
atggacaatatagaagtgcccactttttaccaccaacaatggacaccagaataccctgagtttgtcaactttagatatgatggaacaatataccaaatcaagctaaggcagcatcgggaaaaagtctactttgcggaagggctgaaagaattcagaaaagatttatcaatttacgaatctgtgatcattaaattcttggcatgcaacagcaaatccatgtttgatctttatttcgttccctcactggaatgccagacttgcggaaggccagaagttatgtcaagacaacatatttggacacttgaaatcacacaatcaattcttggtgcaccaggaccactgtggaatgttgtggtggttgatggtggagttgggcgcagatatgttgtccaaccatggtatcaattccttgcagataatgatttctcccatggtgatgaagtctccttctattacaggaccattgataaaatatgggaaattgtcatccgccggagaaagaattgggagtattag

SEQ ID NO: 9207 - DNA, 510 bp, Glycine max
  Peptide Sequence Number=SeqID_125985
atgagtatccgcatcgttcctaaagagcagttaggggcacagcgtgagaagtcctcaacggcggagaacatcccgccgttacttttcgccaacctgaaaagcctgcgcagcagcatgcgcatgcacgataatccgctgcagctcgatctgagcgaagcgctggcgcagggtgccgccagcggcaaaccgccgctcgatctgagcgtgttcccgcgcagcgagcactggcgcaagctgctggcgtcgctgatcaccgagctgcgcccgcaggcaccggagcatatcctggcggtgctggacaacctggagaaagcctcggcgcatgagctggagctgatggccgacgccttgctcaaccgcgagttcggcaaggtaggcagtgagaaggcaccgttcctctgggccgcgctgtcgctctattgggcgcagatggccagcctgatccccggcaaggcgcgcgccgaatacggcgagcagcgccagttctgcccggtgtgcggcagcatcccg

SEQ ID NO: 9208 - DNA, 594 bp, Glycine max
  Peptide Sequence Number=SeqID_125986
tttcgtgacattagagggctgcatgtccttgccatcagaggactacacgtccacaccttcaaagggccacacgtcctcaccttcagaggactgcacgtcctcgcctttagaggactacacgtcctcgcctttagaggactatgcatcctcacctttagagggctgcatgctctctcctttagaggactacacgccctcgccttcgccttcgtagggctacacgccctcaccttcagaggactgcacgtcctcacctacagagggctacacgtcctcaccttcagaaggctacatgccttcgcctttagagaactatacgtcctcaccttcagaggactacgcgtcctcaccttcaaagggctacacgccctcgccttcagaggactacacatcctcgccatcagaggactacacttccttgccaacagagggctacatgtcctcaccttcagaggactatacgtcatcgccttcagaggactacacgtcctcaccttcagagggctacatggcctcgcctttagaggactacacgtcctcgccataagaggactacacatcctcgccaacagagggctacatctcaccttctga

SEQ ID NO: 9209 - DNA, 315 bp, Glycine max
  Peptide Sequence Number=SeqID_125987
atggccaacaaaaacatatcatccaatgaaacatacccccccacacttattcccaaaacaattccaaagctcctaaattccttaagggtaggaaaggggaacataggctcaaaggggctatcaaaggaattaattcaaggtaggctcatttggctagaggcttataagaacaaaatgcctaaatcatctcccaacatgcatgtgaagcaaaaagtatcaacaagagtcaagccaaggctattgtgcaagcaaccaatgggacaaaacacaccgaataaaatagatgatgatggctcaaattctcaccaagggtaa

SEQ ID NO: 9210 - DNA, 189 bp, Glycine max
  Peptide Sequence Number=SeqID_125988
atgtcgatctcccccagtggaagtatcacttggtctgtgtcgttccgacatagggatcgtgcccgcaacacacccagtggacccgaagaagtccaacagggccctggggtttccagctctggttacgggcctctatcagtcctacagggtgcccgtcccccccagcaagttcatgccatcatgacatag

SEQ ID NO: 9211 - DNA, 261 bp, Glycine max
  Peptide Sequence Number=SeqID_125989
atgcatattttgttatcttatgacaggagcaggatcgtcttaggcgatggtcaacgggcttgtcggccgcgattgacgaagggcgcagaagacgacatagcaaaaaagaatgtttatacggataaccactcaggtatctccgcccatcagcgtgactcaaatgtcagtatgacagatcttgtgagcgcggtagatgacgtaaatctccgcgtgtcaacgggcttgtcgaccgctgatcgaggccgtacccgaatcaaataa

SEQ ID NO: 9212 - DNA, 168 bp, Glycine max
  Peptide Sequence Number=SeqID_125990
atggcattcaaattaaaaagtatctctgtaaggttgtttccctacaaaaatcacgcactaatgccattgaggcatttcaccgaacacttggcgggcgcgcgtttaggcatcaatagcaagagaacggggacaatgtggcatgtcccattgcttcaaaatgcattatag

SEQ ID NO: 9213 - DNA, 276 bp, Glycine max
  Peptide Sequence Number=SeqID_125991
atgtcgtaccggatgtcacgacatcacgcttcagaacatgcagattatatttgggagtatgaacagattaaacaaggtaccatcaaggtggctcacaaaacactcaagtcccaaaactcacaaaataactcttcaatcccggacttggtacagaactcgtgcagcctccatgtttttatagcagtgtgtgtgtctgggctgcaacagcttgtgctggatgagatctatcattcttctgaaaaatctgcacttaaagatctaaaagatacagtttga

SEQ ID NO: 9214 - DNA, 288 bp, Glycine max
  Peptide Sequence Number=SeqID_125992
atggcttacaacgaggaggacatgtggcaagtgttccaaaaatatggaaaggtatgggaggtgtatattgcgaagagaaggaatagtagtggacaccagtttggatttgttagatttagaggagcacaaaatgaaaaggaactcagaagcctgatggataatattcacattagaaacatcaaactcaatgtgaatattccaaagcacaacaagcaaaagagactggtggagttgggaaagcagaattttcatggggcatataaaaatggagcaaattggagagggtag

SEQ ID NO: 9215 - DNA, 243 bp, Glycine max
  Peptide Sequence Number=SeqID_125993
atgggagcaaaggcaaatttgaattctaaacacaaaaaagggaaacctagtgagaaaggaggcggcaatggcagggtagtagaagatgaagagggggatccaacgtctggacaacatggtgacgtgggcccaccccttccaggggatatattaggtgacaaggacgtagtggtgtctttgggtgtgttgagcccgatacgtgtggagcccaatacaaaatgtgggaaggggtgtagaaactaa

SEQ ID NO: 9216 - DNA, 474 bp, Glycine max
  Peptide Sequence Number=SeqID_125994
atgttggagggagttggagtttcaaagatggggggcttttgtgtcgaagaaaaaggggggggaacttctttgaaggggctttctacaaatggtgcatgggaggaggatccgcaaattgtgaaggaggaggttagaagctatttcaaaaggccgtatagtaaggagcattgggatagaccaaatttcaaacaaatctctcacgagcacaagagtttttttagctcaatcttcaaagaggaggaactaaaggaagtggctttcttgaaatctagctctatgtcggtgctagtaaatgggagccctacaaatgaatttgtcatggaaagaggccttcaacaaggcgatccattggctttgtttcttttcaccattgtggtggagggtcttgttgggttgataagacaagcaaaagatttgaacccttttcaaggttttgaggtagggagaaacaaggtggaggtcaatttgctttaa

SEQ ID NO: 9217 - DNA, 549 bp, Glycine max
  Peptide Sequence Number=SeqID_125995
atgaatacctacactaagtcactcttcaaattcattatattcatattttcccttcaaatccctaatccgcatgaaatccactcttcaatcccaacgcaggattccaagggagtcctcaactttgattttaaggggagccttaatgtcgccctctccttatcctccaccattgccccttctgacccccttatcccgcacgactcctctatggtcgcctacaccatgtctaacaggggccttgctgcccccgccctatccgtgatggaccccgtgggcagcgacaatgttcccggggtgacgcgtgcaggtttctgcattagtacgacaaggaaaggatttcggtgtgtcacttcatcaggctctatggagaatattgggaacaagatggaagtggagactcaaagaggttcccctgctggtagagtttgcaacaagcaggaggaagagaaagcaattatgaggttattggatggaagtagagagtatactcttgtttatgaggataatgaaggagacaggatgcttgttggggatgtgccatggcagtaa

SEQ ID NO: 9218 - DNA, 384 bp, Glycine max
  Peptide Sequence Number=SeqID_125996
atgtcttgtgttccatatgcaagggtgttaggtacttgcatatgcaccagaccaaacctagcacaagcagtcaatgttgtgggtaagtatatgggtaatcctaggaaggaacattggaaagttgtgaaacatatattcaggtaccttaagcgtacaactaatattggactcatctaccatggagacacgtcctgtgctctcgctggttactcagattctgactatgttgcagacttggatgtgagaagatttgtgactaggtacacatttatgagtagagactctcttatcagttggaaggcaacacttaatcccataatggctttatccactatagaggcagagtacatggctttggaaaaagcaacaaaggaaggaatctag

SEQ ID NO: 9219 - DNA, 684 bp, Glycine max
  Peptide Sequence Number=SeqID_125997
atgttgtggaagcttgggaggattgatggggactcggcgttgagagaaacgaggataagggctacgtgggaatacgtgagctcagttgaaggtgggcaacaggggatggtgggtttatatgtgatttgtggatgtggagaattgttttgcaccatcgccctatcgtcacctagtaccacatgtgatggatattcatcaactacagctagggaacaatggcacacacaacatctttcacacaaattcaggttgcaccctatgttaagcatggattctgcttccattgacaatagctcttcatctaacattgttgtttatgatggttatggaggtggtgggggctataatgtgattcctatggggactactactactgttgttgcaagtgatggtgatcaaaatccaagaagcaatcatggttttggtgataatgagataaaggcacttggttatgaaagtgtgtatggttctacaactgatccttatcatgcacatgcaatgaacttgtattatcttactcaacagcaaccatcttctgttgatgcagtgaaggctagtgcatatgatcaaggatctgcatgcaatacttgggttccaactgctattccaactcatgcaccaaggtctagtactagtatggctctctgccatggtgctacgcccttctctttattgcatgaatag

SEQ ID NO: 9220 - DNA, 414 bp, Glycine max
  Peptide Sequence Number=SeqID_125998
atgaatattactgctgaatacgagcatgtacattatgctgggaagaatccttctcgttgtgggtatgtgatgagaattacgcagggtcttccttgtgcatgtgagctatctaaatatgttctaggtagcatcccacttgattcaatccatatgttttggaggagacttagtttttcagaccaagggttatctaagcctcaagcgaccataacggaagagatggaaaccatatccaagcgatttgatgagcttgatgtttgtggcaaagtcaccctaaaaagtaaactccaggaaattgcataccctgatcaaaactctatgtgtcctcctccagaaaaggtcaacactaaaggtgcacaaaagaaaccgatgaacataaaccaaagatcaacaaagcgtgattcgtcttactag

SEQ ID NO: 9221 - DNA, 1274 bp, Glycine max
  Peptide Sequence Number=SeqID_125999
atgcagcgcaagatgctgctggccatggcggccgatctgcgcatcgtgctgatgcgcctggcctcgcgcctgcgcaccctgcgctggcacgccgaaagcaagacgccctgttcgaccgccttcgcccgccaaaccctggacctgtacgcgccgctggccaaccgcctgggcatctggcagatcaagtgggaaatggaagacctggcgttccgcttcctggagcccgaccgctacaagcagatcgcccgcctgctcgaggaaaagcgggtcgagcgcgaagccttcatcgccggcgccatcgaacgcctgcagacggcgctggccaaacatggtatcgaatccgaggtcagcggccggcccaagcacatctacagcatctggaacaagatgcgggtcaagcgcctggatttctcgcagatgtacgacctgcgcgcgctgcgtatcatcgtcgacgacgtgcgcgcctgctacacggcgctgggtttggtgcacgagatgtggacaccgctgtccgacgagttcgacgactacatctcgcggcccaagcccaacggttaccgttcgctgcataccgtggtggccgacgacgacggccggccgttcgaggtgcagatccgcacgcgcgagatgcaccagttcgccgagtacggcatggccgcgcactggcgctacaaggaagccggcgccaagggcgggcaggtggcggcctccagcgagtacgaccggcaactggcctggatgcgccaactgctggcctggaacacggacgtcgaggcgggcgatggcgccgcggccgacaagtccgatgcggccaagcccgccgccgccaagtccggcccgggcaagagccgccacgccgccgtcacgccggctcccacggacgagcgcatctacgtgctgacgccgcaggcgcgggtgatcgagctgccggccggcgccacgccggtcgacttcgcctatcacctgcataccgacctgggccaccgctgccgcggcgcgcgggtcgacggccagatggtgccgctgcagacacgcctggccaccggccagacggtcgagatcatctcggccaagtccggcggcccgtcgcgcgactggctcaatccacagctcgggttcctggccagcccgcgcgcccgcgccaaggtgcgcatgtggttcaacgccatcgaactgcagcagcgcatcacgcaaggccaggcgctggtcgaaaaggaactgcaacggctgggcaagaccgcggtcaatctcgaacaactggcgcagaacctcgg

SEQ ID NO: 9222 - DNA, 269 bp, Glycine max
  Peptide Sequence Number=SeqID_126000
caactaatgatgcccaagatgatgactttttaaatagtaatgatcgtgttgatttgaaaattgcacctgcttcagatactggagtctctattggaagccatttgaaaggtgctggtgtcaattattgtgaccggtcattgaccctatcgcttcaatatttcattgaatgctctatggaagatatgatgcttctaatgattgatggctacagtctggaaagtgagcctttaccaagttcagacttaattgagacatccaggagaaggtaa

SEQ ID NO: 9223 - DNA, 324 bp, Glycine max
  Peptide Sequence Number=SeqID_126001
atggataagccaaagcgtttgtctcctagggagaaaacgcgtggagtcgccaccaacgtttatatgaggaaaacgttagaaaaaccaaaaagaggtatgcgaatattgagaaaaagggttcgggagttgtttatgcatggggaaggtattagcaccccacgcgcccatcacaagggtcggcagcctttaatcgaaagcaagcttcatgatgaatcaagattgattcaaagaagttttgatgataacaaaagtgatgacaaaaagctcaaaggtcaagaacacctcatgataacaaagataatgatctcaagaatcatagaatga

SEQ ID NO: 9224 - DNA, 144 bp, Glycine max
  Peptide Sequence Number=SeqID_126002
atggggttgtgggatgatgagagagtgcttttctttcaaaagatgaaaatgtttatagagttttcggtcgaagccttggaagtggatttcgaaatttcgggaatgattataaggttttggtgtctcctgggtaaggataaatga

SEQ ID NO: 9225 - DNA, 1191 bp, Glycine max
  Peptide Sequence Number=SeqID_126003
atgttaaaggcagtgtcatttgaactgttgttaatatgcttgctacttcttcgcacatgtgtgtgtgcaacaacagataatggctttcccagatgtaactgtgatgatgagtccagcttgtggactattgagaccattttggagtgccagagaattggtgattttctgattgctgtggcctacttctccatccccattgagctactttactttgttagttgctcaaacttccctttcaaatgggtcctctttcagttcattgctttcattgtactttgtggaatgacacatttgttgaatgggtggacttatggtccccacacttttcaactcatggtggcactcactgtcttcaaaatcctcactgccttggtgtcatgtgcaactaccattaccctcctcaccttgatccctatgctgttgaaagtgaaggttagagaattgatgctaaagaaaaagacttgggatcttgggagggaggttggaatcataatgaaacagaaggaggctgcaatgcatgtgaggatgctcactcaggagattcgcaagtcgttggataggcataagattctctacaccaccttggttgagctgtctaagacacttggtttgcagaattgtgcagtgtggatgccaaatgttgagaaaaccgagatgaaccttacgcatgaattgaatgggaggaatgttaactgttctatacccattactaatccggatgttgtgagaattaagggaagtgacgaagtgaacataattgattctgattcaatacttgccactgctagcagtggagtttatggtggggcaggaccagttgctgccatccgcatgccgatgcttcaggtttgcaatttcaaagggggaacgccagagctaaggcagacgtgttatgccatattggttttgactcttcctagtgcggagcctagatcatggggcgctcaagagctggagatcattaaggtggttgctgatcaggtggctgtggctctgtctcatgcctcgattctcgaagagtctcagctcatgagggaaaagttggaggagcaaaatcgagctttgcaaatggaaaagatgaatacaatgatggcgagccaggcgagagcttcgtttcagaaggtcacgagtaatggaatgagaaggccaatgcactcaattttggggttgctttcgatgatgtatgggtaa

SEQ ID NO: 9226 - DNA, 909 bp, Glycine max
  Peptide Sequence Number=SeqID_126004
atgctttgtcaagatttttctaagttgatgcagaaagaatttgaaatgagcatgatggaagagcagaaattatttcttggattacaaataaaacaaacacccaaaggcatctacattcatcagaccaagtatgtgaaagaattactgaagaatttcaatatgggtgatgcaaaagaaatgaagacttcaatgcatcccaccacataccttggactagacaaggaatcaacaaaggtgggcaagacttggtacagagcaatgattgattcacttctctatctcattgtgtataggcctaatatcaagtttggtgtttatctatgtgcaagatttcaaaaagaacccagggaatttcacataactacagtcaaatgtggcaacttaataacatggatatacaaaaagcaaggctcaactgcgttatccactgtcgaagccaaatatatgttagcatcaaaagtcccactacaaaaccttaatacatcgaaactcttggcattactcactactctgaaacacttcaacttcctctctaaaattcaaacccctcttaaactctctgcaatggccacctctatctcctctactaccaagattatcccaaccatggaaatcaccaccatccatattgacaatgaaccatccattcatataaagcactttttcgacattcaggaacttgaaaaggtaagtctaaagctcaatgagactctgcttttttgtggtgccaaacatttttttaatgagccacaaacaatataccttgaactcatcagaactttatggaggcatgttaagtttgtcaataggaagatgatagcatccaaggttttgggagtcaaggttgtattgtccagtgacactatagccaaggcaactgggtgtttatgtgaaggcaacatctattag

SEQ ID NO: 9227 - DNA, 588 bp, Glycine max
  Peptide Sequence Number=SeqID_126005
atgaagcatgactatgagaacactccatctaaggcctttaaggctctgccaacagatgccatagttcatcttcctcctttacaatggactcatctagtgcatctatggaatccaatcaccaaactcttactagtgcatccagttgatcttaatctctctcaagaagaccgttcctcccttggtaaactacatgaacaaatgcacttgaaagatcaagccattgcctaccctcttggtttgcacatcttaagggccactgatataaagatggttgctgataaaatgagtcaacgcctaccaatttgggatgctgcaaaaaagaaagggtttaagctttactacaataaagagatgccctcaataaaaatgaaggctgaagaagaagaagaagctagtgttgctgctatgaaagaagatgttgcctcaatccaagctaaagcatctactaaagttgtggatgacaccattgtatgtggggtcatcattgatcttaccaacactggtgtcatggacataactcttgaggcatctaatgtagccatagctgatgaagttgaacacgacactttagaatctgcgtccaagtag

SEQ ID NO: 9228 - DNA, 588 bp, Glycine max
  Peptide Sequence Number=SeqID_126006
atggtgatcctgaattggagagttcagttccttcagggcagcttgcggttgatgcaagggaacatatggttagtaccaaacgctcaaggttttcctcaagtcatggccctttttcttcggtttcaactgtggcggtctattgccgtatccaactctgaacctggggaaaattctgagacatccaattcaaattctttcttcagaggtctgcaggtcttgttggccgacaatgacgatgtaaatagagcggtgacacagaagttgcttcagaaactaggctgtgttgtgacttctgtttcttcaggatttgaatgccttaacgtcattggacctgctggttcttcctttcaagtcattcttttggatcttcacatgcctgagcttgatgggttcgaagttgcaacgaggattcccaagttcagaagccggaattggcctgtgattgttgccttgactgcaagcacagatgatttgtgggaaagatgcatgcaaattggcatgaatggagtcataagaaagccagttttgttgcatggaatcgctagtgaactcagaagaataatattgcagggaaatagtgtcatgtga

SEQ ID NO: 9229 - DNA, 141 bp, Glycine max
  Peptide Sequence Number=SeqID_126007
atggctccaaaatatgatctttgtggagtgcactttcaattggatgagattgcttacctccagtcaaaccatgtattgccatgtaggccttcaggaatcactttagacatcaaaaaatcttcctacaaaaagttatcatag

SEQ ID NO: 9230 - DNA, 384 bp, Glycine max
  Peptide Sequence Number=SeqID_126008
atggcttggaattttcgtgagtatagtggtgttgttgaggaaccgtggaagtaccatgttgttaacttggaaaaaaccctccaacatgacaacaaccaaattcttttccaagaagagcttctttggtgtcaaaagtccatagagcaatgggttaagcttgggcacaagaactcggctttcttccatgctcaaactatcatgtggagaaggcgtaataaagtccatgggttgggtctttctaattgcacttggtcaactaattcaactatccttcaaaataaggcttttggctttttcaagaggcttttctctgcaggaagtagtgttgctcaggaggagtttcatgttgctcacatacctcagttgggggaggaagctaagtaa

SEQ ID NO: 9231 - DNA, 564 bp, Glycine max
  Peptide Sequence Number=SeqID_126009
atgtccacttgtgaaaagctcattagaacatcaataatttatagttattgttattcatcaaaatccaaggtggatgagatgaatggtggtggtggtggtggtgaagatggaggaggtggtggtataagagctaaggttggtggtggaggctgcaacaatagctccaagcatggacatctaagcctattgaatgttttaaaggaaaatgacaacaagattgaagaattgagtggtgatggcattctgcatggagagcgtgaattgctcattctcttgacgttgtcgttggtcaaaggtttccatggccacccctatcatatcttgcacttgatccctggtaacggtgattctaaagtgtcgtgttcaacttcatcagctatggctacattagatgcctcaagagttatgtccatgacaccagtgttggtaagatcaatgatgaccccacatacaatggtgtcatccacaactttagtagatgctttagcttggattgaggcaacatcttctttcatagcagcaacactagcttcttcttcttcttcagcctttttcttttattga

SEQ ID NO: 9232 - DNA, 324 bp, Glycine max
  Peptide Sequence Number=SeqID_126010
atggggggtttagcctcccattgtcatgagaggctttgcaattgcaaggggttgatggggagagaaaaagataaagagggatggagatggagggaaggaatgactcctaaaggtgaagtcagcttaaatttacgcaacctcgtgttaagcgcaactaccgtgcttagcaaaaaaacgatcaaacacaactcacaagcaatagggaaggctccattagtagcattagcatccgcaggaaatccgcacattgatttccttcacagagagaatgagagaactgcacatccaagggaagatgcaactgatcccgaatactctgaataa

SEQ ID NO: 9233 - DNA, 450 bp, Glycine max
  Peptide Sequence Number=SeqID_126011
atgattagcatacgcaattttgtagaattggaggctaggaggggccttgttggagagttttggagggtatcaaggaagaacgattcactattgcaacaaaaatcaaggtgtaggtggctcaaaggtggatatggcaattccaaatatttccaccctttggtgaatatgaggaggctgaggagtggggtaaaaggggtgatggtggatggacaatgggtggaggactcggggatagtgaaaatttgtatcatggaattctttaaaattaggttcaaggaggaggtgtgccaaagaccaacacttgatggggtgtctttggagagattgaccgaggaggggaatagtgctctttgtgcgagatttagtaaagagaaggtgtgggattgtggtggtgataaaagtccggaccaggcaatttcaacttcaattttatcaagaaacattgggtaa

SEQ ID NO: 9234 - DNA, 375 bp, Glycine max
  Peptide Sequence Number=SeqID_126012
atgcaggctatattatccatttttcaaaatgtcagtgcatcaactgagtcatctgattttgagtctatggtggaaaagaataaaaataaggatagcgggagccatcttattggtgagagtgtagacaacgatcagactgacgaagcggtcaagatcgtagtgggtgatgccggtgtgcatcatttcaacggcacaagatgggaggctgaaggtcatgggccaaataaagtcgcaacgagcccaattcatcagaccgtcaaccttcaacatcacgaactttgccagcttcgacacgttggtaggaaaggaagcacaacaagatggaaagggaaatgtgagaggagagagctgcgcagagagagtgagaaagcatga

SEQ ID NO: 9235 - DNA, 231 bp, Glycine max
  Peptide Sequence Number=SeqID_126013
atgagaaaagtgatcttcaatgggggatccattcaacatcgctggaagataggaagttggggattagaagtatcagttaaagcttcctcagtgacgttcgacaaaataaagcatgggaaagccgatgatcgagcaactgttggagtagtgggtataacaaatgattcaaaaggcacattggaagtttcttcaacaaaagttgattcaaaaatagtgaaggatgaaaagtag

SEQ ID NO: 9236 - DNA, 441 bp, Glycine max
  Peptide Sequence Number=SeqID_126014
atggcttgtaggagtaagagtaggaaaagtgagattagggaaggaggtgtaaatgattcggtggctagtgtgggagatgtgatatttgtcaagcttcgcggtagctcatggttgttgatgaaaatagtgctaataagaatgttaaaccaagaaaatggaccaaacgattgccaggagacatccttgttaggcagtatggaagctatgcatatcctagttaaggattctcttcttcaggaaatcaatgaaacattcaattttaattcaagttgggatatcaagtgtgctaatatactagttgatgtaagtgggcaagtcaagcttgctagttttgagttggaaaaggcaatgaaatttaatgatgttaaatcaagcaaaggctctccatactggatgtcccctaaggtttgtccctgctcttgtatcatttgcttggagtaa

SEQ ID NO: 9237 - DNA, 348 bp, Glycine max
  Peptide Sequence Number=SeqID_126015
atgggaagaagcttggtggaggtaaagaggatatcggggtatgacttagcatggtggaaagaccctgttgttgtttgtggggttgggagggactcatggtttgacaaaaatgttgcttggaagcaaatattagagggtacacatgaattcggagaaaaagagatgtgggtaggggaaatggggtcatgggataatggggtttggtctaaggagctagtatggaagaggccttggtttacatgggaactccctatggtggaatctttcatggctgatcttcataggatctctagggaccatcaagagatggattgtttggtgtggaaaactgcatcaataggtccttga

SEQ ID NO: 9238 - DNA, 393 bp, Glycine max
  Peptide Sequence Number=SeqID_126016
tggcgtctccaatcatctttcttccttctccattctgcttccattgatattaaagaagcaaaagactccattgatgaagaagatccaaggcctacaagctccacatggagctacatcaagagctcccttgaattttgtcttcaagccaacattactttggccaaaggaaattcaaacttgaaggagcatgttttggttcttgaggtcgagatgaaggccttggagacacgtgttcttgatgttgaggcttcgattaagaccaataaggaggaagtggatagtggggagccgactaccccttttggcgaaacccaaatgaccaacctcagaaaggaggatggagacaaggatgatgaggtccatagggaagaagagggaaacagaggcctctaa

SEQ ID NO: 9239 - DNA, 204 bp, Glycine max
  Peptide Sequence Number=SeqID_126017
atgtggtacatcaagaacctttctactggaatacacgtggtcaagagtcacatgcatgtcaacaatggtgatgataatagtgatatcaatgttggaggaggtgatagtggtggtagtgacagcaacaactatggtggtgacagtaacaacaatgattatgataatgatggtgttgcaatgatagcgacagtgttgacaccatga

SEQ ID NO: 9240 - DNA, 342 bp, Glycine max
  Peptide Sequence Number=SeqID_126018
atgggtggatggggcttgatggagaggtggataagtttgcttcattacggtggagagacgagagataagtgtgtggtgaggagtgcgtggataggtggttctaaagattggggatggatggggtctgaagtggatgagattctgagaagggtttgggacttggaaattccactaaagacacaattcatgatgttgaggcttcttcttgatcggctccctacaaaggttaatttgatcaaagaacaactcaaagatcaatcaaagaacaactcaagtgaatcaagaccaattcaagatctcaagaatcaagatcaagattcaagactcaagattcaagaatga

SEQ ID NO: 9241 - DNA, 1011 bp, Glycine max
  Peptide Sequence Number=SeqID_126019
atgtgttcatattatgttaggtcatggatacaagagctaccactctttgttaatttcttcttaagaccaatctgtgaaagggtaagaaaataccgtcccagttcgactcagtctaaagcagggaaaacctccgaactcacccagatcttctcttgggtagacccagcaaccaattcaccttcttccaccctaaacaaacgccaaatggacctttccatcaacgaaagaagccttgttagagaaagacaagaggaagacgaagaagatgaaagagacaacggtgatgaacccaaagagggtgcagttgaggttggaacacgcaggccaagagggagaccccctggttccaaaaacaagcccaaacccccaatctttgtcaccagggacagcccaaactccctcagaagccatgtcatggaggttgctggcggtgccgacgttgcggaaagcgtggcccagttcgcacggaggcgccagcgtggtgtgtgtgtcctcagtgggagcggtgccgtggccaacgttactcttcgccaaccttcagcgccaggagcggtcgtggcacttcatggaaggtttgagattctgtccctaactgggacgtttctacctggtcctgccccaccaggagctacagggctcactgtgtatcttggtggaggacagggtcaggtagtgggagggagcgttgtgggctcccttgtggcagctggaccagtgatggtgattgctgccacttttgctaatgctacctatgagaggttgccgcttgaggaggaggaagatgacggtggtgctagcgcacatggagggagtaccctgggagggtctcctcctggaatgggtaacagtggtggtaatggtgataatagtggtggcggtcacttgtcaagtggtgggattcctgatccttcttctttggctttgtataatctcccaccaaatcttatccctaatggaggccaccatgaggcttttgcttgggctcatggccatggaagaccaccttactga

SEQ ID NO: 9242 - DNA, 384 bp, Glycine max
  Peptide Sequence Number=SeqID_126020
atgggtgtccttctcattttgaatgtggctccatcgcagttgcatccaaatgggtggactgcctttcaagcattacaggcactatgtttgtatacctatgttaaggccacccctgctcgtttcttcattattttgttgtcggtcacacaagaaggcgtggtggggatcatggctcaaggtggtggcaagatggcaacattccgcctcactcatgaaaatcgtgttccttcttatgctgacaacacaatcccagtgccgcttgttaaccaaaccctcgatttgaggaaccctttggaggatatcatcccctttggttccaaggaacccaagggcaaagacaaacacaagaataagaagtggagccaagatcacaagagtggctag

SEQ ID NO: 9243 - DNA, 357 bp, Glycine max
  Peptide Sequence Number=SeqID_126021
atggtttcgacaaaggtttcattgagggagatcgaagggcttggctttgaggttcaagggttcaatgaggaggtgttggagaagaggattcatctactaatgataatggggagtctatcaactttctcagccttcttgaatcaacttctaaagagtgtggctgttaatataggagagattccagatatagggattaccgctgcatacgagatttcgaggcctctttcccaagaagccaaagaggcaaatgtgggttcccatgacccttctgttcaggtggtgttgcaaaagtgccaacacgtgctaatggagaagaagatgtgccccctattacctttttgggctacaaatgggtag

SEQ ID NO: 9244 - DNA, 294 bp, Glycine max
  Peptide Sequence Number=SeqID_126022
atggaggggtggcgttcactaaggaatgcaatggatttccataggtttaggtctttgcctaggggaagtaacccatcttttatcacacttatacctaagaggcttaagagtgtgttgcatgcggttattgatgggagacaaggggtgttcctatggaggagtatgcttgatggggtgatcattgctaatgaggtggtcgaagaagcgaagaagaagaagaagaatgaagaagatgcaatcgcggcgcagaagaatgaagcagcagaaaagggtctgaggaagactgaagaatga

SEQ ID NO: 9245 - DNA, 117 bp, Glycine max
  Peptide Sequence Number=SeqID_126023
atggcctcgattaaatttgatgtcgttgccggggagcagtgtccaaagtgctttgcgatggatttaacgaccacttttgttgaacgggaaaacagggtagtagtgaaaatcccttag

SEQ ID NO: 9246 - DNA, 223 bp, Glycine max
  Peptide Sequence Number=SeqID_126024
atggatgaagatcagtggatgcatgaaggtataatgcctaaagaagttgatatggatgaaaatgaagaagaatgtggtgtgaatgaaccacatgttgattgttcggatgcgttcaatacttctcaggtgtttgacaaccgagatgatgttttgcggttggctcgatccgttacttatgaaaatggatttgtgacggtgattttaaggtctgacacaaaaacag

SEQ ID NO: 9247 - DNA, 574 bp, Glycine max
  Peptide Sequence Number=SeqID_126025
atgttgctaagtagcaatgtcatctatatctgtgtaagagtggtcatgttggtgcgcatgatccgcactcgtctctttgcagcggcacgggtgaaatcttgccccggtatgcatagtagctgtgtgacagcctccctctctggttgtgctcgcacaattggccctcctccaatatcagggggtggcctaggaaccatgtggagcacactgaaaatgaggacacgtagccctctaaaggtgagggcgtgcagccctctgatggtgaggatgtgtagtcctctcaaggcgagggcgtgcagccctctgaacggtgaggataaacagtcctttggtgggagggcgtgtagccctctcaaggcgaggacatgcaatcctctaatggtgagggcgtgtagccctctcaaggcgaggacatgtagtcctctggaggtgagggcgtgcagccctctgatggtgaggacgtgtagtcctctcaaggcgaggacgtgtagtcctctcaacggtgagggacgtgtagtcctctcaaggcgaggacgtgtagtcctctcaacggtgagggtaactagtacccaag

SEQ ID NO: 9248 - DNA, 447 bp, Glycine max
  Peptide Sequence Number=SeqID_126026
atggatttcttttctgatgagagtttcaaatgcattcaagtatttcaaaactcaaatctcatttcctttatgtctttaaaactgccggtgtattctgaattggtaaaagctttttattctaaccttgaaattcaagaaagtaccttgatttttgaggtttatgggataaagatggtcattgaccaatccctcttctatgatttgacccaattgcctagtgaaggtgtaccatttgaaggtacactggatgatgattggaaatttgatttttctgtgcatgatgcccgccggttggtttgcaccaaccaagcggatatgaccggaaggctgcttgccgattcattggctcttgaaagccacatccttcactatcttattgttcgtatcttactctcaagatcttcaaaccttgcacaggtttctgaagaagatcttatagtcatgtga

SEQ ID NO: 9249 - DNA, 225 bp, Glycine max
  Peptide Sequence Number=SeqID_126027
atgactgtggctactttctgcaaagggttacatgtaggacctttcgatgaatctttagtgcaacaaaaatcagaaaccatggccaacattcgatcatgcgcctcttgtcatgtagaagttgtgaaggctacggtgaacaaaacgatcatggagaaaaaggaggaaaacctggctccctcctcaaaatcacaccaaaaagattacttgaagccgcgcattaactag

SEQ ID NO: 9250 - DNA, 472 bp, Glycine max
  Peptide Sequence Number=SeqID_126028
atggggacgaggggttgcatcagttacaatctcgttcttgctataaggcaacatggctaccctatgagaagggcaccactagaggaagagctcgcacctgccatttcacgagggttcatggtacaaaagaaggacaaagagcttagaggcagtaacaatgggcccattggtggctaccgtgagtggttgaaagcccacgtgcaaggtttggattggctcccaagtctgagaaccgctaaaagggaggaggtcgaggcaccggaagaagacgaagaggtgcaggcccttaggacagaactcgagcaagctcaaacagtcaaagaaaggttcaaatcagcagctctgaagatccgaaaggaaaatgccgagctgagagatataaatatggctactgcaagagcccttgaacaagaaaccaagagggctctcaaggaagatcatggccgagacaaattctgtggagctttgtggg

SEQ ID NO: 9251 - DNA, 870 bp, Glycine max
  Peptide Sequence Number=SeqID_126029
atgggtcaacttcaacggcaagccttctgcaaagcctatggtaagatttgggacctagctagggtagaagtctccacagagtccattgcctcccttgcccagtattatgatcatccgttgaggtgcttcacttttggggacttccaactatcacccatggtggaagaattcgaagaaatcctaggatgtcctctagggggaaggaaaccatacctcttctcagggttctacccctcattggccaggatttctaaaaaaggtccaaatctcggcgcaggaattagaccgccaaaggcaagtcgaaaatggggtggtcggaataccgagaaaatatttggagtcctctttccaaatgtggatgggttggtggacctggcagcgatcgacgtttttctcacctatcataaccacaaggaaagtccggttgtcgctatgctagccgacctatatgacaccttcgaccgaagatgtgaagaaagcaatgcaaggattgtttgttgtactccaagaaggaaaggcgaattgggaccaactgggaaggccgacaatccccacaaaaagaaattaagaacatatttggggattgtcgctcgtgataaggtcgacgtgacatacgagaattggaagcaagtccctgttgctcagaaatatttgatatggaaggatattcaggctgaatttgatatccctaaagcatctgactctgatttgacgttaaaatgggcacttgcagctgacaaggatagtgttgatgacactgtatacgaaaaatacggcattaacaaggagaaatgggcccaattttgtcaaagccttagagacccttcatgggaggatgtacggaaaaaggcacaggccatccagaagtag

SEQ ID NO: 9252 - DNA, 756 bp, Glycine max
  Peptide Sequence Number=SeqID_126030
atgaagtccaaattgaccaagttgcctatggaagctgggattggtccagtgagttcattcaagaatatatataattcactaagctttgacaaatttccaatggtgaaaggaatggacccagagagtttatttttaaaaaggtgcatggagtccaaattgaccaagttgcctatggaagctgggattggtctagtgagttcattcaaggatatatataatccactaagctttgacaaatttccaatggtgaaaggaatggacccagagagtttattttcttcaaggaacaaggagtccaaatggaccaagttgcctatggaagctgggattggtccaatgagttcattaaaggatatagataatacactaagctttgataaatttccaatggtgaaaggaatggacccagagagtttatttagatcaaggagcataaagtccaaattgaccaagttgcctatggaagctgggattggtccatccaaattgaccaagttgcttatggaaactgggattggtccagtgagttcattaaaggatatagataatacattaagctttgacaaatttccaatggtgaaaggaatgataccagagagatcattgctggatttccacttcaacaaagcatttgcttctgaagcaatctcagaagaagcagcaaatgcacagaagtacatcacaagaagcagcaaaagtggttggagcttcatggacagaagcgttggaattatgaacaccatgaggaaattttga

SEQ ID NO: 9253 - DNA, 537 bp, Glycine max
  Peptide Sequence Number=SeqID_126031
ggcactcttgttgatgactggaaacttgattattcaagtcatgatgctcgcagaattgtctgcaatgatcaggctgacatgaccgacaaattacttgctgggtcatttactttcaattgttgcatcatgcattatattattgttcgcattttgcttcctcggtcttcaaattttgcccaagcctatgaggaggatttgattttgttgtgcgcccttcaaactggtcgtcagattgactgggcccatctagttcagtaccggatgcataaggcattacgggccaatgcacctctgccttatccccatcttgttactctttttcttcatcatttcaatgttcctttggatgatgaaccatatgtcaaggttaaaaggtcgttttccattggtgccggtgcggacttgccaccgcctattcccgacgaacgtaccccacctcctccaccacaaagggatgattccacttctcttctaaatgaagtactcacagagctctgcaacctccgagcttttgtgggtgagcgcttcgatgccatg

SEQ ID NO: 9254 - DNA, 459 bp, Glycine max
  Peptide Sequence Number=SeqID_126032
atgcgccgctacagggcgcgtcccattcgccattcaggctgcgcaactgtgggaagggcgatcggtgcgggcctcttcgctattacgccagctggcgaaagggggatgtgctgcaaggcgattaagttgggtaacgccaggggcgaattggagctccaccgcggtggcggccgctctagaactagtggatcccccgggctgcaggaattcgatctaagttcttctcggaactcctcggctcgtcctagagctcctcatctcttcttggatctcctcatctcttctcggagctcctccgctagtcctagagctcatcggctcttctataacatgaactacgaatggcttaatcccttcaaacggtacgtaggcagccttgtttacaaggcacaactaccaggacaatccgaactcctcatctcgctcccgagctccttagctcactcccacgctccttag

SEQ ID NO: 9255 - DNA, 537 bp, Glycine max
  Peptide Sequence Number=SeqID_126033
atgccgatggattgctacgaaggcaactgtgaagttcatatctacagcgaagtacaggcagcgtctggatcgactcaagattcttgttggatgccttttagggagcatcgagtcattcgggagtttgatatgatttcatgcttttccggtcagctctgttgggggcccgttgccgtcagacaccgactagagagggtcatgcgccagttcggatacgtccagagtattcctgcaaggcctgttgattcatgggtgtcatttgaagaaatagacgacggaaggatgcactactcagaccatcttgcgccagcaggtgagatatgtcttgtgccaagtcagtgtgcgcccgagtacatggattggttcttcgtcatttctcatccactcacgatcacggcacaaccatcagatctgccgcaagatccacctgcgacgcatgatgcctcatttatagagccatatatccctcaggtcccagagctagtagcaacatcgattcatgcccgttctaatgtggacgagcctagacatgcagtg

SEQ ID NO: 9256 - DNA, 391 bp, Glycine max
  Peptide Sequence Number=SeqID_126034
atacgggaaaactggaaactacaagcaatatccaccgttacagagacacgcctttgtaaaatggtggtcacaattcgatacttcaaaggctgctccagaccaagtcaagaactggttccagagcaatcctgagttccttaaacctgctgatccggagacatctttgtttctaaatcagaagtcgcaactggcagcattcttagcaagctcaaaatctaaagaaagtcttgctcagaatctcaaagaagttctccaactacttcaacaggaagtggaagaagaaccttccaagaaggaagctgaatcatcagagactaatgatgaccaagaagatgatccattctaccagaatgaagatgactgttttggtatatcattggacgacgattaa

SEQ ID NO: 9257 - DNA, 282 bp, Glycine max
  Peptide Sequence Number=SeqID_126035
atggacggagctaggttggtttatggcttagtcatagggatggacatgaacattggcagcttgatctctggacagataaccattatggctcaatccaactcttctcgcctaggcttcccagctttaatcacagccttgtgtaggtcaaggggagttggatcagatgctcttacttcttacaggagcctgagaccggggcaaggaaaacttggtccaaagcagctggtgttccctcttctccagcatcaacaaccccatctgcccaaagctcccagactttag

SEQ ID NO: 9258 - DNA, 141 bp, Glycine max
  Peptide Sequence Number=SeqID_126036
atggttcacaacatgcctttgttgcatggccaagtcaaggatgttgttgaggagattatacatgcaaatgctctcgttcctgtacccaatgaccagcatcctgtgcctccagcaaaacctccatatacgaccgatccttaa

SEQ ID NO: 9259 - DNA, 280 bp, Glycine max
  Peptide Sequence Number=SeqID_126037
gtgggcaacaggggatggtgggtttatgcgcgcattgtggatgtggaaaaacttgttgtgcaccatcgcccgaccgccacctagtaccacatgtgatggagtggtacctggagatatgtcgcgggggtcaggagaccttggggacgtcaggcgagctcctggcagtcaacagataaaaggaaaacaagaccacaaagcaaggaggcttgtggtggctggccggctgcttgaaaacgaggtcaggaagctaaggaagcctctggtaatcgattaccaaggg

SEQ ID NO: 9260 - DNA, 270 bp, Glycine max
  Peptide Sequence Number=SeqID_126038
atggagcatatggatgtgaagacaacatttcttcatgatgatctagaggagcaaacttacatggagcagtcagacaggttcattaaaggtggactgggtcggttggttttctccaaggaaaaggtgctagacaagttcaacatgagcaatgtgaatcttgtgagtactctattggaaaaaaactttaagctttctgtagatcaatgtctgaagacagatgctgagttaaagtacatgtcaaaggttccacatgcaaatgcagttggttga

SEQ ID NO: 9261 - DNA, 194 bp, Glycine max
  Peptide Sequence Number=SeqID_126039
gctttggattgggaggagttgcaagagagggttgcggcaaccatacgcttatgtttggcagcaaggttctctatcacgtgatggagttggcatctccgtgggaggtatggaagaaattggagagtaaatacatgtctaaatcattgacggacaaattgtatctgaagcataaattgtatgggctgaagatgtag

SEQ ID NO: 9262 - DNA, 978 bp, Glycine max
  Peptide Sequence Number=SeqID_126040
atggctcttatcaatgccttcaatcaaattatcaatgatttagcacacctggatgtaaaggctacacttatgtctcactctcaatggagacaaaatgcagcaggaggtgaagatttgtatgtgaaggaaaaaaaggaacatggaaggacacaaggaaagagttttggtggtagaatgcggaagaattccaagtccagagaacacaagaaaacaatggagtgctacaaatgcaaccaaaaagggcatttgaagagggattgcccaaagttgaagaaatttggtgaagggacatctcgctcagcaaatgtggcagagattgacaattcaaactactacactgagggagatgtctactacagtaagggatatgttctcactggttcatgcagtaattttggtagtgtctatatgggtaacaacaaaacgtgtgctattgttggaatgggacaggtgcaaattgctatggatgatgatggagccaatggtttcatttacaaaactgatggagatcggaatacccttagagtgtgcaatgggacattgattgtgatgaaagcacaacagactataagaaatatttacaggctgttggggtgtagagatataagccgagttgcatttgatgagtttgatgatgatgctaccagattgtggcacttgcgtatgggtcatctcagtgagcatgggatgacaaagcttcataagagaggactcttgaaaggagttcagagttgcaagttagacttgtgtgagtattgtggtcctactagagatttgtccttgggtggttctcatgattttgtgaccttcattgatgatctttctcgcaaggttgaggtgaagaacaagacgggcagaaagatctggtacttgaggtctgataatggtgtgaaagggttcaagttttgggatccaatttctaagaatattgtgatgagtagggatgcaatgtttgatgagaagtccatgttgccatag

SEQ ID NO: 9263 - DNA, 1707 bp, Glycine max
  Peptide Sequence Number=SeqID_126041
atggggtatgacttccccatacaatatcgttcaagccttttgaatcgtatcgctgatgctctctctcgggttcctgaggtggacaagggcatggtgttttggttatcagtccctgatttcaccatcatggatgaccttaagcgagaactggcagccaatcaggagttcttgaaccttcgaaaagagttgcaggaacaaccatctcaacatcttgactttgtgtactcatatggtttaatattgcagagtggtcaaatatggcttcccaatgacctaaatttcattccactcttgttacatgaattccattccatacctacgggtggacatatgggcatcaccaagactttagctcaaattcaggctaatttcacgtggcgttcgatatgcgaagatgttttccattttgtgggtagatgtccggattgtcaagccactaaatacgaaacccaaaaatcagctgggctcctggcgccattatcacttccccatagaccgttggaagacttgccactcgacttcattgtgggtttaccaccatatcgagggcacacaatgatattggtggttgtggatcacttttcaaagggtatccattcgggtctcttgcctgcgcaattctcagcttatcaggtggccagtgtcttcctggatatagtagcaaaacaccatggcatgccaaagagcttggtgtctgatcgtgatcctcttttcatttgtaaattttggcaggaactctttaaaatttcagggaccaagttacgcttcagctctgcttatcacccccagttcgatggacaaacggaggtaatgaaccgcatcatcaatcaatatctacgagcatttgttcataacaaaccagctacatggggaaaatttctaccatgggtagagtggtcctacaatacctcgaggaatacaagtactggcaattccccatttgaggtaacctttggcaaggaaccacttacggttcttcagtatattcaaggatcattattagtggatgcggttgacacactgttgacttctcgggaaaccttgtttgctagcctgagaaagaagttgcttaaagcgcaggaatgcatgaagcactttgcggataagcatcgtcgagagcgttattatggatctttcaagattatcaaacgcataggtccggtggcctatagacttctgttgccagcagggtctcgcattcacctggtctttcattgctcactactcaagccatttcttcaagatgttgacaatcaactcgcgccacttccactcccaccaacgaccttggataaccaacctgtgatctcatcgttagctattcttagctcgcgtcaggaaggtccagatgaagacatgtatctccaagttctagtgcagtggaagggtctccacgtagacgacacctcgtgggaggactgggccacattgaagggcacctatcaccttaaggacaaggtgatttttgatgaggttgggaatgatagaccaagcgggtcacaagcagtccataccgagaggcccaaaagaaggatcacaacacctcgaaggttccaggacttcggatctttgggccttcacttcgacgaccttggcaccgtcactagtgaaagcagagaggtggagggagctgtcacaagcccgggagatggagaggtaatgaaacgaagggccaaggctgtggttaagggtaatgtgcggatataa

SEQ ID NO: 9264 - DNA, 855 bp, Glycine max
  Peptide Sequence Number=SeqID_126042
atgccgctaacaacaatttcgtacaaacgcctatcatcggaggaattgtccatgcgtcatgagaagggcctatgttttaactgtgatgagagattcacacgtggccatcattgtgcttccaagctgtttatattcattgctgatgatgatgagcttgaccctgagatacctcttctagaggactctccttccttgccacatgatcaagatgagctaccacatcctcaaattagcctccatgctatttcgggtcacctcgcgcccgaaactgcgtatggagggatatatctcaaccaggaaggttcaagggcaccagttctcggtagagtttcatgtcttacctcttgggggtgtggacttggttctgggagtgcaatggctcaactacggcgtgtagttcaatctaacggtgtcagcgccctttttcacattagactcacagaaactaagctcccttccaaccaaatcacccgaacctctacccagttccctgacatcgacattcttcttcaacaatacgctggtttgtttcaaaacccatccgctctacctccaaccagacagattaatcataccattaacctcctactgaactctgcgctgttatgggtacgtccctacagggcattgaatgcgataacagtaaaggatcgctttccgatacctgccattgatgagttgcttgatgaacttggcaaagcttgctggtttacaaagttagacttacttcaagggtaccgtcagatcttaatgcaggaggaagatgtgtataagatagcttttcacacttatgaagggcattatgagtttcatgttatgccttatggcctctgcaatgctccctcttcattttag

SEQ ID NO: 9265 - DNA, 1815 bp, Glycine max
  Peptide Sequence Number=SeqID_126043
atgtggggtccaccttgctgtgaaattattggtaactttgtggtagaaaattacaacaaaagaacaaacaaattgaagcaccgtggtcctgactggagtgggctccaccaatatggtgataactatttggctcatcaaaggttagccatagttgatccagcgtctggtgatcaacccctcttcaatgaagacaaaactgtagtggttacggtgaatggagagatctacaatcatgaagaactcaggaaacagttgcctaatcacaccttccgtacaggaagtgactgtgatgttattgctcacctgtatgaggagcacggagaaaactttgtggacatgcttgatggtatattttcgtttgttctgctagatactcgtgacaacagttttatagtggcacgagatgcaattggggtcacttccttgtacattggttggggtctagatggctctgtctggatttcatcagaattgaaggggttgaatgatgattgcgaacattttgagtcttttccacctggtcacttgtactctagcaaagagagagcgtttcgcagatggtacaatcctccatggttctctgaggctattccctcagcaccttatgatcctcttgctttgaggcatgcctttgagaaggctgtggtaaaaaggttgatgactgatgttccctttggtgttttgctctctggaggtttggactcttcattggttgcagccgtcacggctcgctacctggcaggcacaaatgctgccaagcaatggggaaccaaattacactctttctgtgtaggccttgagggtgcacctgacctaaaggcagcaaaggaagtagcagactacataggtactgtacatcatgaatttcactacactgttcaggatggcatagatgccattgaggatgtgatctatcacattgaaacatatgatgtgacaacaattagagcaagcattcccatgtttcttatgtctcgtaagatcaagtcattgggagtcaaatgggttatatctggagaaggatctgatgagatctttggagggtatctatatttccacaaggcaccaaacaaagaagaatttcatcaagaaacatgccgcaaggtctttagagttatcatgcttcttgtcaaaacaaaatataaatatggttggattattcaaattaaagcactccacaaatatgattgcttgcgagccaataaatcgacctttgcctggggtctagaagccagagtgccatttttggacaaagattttatcagagttgcaatgaacattgatcctgagtataaaatgtggtttactacatcatctgttcagattaaaaaggaagaagggcgaattgagaaatgggtactgaggagggcctttgatgatgaagaacatccttatctgccaaagcacattttatacaggcagaaagaacaattcagtgatggagttggctatggttggattgatggccttaaagctcatgctgagaaacatgtgactgatagaatgatgctcaatgctgctaacattttccccttcaacacaccaaccaccaaagaagcatactactatagaatgatatttgagaggttcttccctcagaactcagccaggctgagtgttcctggaggaccaagtgttgcatgtagcacagccaaagctgttgagtgggatgctgcttggtctaacaaccttgatccatctggtagagcagcacttggagtgcatgcatcagcttatggaaatcaggtcaaagctgtagaaccagagaagatcataccaaagatggaagtttctccactaggagttgccatatag

SEQ ID NO: 9266 - DNA, 147 bp, Glycine max
  Peptide Sequence Number=SeqID_126044
atggttgtcattttgcctgaggacaatgttgtcatctggttatgttccttgcacaattggcccaataactacttgaaaggaattattaacagggattcagtgacagtcaaggaagtaaatccatggatgttgctagatggatcgtag

SEQ ID NO: 9267 - DNA, 273 bp, Glycine max
  Peptide Sequence Number=SeqID_126045
atgggagaaggtggttttggctcagtatacaggggtaaattggcacatggacaagaaatagctgtgaaaaggttatcaaaaacctcaaagcaaggaatctcagagttaatgaatgaagttggattggtagccaaactccaacatcgtaatcttgtgagtgttttgggagggtgcactcaaggagaagaaagaatgttggtctatgaatacatggcaaatagtagcttggaccacttcatttttggtaataccaccaatgcaaaaacactgtaa

SEQ ID NO: 9268 - DNA, 510 bp, Glycine max
  Peptide Sequence Number=SeqID_126046
atgcttggattggtattgagggataatggcttcatggatgatagtgaagattcatttcaggagctgtcaaattcttctcaccaacgattcaacatcctatgcagtgcggataaagatggaaacatttctttgggtatatttggcatcttccctataaggaaagttaacatgcacaacctcacttttcctacttctcatgatggttcagaaatgagtaacagaatttcaaaggcttctatacacaaggtttctttatcaaaagatctttgtcgtttgatagtcaggtgctctagagaacttgttaacgttggtgatgacttgagtgaaattcaaatggatgggcacaatgagcatggtctacattgcttagcattgaagacaaccatattttggaataggaaaaatgagcttcaccagggtgttaagcatatttcaaaggttctctccggtgcaggaaaaaacttgaatgtattgtcttggaccacctccaggtgcagcaatatttactaa

SEQ ID NO: 9269 - DNA, 297 bp, Glycine max
  Peptide Sequence Number=SeqID_126047
atgacggttcctcaagaaccatcctatgaacgtgaactccctcttcatgatcgtcatcttggtgggcctctccctcaccaccccgggccagccagcctcgagaatcgctccttttgcgacgtaggcatcgatgtagtgaagaagctcctcgtcttcgaagtggtgttgcttagcttcttcctcttctcgtcactggtggcagaggggctgaagctagcattgaatctactcaacaacaaggacgctgacgaagccttccaggcccacatcaacctcagggccctattgctcgacatg

SEQ ID NO: 9270 - DNA, 288 bp, Glycine max
  Peptide Sequence Number=SeqID_126048
atgatggacaatcaagtgacacaagtaatgatagttaccactctgaagaatttgagtctcttcccaacagtgatgatgaagggtgatgtaagctccattggagcttcggaatggaaaaggaagagaaaaaggaaatgccacttcaaggagaagatgagtctagaagaagctcaccaccataggaggccatggattagagcttggaggaagaatgagatgaatgaagggagaggaagagaagagcacgaaattttgtgctctagaagagctctgaaatctgaaatttaa

SEQ ID NO: 9271 - DNA, 423 bp, Glycine max
  Peptide Sequence Number=SeqID_126049
atggtgtttgatcgatgctttatcgaaggaagcatattttttttattgcaaaccaagtgttgcacactagtttctccgcaggatccaatgccaaaaattgttgatttccaccatacagagaataacaacaataactccagcagatattcccccaatacttgtgctggcaaaaataatcaagttattggtgctattgacccagtcaccattgtactattttcttctcctaacttatttcttttagtgtggtttcttgcttcagtggagcaaccgagtcctggggctcaacagtgccataatggaacaatcagcttagagtgctctattgataaacaagttgaaacgaataatggcctgtataagtgcgtctacacgcgaaggaaagtgagaaagtcatgtgaaggatttagcatgccatcatga

SEQ ID NO: 9272 - DNA, 315 bp, Glycine max
  Peptide Sequence Number=SeqID_126050
atgccgatctccccctacaaaagtatcgattggtctgtgccatcccgacatagggatcgcacccataaggcacctagtggacccggagaagtccaacagggctctggggtttccagctctggttacgggcctctgtcattcctacagggtagcgcccacaagacacccagtggacccggagaagtccaacagggccctggggtttccagctctagttacgggcctctgtcattcctgcagggttcccgtccccccaacaagggatcgcgcccgcaagacacccagtggacccgaagaagtccaacagggtcctag

SEQ ID NO: 9273 - DNA, 162 bp, Glycine max
  Peptide Sequence Number=SeqID_126051
atgaaagcttaccttgacaaatacttgcagggcacgacaactaaaggtcaccagtccaaggtcacggtggtgagaaactcaggcacacgtcacgatggtgcactagggttcctctgtggaggtcacggtggtgcacctagtgttcctttgcggggcagctga

SEQ ID NO: 9274 - DNA, 297 bp, Glycine max
  Peptide Sequence Number=SeqID_126052
atgaagaatattccagattcgagagttatctttacgtttgaggaagtcgacaaaagcggagctcttgctcctacgtaccctccatcgaagtggaaatcagacctacgtagttctttaaaaaggggcgaatcaagtgattctcttttacttggaaggtggtcatttaaggcgttggaccttaaaatgatccattttacttggttagaaaagctgaggcgttggacctctaaccatctcatgaggtcgacaaaagcggggcttttgctcctacgtatcctccaacgaagaggaaattag

SEQ ID NO: 9275 - DNA, 402 bp, Glycine max
  Peptide Sequence Number=SeqID_126053
atgcttgcggatcaacctaactccggcaacaatgaactaaaagacatggttacgacgtttacctcgacgatggacgatggtgttgctcttcacgaaaacctcctcaatgcacctcgcaacctcttcacgacaataatggtgactgaagaagaagaagaacctcttcccgacaacctcctcttaatggcaacaatggtgacaaatgaaaacgtcgatgagagcaagaatacgaaaatggctgagaagctatggtggttgatgtatatcagaggcacaaaaatgatgatacgtgatttcttcatcgaaaacatcaaagtgagggaccctgtgaatcttgttcaaatggctaccaaattaacccagtttgcaactgcccgagcactgctactcagacctatttag

SEQ ID NO: 9276 - DNA, 393 bp, Glycine max
  Peptide Sequence Number=SeqID_126054
atggggtgggtgcagagaacgtcgaaatcggaggggagcgcgtggagaaggaggtttttggggaactctttgacgggaagcaggtcgacgaagggtgtgctgcgttttaagcgctggagggggagagtgaggagcacacgctgggtgcagatgatggaggagcataagagaatcacttcggggtgttcctcgcagaggtcgtgggggttggggaagaaggtgacgccgagttgttgggccgtgagggagtggtcggagcgggagtgggccaggacggtgtggccctggcggacgagggtttgggccaggaactgcccgaggttgccgaagcccacgatggcgatctacagcttctgggcgtcgtggaactgttgggccattctggactcgtag

SEQ ID NO: 9277 - DNA, 261 bp, Glycine max
  Peptide Sequence Number=SeqID_126055
atgggtctgtttctaaaagcacatgcaaatcgcagctcgtattggtgcgttccatctcgacgcgacacctggcagtggtgtcgccagcttcaatggcgttttgcagggcttggactcgccagtttgactagcgagttgagggtaggggactgttttgctcagactacgtgcagcaggaagcgttgcaggagggcagcttttttgcagttgaaagcgccagtgctactggcgatttgcgctgcagttgggagtagccagtag

SEQ ID NO: 9278 - DNA, 1656 bp, Glycine max
  Peptide Sequence Number=SeqID_126056
atggagatcgtccataataattattctcctcggaacaggaagcgaaaacgagggttttcaagaaagcttggtgtcaatgaaaaagtggaggtgaggagtgtggatttgggatttctaggatcatggcaccctgcgacagttatccagtgtgagaagctgaagcggcatgtcagatataacaatgttttggatgatggtggggtgaattatcttgaggaggcagtgagtgttttagaagctttggatggtgataaggaatgttacagctactcgcgtggatccattaggccaatgcctcctttggttgagtttgagagaggggaccttaagttcggtctgtgtgttgatgtgaactatgagaaagcttggtgggaaggtgttatattcgatgaccacagtgacggaatggagaagaggagtgtgtttttccccgatttgggtgatgaaatgcaagttggaattcatcagttgcggattactcaggactggcatgaagttactgaggagtgggagcagcgggggaactgggtgtttcttgatttggttgaggagcagaagaggaaatcgtttgttgcagtttcggctaagcagatttggtatgatgtacgcataaaaaatggatttgagaagattcaagagtggacatgtaatatgaagtacttgtggagaaatctggtaatggaggtaattaatgactatttatctcttacgataaatgaagttatctcagtgttgaaccttcaactatttcctccaactatttcatcttctctggttgaagatgaagttgaagatgtacctatgttttgtcctgaggctgttgagcagtattatcgctcatatatatccaacatgagtcgggctgataaaaaacaatggatactgaaggcaaaaaaccatttgttagcagaaggatggatttttgactatccacctccaactaataagaaaaggggaataatatacatttctccactaaaacgaagattctcaacactccatgcagcatgcagattttgtatgggaaaaagtatttttaaattggctaggtctgacatgaaacatttaaatgtctcaggcatgaatgaagaaaatgttgatcaggtttggagcagggatctagtttatagatcagctggaaatcgaaagcggaagcgcttggaaaattcaaaggccaacatacaaaaggtgtctgcctcttcttctcttacaaatcataaacctctaaatgttctgtcttacttgatagacaacagcatcatcttaccaaggtgtaaggtttattataaggtgaaaggcagacaccgtaaagtctgtactttggctgatgggaaaataactcgtgatggaatcaagtgtaactgttgcatgggaatatacagttttgttggctttgaaaatcatgctagtggcaatagtacctgcagaccctctgctagtatctttttggaagatggtagatcactattagattgcctgataaaaatgatgcatgatcataagacaatggaaactagtggaaaatcattcagtggtttgtctctagttgagaatgactacatttgttctgtttgccactatggtggtgaacttattttatgtgataaatgtccgtcttcatttcataagacatgtcttggtttggaggtagattaa

SEQ ID NO: 9279 - DNA, 1278 bp, Glycine max
  Peptide Sequence Number=SeqID_126057
atggggatggaggaggaatgcggagttgggggcggtgatggcgccgggaagaagatatatgagggccttcataaattattaggagagccagtttcagtgggtgtggacaatctaacttggacattggtgaagtttatccaccctgacaggtttgaacatgatagtagtaaaagtgacttattggcagaaagttacagtaagctccatcttgctatttcggtgatgcacgaatgttttgagcccctaaaggaatccttatcaaacagagatcttgtggaagatgttatattcagcagatggtcagagctaaaccgattgaattttcagggtttctatactgtgctacttgagagaaatgaagaactaattagtgtggcaactgttagggtctatgggaagaaggttgctgaaatacctcttgtcggtaccagattacaatatcgtcgacttggaatgtgtcacattttaatagaagagcttgaaaaggtctccttatgtggtgactcgtggtccacaggtgtacccctcaaatctctccaacaattggtattagagccgatgattcgacttggtgactggctcaaacgagtaaaatggcagcgatggatctcagccttggagatcccttgtatcaaaagtcttcctagcggtgaatccaagcaacgtgtcccacatatggagcgacagtgcaagtactgcaggtctccttatgtggtgactcgtggttcacagaagctcaagcaattaggggtggagaggcttgttttgcctgctgttcctagtgtgctagaaacatggacccgctcttttggttttgcaaagatgactaatcttgagagatctcaatttctggactacactttcctagattttcagggtgccatcatgtgtcaaaagctcttgacgaataataatccatctccgaatccagtcttgttaacagagtcacaagcaaaatgtgatgtttcttctggaagttgctgtgctaacctcagtgagtctagtccagtatgtgaattataccaagtagaagagattgacctaggagggatgatgaatcatcaaatggatacttgtgctgggaaaaataatcaagttattggtgctattgacccagtggagcaaccgagtcctggggatcaacagtgccagaatggaacaaccagcttagagtgctctattgataaacaagttgaaacgaataatggcctatataagtgcgtctacacgcgaaggaaagtgagaaagtcatgtgaaggatttagcatgccatcatga

SEQ ID NO: 9280 - DNA, 1692 bp, Glycine max
  Peptide Sequence Number=SeqID_126058
atgttgagtttcaacacagattgtgagaggtttgtcatgcatgatgatgcaccggttcatgaagaagagatttcatctgatttggggcaagcctcttcagatctgatgacttcagggcaggtgttgtgttctaatcttggatccacctcgccagtgatcctacctgctgcaactcaatcagatgaaaccccatctgcccctgctgaacttaatttaagattagatgatgacaatgcagacagaacaggtcttgttgaatctattacttgcaaacctgtttctctctccctaacagatgatgctcaccctgtgggttcttctgctaaaacatcattagacaacttggatgatgatgacccatatattcattctgatgatctgttacaagttcttaatgatttggaattagctcatggagatgaatgcagtgatcattctgaaatcaaaatgtccgaggcagagcctcccaatgaaaatccttctaaaagtttggttaatagagatattggttcaccagtagaggatcctgtttccccatccatggaagaactaaacttgaattcaggtgctacactggctcatgataaacaatctctatttggtttgccaacttctgagaaagagaccttgtatcagaatcctttttttcctgtcatagctttggaaagtgataagctccaacattcttctgggtttgctgttggtgtttcagggcaccctgttgctataccttttcaatttcctatcatggttaatgaatcaaaaggtcaatataattacctattgctggacagcaaccaaattcaaaaccccttgttaacattacccgtggcatctatgggcatgcctcctcaaggtttcattgttgctcctgagggagaagtgatacagaattcaaacccatgcgcaccaataccatctgctgcatatgctgttttaggacacaattccatccctccacaagaaaaatcaactcaacctccatatcagttaatgatggagactactccagatgataaatcacttaaacagagtatgagtaatgtggtatctatggacaggcctccacatggtcatgcagttgcttctgagggagaaatggaactgaactcaaacccaggccctacaattccaccggctgaatgtgctgtttctggacatgattctctctcacctcaagaaaaactgactcaacctccaagtcaattactgatggagcatagttctgatgataaaacacttctgcagtttgtaactaatgtggtgtctatgaacagttccaacagtcacattgtttcttctgagggagaaatggaacaaagttccaacccagaccctccaactccacctgttgaatgtgctgttcctggacctggacatgattttatctcttctcatgaaaacccgactaaacctccaagtcaattgatgtcagagactagttctgaatttaaaacacttctgcagtctataagtaatgtggaaggggaacaaggacttctgcctatctcattcatgtctccaccgaacatggaaagtatggagcctaatcagagtttcctgccctttgagggaggaatggagatgtccttggatacgtctgataatgagccacaccaattcaatcatagttcacaagctttttatcccagaatccagatcattacaagcttatttctttttgttcattga

SEQ ID NO: 9281 - DNA, 198 bp, Glycine max
  Peptide Sequence Number=SeqID_126059
atgcaaatcgcagctcgtattggcgcgttccgtctcgacgcgacacctggcagtggtgtcgccagcttcaatggcgttttgcaggagcttggactcgctagtcaaactggcgagttgagggcgcggagatgtcgccaacttcaatggcgttttggttggcctaaagcgccagcaccagcagtgatttgcgttgcttga

SEQ ID NO: 9282 - DNA, 255 bp, Glycine max
  Peptide Sequence Number=SeqID_126060
atggaaaaatcccatgtcatcgtcgccaacggtggtggctcattgaccgacaatggttttgcgagcgagcagcgatggtggctcgaggggcggttatggtcacgcaacagagcgacattggtggctcaacgggtggcagcgaagggtggttacgaaacgaagaagaagaaaaaggaggaagaagaagaagccaatgagaaaaatgaaggtagttggaatggtgggaagggaaaggaagattttggagttggatgg

SEQ ID NO: 9283 - DNA, 1065 bp, Glycine max
  Peptide Sequence Number=SeqID_126061
atgggtttcaagtatctgctggttgttatgtgtgttttggtttggttcggatcgttgagttttgcaacttctaataatggggggttgatgaggattggtctgaaaaggaggattttagaccttcagagtcttaaagcagcaagaatcaaagagactgttcatcacaaggatttaggaggtgttaatgaaaactgttgtgatgaagatatagtatatcttaagaattatcttgatgcacaatattttggggagattagtattggttcacccccacaatacttcaatgttgtgtttgacaccggcagctcgaatctttgggtcccatcttccaaatgcatcttctctgaataccttgcaaaatcccttatggccaaggatcaatttttggattcttcagccaagataatgtacaagttggggatatcatcatcaaagatcaacttgttacttcccatcctcaaggaatttgctgagattacaagggaaggatctttggcacttgcagcacttccatttgatggcatacttggactcggattccaggatacttcagttggaaaagtcacaccagtgtggtataatatgttagaacgagggctcatatcccacaaaattttctctctttggctaaatcaagatccatcagaagagatggggggtgagattgtctttggtggtattgactacaggcattttagaggagatcacacatatgttccactttctaaaaaaggttattggcagattgatttgggagatattctacttgcaaataattcaacaggcttatgtgagggtggctgtgctgcagttgtggactcagggacatctttaattgctggtccaactagtgttgtgactcaaattaaccatgccattggagcagaaggatatgtcagttttgagtgtaaaagcattgtccataactatggggattcaatatgggaatccttgattactgggttaaatcctgacattatatgcagtgacattggactctgttcaaacattggatttaatataatggagtacacttttctcattttcctaatcttgattctttaa

SEQ ID NO: 9284 - DNA, 351 bp, Glycine max
  Peptide Sequence Number=SeqID_126062
atggctgaaaacaatgctgctttgagagaaggatctttggttatagcctcactgacaacatccactagggcaaggtttttattctctggggctaacatggttggaagtggaaccctataccacaagtccagtgttactgtggggcatgttgcattgtgggagaaagtggccacagcagtacttggggaaatagtggatggtgatgaagagaagaggggtgagtttgagagagtagtggtgcaatgtgagcttgtgattgagccagaaaggaacatgttcagtgcagctgatgttgagcttgccaagggtcttgctgctggtgggagtggatggttgtggttcccttcatag

SEQ ID NO: 9285 - DNA, 321 bp, Glycine max
  Peptide Sequence Number=SeqID_126063
atgatcagcatccttggaacattagggagactcaatgagatgagggatgtgattgagcagatgaaagaggattcatgtgaatgcaaagattctgtttttgtgtctgttatcaagacatatgcgaatgtcgggctggtggatgaagctgataaagtggtgaggatattatggcaatatgaagcagttatatggttggaggacatgataagtcaggggaagcttcctgaaatttctgtctggaattcattggcatctttattttgtaactcagaaaagataaaagtgtcctctgagacatttagtcgcctaagaagtttgtga

SEQ ID NO: 9286 - DNA, 120 bp, Glycine max
  Peptide Sequence Number=SeqID_126064
atgaccaatcatcaaaagagtgcctcaaacaacttaatcagaggggctaacattctagttgatcctaatggtgaaatcaagctgacagactttggaatggctaaacatgttacattctga

SEQ ID NO: 9287 - DNA, 156 bp, Glycine max
  Peptide Sequence Number=SeqID_126065
atggaggacaatgccttggtgctgttgttctccaaatgccggacgggaatgagggaatccatcactctcttattgttttggccgaaaaacccaaagggaaagaagagagaatggagtgcttccaaggtgaaagaagtcaccaccaacccagagtag

SEQ ID NO: 9288 - DNA, 135 bp, Glycine max
  Peptide Sequence Number=SeqID_126066
atgcagtcaaatccagttcttgaagcatttggtaatgcaaaaactgttagaaatgacaattccagagtacttggcctgggactttgtggctggtggcaggaatgtattggcctccatctccataagaagctatag

SEQ ID NO: 9289 - DNA, 144 bp, Glycine max
  Peptide Sequence Number=SeqID_126067
atggtttccaacaattggagacctaatcaaacttctaatcccattatggatataagtgattggagaggtcaaataccaactgattcacgccaaagaattgtcaacaaaatgttgattgattacacctatggaaaacatctttga

SEQ ID NO: 9290 - DNA, 339 bp, Glycine max
  Peptide Sequence Number=SeqID_126068
atgtctagcagtttgtgctggggacatcacaaattcatctgcagaatccttggaagcagcatctttgtacgagcaggcagcagttatttccttgtttattgtgccatgcacaatgtcaacaactttaacataaaagagatgaagaggtgccctcttaggaacaaagaggataggcttacaagcataagtgtccctcacctgagaagtgcttcacaggcaaatgctcttccagtcattggtgagactcttgtagaaagcataatactcctcctttgtgatctcctcaggctctgtcatccaaatggccttatgcttgttcaccaacgagcattcatgtga

SEQ ID NO: 9291 - DNA, 288 bp, Glycine max
  Peptide Sequence Number=SeqID_126069
atggtagtgagcaacttcttctccttattcctccttctccctcacggttcctctcaaactctcgtctcccttgctatttttttcttctatgtgttgtgttgtgggtttagggtgatgtgttgtcttgtggttggttatggtggaaggtgctcctcagtcctcactctaccactcctgtacttcaatctcctctccgatcttgattctgccatagacgaggacaccaaggtttctctctctctcttaaccatccatggcattgctttggataattttatctccttttaa

SEQ ID NO: 9292 - DNA, 627 bp, Glycine max
  Peptide Sequence Number=SeqID_126070
atggtgttaaaatgggtttcgttctctattgaaaccgtgaggcaagttgagcggttccactccaatcgacgggttcctcttgttgtggagtttcaatggagaacaatggcagtttctggtggctactggtggttgtggaaagaaaggagaagaaatggcatttttcctaagctacttggactacaaggctcaaaacgcacaagtgagcaatgttctcggaaacggaaacatagctcacactctagacatcttctcaaagatcccaacggtcagatcatgggcaaatgtcttgtgaagctccagaccaaatttctagaagagctaacgatatatatcagggtgttacagcaaacattaaccaagttcactatttacagcaaacaagccatactaatagtaaaaaacgtgtgcacattccatgaaggtacaaggttaaaggaaaaagttaaaaggggcacacacacctcaacagcacactggggcgcgcgcggcacgggaaccacctttgagattgtgcggttgacttcgacgagatggcacaaccacgatctcactaacggaacacaacagtatcagagaaataaccttaaggttatgagctttgtcttcgaattcaagaacgcgtag

SEQ ID NO: 9293 - DNA, 207 bp, Glycine max
  Peptide Sequence Number=SeqID_126071
atgatcactaaatatgcacaacatggtcgggccaagaaagcattaatggtatttgaggggatgcaaaaacaaaatttggaggtgaatgctataacatttaccggtgtcatttctgcaagcactcatgttggcctagtcgacaaagttcaatactacttcaatgtaatgatcaatgatcatcaaattaagccaacaatgaagcactag

SEQ ID NO: 9294 - DNA, 201 bp, Glycine max
  Peptide Sequence Number=SeqID_126072
atgactgttgcagacagtattaagattgctctccctaagaccgataatgctaaagagtttataggattagtgggagagcgctctcaaacagctgataagtctcttgctgggacattaatgagtacactgatcaccatgaagtttgatggttcacgtactatgcatgaacgtgtcattgagatgacaaacattgcaacatga

SEQ ID NO: 9295 - DNA, 462 bp, Glycine max
  Peptide Sequence Number=SeqID_126073
atgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttcctccgctga

SEQ ID NO: 9296 - DNA, 117 bp, Glycine max
  Peptide Sequence Number=SeqID_126074
atggagcctgcgccaatgagtaagggattcgcaacggatatgctccaaagaagaatacttccctatagcagtttctgctctataagaggaagtagctcacctaagaggaagtactga

SEQ ID NO: 9297 - DNA, 144 bp, Glycine max
  Peptide Sequence Number=SeqID_126075
atggctaatttcctgggacttaataaggtgaatcttggcataaaatggatgaatgagatgaacaaggttgaagatgaaatggtggaaggaaagaatcactctttccggcgagggcaacacacaaaggatgtgaaagacctttga

SEQ ID NO: 9298 - DNA, 300 bp, Glycine max
  Peptide Sequence Number=SeqID_126076
atgaaacttaaccaaaaagtagggaagaaggagacaaacacacaagagttttatactggttcggcaacaacccgtgcctacatccagtccctaaacgacctgcggtccttgagatttattttcaaccttgtaaattcctttacaagcaaagatccacaagggatgtacccttccttgttctctttgaacaacctagtggatgtaccctccactagaactgatccacaagagatgtaccctctacttgtaccacaaaggatgtacctccaatgtgttaagacaaagatctcaggcggttaa

SEQ ID NO: 9299 - DNA, 261 bp, Glycine max
  Peptide Sequence Number=SeqID_126077
atgcatagcataggggtcaggaaccctttgaaacagcccccttccactatttacaggaggaaaaggggagaaggttgccgcccagctcgcccaggcaagcagggttataggaattttacggaagcattacggaagccttggatgccatttttcaacaaaatgggggaggtcgctgccgcccagctcgcccaggccagctcagctcgcccaggcgagctaggttgcttccacctgaagcaaaagaaatccagaatcctctag

SEQ ID NO: 9300 - DNA, 240 bp, Glycine max
  Peptide Sequence Number=SeqID_126078
atggacccgattcacccagccagtttcaatcaagtgaattgtccagtctcagatgtagttcagagcaagcattccttcccaccatatgggttgtctcctaattatacaccacccactgttatatacgcttatggtgagaatatcaacaattctgcacccgtactaattcagaatcaacaaccccaatctaatcatgcacatgtctctcaacccatgggggaaacacatgaagttccctaa

SEQ ID NO: 9301 - DNA, 393 bp, Glycine max
  Peptide Sequence Number=SeqID_126079
atggactgccccctgtgtaagctctgtagcatggagtgcagcatctgtggtgtaaatgaaaaatctgaaagtcctgcagataaaggaactagaagtggtatctgtgtagatgctagaggaatagctggagtcggaatgggaggtactggggttgtggaagaagaaggagctgttgtctttggtgttgctgaagtagtggggacctatgttctcttacccctggccttccttgaccctctaaatgtcactgttggatcatcaagattccaacagttcttcttaatatatgtcaagttaatggtagggctcaagttctccagggatctagaatctgattggacttctctggccttacatagaactgtgatcaaggcagggaatccaagtctggat

SEQ ID NO: 9302 - DNA, 252 bp, Glycine max
  Peptide Sequence Number=SeqID_126080
atggataaagttgatatctttgtccctcatcctctcacaaacgcatgtttgcttattcaactttcaccggaatgtgggtgtaagccattggtctgtttgctcaagcaacctgcgctcctgagtgttgacttccaagaccgttcaatcagagattactcatcttgcacgttggtggggagttgtgagctatcaagaataggatgtcggacatatggcctcagttatcttgagaagaagaggggattgaattaa

SEQ ID NO: 9303 - DNA, 795 bp, Glycine max
  Peptide Sequence Number=SeqID_126081
atgaaggcgctgccaagcagcgagatgaacagcctgtcaccacgcgtcgtttcgaagcgcaacaggccgaagcggggattgccgccgggcgagagacgttcccagaaccacatgccgaccagcaaaaccgcgatggtgccgaaaaaggccgccgtctgccacgtccacgccatccagcgcaaagcctttggcgatgtaattgcgcacgaaccagatcaccagagcgccgggtatcagcgtcaacacgccggcagcggcaagcaggccccagtccatgcccgcggcagaaacggtgcgcgtcatcgtcgcggcgatcggttttgcgtccgtggtggtcagcgtgcgggcgatcagaagctcaacccacgagaacatgaagctgaagaagcaggcgacgccgatgccggaagcaatgagcggcatgaagatcttcacgaagaatttcggaaaggagtagccgtcaatataggcggtctcgtcgatttccttcggcacgccggacatgaaaccttcgagaatccaaaccgccagcggcacgttgaacaggcaatgcgcgagcgccaccgcaatatgcgtgtcgatcagcccgaaagcggaataaagctgaaagaacggcagcgcaaagaccgccggtggcgccatgcggttggtcaaaagccagaagaacaggtgcttgtcgccgagaaaacggtaacgcgaaaaggcataggccgctggcagcgcgacagccaccgagatcaccatgttcatgacgacatagatgatcgaattgatatagccggaataccaggatga

SEQ ID NO: 9304 - DNA, 301 bp, Glycine max
  Peptide Sequence Number=SeqID_126082
atggggaccaccacgggggaggagcttgccacccagctcgcccaagcgagctcagctcgcccaagcgagctcagctcgcccaagcgagctcagctcgcccaggcgagccaggttgcttcctccagaagcaaccgccttctggaggaagaatctggaaggcatactcagagagattgtccatatcccaagaaggagcagagtggtgggtgcctgaatgaccaaactggacatccgaaggccacgggaagagtctttacccttaacggtgccgaggctttgaaatccaaagatctaatccaag

SEQ ID NO: 9305 - DNA, 564 bp, Glycine max
  Peptide Sequence Number=SeqID_126083
atgcctctaatcattgggcttttacccgatagaactcgcccgcgggctccagctatccctgagggaaacttcggagggaaccagctactagacggttcgattagtcttttcgcccctatacccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttga

SEQ ID NO: 9306 - DNA, 310 bp, Glycine max
  Peptide Sequence Number=SeqID_126084
atggatgggcctaaggtacacatatctcaagtgggccaaaacaagatgaggatatcatggatcacagacagcccaactcctgcaaaggttatgtacgctccatctccttcaggtaatacagtctctgccacaggaactacctcttcgtatcgttatctggtctacgagtctggtgaaattcacaacgtcgtaattggtcccctcaaccccaacactgtctactactaccgtttgggtgacccaccttcttcccaaacatacaactttaagactccaccctcccaacttccaatcaaatttgcaatagttg

SEQ ID NO: 9307 - DNA, 201 bp, Glycine max
  Peptide Sequence Number=SeqID_126085
gttccgctggcagggaggttcactagccgaatggtgtttcgctcgaacgaaattagtgtcttatctttacttctcttttatctccaatataagacaagtaaagaggggcaactgtcataccctaatttcgttcagggaccatccgttgttgggatgcgaccgtcgtttgaccatttcgaggtatttggcacccatcgttag

SEQ ID NO: 9308 - DNA, 571 bp, Glycine max
  Peptide Sequence Number=SeqID_126086
atgagtcatcattcatctagtgttaatggtgagggtactagtcataaggaccctttatctagaatcttagatgagttgagttccctcaagttatggaaagaaaaaatagaaagaaaagaaaaaggaaaagagactgtagaaataaatcaagatgagagagaaaaaataagggaagaagaaagaaggaaaatacttaaagagttaagaaaagaaaaacatgccacctatagtagtcatgaatcttgtaagagtctaagtaaagaacttcgtgactattatgaaggaagacataggttacatcttagacctcactcccataggagaaaaaaggaaagaaagcctcaagaggctaacattaacctcccatacttctatgggaaggacaatgtagaggcttacttaaattgggaaataagggtagagcaacaatttaaaagaaagtctactttaaaatcttatggctcttactcttatccaaagaaagaccaaggtctaggcatattaggggcaacaccttctaagcccaaagatgataaggggaagacaatagaaaagcaaccccctaaggcta

SEQ ID NO: 9309 - DNA, 366 bp, Glycine max
  Peptide Sequence Number=SeqID_126087
atggcccagtctaactcctcaagactcgggtttcctacttttatcacagctttatgcatgaccatagaagttgcctccgacaatcttgtctttgaacatctgagtccaatcattaatttggcctacataaggaagaattgttggaaccatgatgatccaacaattattattaggggggccagaagaccaagggaaaggccagctgaggctccttctacatcagcagctcctcatctagcttctacatcagcagctcctcctccagctcgtattgcaacagctctttctaccctacctcctgcaaattttcaacgtttcgaagccatgcttcgaagcatacatcaggggaagattattttgctgtaa

SEQ ID NO: 9310 - DNA, 723 bp, Glycine max
  Peptide Sequence Number=SeqID_126088
atgctccagctgttccgggagcattggccgcgcaaacagaaagccctgtttttcgtccacgccgacctcgtcgaggaagtggttttcgctctcggtctccaccccttcggcgattacccggaaggccaacgcctccgccgccgcgacgatcgcgcgcaccagcgattgcgataccgggttgaaattcaccccgcgcacgaagcttttatccagcttgatggcgtccagaggaatgcgcgccagctgcgccagcgacgaatagccggtgccgaagtcgtcgagatgcacctgcgcgcccagttcgcgcagccgggtgatcaacgcgcgcgcgcggttctcgtcttcaatcaggctactttcggtcaactcgaagtccagcagacagggggccatgcggtgatagcgcagcaccccgagcaggtcgttgacgatgctgtcatcggccagctgacgggcagagaggttgaccgccacccgcagattcaagccctgttcttgccactgcgccgcctgcccggcggcggtctgcagcacccattggccgagcgggccgatcaggccggactcctcggcgtaggaaatgaactgcagcggcgggatcaggccgcgctccggcgaatcccagcgcaccagcgcttccacgctgtgcacttcaccgctgcgcgcgtcgattttcggctggtaatacagcaccagctgattttgctccagccctttgcgcag

SEQ ID NO: 9311 - DNA, 273 bp, Glycine max
  Peptide Sequence Number=SeqID_126089
atggaagagggatatgctactgctttgttgttgcactgggggaggaacgtatggtctacttggaccagcaatattttggaaggaaggagcaggctgctattgttgttgttgagggctagaccatttgagattagggtgattcctccatccgggattgtatctgttgctggagaggtcataattgttctactgtggttgattttgctgctgaggttgaggagattgctacacagaagggcaaaggtctgtatggtggtcgacagaggagcataa

SEQ ID NO: 9312 - DNA, 480 bp, Glycine max
  Peptide Sequence Number=SeqID_126090
atggataagatgctatggagtatagcttggggttggggaattcattggtttgataaaccccctcaattttatagtcaccttctgtgccaggatttcccacgggtttgtcactcccgtagatgccaacgtttttgctccatttacgagacgatggatgtgatcaacatgctgagttgctgtgggcgatggatttatagctcaagacatatgattccaaaacacagcaggcccatagaagcaccaagcagtgactcttcgtgtaggcgccgaccaatccatcataaacccattgccgtattgatgccttccaagacactctctacgcccacactaacaggcagttctaccaagattcctttatcactggcacgtacagttcacttcatatttggaaatgcagttgttgtgttccaaaagtgcaacttggtagctaggaaaaccttgagtaaccaaaacaacatggccacgacacaaggatga

SEQ ID NO: 9313 - DNA, 564 bp, Glycine max
  Peptide Sequence Number=SeqID_126091
atgatgagtgcgtgccgcaagaggagacaatccaacagaaaattcacttcaagttctgacttgtcaacctcttctttccttcacatggagctctctactcagtttcatcaagttttcaagcttatcgacactaatggggatgggaagatatcagctactgagctcagtgaagtgctctcatgccttggatacaacaagtgcactgctgacaaggaagctgaaggcatggtgagagtgttggacttcaatggagatgggtttgtggacttggatgagttgatgattgtcatgaatggcatggaagaagaagaagaagaagagaaatttggaagtggcatggagcatggtggtggttacctcatggatgcttttcttatctttgacactgacaagaatggcctaatttcagccaaggaactgcagagagttctgatcaatctagggtgtgataattgtagtcttagagagtgcaagcgcatgatcaaaggggttgataaaaatggagatgggttcgtggattttgaagaatttcgatccatgatgcaaagtggacttgccaattag

SEQ ID NO: 9314 - DNA, 420 bp, Glycine max
  Peptide Sequence Number=SeqID_126092
atggagctatccaaatctggcacagaagatccaacaaaggtaatgccatttcctatcaaagcagggaagtcagttccatctattagatttcctccactggctgagattagaatctcatctatgaacaacctccacgtctttgcctgtgttgagaactgttgcggtggcattgaaggcccaaggctgtgccgtggccttcttcacgcgagggaattctttcgttcgggtgagaaagtcataggaaatgaaaaccccgatgatgaaagaaagtggctgagcttgagcttcattaattgttggagcaaagaaattaagtttgaagaaaggaaacaagggtgtgtggttgggaagtgtaggaggagtagagttatggagaaggaagtgaggtgcatggaaaatcgaaaaatgggtgaagaataa

SEQ ID NO: 9315 - DNA, 711 bp, Glycine max
  Peptide Sequence Number=SeqID_126093
atgatccagcttattggcacccagtttagagtaaatcctcctacaattcctatgcctaaaaccataaagttggtaactgatggttacaattgcccccaaccaactacccgtaaggattccatgcatgcgtgttgtaaaaaagaccctaaattcaaggctacactgaggaagacaaaattctttccacggcaaaaaggggatcttaccatatcctacgacgtgaatcaagtgtatgagaataattatatggtagaggtgaccatggagaataatcaccttttgggacggctggaccattggaacttgacttgggagtggacaagaggggaatttatatacagtatgaaaggtgctttcacatgtgtgatagaatactcagattgtatctatggtgctgcaggacagtattataaggacatggatttctctaaagtcgttaactgtcaaaagaatccaatagtcagtgacttgcctccggagaaagctaatgacactgaaattggaaagatacctcactgttgcaaaaacggaactattttacctatccatatggatccaagcaaatccaagtctgtcttccaaatgcaagtgttcaaagttccacctgatttaaacaaaacagcaatttaccctccagagaaatggaaaataatgggcattctaaacccggattacaaaagtggggcacctattagagtggatcctgcataa

SEQ ID NO: 9316 - DNA, 681 bp, Glycine max
  Peptide Sequence Number=SeqID_126094
atggccatgaaagtcctgtgtcttagcaagctgtcatgctccatttttatcagtctggtgtcaagatttagagctggattgaaggcagaaattggggtttttttccctatgattgttctgagggtcctagaaaatgtttctcaacctaattttcagcagaagatgacagtgcttcgatttctggataagctttgtgttgattcacagatattggttgacatatttatcaactatgactgtgatgtcaattcatcaaatatatttgagaggatggtcaatggacttcttaaaactgctcaaggtgtccctcctggtgtaatgaccacacttttgccacctcaagaagcaacattaaaacttgaggccatgaaaagcttggttgccgttctaaaatcaatgggagactggatgaacaaacaattgcgcattcctgaccctcattcagccaagaaagttgaagcaacagataatagccctgaaagtggaggttttaccatggtaaatgggaatggggaagaccctgttgatggttctgactcccaatcggaagtctccaatgatgcatctgatgtttcaactattgagcagcgacgggcttataaactggaactccaggaaggtatatcactttttaataggaagcctaagaaaggaattgagtttctgatcaatgccaagaag

SEQ ID NO: 9317 - DNA, 862 bp, Glycine max
  Peptide Sequence Number=SeqID_126095
atgtttgattctcaccctcacttgcttgatatgtcaccaccccacaagactacttgctctgagagtgatttggcaaagccctgcagagatgatgagtacgagaccaaatctatcactgacaccatggacgctccttctggcgacgaccaagatcccaacccgcgacccaaaaagaagggttaccgccgccacacacagcgccaaattgaagaaatggaagccttcttcaagcagtgtcctcacccggatgacaagcaaagaaaagagctgagccgtgagctggggttagagcctttgcaagtcaagttttggttccaaaacaagcgcacccagatgaagactcaacatgaacgaaatgaaaatgctattttgaaggcagagaatgaaaagcttcgcgctgagaacagcaggtacaaggaggccctaaccaatgctacatgccccaactgtggaggcccagctgctcttggcgaaatgtccttcgacgagcaacacttgaggattgagaatgctcggttaagagaagagatcgataggatttcaggaattgctgccaaatatgttggaaagccagtgacttcttcgtactccaacctctcatctctgaataacaaccacgtgcctgtcggtaactatggatcacaatcaggcacggtaggagaaatgtatggaggcagtgacctttttaggccactcccagctcctgctgatgctgacaaacccatgattgtggagcttgctgttgcagctatggaggaactcacaagactagctcaggctggagagcctttgtgggtcccaagcaaccaccattctgagattctaaatgaagatgaatacttgaggactttccctactagag

SEQ ID NO: 9318 - DNA, 1245 bp, Glycine max
  Peptide Sequence Number=SeqID_126096
atgacattgatgggtactggttttcagaatcaatggtcaactgtgttttgcggtattgtctcgagagcattgacccttgaagtcctttcaactggaatagcaggaaactacaacggagccttgcaagtgatgtcatctgagttccaagtcgcttcaccacttgttcctactcgtgagaactatttcgtaaggtactgtaagcagcaaccagatgggatatgggcagtggtggatgtttccttggataatctgcgacccagtacaatctcaagaagccgaagaaggccctctggttgtttaattcaagaattgccaaacggttactccaaggttacatggattgaacatgtggaagtggatgatagagcagtgcatagcatatatagaactctggttaattcgggcctggcctttggagctaaacgctgggtagctacattagaaagacaatgcgaacgtcttgccagttcaatggccaacaacataccagcaggggacctctgtgtgataacgagtgctgagggaaggaaaagtatgatgaagctggcggagagaatggtaatgagctattgcactggtgttggtgcttctaccgcgcatgcttggacaacgctctccgcaactggatgtgatgatgtaagggtaatgacaagaaagagcaccgacgaacctggcagaccccccggtatagtgctcagtgctgccacttctttttggcttcctgttcctccaaagagggtttttcatttcctacgtgatcaaaactcaagaaatgagtgggacattctctccaacgggggtctagttcaagaattggcacatatagcaaatggtcgtgatcccggcaactgtgtctctttacttcgagtcaatagtgcaaattcaagccaaagcaacatgctgatacttcaagagagttgcacagattcaactggctcatatgtagtttatgctcctgtggatattgttgctatgaatgttgtcttgagtggaggggatccagactatgttgccctgctcccctcgggctttgctattctacctgatgggcctcctgcattaaacggtgggcccatacatgatgttgggtctggaggttctctactcacagttgcattccagatcttagttgattcagccccaactgcaaagctatctctgggttcagtcgccactgttaacagtttaattaagtgcacagttgaaaggatcaaagttgcagtcatacgtgacaacaccacctga

SEQ ID NO: 9319 - DNA, 351 bp, Glycine max
  Peptide Sequence Number=SeqID_126097
atgcattttttttataaggctgaggcaaagagcctttttgagattaacatgttagaggatggtgatgttgatttgaatgcttcaccagaagcacttgataagctcctgggatattcacttgcgtttaaagtgaaggcatcttgcaagatccatattccactccctgatttcaatgatccttcctactatgagactgtgactgcaaaatctgatgttccagtttttagctcatatttgttgaatgcaccaataaatccctatctgcaacagcagatcatgatccgcttctcagagccccctttacaccaacgaagtgacagacactttagggatgtgacgatgaagcactaa

SEQ ID NO: 9320 - DNA, 648 bp, Glycine max
  Peptide Sequence Number=SeqID_126098
atggttcatggcccatgcgaaatactacgaaaagaatcttcatgcatgaaagaaggaaagtacagtcgtttctatcctaaaatgtttcaacctcatacttttctagacgtggatggttatccaatctatcacaaaagagacaatggtcaaacaatttccaagaatggggttataattgataacatatatattgtaccttacaatccaaaattgctaagaaaataccaagcatatatcgatattgaatggtgtaaccaaaacacttctatcaaatatttgtttcagtatgtaaacaagggatatgatagagttactgttgttatagttgatgatgaaaatgatgcaagcttgcatgttgcaagccatcatgatgagatcaaagaatatctagattgcatatacatttctccctgtgaagctacttggaggatctttggttttccaattcatggcaggaagcttgctgttgaaagactgcatttccaccttccaggacaacatgctgttttttatcaagaccatgatgatattgacgatgttctatccaagccaagcattttcgattcaaagttcatttcttggatgaacactaataaaaaaaaagacattggaaactcaggaaaaaatgatacactattgggaggctaa

SEQ ID NO: 9321 - DNA, 417 bp, Glycine max
  Peptide Sequence Number=SeqID_126099
atgacaacattgattacaatggtggtggaaatgtcagtgccaatgatgtcgatagtgaaggttgaagatgatagtggtgacaatgcaacaatgacgatgatgatgattgtgaaggcaatagtactagctagtgatggtggtgatggtgataacaatggtggtgacaacaacaagatggtggtggtagtgacaacaagagaaaagactactgtcaaatgtagggaaaatttcaagtgtttagaaggaaaatttatgcaaaaatgtgaagaaaaaactttcaagaaaaagttgaagattgagatagctcgcttaacgtgcaagacaagctcaacagtcaaatgtccttgtaatgtaatttctgaagaacttggaaaggacatctcaacaattcattatcaggatcgagggatagagtga

SEQ ID NO: 9322 - DNA, 336 bp, Glycine max
  Peptide Sequence Number=SeqID_126100
atggtgagggttagtgtgttgaatgatgctctgaagagcatgtacaacgccgagaaacgggggaagcgccaagtcatgattaggccgtcctcgaaggtcataataaaattcctcttggtgatgcagaagcatgggtacattggtgagttcgagtatgttgatgaccacagggctgggaaaatcgtggttgaattgaatggcaggctgaataagtgtggggttataagccctcgctttgatgtcggtgtcaaagagattgaaggttggactgcaagactgcttccctcaagacagtggactgttgtggaagggtctggaataggttttttaatttga

SEQ ID NO: 9323 - DNA, 390 bp, Glycine max
  Peptide Sequence Number=SeqID_126101
atgatttcaagatgggtcaacaagttcaagatcaggataattgcaagtttcatgagaagaaatcaagaaattcaagattcaagggaaattggattccaagattcaagagaagatgaattcaagattcaagagaagaaatcaagaagacttcacaagggaaagggtacatctacttgggttgttgtaattgagaacaagagagggtacatctcttgtggatcagttcaagtggagggtacatccacttggttgttcaaagagaccaaaggagggtacatcccttgtggatctttgcttgtaaaagtttttataaggttgaaaagaaatcccaaggaccgctggtcgcttggggactggatgttggcacgggttgttgccgaaccagtataa

SEQ ID NO: 9324 - DNA, 390 bp, Glycine max
  Peptide Sequence Number=SeqID_126102
atggccacagatccgacgtctcctccgcagtccgatggtcaatcagaggcgacttccaagaggagtagaacaacgacacggctgagaacattgacattaagaaccgtggatcagcccagaccggctgtttatgtggatcccgctaccgggagagcatccggaccgatgcgtgaaaagttccacagctacctaggcgtagtggcgcgagaaaaggttcccattatccacaataattggaaagacgtacctgaaacgctaaaggagattgtgtggaatgacattctagtgtctctacctgcaatagaaacatacaacatattcatgtatacaactctagtgtcttatctaagctcgagtccacaccacatcatggagttgcttgctgattga

SEQ ID NO: 9325 - DNA, 627 bp, Glycine max
  Peptide Sequence Number=SeqID_126103
atggaacgtgagaagcagatgaataatcatctgcttccgcaagaaatcgaagaatttcttgggaatcctgcaagagctactcgttcttttttctctgacagatggtcagaacttcatctgagttcgaatcctactgagaggtctactagagatcagaaattgttgaagaaagaacaaaagaaacatcttgttctttccaggcgatcggaaaataaagaaatagtgaatttattcaagataattatgtacttacaaaataccgtctcaattcatcctatttcatcatatccgggatgtgatatggttccaaagggtgaactggacagttccaataagatttcattcttgaacaaaaatccattttggggtttatttcatctattccatgaccggaacagtgggagatacacgttacaccacgattttgaatcagaagagatatttcaagaaatggcagatctattcactctatcaataaccgagccggatctggtgtatcataagggatttgctttttctattgattcctccggattgggtcaaaaacatttcttgaatgagttattcaactccagggatgaatcgaaaaatcactctttattggttctacctcctctttttttatga

SEQ ID NO: 9326 - DNA, 112 bp, Glycine max
  Peptide Sequence Number=SeqID_126104
atggataacttttccaacttactcgcaaaattacatgttgaggccaaatattgctccatgataaccactatttgtgagctgaagtggttaaagggaattctttccataattg

SEQ ID NO: 9327 - DNA, 1425 bp, Glycine max
  Peptide Sequence Number=SeqID_126105
atggctttattcatggcagttcttggtgttgttgccttggtgctctgtttttgctctgctctcttgaagtggaatgaattgaggtataggaggaaaggtttgcctcaaggcacaatggggtggcctgtttttggggagacaactgagtttcttaagcaaggtccaagcttcatgaagaacaagagggcaaggtatggcagttttttcaaatcccacatcctggggtgtcctaccattgtatccatggatccagagcttaataggtacatactcatgaatgaagcaaaagggcttgttccagggtacccacaatccatgttagatatcttaggcacacgcaatattgcagctgttcatggctccactcacaagtacatgagaggagcacttctttcaatcattagccccaccttgatcagagaccagcttttaccaaaaattgatgagttcatgagaacccacttgagtgattgggataacaaagtcattaacatccaagagaaaactaaagagatggcatttctctcttccctgaagcagatttctggtatggaatccagctcaatatcccaacccttcatgacagagttctttaaacttgttttaggaactctatctttgcctattaaccttcctggcacaaattatcgccgtggattgcaggcaagaaagagtattgtcagcattcttagtcagctgctagaggaaaggaaaacatctcaaaagggccacgtggacatgcttggttgcttgatgaataaagatgaaaatcgatacaaactaactgatgaggaaatcattgatctaattattacaattatgtattctggttatgaaactgtttcaaccacatcaatgatggcagtgaagtacctccatgatcatcccaaagttcttgaagaaatcagagtgagtgcaaaagttctcatgtttcttaagaaagagcattttgccattagggaaaggaaaaatcccgaggatccaattgattgtaatgatctcaagtcaatgaggtttactcgtgcggtgatttttgagacctccagattagctacgatagttaatggggttctaagaaaaacaactcatgacatggaactaaacggctatttgattcctaaagggtggaggatatatgtatatacgagagagatcaattatgatccatttctgtatcatgatccactaacattcaatccatggagatggctgggtaacagtctagagtcacaaagccacttcttgatatttggaggagggaccagacaatgtccagggaaggagttggggatagcagaaatttccactttcttacactactttgtaaccagatacaggtgggaagaaataggaggagataaactgatgaaatttcctagagttgtggcaccaaatggactgcacataagggtctcgtctaactaa

SEQ ID NO: 9328 - DNA, 1812 bp, Glycine max
  Peptide Sequence Number=SeqID_126106
atgcaggtgtgtcgtaatttggagggtgacgatttgaaaggcgaggttgtcgcaaacccagacccaatctctcttgcgaaggaagacgatgggtccgatgctacaaaccattctcactgtgcttcttctccttatgcttcttctcatcgtcatttttcttttctttctcttcaaaccatggcgcttctttttctcttcgcgtttcctctcctccatcaaggtgatgcgtcgtcgtttaatcggagtaatgaattgcctcgagatcatgatctcgagggtgcgtgttatcccagtgaagctcatttccgctctcctcgaacccatggccaagtccttgttcacaagcaaaggcttcaaacccttaacatgccccagccacaggctgctgatactttggttgtcgatgtcatctctgatcattcctcctccgaggatcttgatgttggtcaaacccttaagcttccctcatctcatttagctcaaattcaaaagcatgcccttcccaattttcaaattgatagacttcaggactttgtgcaaagggatatctctgatcaaagaagttgcctcactctggaggttatcagtggcccttctcagggacttcgttattcagtacagtcaacgagcccctctcgtcttccgctgaccttgggaagggtttctccgagtgatttgttgataaaggattcagaagtgtcgggaaagcatgccatgattaagtggaatttggataaaatgaaatgggagttggtggatatgggtagcctcaacggaacactgttgaattctacgccgatcaaccatccagacactggaagtaggaattggggggatccaatgaatcttactaatggagatatcataacacttggaacaacatcaaaagtaatggttcatattacatcacaaactcagcatcacattccctttggagttggtatggcatcagatccgatggctttgcatcgaggaggaaaaaggtttcctatggaagacgtttactattatcaatggcctctacctgggctggatcagtttggaatttttggcatttgtgatgggcattgtggagatggggctgccaaatctgctagcaaactttttcctgagataattgctagtatattatcagattcattaaaaagggagagggttttatcacaccgtgatgcttcagatattcttcgagaggcattttctcaaacagaagcacacatgaacaactattatgagggatgtacagcaacagtgcttctggtgtggactgatggtggtgaaaatttctttgcacaatgtgctaacgttggagattccacctgtattatgagtgtgaatgggaaacaaatcaagatgtcagaagatcacaagtttacgaattattctgaaagactcagaatcgaagagacaggtgaaccattaaaagatggggaaacacgtctatatggtataaatctggcaagaatgcttggggacaaattcctgaaacagcaggattcccggttcagttcagaaccttatattagtcaagttgtgcatattgatcaagcaagcaaggcttttgctattctagctagtgatgggttatggaatgtcatcagcgtgaagaaggcaattcagctcgtgttgcagtttgctttctcaaatgcacagatgagggagagatgctattcagagaggcagaatacagcagaaaagattgctagtttgttgttgaatgaggctaaaacactcagaacaaaggataatacttctgtaattttcttagactttgataccttcaacagattctcttgtaaagttgaatcctag

SEQ ID NO: 9329 - DNA, 626 bp, Glycine max
  Peptide Sequence Number=SeqID_126107
atggctgcaatcgtgtgccagtcgtcaagaatacacagacttatgttggcatccccaaaacctcctcctcaacaacccttcaaatcttgcttatgggaaaacaattacagttacaaacccgacaccacaacagcttggacctccattgaagctctttcaagtactgtgagcaactatgagtatgaggtgtcgctgctgcgactcagccccaagagtttggagctctgcactgagaacctagggaatgagacaggctgtgatgacatcataactgagactggcattgagttgctctcttcttcttcttcttcttcgacaagggagcagaaaagtaggaaagcgcgtgaagcagctcggagttttccaccgcctttgacaacgataagaggatcggagtcgatacgagtgaggccccacagagaaggtgggaggttagtgcttcaactcactaaggtcccatcttgtttccaagctcagaggagccctggacgccttcgcctctgcttttggactgacattcaaacacaagaacatgaagatgaagaagatgatgatgggcgtggatgggaacacaccaaaggctgcaacagttgggtggaaaataactatgagaggcaaatcagcag

SEQ ID NO: 9330 - DNA, 264 bp, Glycine max
  Peptide Sequence Number=SeqID_126108
atggcaaggaactgggacatggccagtaaacagtccctttggcctggcctatcctttgatctaaggctaattttgctcgagctgtatcgactcttagcaaggcacaagctaagaaggttgcacgctttcttccaaatcctgaaaggtactggggtcctaaacttagggcaggacgtcaaattaatagcaagcgtgtctctgtattgggttaagcagcagttaatggaattctcaatcaggaagagaatgaagaatctaaattaa

SEQ ID NO: 9331 - DNA, 180 bp, Glycine max
  Peptide Sequence Number=SeqID_126109
atgattttggatctgaacgctgtggacgattcaggcagtgatgatgactccgatgagtggcaatggtggtttctggtattgattgctaaacagttgcttcctgcatcttttaaagcttctggaacacctaatccagttccagactgtaaaattacatttcgaattaggtactggaattaa

SEQ ID NO: 9332 - DNA, 402 bp, Glycine max
  Peptide Sequence Number=SeqID_126110
atggggagccttattttcatttttcagaataatagtgtcaaatatctgcctggccatggtcctgttgttcctcaagaatgcaattattgtgggaagaaattcaatatgggtggacctatatggtctgctcctatccaggatcaagaatgggtgacttctatactagcagacgtgaaatctatgaaagaaagttgttctgatattttcttttcaggaattgccacactgtttctgagtctgcataatctctgtgcaacacttaaatgcacttctccatcagcaataattttccgttcggccgtgattaatgcaggctatcatatatctggaactcatgttaatccacaaggactgaaatcagatgcacccatggatgttatttgggatataatgcgctgctgg

SEQ ID NO: 9333 - DNA, 427 bp, Glycine max
  Peptide Sequence Number=SeqID_126111
cacatctggttacttgttcaaatttggtggagctgttgtgtcttggagctcaaagaaacaaccagttactgctctctcaagctgtgaggcagagtatatatctggttcctttgctgcttgtcaagcaatttggttgaaatcactgcttgatgagttgaaatgtgaagtacagatgccactgtcattactgatagataataaatcagcaattagtcttgctaaaaacccagtctcacatgggcgtagcaagcacatcgaaacaaggtttcatttcatcagagaacaagtgaataatggagttctgaaattgatttactgtcccactgaagatcagttagcagacctgctaaccaaggctgttaaaccagacagcttcataaagctaagggaagagattggagtcatttgttttgaagatttgaattaa

SEQ ID NO: 9334 - DNA, 636 bp, Glycine max
  Peptide Sequence Number=SeqID_126112
atggttgaagactcaaatgggcttaggtccacgtgccccatttatgatgctcctagcaatagcgacatggtaaaatcaaaagaccctgataccgaagtaactgatcccaaggatgatgattcttactgcttgactttcctagctgattgtcgtaaccgctccaagctttcagttccatcaacttactttggaaactgtttgactatttgccacgtggaacttcagaaggagaagttggtgggagaaaacggtattttggaggcagtgagtgctattggaggggaggttagaggtctgaggggtgaccctttgaaagggtttgaatggatagtttcgggtcgtcgtaggagggaattggggagacaatcacaacatgtgatgataattgcagggtcaccaaagctgaatgtgtatgagactgacttcgggtggggaaggccaaagatgagtgaaatacttcatgctgatgatgcaggagccatgtgtctttctgattgtagaaaccaagaacgtggtggcattgaagttgggctagcactaagtgcaattcaaatgaagaaattcaatgccatattggatgagcaacttggagatattgacattgttgttccgcaccgaatccttaatactatatga

SEQ ID NO: 9335 - DNA, 945 bp, Glycine max
  Peptide Sequence Number=SeqID_126113
atggtacaggctgttgttacaatgaacaacttcctagcatttcgtcacatcccttcacctggctggtcaatgagatggacatgggccaaaaaggaggtaatatggaacatggtgggagggcaggccacagaacaaggggattgctcaaaatttaagggaaatattccacattcctgtaagaaaaatcccacagttgtagatttgcttcctggaacaccttacaatcaacaagttgcaaattgctgcaaaggtggagtgctcactacattggtgcaggatccaaccaaagcagctgcatcatttcaagtcagtgttggtagagctggaaccacaaacagaactgtcaaactcccaaaaaacttcaccttgaaagcaccgggaccaggttatacttgtgggccagctaagattgtgagacccactaaattcattactccagacaaaaggagagtgaccgtagcactgagtacaccacatttggcctctaacgttactagctctgggacgaataatttgtcacctttggttcaatgtactaagcatatgtgcccaacccaagttcactggcacgttatgcgaaactccaagaaatactggcgtgtgaaggttactgttactaattttagttacaggatgaattattctgactggaacttgcttgttcaacaccataacttcaacaatcggactcaagtgtttggtttcaactacaagttactggctttggatgcatatacaaatgatatagcaatgctgtggggaattaagtcccgtcataatgacattctcaaccaagctggccctaaaggcaatgttcaagcagagctactcttcagaaaggataaagcaacttttacttttgataagggttgggcttttcctcgaaggatctacttcaatggtgacatatgtgtgatgccaccacctgatgcttatccattttag

SEQ ID NO: 9336 - DNA, 1011 bp, Glycine max
  Peptide Sequence Number=SeqID_126114
atgaagttcacccaattctgcaggcttgataaaactaggttctatgtcgtaggagctggactctttacaggtgtttcagtggcactttaccccgtttctgttgtgaaaactaggctgcaggttgccacaaaggatgctgtagagagaaatgtgttttctgttgcaaaaggactacttaaaacagatggcatccctggtttgtatagagggtttggcacggttatcactggtgcaattcctgccagaatcatattcctctccactctagagaccacaaaggtggctgccttcagaatgcttgaaccatttagactatctgaaacttctcaggctgccattgcaaatggagttgcaggcatgacatcatcgctttttgctcaatctgtgtttgtaccaattgatgtggttagccaaaagttgatggtgcaaggatactcaggccatgcccaatatagcgggggtctggatgttgttcgccaggttttaaggactgatggcatacggggattgtatcgagggtttggtctgtctgctattacttatgcccctgccagtgcagtatggtgggcaagttatggttcaagccaacgcttcatttggagattcctggaccatggtgccaaatatgatgaagtcgctcctagtctgcagaaaattatgttagttcaggctactggagggattatcgctggtgcaacttcatcctgcattacaaccccattggatactatcaagacacgattgcaggtaatgggacatgaaaatagaagctctataaaacaagttgctaaagatttaatcaatgaagatggttggagaggcttttatagagggtttggtccaagattttttagcatgtcagcatggggtacttcaatgatattgacttatgagtatctgagtaagaactcttcctctctgattacattttctttaagtaacgcgtatgctcaaaagatgaatagatgcaattggtctgaaagcttttgccgatctattaaccaagattag

SEQ ID NO: 9337 - DNA, 1275 bp, Glycine max
  Peptide Sequence Number=SeqID_126115
atggaaggagatgcttatgatccgcttgacccaaatgggaatatcacaatcaaatgggatattataagctggacccctgatggatatgtggctgttgttacgatgaacaacttccaacaatatcgtcatatcgcttcacctggctggtcaatgggatggacatgggcgaaaaaggaggtaatatggagcatgatgggagggcagaccactgaacaaggggattgttcaaaatttaagggtggtattccacattgctgtaagaaagatccgacagttgtagatttgcttcctggaacaccttacaatcaacaaattgcaaattgctgcaaaggtggggtgctcagttcatgggcgcaggatccaaccaatgcagtttcatcatttcaagtcagtgttggtagagctggaaccacaaacaaaactgtcaaagtccccaaaaacttcaccttgaaagcaccaggaccaggttatacttgtgggccagccaagattgtggcacccactaaattcattacttcagacaaaaggagagtgacccaagcactgatgacatggaatgtgacatgcacatactcacaatttctggctcagaaaactccctcttgctgtgtctcactttcatctttctataatgatacccttgttccctgcccaacatgtgcatgtggctgccaaagtaactcgtctcggtcagggacctgtgtagatccagatacaccacatttggcatcagttgttgctggctctgggaagaataacttttcacctttggttcaatgtactagacatatgtgcccagtccgtatccactggcatgttaagcttaactacaaggagtactggcgtgtgaaggttactattactaattttaattacaggatgaattattctgagtggaacatggttgttcaacatccaaactttgacaatctgactcagctgttcagtttcaactacaagtcattgactccttatggttcaataaatgatactgcaatgctatggggagttaagttctataatgattttctcaaccaagctggccctaatggcaatgttcaatcagagctactcttccgaaaggataaagcaacttttacttttgataagggttgggcttttcctcgaagggtctacttcaacggtgacaactgtgtaatgccaccacctgattcttatccgtggttacctaatgctggtgctaggcaagaggtttccttgttttctttagtgatagcatctttggtagccttggtattttatgctcacgcataa

SEQ ID NO: 9338 - DNA, 1115 bp, Glycine max
  Peptide Sequence Number=SeqID_126116
atggccatgagagggataagaaaagttccatcttttaagttacgaggtggagtcagagacaagtgtggtgaaatctgcagtggattctgctacggtgaaggagatagaattagaatctgtttgtgtgaagaggatgtgaggggggtttggctttggaaggaagacaaggttggaagagaaagggaagaagtgttggagagtgagggaaagagagtgtttgagagttggaagaaaagtttggaggaagtgttgggaggaataagggaagtggttgaaggaaccgtatctggtggagggctcacttcacactgttctatcactttcactgtcactgtgtcagccatgaattatggagttgaacttgggaaattaagagcttgcttcgaagcaccaaaacctccagaggaagaagaagagcagagaggagaaatgttcagaattcagcaatttggttattcttatctcctaaaggccagcatcgaatcttccatcctgcacacaatgttcctgcacgatcttgaagtcactaagataagcaggtctcaccattcttctctttttgttgctgtttgcacccctttgcttgtgtttgatctgtttgtgcttgaacttctgctaatggcaccatctgctctttgtttcctgctgctgtatggcacgttgctagccccatctatgacggttcaggtcacggttttcgacaacaacggggaaacacgagagaattgtgaggttcatttgagtgaagaacagagtgagaagatgaatggaaacggtggatttaacactcacttaccagtgtttgatggtaagaactggagtcgttggtcaatacagatgcgtgtgttgttcggagcacaagatgtgctcgaatttgtgaatgacggagttccggatttggaggaaaatgcgacggaagcgcagaggaatttgcatcgcgaaaagaagaagaaggatcagaaagccttgttctacattcaccagtgtgttgatgcaaagatctttgagaagattggggaatcgacgacggcgaaagctgcctgggacacgcttgtgcgttgctatggtggtgatgcaactgtgaagaaagtcaagcttcaatcactgaggaagca

SEQ ID NO: 9339 - DNA, 1002 bp, Glycine max
  Peptide Sequence Number=SeqID_126117
atggcttggagcggtaccaacaccaacaccaacaccaaacacatagtctcacagattcctccctacatatatgtctataatgatggctccatcgaacgtcccatagacatcccaagaactcctccctcacttgaggaccctgcaacaggtgtcgcttccaaagacattctcttctcaaagaaccctttcctctttgcaagacttttccttccaaaactaacaactccaccacccaaccaaaaaatccccattttggtctactcccatggcggtgccttctgctttgaatcagcatttgcagcgcaccacaccaaatactgcaacctaatagcttcccaggcaaatgttatcattgtttccgtagagcataggaaagctcctgagcattttctccctgcagcttataatgattcttgggctgctctcaaatgggttgcatcccattcccatgccaccaacagcaacagcgacacgtggctcatcaatcatggtgatttcagcaaaatatttatcgggggtgatagcagcggtgccaatattgttcataacctggccatgcgtgctggggttgaagctttgcccggcggtgtaaaagtttacggtgcttatcttaaccacccttacttctggggttcaaagccaattgggtctgaagctgttataggatttgaagagacccctcagtcattgatttggaactttgcgtaccctgatgcacctggtggcttagataaccccatgatcaatccattggctcctggggcacccagcttggctcaacttggctgttctaagatgcttcttactgttgccggtaaggatcacctactcttcagggacagaactctgttgtactataaggctgtcaaggagagtggctggaaaggccaagtggaactctttgaagaggaacaagaggatcatgtttatcacatgtttaatatggaaactcaccaagccaaaagattgataacaatcgtcgctaattttcttcgccagtga

SEQ ID NO: 9340 - DNA, 417 bp, Glycine max
  Peptide Sequence Number=SeqID_126118
atgtggttaatgaatgctggtttttcaattaaagggagcaaatatttgaattcaccaaaaatagatgtctattccttgaagttagaaagaattgaacgcacctcaggaaaaatatcagcactagacaattgcaaggaaataagcaggattcttagtaggattaataatgcccttttaaagattcagcttggcttgattttcttcaagcaacattgtccttttgtgtgcaactactttaggatatattggataatttctactatggactctatgatgacagttaattatcttatcattcaaaatcttagacttagcctctatctagctatgactacgtggattcaaagtagaacttttggagatgatactgccacttcgaagagccctttaaacaccggatgggagctatcagtttga

SEQ ID NO: 9341 - DNA, 219 bp, Glycine max
  Peptide Sequence Number=SeqID_126119
atgagagaagaacgagaagaggaagaagaagaagaagaagaagaagaagaagaagaagaagaagctgagtccctcgacgcaacgcaacccaaaactgttcacaaatggaactcgggatttgaacacgagatggaagggttagtgtgggttaagaaagcaggtccagtgataaagtttggtgggcctgcttggcttcagatcctgcacgttcgcttatga

SEQ ID NO: 9342 - DNA, 1375 bp, Glycine max
  Peptide Sequence Number=SeqID_126120
ttctaagaagcaaggcattgtgacactttctacttgtgaagccgagtatgtagctgcaacttcttgcacatgtcatgccatttggctaagaagattgttggaggaacttcagttgttgcaaaaggaaagcacaaagatctatgttaataatagatctgcacaagagcttgccaagaatccggtgttccatgaacgaagtaagcatatagatacaaggaagaatgtcgccgtcaatgaaagttcaaataaaaaagagggaacttctcgggacaatggctcactatctgtaccaacgggcctctgccgccacttctcaatcaaagaaatgagaactgccaccaacaactttgatgaagtcttcgtggttggcgtgggaggcttcggcaatgtgtacaaaggccacatcgacaatggttcaactacagtcgcaatcaaaaggctcaaacagggttctcggcaaggtattcgcgagttcaagaacgagatcgaaatgttgtctcaacttcgtcatcccaatattgtttccctcatcggttactgttacgagagcaatgagatgatcctggtttacgaattcatggattgtggaaacctccgtgatcatctctacgacactgataacccgtctctgtcgtggaagcataggctgcagacatgcataggtgttgcgcgaggattggattatctgcatacaggtgtgaagcaggtgataattcaccgtgacgtcaagagtgcaaatatcttattggatgagaaatgggaggccaaggtttcagatttcgggttagccagaattggggggccgatgggtatttcgatgatgaccaccagcgtgaacactgaggtgaaaggtagcattggatatttggatccagagtattacaagcgtaacattttgacggagaaatctgacgtgtactcatttggggtgatgctgttggaggtgttatctgggaggcaccctttgctccattgggaggagaagcaacgaatgtcacttgctaattgggcaaaacattgctatgagaagggaactctgagtgagattgtggattcagaactcaagggtcagataaaacctcaatgtttgcacaaatttagtgaggtggcactgagctgtttgcttgaggatgggactcaacgaccttccatgaaagacattgttggggtgttggagtttgttcttcagattcaggatagtgctgttaattatgaagatagcagtagccatagtactgtacctctttcagattgtagtgagaacactggattgagcacgacaagtgatggagatggtagctatggcaggatggaatcttttgtgttgataccggatgatgttttctctgagactaagaatccaaagcgacggtga

SEQ ID NO: 9343 - DNA, 1020 bp, Glycine max
  Peptide Sequence Number=SeqID_126121
atggacctctccgagtgtggcaacagaacagtgatggatgttaccgcaacagtgaaggattatttgtcgacgccgctggtttgctcgatttcggcagtgaaaagctctcgttttagggccgaacgccgccatcgaaaatcacctccggcgggaggcaatgatcaaaaagtggacttgaattacttatccaaggcagaactccgcgataagcgtgcgatctcaggataccaaaacccccatccgttgataccgtttgacaagaaagaacgaaccaaagcacgcacgcacgcaggcaccattgaaagggaaaacgacggaacaacactgaaggaagagactgctgttttgagtttcggttccgatcgaccgacgatgctgtccaatcatttccaaaacggcatcgaaacggcgaggctcgtttggtcgcggattcctaattcggaagaatcgcagctcctcgacgacgccgttggcatccttaagaagaacgacggaggcggtgtcgagagccttgactatgaagtcattgagaattttgcttatcgtgaggaacagggggaagctgtatgtgagctatttgctggtggtgaaatggttctttgccttgctcattggcatttgtacgtccttcaatttgatcgcagttttgaaagtacaggacttgctgctgttttcatcaatattgctgttgaaaattttgctggctggaagttctcagtgacatttaatataattcagaaatcatatattgctggatttgttgtatatgtcctgatcaacttggctttggtgttttcctctgtatatattatcacacaatttgcaccagcagctgctggatctggtattcctgaaatcaagggttacttaaatggagttgatattcatggcatccttcttttcagaactctaattggaaagatatttggaagcattggttcagtgggtggaggccttgctcttggtaaagaaggtcctcttgtccatactggtgcttgtattgcttctttgcttggacaa

SEQ ID NO: 9344 - DNA, 219 bp, Glycine max
  Peptide Sequence Number=SeqID_126122
atgactaaattggggatgaaaacaatgagccagacggctgctgcatggcattttgctttcatcgtccggcacttctttttttcccctatgccttgtgcacagtggtgggagctaaaatttggatttaagagtataaaaaactttctacccattgcccagaggctcttcagccttacccttgcatatgtaaagagactgtttccggatttgaacccatga

SEQ ID NO: 9345 - DNA, 2628 bp, Glycine max
  Peptide Sequence Number=SeqID_126123
atggcacctgctcactgttttgcaactgtgtgctgcttcgcttacagcttatccatggacacaactggcacccatattgcttcaggggcaatcctcttccttctgttgctgtgcctctcttatctttccatagcagatgttatttatagtcccgttgaactcttcagcatcaactgtggctctaacagtagcttgtccacgcgcgatggtcgcaattggactgcagacatcaaattcctctcagaaaacaaggactcagttgctgctcctgcactcacaccatctaccctagagggtccttacaccgatgctcgtttctctcactcccaattcacttactctttctctgtctccacaggcccaaagtttcttcgcctcttcttctactcaacttcctaccaaaacttccatcgctccaaagcctatttctcagtcaaagcaggccaatacaccctctttcaagacttcaatgcttccctcaatgctgatgctgatgatgaccctgcccagaccgacattttgttcagagagtattgcatcaacctcaaagatggcgatcggctcaacataaccttcattccaagcaaaacatctcagcatccagattcgtacgctttcatcaatggaatagagattgtttcaatgcccccttttctctactacaccaatcctgacgacgtcgacatcagtggattgcctctactcgttggcctcaatacgaacccgttccccattgaaaacaacttcactctggagacaaagtatcggttaagagttggaggcgcagaaatccctgcctcacaggacacgggtatgctcaggagctgggatgtggataacaaatatgtaacgagtcaaagtgtactatctctatatattgccactggaattaagctgagattcacaaacaagattcctaactacactgcaccagacacagtgtaccgatccgtaaggaatatgggaagtaatggtaccttcaacatgggtttcaacctcacatggcaacttcccgttgattcaggcttcacctacttgctaaggttacacttttgccagcttgacccgaatattagccgtcctggtgaccagagcttcttcatctacgttcaggatcagttggttgaagactgggcagacattctcggttggagccataaacagaagggtgtcccagtggttaaacagtatgtagttttcatcccagggaatcagcaggaaacgcttaatctttcactgaaaatgcatcctaaccctaatagcttggccaaggacgctcaaataaacgcaattgaactcttcaaaatcagcaactttaacagtagtcttgctgggccaaatccagacccaaaccgtcttccagtaacccccattgttccccttcaaagaccaaacaataaaagcagcggcaccacaagaaaccttgccaccgccgtggcaggtgcagtttctgctgccgttttgctctcctttattgtcgctttcttcctcatccaatgcaaaaagaagatgggttccaagaaaaaagacgaaactcctctgggcggtggcttatcatcactaccaaccagcctctgccgccacttcacgatcgtggaaatcagaggcgccaccaactacttcgacgaacacttcatagttggcatgggaggcttcggcaacgtgtacaaaggctacatcgacgacggttcaacccgagtcgcaatcaaaaggctcagaccggattctcggcaaggtgcgcaggagttcatgaacgagatcgaaatgttgtcccaacttcgccacctccatcttgtctccctcgttggttactgttacgagagcaacgaaatgatactggtgtatgatttcatggatcgcggaaccctctgtgagcatctatacgacactgataacccttccctttcatggaaacaaaggctccagatatgcataggtgctgcacgaggactgcactatctgcatacaggtgcaaagcacatgatcattcaccgtgacgtgaagagcaccaacatcttattggatgagaaatgggttgccaaggtttcagacttcgggttatcccgaattgggcccattagttcttcaatgacccatgtgagcactcaggtgaaaggtagcgttggatatatagatccggagtattacaaacgacagcgtttgactgagaagtctgatgtgtattcctttggggtggtgctcttggaggtattgtctgggaggcaacctttgctccgttgggaggagaagcaacgtatttcacttgttaattgggcaaagcattgctatgagaagggaactttaagtgatattgtggatgcaaaactgaagggccagatagcgcctcagtgtttgcaaagatatggtgaggttgcgctgagttgtttgcttgaggatggaactcagaggccttccatgaacgacgtcgttcggatgctggagtttgttctgcatcttcaggagggtgctgttaatgaagtgacggagagtgaagataccaaggacgtgtttagcagtagccatagtagtctacatttttcggattatagtaagagcactgcattgagtatggctacaaacgttggagattgtagctatggaagtaaggactctgaggagagaggttga

SEQ ID NO: 9346 - DNA, 351 bp, Glycine max
  Peptide Sequence Number=SeqID_126124
atgttgattgctggggtattcttcatctgtggagttgtccttaatgctgctgctcaagaccttgccatgctcatcgttggcagaatcttacttggctgtggtgttggctttgctaatcaggccgtgccagtgttcctctctgagatagcaccttcaagaatacgaggagcattgaatatattgttccagctcaatgtcacaattggcattctatttgctaaccttgtcaactatggcaccaacaaaactcgaaagtgtagcacatgctggcttctttgtagtgtgctatcagctagcgggacaagtgtcaatttagtgtttagccagcaagcatctgttttgggtcattag

SEQ ID NO: 9347 - DNA, 282 bp, Glycine max
  Peptide Sequence Number=SeqID_126125
atgccacgaaacgttttaaagaaagtgacattgtctgcgactcaaccaggatcgttggcagaaaatcatggtatccagttttcggctaaagagatcgagtttgaagagcatggaggcgtggaacgcgtcaagacgaagttgagatccatggagagcggaatccatggaagcttgggttgcggcgaggttggccatggcggcctcgaggcggtccaggctggcgaaaggttcgacatctgccatggaagagcgacagagaagggggcaggtcggaccaattga

SEQ ID NO: 9348 - DNA, 375 bp, Glycine max
  Peptide Sequence Number=SeqID_126126
atgtcatctattgtttgtagggattgtgcccgcaagacacctagtggacccgaagaaggccaacagggtcttggagttgccagctctaaatacgggtctctgtcagttctagggagtgcctgtcgcccccagcaaggtcatcaggtcccccctaccaatcgagctttcatcaagaagttctgcgtctccaggcaggcgcagggcgaaacaccacagcagcctggcgaaggctggcagcgggcaacagacgcaccgccatcacctttagagttcacctctgctcatccacaaaaaggtttgagtatttcctacaccacatggccgaccaataggcgaccaagtccaaagccaaaggacgcacctagttgctcatga

SEQ ID NO: 9349 - DNA, 837 bp, Glycine max
  Peptide Sequence Number=SeqID_126127
agccggcatcagaatttgcggcacgtattggccaccaaattcgccgaaggtctggaagaccgaggccaggcgcgcgggatctttgatgcccggttcgctttccacgccggagttgaaatccagcccggcgcagccgagcttggccgcctcgacgcagttgtcggcgcgcaggccgcccgccagcatcacgttagtcagatcttcgccttgcaacaccgaccagtcgaagcgttggccggtgccgccggcgccgttgtcgagcagatagcgatcgacatgctgcagatcgcgcgccggcacccgatctttcacgctcagcgctttccagatgcggcaatcggccggcaagcgggcgcgcagggcgttgatataggcctggtcttccgcgccgtgcaattgcaccgcgtgcagaccgaggcgctcaacggtcaacgccacggtatcgacctgggcgtcgcagaacacgccgacgtacttcagcggcgcgccggagatcacttcgcgagcgcgggtgatgtccacatagcgcggcgagcggccgacgaaaatcagcccgccgtagatggcgccggcctgataggcggcggcggcgtcctgcggacgggtcaggccgcacactttgttgtcgcccaggatcacgcggcgcacggcggcgcgcagatcgggttccgacatcagcgcgctgccgatcaggaagccgttggcgtaatggctcagctcgcggatctgcccgtagttgttgatgcccgattcgctgatcaccgtcacgccgtgcggcacgcgcggcgccagctgacgggtgcggttcagatcgatgctcagatcgcgcagatcgcg

SEQ ID NO: 9350 - DNA, 829 bp, Glycine max
  Peptide Sequence Number=SeqID_126128
atgtttcaccctcaaactgttttagattcaaatggctatccaatctatcgtagaagaaatgatgaccataccatttcaaagaatggagttattattgataatatatatatagtaccttacaatgcaaaattgctgaggaaataccaagcacatataaatgttgaatggtgtaatcaaaatacttccattaaatatctatttaaatatataaacaaaggttatgacagagtcactgctgttgttattcatgatgataatggtacacttgagaatgctatcagtcaaaatgatgagattaaagaatatgtggattgcagatatatttctccatgtgaatctacttggagaattttttgttttccaatacatgctagaaagcctgatgtggagagattacattttcatattccaggacaacacaatgttttttatgaagatgatgatgatatagatgatatcctgtcaaagccaagtattttagaatcaaaattcttagcctggatgaatagcaacaaatgtttttcagagggtagaaatctcacttattcacaatttgtttccaaatttgtctacaaccaaaaggctagatcatggaaccttagaaagaaaggcaatacaattggcaggttaatatgggttccaccaaccactggtgaattgttttatctaagaatgatgcttactgcatgtaaaggagctacttcatttgaagatattagaacagttgaaaatgttctataccctacatatagagaaacatgctttgcaatgggttttttgcaagatgatagagaatttgtggaagcaatcaaagaagctaaggaccagg

SEQ ID NO: 9351 - DNA, 528 bp, Glycine max
  Peptide Sequence Number=SeqID_126129
gtgctatcttgtacactctgggaaaattactgcttacagtttttgtcttatttgaatgatattgaagatgaaaggccaatcattattctcttgactcatgctaggattaaggaagcacagagatcatatctggcatcggtcagtaattctttcaaggcgtctaaactcatgatcaatgacctcgtgctggaaattcaagaatttagagagagtcttttagatttagggatcgaggttagagcaattttggtgcctattggacaagggagttcacaggtttcaggctcatctcaattatcatcaaaagatgcgtttctgtcaaagactgaagtaaaaaatatctctgagattaatgtcagtttagaggagtttgtttgtgttactgtcgccaagattacaaccatagtgatggacaactattcatggtgctatccggcttgtggtcaatgttataaaaaagctgacatgcaaactgtgtcgttcacatgtccgtgtggcaaagagaatgatcaacctgtactgaggtga

SEQ ID NO: 9352 - DNA, 276 bp, Glycine max
  Peptide Sequence Number=SeqID_126130
atgaatgtgttgagtggtgcaaccctcttttgtaaaatcacttatgcacccatgatttgtgtacatagggactcattaggtaggaataatcaacatgaaaatatagaaaaaggggttcccacggaccctaagagaataaaggtcattcctgagtggtccactccaccaagtgtcgagggaagaaacatagagtatcaagaaactttggatttgaagtcaaatcctttccaagggggaggggatgatgcaatcctacccctaaagggtattggatag

SEQ ID NO: 9353 - DNA, 303 bp, Glycine max
  Peptide Sequence Number=SeqID_126131
atggtcattgaccaatccctcttttatgatttgacccaattgtctagtgacggtgtaccatttgaaggtgcactggatgatgattggaagtttgattttctgtgcatgatgcccgtcggacacttaccggctggagaggattcttctctccttcagagtattttggacagatttgacggacttcaaaccaatgttgtggacacacgattcaaggagatggactcaaggattaaaaaggttgaaggagatgtcacctttattcgcgattgctttgacttaccaccactgccaccatcagtttag

SEQ ID NO: 9354 - DNA, 543 bp, Glycine max
  Peptide Sequence Number=SeqID_126132
atggcggaagcctctggtaatcgattaccagcctgtgtaattgattacacagaggaatgggtcactggtaatcgattaccaggcatgtgtaatcgattacacagtatcgtgatggcggcgcagctaatccgtgatcgagtagagatggagttcctagagggagcttgggagaccctcgaaggcaacacgaggtgccgatttcggggcaccattcgattcacggcaacttctttggtgcatccagatgaacctgcacggacgcttcagcgcactgtggagtggatactacccacgcctacaccatatcgtctagtggagcccgttcaagtgatcgaggtaacatcatccgaggaagaccctgaggaggacctggaggagctacctcctgagcctgctgtggatgcccttgactttctagagggtgatgaggatccacttcttgaggtggattctcctgaggaagtcatgtcggcatctgaggcagactctacggaggatagtgacccgagggagatggcgatcagcggaggctcttcatcctag

SEQ ID NO: 9355 - DNA, 597 bp, Glycine max
  Peptide Sequence Number=SeqID_126133
atggggataagttattttgcttaccaagaccaattgaagaagcaaccccaaggggaacccaccacagcccaaagcgaaaatattcaagaagctcctcaagatgctgcaaaaaagaacaggcatttgtggactccaggtttatgggtcttttcctcacttatatggtgctcaacttttccactttttgcctggtgtgggacttcacctcacacttgtaacccaacaatctccccctcaagtctattagagcctacatgctctagctacttgcaccaccgctctatctgcgggacacgctgcctggacccaccgccaggaagacttttgatacaagggatccccaaggccaagatccatcaccgccatcttactcgtctgagccggtcaccaattcttctgataccagttgttggggaattcgaggggagtaaacaccggatagatttacaccggctcagacgagtaagatggcgacgatggatcttggcttggggatcccttgtctcgaaagtcttcctggcgatgctccaggcagcgtgtcccgcagatagagcggcagtgcaagtaccgcaagtagctagagcatgtgggctttaa

SEQ ID NO: 9356 - DNA, 528 bp, Glycine max
  Peptide Sequence Number=SeqID_126134
atgactcattttactgcgaggtacggaatccgtgaaatatccggcgagatggaatccggggtgagatcgggtggttctggggttgtggtgaagagcagaaactcatctggttgtttaattgtgcgaaagaaaggggatgggttgagtgctaccgcttccacctctcgcaatctctatgaatccaagaaaaggccaaacatcaacgtgtctgtgtcctcgagtgattctggatcaagcgacgagttgctgatgcctcctggtagaaggcttggtcccgagaccattcgagtttgcaatggtttggctgcctctgagcgaggtgggagtgaaattagtcggaagagggatagagtggaacgaataagcggtagtggggaggacattgctgcggagaaaggtttggagcagtgggaaaggaagcgtagtaagttggatgtgtacgatttcaatgaatacgatggcatggatgtggagaacataaggaggaggcatttggatggtcatgggggaggaaggtttatgggataa

SEQ ID NO: 9357 - DNA, 981 bp, Glycine max
  Peptide Sequence Number=SeqID_126135
atggaaggagggaaacgaggcacgattctggtcaccaacgacgacggtatcgatgctcctggcttaagagcattggttcactccctcgtcaacgccaaccttttcaacgttctagtgtgcgctcctgatagcgagaaatcagctgttagccacagcatcacttggctccatccagtagctgttaagcaagtacagatcgagggaaccaccgcatttgctgtttctgggactcccgctgattgtgcttctctagggatttccaaagctctctttcccacagtacctgatctggtggtcagtggcataaacaagggtagcaactgcggttatcacatttgcttcagtagttattacttcatgaagaaacttttgcccatagctttactgagtaggtccctttgcagtgtttactcaggcactgtagctggagctcgagaggccttcttcaatgatatactttctatctccatttcatatgactgggttaaaggaaagagtaagctacaagacttcacccttgctgcacaagtatgcttacctatcataagcgctctactggttgagacaaagaatcaaagctaccctagaaaatgttttttgaatatagacgtgccaaacaatgttcctaaccataagggttacaagctaactaagcagggtaaaagtatcatcaagactgggtggaggcaagtcacatctgagacagaaggaccaaaaatgtcatctgatatgaccaatacagatacagaaacatcaaagaattttgactcatcatctgcatcaccagaacatcttttgtttgcgagagaggtaataggttctgtacttgatgaagatgatacggactacaaatgtttgcgggaaggatatattactgttactcctcttgctgctctcactcatgtggaggtagattgtcaggcctattttaagaattggctacaaagtgtccccgaactcccctcgtcatcatctttataa

SEQ ID NO: 9358 - DNA, 1839 bp, Glycine max
  Peptide Sequence Number=SeqID_126136
atggtggaacctgcatatactgtgacatctgacagtgaaaccactggtgaagaaaaatcgtctacttttcctgaaatagcaattggcattgatattggcacatcacaatgtagtgttgctgtgtggaatggctcccaagtggagcttttgaagaacacaaggaatcaaaagattatgaaatcatatgtaaccttcaaagataacatcccttctggtggagttagcagtcaactctcccatgaggacgagatgttgtctggagccacgattttcaacatgaaacgcttgattggaagagttgatactgaccctgttgtccatgcatgtaagaatctcccatttctagtgcagactttggacattggcgttcggccatttattgccgcattagtgaacaatatgtggagatccacgactccagaagaagtcctggcaatatttctggtggaattaagagcaatggctgaagctcagctgaaacgaagaataagaaatgtggttcttaccgtcccagtttcattcagtcgatttcagctaacccggatagaacgtgcttgtgccatggctggccttcatgttctcaggttgatgcctgaaccaacagctgtggctttgttatatggacagcaacaacagcagacttctcatgagaatatgggcagtggaactgagaaaattgctctcattttcagtatgggtgctggttattgtgatgttgctgtcactgctacagcgggtggagtatcacagattaaagccttggcaggaagtaccattggtggtgaagacttgcttcagaatatgatgcatcatctgctaccaaattctgaaaatctatttaagaaccatggggtcaaagaaattaaacagatgggcctgcttcgagttgcaacccaggatgcaattcgccagctttcctctcagaccatcgttcaggttgatgtagacctgggagatggtttgaagatatgcaaggctgttaaccgggaggagtttgaggaggtaaacagaaaggtgtttgagaaatgtgaaagccttatcatacagtgtttgcaagatgccaaggtagaagttgaagaagtaaatgatgtgataattgtaggcggatgttcttacatcccgagggtgaaaaatcttgttactaacgtatgtaaaggcaaggaactttataaaggcatgaatcctttagaagctgctgtttgcggtgcagcagtggaaggagctattgcttcaggcgtcaatgatccctttgggaacttggacttgttaactatccaagctacacctcttgccattgggattcgagctgatgggaacaagtttgtccctgtaattccgagggatactacaatgccagcacggaaggagctagttttcacaactactcatgacaatcaaactgaggcgttgatccttgtctatgaaggagagggtgaaaaggcagaagaaaaccacctattgggatatttcaagataatgggaatacctgctgctcctaaaggagttccagaaatcaatgtgtgcatggacatagacgctgcaaacgtgctaagagttttagctggtgttgtgatgcctggttctcgccaacctgcgattcctgttatggaggtgtgtggtgtccaggaaactagagctagagaggtgagacatgactcagaagtgctgaatgattttaagaggtttgaggaaatggccttggttggactatggtgtgttcatccaagtccatctcctagacattcaatgaagcaggtgatgcaaatgctagatggaaccgtggaagttggtgttcctcctttggtttatgatcagatgatggcagatcagtgcttatag

SEQ ID NO: 9359 - DNA, 1107 bp, Glycine max
  Peptide Sequence Number=SeqID_126137
atgtttccagttgtgtcgggtatctttaacaggggccagaagctaaaggggacagtggtgttgatgcgtaagaatgtgttggacatcaacgccctcacctctgctcaaagtgccactggtattatcggcggcgccatcggtgccgtcggtgatatcattggcaccggagttgacaccctcacctcctttctgggcagatcagtggccctcaagttgatcagtgccaccagtgctgattcaaccggaaagggaaaggttggaaagcaaacttttctggaaggtcttgttgcttccttaccaaccttgcgagctggagagtctgcattggatattcactttgaatgggacagtgacatgggaattcctggagcattctacatagagaatttcatgcaagttgaattcttccttgtgagtttgactcttgaagacgttcctaaccatggaaccatccactttgtttgcaactcatgggtttacaatgcaaaaatgtacaaaaacactcgtatcttttttaccaacaagacataccttccaagtgaaacaccgggtccactagtgaagtacagagaagaagaattgaagactttgagaggagatggaacaggacagcgcaaagaacatgaaaggatctatgattatgatgtctacaatgatttgggaacacccgaaaaggacaatttggctcgcccggttctcggggggtccaccttgccttaccctcgcagaggaagaactggtagaaacaaatctaaaaaagatcctaaaagcgagattcgcagcgactctgtttacattccgagggatgagtcatttggtcacttgaagtcatcagatttccttgcttatatactcaaatctgcatctcaaaatgtgatacctcaattacaatctgcacttagactacaattcaaccagcctgagtttactagctttgacgacgtgcgcggactctatgatggtgggattaagttgcctactgatgcacttagcaagcttagtcctataccattgttcactgaactcttcagaactgatggggaacaggtccttaagtttcccacacctaaagtaattcaaggtagtacattaaaagcatattcctga

SEQ ID NO: 9360 - DNA, 285 bp, Glycine max
  Peptide Sequence Number=SeqID_126138
atggaaaaagaaagattcctcctactagacacactcaagcttaagatgtattcattagagagctctgagtcttcggggtgcgggtattgtggtgatcacgcgcttagcacaacagcacatagacttaacgagtatgacgacgatcacacagctaacgtgaaatgcacgttaagtgtgcctctaggcttcttcaagagtcttcttcgcgctaagcttgagttggccactaagctaggaaacgcgttggatttgtcttgtgcactaagtgaattatctcaatcttaa

SEQ ID NO: 9361 - DNA, 786 bp, Glycine max
  Peptide Sequence Number=SeqID_126139
atgttttcgggtgtaacaggtttgataaacagggggcataaggtgaaggggacagtggtgttgatgcaaaagaatgtgttggacgtaaacgcccttacttctgccaagagtgtaggtggtatcgcgggcggtgcactcggtgttgtagggggtgtcattggtaccgcagtggacacactcacttcctttttgggccgatccgtggctctcaggttgatcagtgccactagttctgatggaagtggaaaagggaaagttggaaagcaaacatttttggaaggtattgttacctcccttccaaccttgggagcaggccaatctgcattcaatgttcattttgaatgggacactgacatgggaatacctggagcgttttacattgagaattttatgcaagttgaattcttccttgtgagtttgactcttgaagacattcctaaccatggatccatccacttcctttgcaactcatgggtttacaattccaaaaaatacaaaagtgaccgcattttctttgcaaacaagacataccttccaagtgaaacaccgggtccactagtgaagtatagagaagaagaattgaagactttgagaggagatggaacaggagagcgccaagaacatgaaaggatctatgactatgatgtctacaatgatttaggtgatcctgactccaatgccagattggctcgtccagttcttggaggatccaccaccttgccttaccctcgtaggggaagaactggtagaaaaaaatctaagaaaggtataaggcttctgttctaa

SEQ ID NO: 9362 - DNA, 1845 bp, Glycine max
  misc_feature (125)..(125): n is a, c, g, or t
  Peptide Sequence Number=SeqID_126140
atgaacaaggatggagctcaggtgcctccactctcacagagggagaagtttaattcggacgagtccattagggttcaggggaagaatggtgttttgaaggtaatggttaataagaagaaggtggntggtccatcagaacagtattatgatcatcacaaacccttggaaagcaggctaaggttgaagactgaagagatggctaagaggttgaagactgaagaggctgccaagaggttgaagactgaggggacttccaagaggaatattccaattcgtccttcctcatacatcgataagaaacctgttgataaaccagcattacataagaggccagagaagaaaaggatagcatcaagaaaatcattgtcaagcaaggatagtaagggtgatgagggggattcagataacagtgacacatcattgaatccaagaataagaaatactgaagctcgtaagtctgtgaaaaaaataatctctgaggatgagcagactcctgtgcaccaaaaaaccccaaccacaagaacaaaagaaggaaaactcaagcgtggtagtggtacagaaaaacaaaaactgcgggaacaaataagggagatgctgctgaattcaggttggacgatagactatcgacctcggaggaacagagactacctggatgctgtttacattaatccagctggtacagcctattggtctatcatcaaggcctatgatgctcttcaaaagcaattgaatgatgatgctgatgaggtcaagcccaaaggggatagttcttcttttgctcctattgcagatgaggttctcagtcagttaacaaggaaaactaggaagaaaatggagaaagaattgcaaaagaagaagaaaaggcatgatagtgaaagtgatagtgaaaaagagcctcaaaggaaaagatctgccagcaacaagcataatatgaatagcatggatagtgatagctacgaggagaaattaagctcctttataaaacagggaaataagtcaatgaaaaacaaaatgtttgaaaatacctctatcagtgctcgctctaaaatccagaatgctacccatcactcaagtgatggaatagaaaaatcattatttggatgtgatcctcatatacatggacggaagagtaaaaaacatggaagatgtactttgttagttcgcagttctaacaaaggatcaaattcagaatctgatggctttgttccatatacgggcaagcggacagttcttgcctggttaatagactctggaacagtagagttaagccaaaaggttcagtaccgcagacggaagaaagtcatgctggaggggtggatcacaagagacggcattcactgtggctgctgtagtaagatcctcacagtttcaaagtttgagcttcatgcaggaagcaaattgccacagccacatcacaatatatatttggaatctggagtttctcttctacagtgccagatagatgcatggaatagacaagagcatgctgaaaaaattggtttccatgcagtggatattgatggaaatgatccaaatgatgatacttgtggtatttgtggagatggaggggatttaatctgttgtgatggctgtccatcaacatttcatcagagctgcttggatatacagatgcttcctcctggtgaatggcattgtccaaattgcacctgtaaattttgtggcatagccagtggaacttctgataaagatgatgcatctgtgaatatcctacagacttgcatcttatatcacaactcttgcactaaggagatgaatacccttcctaataaaatcaattcatcaagcctttctttttgtgggaaagagtgcaaagagcgtgcatga

SEQ ID NO: 9363 - DNA, 1572 bp, Glycine max
  Peptide Sequence Number=SeqID_126141
atggaacagaagagcgccaagaacattacaggatatatgattatgatgtttacaatgatttgggcgatcctgacaccaatgacagattgggccgtccggttctcggaggatccgacacgttgccataccctcggaggtgtagaactggcagaaaaccatctaagaaaggttggaattaagttgcctactgatgcactaagcaagcttagccctataacattgttcaaggaactcttccaaactgaaggcgaacaggcccttaagtttccaaagcctaaagtaaatcaagcggagcagtctgcatggatgaccgatgaggaattcgtaagagagatgcttgctggtgtaaatccaaccgttattatggcttcggaaaactataacattatccacttgttaaatttgcagttagctagctacaaattgtttgagttcccaccagagagcaagctagatagacagctctacggcgataacactagtacaataaccagagaacacttggagcctaacttgggtggcctctctgtagaaaaggctatggaaaacagaaaattgttccatctagaccaccatgatacaatctttccatatttgaggcgaataaacgaaactgacacaaaggcctatgctgctagaaccatccttttcttgcaagataatggaactttaaagccattggccattgagctaagtaggccacatcctgaaggtgataaatttggtcctgttagtaatcttaaccttccatttggctacttgccaaggcttatgtggttacacactcacgctgttgttgagccatttatcatagcaacaaacaggcatcttagtgtggttcatcctattcacaaacttctgcttccacactaccgtgatacaatgaacataaatgcagtagcacggaatgtcctggtgaatgcagagggtatcatagaatcaacattcttggggggaaaacatgctttggaaatgtctgctgttgcatacaaggattgggatttcctttggagttcactacctaatgatcttgttaaaagaggacgggctgatgcggatccatcttcgctgcacggtgttgttcgacttctgatagaggactatccctatgctgctgatggattagagatatggtctgctatccactcatgggtggaagaatatgtcagtttctactacaagtcagatgttgctattgcacaagacactgaactccaagccttctggaaagaagttagagaggttggtcatgctgaccagaaaattaatgcaaggtggccaaagatgcaaacttggaagagtgatgcccttaaaaaccttacaattatagaggtcttgtcaaggcatgcttctgatgagttgtaccttggacagagagatagtgaattttggacttgtgatgcacaaccattagaggcattcaagaggtttggaaaaaagttggcagaaattgagcaaaagctcatccaaaggaacaatgatgagacactgaagatgtcctacacattgctctatccttctagtgaggaaggtttgacttgcagaggcattcctaacagtatctccatttaa

SEQ ID NO: 9364 - DNA, 2367 bp, Glycine max
  Peptide Sequence Number=SeqID_126142
ttcaatcagcctgagtttaatagcttcgatgacgtgcgaggactctatgatggtggaattaagttacctactgatacacttagccagcttagccctataccattgttcaaagaactcttcagaactgatggcgaacaggcccttaagtttccaacacctaaagtggttcaagcagtggagcagtctgcatggatgactgatgaagaattcacaagagaaatgattgctggtgtgaatccacacattattaaaagacttcaggagttcccaccaaagagcaagctagatagccagctctacggtgataataccagtacaatagccaaacaacacttggagccaaacttaggtggactcactgtagaacaggctatccaacacaacagattgttcatactagatcaccatgatacaatctttccttatttgaggaaaattaatgcaaccgacaccaaggcctatgctactaggaccatcattttcttgcaagataatggaactttaaagccactagccattgagctaagtaagccacatcctcggggtgataattatggtcctgttagtaatgtttaccttccggcaaaccaaggtgttgaagcttctatttggctacttgccaaggcttatgcagtcgtaaatgactcttgctttcaccaacttgtcagccattggttaaacacccacgcagttgttgagccattcatcatagcaacaaacagacatcttagtgtggttcatcctattcacaagcttctgcttccacactatcgtgacactatgaacataaattcactggcgcgaaatgtcctggtgaatgcagagggtattatagaatcaacattcttgtggggaggatattctttggaaatgtctgctgttgtatacaaggattgggttttcactgagcaagcactacctgctgatcttgttaagagaggtgtggctgttaaggattcatcttctccacatggccttcgtcttttgatagaggactatccttatgctgctgatggattagagatatgggctactatcaagtcatgggtccaagaatatgtctctttctactacaagtcagatgctgctattgcacaagatgctgaactccaagccttttggaaagaacttgtagaggttggtcatggtgacaagaaaaatgagccatggtgggggaagatgaaaactcgccaagagttgattgattcttgcaccatcctcatatggactgcttcagcccttcatgcagctgttaattttggacagtatccatatggaggttacatccttaaccgaccaactcttagcaggcgattcatgcctgagaaagggtctcctgagtatgatgagcttgctaagaaccctcaaaaggcgtatttgaaaacaattacagggaagaatgagacccttactgaccttacaatcatagaggtcttgtcaaggcatgcttctgatgagttataccttggacagagagatggtggtaatggttggacttctgatgcacagataatacaagccttcaagagatttggaaataagttggctgaaattgagcaaaagctcatccaaaggaacaatgatgagaccctgaggaatcgatatggccctgtgaagatgccttacacactgctttatccttctagtgaggaagggaaaattgatgcaaaaattggaagaaaaaaagcgttgaagaaaaattggaagaactggacagcttgcttaacacgcaatccaggcttagcgcgcaccctcgctaagcggaaaagctcaaggcttagcacgaagaaggcaaacgaggaagcccaaaggttagacacccatgcagatgttgagccattcgtgatagcaacaaacaggcatattagtgtggttcaccctattcacaaacttcttccgcaatatcgtgacacgatgaacatcaattcacttgcaaggttagtcctggacaatgaggagtctagaggagtggctgttgaggattcagcttcctcacatggcattcgtcttctgatagaggactatcattatgcttctgatagtgaactccaagccttttggaaagaactcgtagaggttggtcatgctaacaagaaaaatgagccatggtggccaaagatgcaaactcgtgaagagttgattgaactttgcacaactctcataagacagtatccatatggaggttatgtccttaaccgatcaaccctcagcaggggtttcatacctgagaaaggctcccctgaaggcaaagaatcagacccttacactcacagaggtgttgtcatttatcaatgcatgcttctgataatttataccttggacaaagagatggcggtggtgatagttggacttctgatgcacagatga

SEQ ID NO: 9365 - DNA, 537 bp, Glycine max
  Peptide Sequence Number=SeqID_126143
atggcaagccttcagttaacaacaacacccttcactcttttgagacaacaaaggcagcaccccacaaagaagaagtccactgcttctcagctgaaccctcctcggccacgtcccctcagagtgagtgtgaggtcctataaagtggtgattgagcacgatggagagtccactgaggtggaggttgaacctgacgagaccattctgtcaaaggcattggactctggcttgtctgtgcctcatgattgcaagcttggagtctgcatgacatgccctgctcgcctcattagtggatctgttgatcagagtgatggaatgctaagtgatgatgtggtggagcgtggctatgcactcttgtgtgcagcctaccctcaatccgattgtcatattaagattatccccgaggatgagctattgtctttgcagttagccacagccaatgactacattttattgatgcttgaaatacaacatttgactcaaattagaatagacaccaactgcccaacactgctgataaatggttatctagcacaatga

SEQ ID NO: 9366 - DNA, 534 bp, Glycine max
  Peptide Sequence Number=SeqID_126144
atgagagtttgtggcgatctattctacaagtttgaacgcagttccaaggagtttgaagagtataatttagatttgcaccggaagaaatctttcaagaaaaaagaggagctaaacaaagctaaaacaactccaaatgtggtttccaaagatcacaagcttcccagagttaatgaattgacaagaagtaaaagtgttgtgccccgggtggaagaaatcaatgatgggtctactgtgaacaagaggcagaggacacccacgtttaaccagcttacggggccttatcatgaaccgctttgtttggacattttcgtatcaaaagcctgggttcgtgcttgcattgttcatagggtaactagcaaggttgtcgctgtggcacattccatttccaagggcatcaagtttgacctggcttctaccaagaacaaaaccacttgtgctgctgtgggggcaattctggctcagagagcattggctgatgatatccatgacgtaatttacactccaaggaaagaaagggtggaggggaagctttag

SEQ ID NO: 9367 - DNA, 2916 bp, Glycine max
  Peptide Sequence Number=SeqID_126145
atggaatccggcttgagatcgggtggttctggggttgtggtgaagagcagaaactcatctggttgtttaattgtgcgaaagaaaggggatgggttgggtgctactgcttccacctctcgcaagctctatgaatccaagaaaaggccaaacatcaacgtgtcattgagtgattctggatcaagcgaggggtcactaatacctcctggtagaaggcttggtcccgagactattcgagtttgcaatggtttggctgcctctgagcggggtgggactgaaattagtcgaaagagggatagagtacaacgaattaaaggtaatggggagggtattgctgcggagaaagggttggagcagtgggaaagaaagcgtagtaagttgggtgtgtacgattttgatgattacgatggcatggatttggagaacatgaggaggaggcatttggatggtcatggaggaggaagctttatgggatcagtgcatgctgctagaagtggcattgatagggaattcataacaggttcaagtgtacgaattcttgataagagaaagaactcttacggtgacagacctagtggcttgtatctgggagataatgttgatcacagtaggtacaagataaacagggatggagtctgggtacctctacgcttgcagagggaaaagtttaattcagatgagtcgattagggttcaggggaagaatggtgttttgaaggtaatggttaataagaagaaggtgggtggtccatcagaacaggattatgatcatcacaaacctgtggaaggcaggcaaaggttgaagactgaagagactgctaagaggttgatgactgaagagactgccaagaggttgatgactgaagagactgccaagaggttgaagactgaagaggctgccaagaggaatgttccaattcgtcctttgtcatacttggaaacaaaacctgttgagaaaccaggattactcaagaggccagagaataaaaggatagcatcaagaaaatcgttgtcaagcaaggacagtaagggcgatgagggggattcagataacagtgacacatcattgaatttgggaataagaaatactgaagcacggaagccagcaaaaaatgtaatgtctgaggatgagcagactcctgtgcatgaaaaactcccaaccacaagaacaaaagaaggaaaaatcaagcgtggaagtggtacagaaaaacagaaactgcgggaacgaataagggagatgctgctgaattcaggttggaccatagactatcgacctagaaggaacagggactatctggatgcagtttacattaatccagcaggtacagcttattggtctatcatcaaggcctacgaagcacttcaaaagcaattgaatgaagatgctaatgaggccaagcccaaaggggatagttcttcttttgctcctattgcagatgaggtgctcaatcagctaacaaggaaaactaggaagaaaatggagaaagaattgaaaaagaagaaaaaatatgatagtgaaagtgataatgaaaaagagcctcaaataagatctgccagcaacaagcgtgatttgaatagcacagatggtgataacaatgaggagaaattaagctcctttataaagcaggggagtaagtcaatgaaaaataaaatgtttgaagataccattatgagtgcttcctctaaaatccagaatgctaccaatcactcaggtgatggaatagaaaaatcattatttgaatgtgatcctcagatacacggacggaagagtaaaaaacatggaagatgtaccttgttagttcgcagttctaagaaaggatcaaattcagaatctgatggctttgtaccatatatgggcaaacgaacggttctttcatggttgattgactctggaacagtagagttaagccaaaaggttcagtaccgcagacggaagaaagtcatgctggaggggtggatcacaagagatggcattcattgtggctgctgtagtaagatcctcacagtttcaaagtttgagcttcacgcaggaagcaaattgccacagccatatcaaaatatatatttggaatctggagtttctcttctacagtgccagatagaggcatggaatagacaagagcattctgaaaaaatatgtttccattcagtggatattgatggcgatgatccaaatgatgatacttgtggtatatgtggagatggaggggatttaatctgttgtgatggttgtccatccacatttcatcagagctgcttggatatacagatgcttcctctgggtgaatggcattgtccaaattgcacctgtaaattttgtggcatagccagtggaaattctgaaaaagatgatgcatctgtgtatgtcctacaaatttgcaacttatatcatgactcttgcactaaggagatggataaccttcctaataacatcaatacatcaagcctttctttttgtgggaaagagtgcaaagagctttctgaacacttgaagaaataccttggtaccaagcatgagctggaagccggtttttcatggtctctcattcataggatagatgaagactcagaggcagcttgcaggggtattagccagagggtagaatgcaattccaagttggctattgcactgactgtgatggatgaatgttttttacctgttattgatcgaaggagtgggatcaatttaatccgtaacgttttatataatagtggatcaaactttagtcggttgaactatagtggcttttacactgctactttggagagaggggatgaaatcattgcttcagcatctatcagggcaaactgcagaaacaatagaagttgggagagtgaaaggtttttcagttgcaattggattgaaagtccacccactttccagatctaccttagagaagtgagggaactaaggaaataa

SEQ ID NO: 9368 - DNA, 1534 bp, Glycine max
  Peptide Sequence Number=SeqID_126146
atggttgatagcaatccttcctctggatcacccgaagaaacacaaaatcccaacccagatgggaatgcacctgttgaaagtgatcttgcattggagaatctagcccaaaaagttcaagaatctctctctctggaaaaaagacataaattttgggaaacccaacctgttgggcagttcaaggatgtaggggactccagtttgccagaaggcccgattgaacttccaacccccttatctgaggtcaaacaagaaccatacaaccttcctgaccactatgaatgggttacttgtgacataaactctgaggagacgtgtgatgaggtatacaaccttcttgctcataattatgttgaggatgatgagaatatgtttcgatttaactactcaaaggaatttctgcgctgggctctgcaacctccgggttatttcaagagttggcatattggtgtccgtgttaaaagttccaagaagatggttgcctttataacaggtattcctgctagaatccgagttcgtgatgaggttgttcatatggcagagatcaattttctgtgtgtccataagaagcttcgaacaaagaggcttgctcctgtcatgatcaaagaggtcaccaggagggtgcatctggaaaatatgtggcaggcagcctacactgctggagtagttctccctacaccaataacaacttgtcaatactggcacagatctttgaatcccaagaagctaattgatgttggtttttctcggcttggtgcacgaatgacaatgagtcgaaccatcaagctttacaagctaccagaatcaacaatcaccccagggtttaggaagatggaaattcatgacgttcctgcagttaccaggctaattagaaattatttgagtcattttgttgttgcacctgattttgatgaaaacgatgtggagcattggcttcttccaagggatggtgttattgacagttatctggttgaaagtccggaaactcacgagctgataaatgatgctctcattgtcgcaaaacacaaggattatgatgttttcaatgcattagatgtcatgcagaatgagaccttcttgagggaactgaagtttggaccaggtgatgggaaacttcattattatctttacaactaccgaataaggcatgcattgaagccatcagagcttgggcttgtgcttcttggtaatgacaatgatgatgacatcaatgttgatggtgatgatgtcaacaacaatgacaatgataaagatatcagtagtggttgcaatgacaggacggtggcaatagtggcggtgacattgactgtcgtgataatggtggtaggaatgtcggtggtgttggtggtgacaacatatggtgacaatgtggtggtggcggtgatggaggtggtattgtttgtggtggtggtgacaatgacgatgacattgacatttggtgacactggtggtggtagcaatgctggtggtggtgatggtggtgataaaagtgttgggggtcgtggttgtggtaatggtggtgatggtgataacattg

SEQ ID NO: 9369 - DNA, 834 bp, Glycine max
  Peptide Sequence Number=SeqID_126147
atggaggctgggattttcagtaactccaacaagtgttaccccattatgaatgtagatgaggtgattgatctgttattcaagggtgatgacatccccgcttggaaatacactgccaacggagaattcaccgtcaagagtgcctcctgtgctatttcctcaatagatgaggtgattgatctgttattcaagggcatttggaaatggcagggtccagagaggatcaagattcttttatggaaaatggctaacaaagggattctcaccaaccaggctcgtcttcgaaggggcatgacagatactgcattattcccgatctgcaataagaatgatgaatctatatcccactgtcttagggatttgaaatatgctccaacatcgagaatgctagaccaagtacgaaagatgtttggagtattattttctgtgtttccatctcggtctggtggaggaataggaatgatgtgcttgggagtctgcttgtttactcaagccaaacttcatgccattagaattggtcttaagattgtagctatgagaggcttctctgatcttgatattgagtctgattcgttgacaactatcaaccttattaagtcagggtgcctccctgagcatccttgcaattgcctagttgaccagattaaggatatggccacttgccttgctatttcttcttggaagcatgtttttcgcaaaactaatcaagttgcagatgctcttgctaaatatggtttgtctatagataatggttgtatctttgatgttaatccgtcctttattactctgaaagtcatagctgatgtagcttcgacgaccttttttagaggcttttaa

SEQ ID NO: 9370 - DNA, 3729 bp, Glycine max
  Peptide Sequence Number=SeqID_126148
atgacacgggggaggataagggcgaggctccggaggagccatctttacacatttggttgccttaagccttctaccactgaggaggcacctcatccacttaatggccccgggttctcgcgaactgtgtattgcaaccagcctctacttcatgacaagaagcctgtattgtactgcaaaaatgatatatccacgaccaagtacaatgttattacgtttttccccaaggcactctttgaacaatttcgtagggttgctaatatatacttccttttggctgcatgtctgtcagcctctcccatttcgcctttcagcccactgagcatgattgctcctttggcatttgttgtggggcttagtatggcaaaggaagcattggaagattcgcgcaggttccttcaggatgtcaaagttaatcgccggaaggttaatcgccataaaggagatggtttttttagtcccaggtcgtggcagaacattatggttggggatgtggtcaaagtgaacaaggatcaattttttccagctgatttgcttctcctgtcctcgagttatgaggatgggatttgctatgtggagactatgaatttagatggtgagaccaacttgaaggtgaaaagatcatcggagaccaccatgactctagataatgatgaagtttttaaagatttcactggaacgatacgttgtgaagacccaaaccccaatctttacacgtttgttggaaacttagagtacgagcgccagatttatcctcttgatcctagtcaaattcttctccgagattctaagctcaggaacactgattacatctatggggtggccattttcactggtcatgacagcaaagtcatgcagaattccacaaaatctccttcaaaaagaagcacaatagaaaagaagatggattatatcatatacaccctcttcactgtccttattttgatatctgttattagttccataggatttatcttcaagactaagtaccaagccccaaagtggtggtatttacggcccgacaatattgaatatcagtatgatcccaacaaagttggactggctggaatgagtcatctgattactgcacttattctttatggatatttgatacccatctcactttatgtttccattgaggttgtaaaggttttacaggcaaccttcatcaaccaagacattcaaatgtatgatgaagaaactgggactccagctgatgcgcggacatcaaatttgaatgaagagttgggtcaggtagatactatcctgtcagataaaactggaactttgacatgtaaccagatggactttttgaagtgctccattgccggtactgcatatggtgtgcgctccagtgaagttgaagttgctgcagcgaagcagatggcttctgatcatgaggaccaggattcagatctctccaatttccccatgcctaagagtaaagcacgcgtttcatgggatgatgttagaaaagctgaagaaattgaactggagactgttgttacttccaaaggagatgaggatcaaaagcatgccataaagggatttggttttgaagatgaccgcctcatgaattgtaattggttgaaagagcccaatgcggatgaccttttgatgttctttcgtatattagcagtttgccacactgccattcctgagctgaatgaggagactggtgtttatacatatgaagctgagtcacctgatgaaggggcttttcttgtagcagcaagagaatttggctttgcgttttgcagaaggactcagtcaagtattttcatacatgaaagattttctgcttccgggcaagtggttgaaagagagtacaaacttttgaatctgctggatttcactagtaaaagaaagcgtatgtcagtgattgtgcgtgatgaggagggcagttttcttcttctttgcaagggagctgacagtatcatatttgatcgattgtcaaagaatggaaaaaattatttggaggctactaccagacatctaaatgaatacggagaagctggtttgagaacactagccctggcttatagaaagcttgatgagcaagaatacactgcttggaacaatgaatttcagaaagccaaagcagctgttggggcagacagagattcaatgcttgagcgggtatcagatatgatggagaaagagttgattcttgttggggctactgctgtggaagacaaactgcagaaaggggttccccaatgtattgataatcttgctcaagctggtctcaagatctgggtgttgacaggggataagatggaaacggcaatcaacattggatttgcttgcagtttgcttcgacagggtatgaagcagatctgtataactactcctgttacagattcagtagccactgatgtcaaacaggctatcaaggacaacattttaaatcaaatcaccaatggttctcaaatgataaaactggagaaggatcctcatgctgcatttgctttaattattgatgggaaaactctgacatatgctctagaagatgatatgaagctcctatttttgggattggctgttgattgtgcatctgtcatctgctgtcgtgtgtctcccaagcaaaaggcattggtaaccaggttagtgaaacaaggttctgggaagactactctagcaataggtgatggtgcaaatgatgttggcatgattcaagaagcagatattggtgttggaattagtggggttgaaggtatgcagaattcggtcagaaactataattggcccatactcaagcctgcaactcccttccaggcagtgatggctagtgactttgcgattgcccaatttcgatttttggagaggctcctggtagtccatggacattggtgttacaagagaattgcacaaatgatatgttatttcttctacaagaacattacatttggtctcaccatcttctattttgaggccttcactggcttctctggtcaatcggtttatgatgactggtacatgatattgttcaatgttgttctgacatcgttacccgtcatttcactcggtgtttttgaacaagatgttccgtcagaagtttgtttacagtttcctgcactatatcaacaaggacccaagaatttgttctttgactggtatagaatattggggtggatgggcaatggtctctatgcctccctcatcatcttcttcctcatcgtcaccatcttctatgaccaagcattccgtgcggatggccaggtagctgacatggctgctgttgggaccactatgttcacttgcatcatctggactgtcaactgtcagattgctcttacaatgagccactttacatggattcagcacctgtttgtatggggtagcatagccacttggtacatctttctctccttgtatggaatgctctctccagaatattccaagagtgcctaccaaatactggttgaatctcttggtcccgcacccatttactgggtaacaacccttttagttacagttacatgcaatctaccttattttgctcacatatccttccaaagatgtttcaatcccatggaccatcacattatccaagaaatcaagtactacaaaaaggatattgaggatcaacacatgtggacaagggaacgttctaaggccagacaggaaaccaagattgggttcactgcaagagtggaagcaaagatcaggcaactgaagggaagactgcagaagaagcaatctaccttggctatttcagccccatcgtga

SEQ ID NO: 9371 - DNA, 1431 bp, Glycine max
  Peptide Sequence Number=SeqID_126149
atggaacctcgagttgggaacaagttccgtctcggtcggaaaattggtagcggatctttcggagagatctatctcggaactaatattcagactaatgaagaggttgcggttaagcttgaaagtgtcaaaaccaagcatcctcaattgttgtatgaatccaagctgtataaaatactgcagggaggaaatgggattccaaatgtgaaatggtatggtgttgaaggagagtacaatgtgctcgtgatggatttacttggccctagccttgaagatttattcaacttctgcagtcggaaattgtctctcaaaactgttcttatgcttgctgatcagatgctaaatcgagttgaatttgttcattccaaatcatttttacatcgcgacatcaagccagacaacttcctcatgggtttagggaggcgtgcaaatcaagtgtatattattgactttggcttggccaagaaatatagagacaccactacacatcagcatattccttacagagagaacaagaatttgaccggaactgctaggtatgctagtatgaatactcatctaggaattgagcaaagccgtagggatgatttagagtcacttggatatgttcttatgtactttttaagaggaagtctgccttggcagggattgaaagctggtactaagaagcagaagtatgagaagattagtgagaagaaagtttctacttctattgagtctctctgtcgtggctatccctcagaatttgcttcatacttccattactgccggtcactgaggtttgatgataaaccagattatgcttatttgaaaagacttcttcgtgaccttttcattcgtgaaggattccagtttgattatgtctttgattggaccattttgaaatatcagcaatcttcaagtgtcactgcccctgcccgtgctattggtcctgctgctggaccaagttcaggcatgccaccactggcttcaaatggtgacggacagttaggtggagaggatggtaatggtaggcctactaattggtcttcatcagatcctactcgtaggagaaactctggaactattgctaatgacggaatcttatctagacaaaaaggcccagttacatatgactcaactggatctaaagatgctatgttgtcaagttctaatttcttctggtcaagtggaactgcaaagcgaggtgctgtctcaggcaaccgtgatgtagttggcagtgagaccgaggcctctcgttctctgatcctggattcaagtcagggagcacttcgtaaaatccctgcccctggtgctcagagaagttcagctatcatgtcatctgagcacaaccgaacatcctctggcagaaacacatccaacataaagaatttggagacaactcttaggggtattgagagcctgcatttcaatgacgagagggtacattattag

SEQ ID NO: 9372 - DNA, 777 bp, Glycine max
  Peptide Sequence Number=SeqID_126150
atgaatagcagtttagactccttggagtctttatgttcagagtttggtgaccaatatcgctatagcaggctcatcataacaacaagaaataggaaattgcttgatggaaaagttgaacgtagatacaagtacgtcaagcatgtagagaagatcctggaaaaagataatgaagctcatgaagtgattaaatcaaacaagggaactgatgcaattcaaggtatagcattaaatttgtctctcattaaagatttgcttttgcatgctgacacgttcacaaagatgaaaaccttaagatttctgaaatttcacaacaccttgggtcagagttctagtaatacatacctcgaccttcctgctactcttgagccattttctgatcaactgaggtacattgagtggattggatacccttttcagtctccatcacctttctttgctaagtttcttgttgagattccaatgccacacagcaaacttaaacaactttggcaggggatccaggaacttgactatttacaggaaattgagcttggtgaatgcaaacagtttgaagaagttccagatttgtccaaggcacctgttacaattaatgactcagcccaaagcaatacagagcaaagcataatcaagcatggtgagcaaggaatagaatcaaacacagaagcaattcagggagcagaatccaagccagaaacagggaccagcatggaaaaagcatcaaagccaaaaaggggaattattaagcctcggtgcctcaaggattttgtggaaaaatag

SEQ ID NO: 9373 - DNA, 612 bp, Glycine max
  Peptide Sequence Number=SeqID_126151
atggcaatcaagttcattgccattcccgacaaggacgcgcagaggagccgacaaggcgtaaagtttccggggcggagtgacccactaaggcacaaaagcttatttgggtcttgggctgttcgggttggggcgggtcttcgggttccggttaaagcagagtccctgctcgcggtggcttgccatttcggcgggggtggtggtttcggtggagttggtaacaaaggaagtggtgagggtgcaagggaaggtggagagagaggtctgggtggcgtgaccacggaatggccggcgagtgtctaccagcttctcctcctggagtcgtgcgagcccgatggcgtggacaatggtgagggacggcgagaggccaacaatgcggttagccaaggcctcgaattgcgtcaggtactgagtgactgtccctttttgcgtgagcttgaagaggatcccggtagggtcctcgtatggagaatgcgcaaaacgggcctcaacggcttccagaaagcttggccaggtggtgagttggtggttacgggtgagccattgaaaccatgccaatgttgggccctccatgtaggaggcgatggtaagcttttcagattcgggggtggaatg

SEQ ID NO: 9374 - DNA, 1125 bp, Glycine max
  Peptide Sequence Number=SeqID_126152
atggcggcaaaagacctgtattattacccgaaacaaacaacaaacaaaacaatgttgacgactcgtcaatttaaatgtatgctggagaagcataaattatttttacttccggttcgatttcaatctacttctaactggatttctcactttgcaaatacattggatatgccggaaaataaaagcgagaatcgtgctaaaatagaaagtttctgggaaggtgctttaaaggatatttacgaagaaacactaatgtatgataataatgatgtggtccacagtccggatgaatgcgttgatcctgaaacacgaaaaataaaagtccctaaatcagagtttgttaagacatataaaaatagcgtcttttctcttctggaccgttatagatatgaaaataatgatgcacaaacattagaatcgcttcagagagaaattgaggatctgactttgaacttctctgaagataaatatcccggcagaatgaccatttatgcagaaagtcgaagtggtgatagtctagaaaccagcggctcagagctatccgacgaggagaataaaaatctaagatgtgtactatctgaaagtgataagtcgttgttggtagagttaggcgagcactccattgagtgcctactggttcacaccctaggccatctgtttaatctggaaaatattgtcagtcttgctagtttggttgatcgtatagaacgcaatgtaagggattatgcctcatcgtcaacattgtattataatagtagggtatgtaatctaagtatggatgctgttgataaaggtactaaagcatctaaaactagagcttatccctttggtacagcattagttgaatttttagtgagtcgtggtctattgcgcttagtaacatataatgttgatttattaaatttctctgatgatagtggtccaaagactgttgtcaaaaatgttgtcaaaaagggccataattactataggagctctttagtatatgccgaatgcttgtttaaccccgcattacttcctataaagttaaacctacctatggtatttccacctaaagattgggagccccacaaacctgaacagaaaccaaccctacgggccaaatctacagcactcaacggagtatga

SEQ ID NO: 9375 - DNA, 936 bp, Glycine max
  Peptide Sequence Number=SeqID_126153
atggcgaagacggaaagggacagcagacggagcgtcagggacatgacagttctcgattgtggaatgaaggcacgcggtgaccgcccatggcagccagtgcgaccagtttcgatgcgcgcgccaggccgcggaatgcaacaaactgcgcggcctcgattcgttgccgaaggaatcgccatgtgcgttcccatccttccctccgccgctgcgcggcgcatatcgcgtgtgccagcgttggtggcgctactgatgatcgctgcgatggcgctgcaagcacagcaggccaacgcgagctgtgtgaggttgaatccgggtgatcaggatctgacggtgtcgctgacgatgccgaacattgatcggccggatacgcgttacagagtgttcaatgctggccagattcctggtggcttcgaatgcacggcaggacaaactgcattcaacatcgatgcaccactcacgggtctcacctatgtgcgggatgttcagatggacagctacctctataaggtctacagcacaggaccaagatcgccactgattggtttcagcttcagcgtgaagaaaagcagccagggaagctatggcggtcctcccatcgagctcggagttcgcaaccgacaccccggagaatctgtcacccaaacagagccgatgaacgtggatgtctacatggtgatcttcttccgcggcggtgccatggagagcattcccatgaccgacctgggcaccatcacctcgtcggttgaaggtgatccaagccagtcgatgcagcaccatgtgcggctggaaatcatcgtcccccccgtcacctgcacgctcgccaacgcctcccacaccctcgacgacgttcttgccaacgaactcgccgccagcggcagcaacgcgaaggaatccagcttcgacgtcgcgatgaactgcccgatggacaacatcgat

SEQ ID NO: 9376 - DNA, 1353 bp, Glycine max
  Peptide Sequence Number=SeqID_126154
atgcaggttgcatcatttacaggcgagagtcaagctacagctcaatacaatcaatccttaaccaaagcttacaggactgcagtgcaagatggagtggttgctgggaggataatagacagtgctaagattcttgcttggagttttagtgattcaaaattttcaattggtgatgcattagtgacagaaaatttgccttcatttgttcatcataaaaagtggtttcctggagcacaagctttcgcggtagcatttttcgttctccgcagaagaaagacacaagaagaagttgaagattgggaactggagtattggcctcacaggataggtttccatgagatcgatgcagcaacaagggggttttctgaagagaatgtggttgttgtaggagggaccgtgaaggtatataaaggggttttgcatggggtagaagttgcagtcaagagaattcctcaagaaagggaagaagggatgagagagtttttggccgaggtttcaagccttggcagaatgaagcacaaaaatttagtaggattaagaggctggtgcaaaaaagaaaagggaaatttgattctagtttatgacttcatgagcaatgtaagtttagacaaatggatatttgagtgtgaagagggaatgatgctaacatgggaagagaggattcaagttttgaaaaatgtagccacagggattctatacctgcatgagggttgggaagttaaggtcttgcatagggacattaaagaaagcaatgttcttcttgataaggacatgaatgcaaggctgggagatttcggattggctcgtatgcatgatcatcagggacaagtggtcagcacaacaagagtaatagggacactaggatacattgctcctgaagtgattcaaagaggaacagcgtcaactttgtctgatgtgtttggttttggaatattggtgttggaagtaatttgcggacgaagacctattgaagaacataagccggggctaattgaatggctgatgtccttaatggtgcaaggccaattgcacagtgcagttgatgaaaggttgaaggctaaagggggatacaccatagaggaagaccctagtattagaccaacaatgaggcaggttgtgaaaattttggaggtggaaattgacagcattgagtctgatgaagataacatggaaatgagtttgcttggaaaaataagatcagctactacgtggtctagagctgaatgtgctttaccatacagtggttacccttcttttgatgaagttaagatgttcagttttaattctaggacttctagaagtggctcaagtacctttccaggatcaggatcagaaatcaccagtattaatatgtaa

SEQ ID NO: 9377 - DNA, 435 bp, Glycine max
  Peptide Sequence Number=SeqID_126155
atggcaattgctaggggcaccagcaacattgctggtgcacccagcaattttttaaaaacccaaaaatgcccctgtactttttccttgtataaaaactattttttttcattcttcctttttgctttctctctcctgcgtttcctccactctggtgtgcgttttctccattctggtgcttgtgctgtgcgatttttgtcgatgttggatgtgcttgtgctcttctttggtgtgatatttgtcaaggaacacattacaactacggaagaaaaaaacttgttccgaggaatcacgcggaagacgcctttcatggacgaagatcaatgggcatattacagtgcgatgtccgaagaagttgatatggattttcaaaatgaagaagattgtggtgtgaatgaagcacatgttgattgttcagatgcttttaatacttcttag

SEQ ID NO: 9378 - DNA, 944 bp, Glycine max
  Peptide Sequence Number=SeqID_126156
gcattaaattcttcgagtattgatcgtgttattgtttctacagattgtgaagatatcgctgccgtagccagagaatatggcgcggaagtcccgttcatgcgtccggcccatctggcgaacgataccgctgcgactgagcccgcgcttttgcatacgctggagtggttggctgaacatgagagttaccaccctgagtataccgtcctgttgcaggctacttctcctgttcgcaaagatgatgcgattgattctgcaatcagaaagattcttgaaaagaaagccgattcactgctgagcgtatgtgagttttggcatttcttgtgggaaaatgaagataatccgaaagcctattacgactacttaaaccgtccgcgtcggcaagatattaagcctgaaaatatcaaacttaaagaaaatggttcaatttacgttacgaaaagcgaaattctcctcagtaccggtaatcgtcttggtggcaaagttgtagcgcataagatgtcggaagaggaaagctttgaaattgacaccatgctggactgggcggttgttgaagtaattttgaaaaattggaacggcaagctgtgcggctctttctcagacggtgatttccgtcgttggatcactaacggtgacttcgatctgagccgcgaaatgtcggaagtgatgaatcagaacgtccgctataaaaaagtggatgcgccacgcaatgagattgaatcgctgttttcgaatggcgttgacgttctgccgctggttgatgattatcgtcgtttggtcgccgttgcgctgcaaagcgaaaaaggcctgacgattggcaaacacactatcacggaaacctcgccgacttacattattgctgaaattggcaacaaccataatggcgatattaagctggctaagcatctggttgacctggcggttgacgcgggcgccgattgcgtcaa

SEQ ID NO: 9379 - DNA, 426 bp, Glycine max
  Peptide Sequence Number=SeqID_126157
atggttatgggagatttcatcagcagactctccttccccgcatgtttgcattttagtggagaaaacaccgagactttttcaagtctcacaagttatccagaactacgtaggtctgagttcctcattggaggatacgtaggagcaagagcctcgcttttgtcgaccacaccgccttttgttgccatgactcaagagctggtagcccgcggagacaccttacggttatccgcacctcgtcattcagtgatcccaagtgtgattgacgagcagagaccaatatggtcatctgcgccctttccggagatgtcagcattttccgatggagacttttcaagtctcacaagttatcaagaactacgtaggtctgagttcctcattggaggatacgtaggagcaagagccttgcttttgtcggccgccccataa

SEQ ID NO: 9380 - DNA, 399 bp, Glycine max
  Peptide Sequence Number=SeqID_126158
atggacgaatgggctttaaccatccaagaaattgatgatcaaattcaatcaaaacggattgagaaatccagtacacttgaaactgtgcagaagagaaaagctgagctgacctctaggctagcaaatactgccaactcaattccaacccttgttcacgagattcagcttctattatctcaaatatcaaaatgggagcaggagaaagccagcaatgccaagcgtgtagctgagatagaagaaaaaaacatagctagttgcggcagtgatttacgtgttatctatatttctaaccaatgggtttacatctatataatgtggcttttagacttggtgacaatccctgtagttgtggctctagacctcgtgacaatccttgtagttgtgttatcaagtctttaa

SEQ ID NO: 9381 - DNA, 1365 bp, Glycine max
  Peptide Sequence Number=SeqID_126159
atggatattctattttggccagtatttgtggtggctgctttggcagtaatagttgcaagtcaggctgtcatcgcttcaacattctcaattgtccaacaatgccatgcatttgaatgtttcccacgggttaaggcagtacattccagaaggtggatccctggtcagacatatatacccgagataaactggattcttatgataatcagcttggttgtgacagttggtttaggagacatgagtaatataggatacgcttatgggatggcatatctgattgtggtgtttgtgaccacatgtttgacatcactagtcatcaaccttgtatggaatcaaagtcttatagttgctctggcatttgccttattctttggcgcaatagagattctcttcctgtcatcttattgcatgaaaatccttaaaggtagctggattccactcgtgctttctgccgtcttcatggttgttatgtacgtgtggcattatggttctaggaaaaagtatttatttgacatgcttaacaaagtttcaatgaggtcgatcattacattaggtcctagtcttgggattgttagggttcctggattgggccttatctacactgaattggctactggagtccctgccagttttacccatttcttgacaaatctgccagctttctaccaagtggttgtttttgtttgtgttaagactgtacctgtgccttgtgtgccacatgaagaacgatacctcattggccgaattggtcccaaatcttaccgactgtatcggtgcattgttcgaaatggctataaagatgtgtatagtcatcaaaatgattttgaaaatgacctggtgatgagcatagcagaatacattcaattggaagcagaaggttgctctggaaatgcagagggttcagtggatggacggatggcagtggttaggacctcggggaagtttgggacaagattgcgtatgtcagaatctgctggttttgaagaaggctgcagtattagtcttcccggagctttgactgttactagtagtaaatctccagcattgaagaagctgcaggccatgtatgagcaggaatcacctgatgaactcaatactagacgaaggattcaattcgagttgctaaatgtaatatataaagatccacgtgtcaaggaagagctcatggaacttgtagaagccaagcgcgctggagcagcgtatgtaataggtcattctcacgtaaaggccaagtggaactcatcatttctaaagaggtttgctatcaacctctactcttttctccgaaaaaattgccggtcacctgcagtaggactaaacattcctcagatttctctgattaaagtaggaatgaattatcatgtgtag

SEQ ID NO: 9382 - DNA, 1038 bp, Glycine max
  Peptide Sequence Number=SeqID_126160
atgcagctgcaattgcgatacggtcatggcaatgcattgcctatagctgctgtaccacttcaacagatagcacaagaagcctatgactccgactctggggatgttgtcaagtgtaaagcaagaaataagaagtgcacaagtctggtgttagaagaaatagaaaaatattcaccagccatgcattgtgatatctgctgttctgaacctgggttttgccgtgattgttgttgcattctttgttgcaaaactgtttcttcagcttatggtggctataattatatcaagtgccaagtgaactctggtgggggcatctgtggccatgttgctcatatggaatgcgctcttcgatgtctattggctggcaaagttggaggaaatattgggctagatgcccagtaccactgccgacgctgtgatgggcggactgatatgatttcgcatgttaataatcttctacaaacatgtagagctgctgatttggatgatgaaattcggaagaagattttgaatcttggtgcttgtctcctgcgtggttcacagaaacctggtaatagaaataaaaatcatcttgcttgttttctcttgcatattgtaaaggcttatgaccaatttgatagtttatatcagcttaaatgtggaactaatcttgaagatatctggaaggaagatgacagttttatagctcattctgcagataacggcaatgatgtgatggaagttatggtctatgacgacccttttgaagttaggacagggttggaatcttatgattttctacctcgttcgataaaacttgagtctgaggttgatcaggttctacgagctctgagaaagtcacaggagcttgaatataaggtagcggaagaaacacttcaagaccaaaagacttacttaaaaaatttgtatcagcaactggactgtgagaagtatgaattggcttgtcaaaactcatctacctcagatgtctcgtctagtgctgtaagagaaagaaagaaacagataagacgggaggtggcaaaatttgaaatcatgaaaaag

SEQ ID NO: 9383 - DNA, 222 bp, Glycine max
  Peptide Sequence Number=SeqID_126161
atggagaagaagggaaaacgtaccacggttgatgcaccgcgttctctactagcatctgagctcatagcgaagcctgaagaaaacagagcaagcagttttggtttagagagagagagagcgttgtcgttgcgctcgtttttggaaaggaaaaaaaatggaaaatcgactccaactggtgtatattgggaccgcgaaattgcctctaatgtagaacatgtttga

SEQ ID NO: 9384 - DNA, 177 bp, Glycine max
  Peptide Sequence Number=SeqID_126162
atgggactcacggtgtttgctcccccaagccacctttggttgcattttgctttcatttttggtactcctactcactccaacatgcctaaggtgcatcctgaagcaatggggcatgccacattgcccccattctcttgctattcatgccaaaacatgcgcccaccaagttctcggtga

SEQ ID NO: 9385 - DNA, 495 bp, Glycine max
  Peptide Sequence Number=SeqID_126163
atgaagagttactattgcttagtagaggagtatttaggaacggtgacaaaataccagaatgatcctttgctaatgcggcttatatctaagcatttgtacttggagaggatttttgatgattcaacctctaataatcctacattaagatggagataccggaatttctttagcgataatgcagtcaatggtcataggacacatgatcgtgaatctaatgataaatcccaaggcaggtctgaaaatgtcaccgacagcaaaagaacaaatcttaagaccaagcgtacttttaaaaacgcgagtcctgatattatgtcggagggtgaccctcttgattgtctttttggttatgctcctccggtggaagagatccatcattcaaatttcccaaataaaccatcaggaatacataatcgggctcgtagaaaatctcaccgtaggcgtcggatgcataatcatgaggacctttcaaactctgagtctgcagcagctgtttga

SEQ ID NO: 9386 - DNA, 363 bp, Glycine max
  Peptide Sequence Number=SeqID_126164
atgatggatttatcaacatttaccaagaggttgaggggaacaataatgcacatatgtgctgaacttgaagcaacaaggatatatggactaagcaagcttgatctcagtgcccttttcgagcaacagtatcctatgatcttttgtaaaggctcaaattacttaccagtcacatatttgagttattgcttgccgtgggggcaccaaagatttcagtatctagacccagtgaacttgtcgtcccagaagtggggcagaagaaagaaagaatggaaagtaaatgcaaccgttactaatgataagtcagctgctgcagtgactgctttcagaaatacaaagttaagtctttatgaagtaaaaggctaa

SEQ ID NO: 9387 - DNA, 1464 bp, Glycine max
  Peptide Sequence Number=SeqID_126165
atgaagacttctggtacggagccagatgctattatcctttgtactgtgctttctgcttgtggccacgctggaaatttaagctatggcaaattaattcatcagttcactatggataatggttttcgtgttgactctcatctacagactgctcttgttaacatgtatgcaaattgtggtgctatggatttggctagggaggtctatgatcaacttccacagcgatgctttcggggtatgcgaaacttggaatgggctatgatatctggttatgccgaaagtgatgagcctctggaggctcttcaattgttcaatgaaatgcaacggcgaataatagtgcctgatcagatcacgatgttgagtgtcatctctgcttgtactaatgttggtgcacttgttcaagcaaaatggattcatacatacgcagataaaaatgggtttggaagagctctgcctatcaacaatgccctgattgatatgtatgctaaatgtggaaatttggttaaagcgagagaggtatttgagaatatgccgagaaaaaatgtgatatcttggtccagtatgatcaatgcttttgccatgcatggggatgctgacagtgccatagctcttttccataggatgaaagaacaaaatattgagcccaatggggttacgtttataggtgtcctctatgcttgcagtcatgcaggtttggttgaggagggccagaaattcttttcctccatgatcaatgagcatggcatttctccccaacgtgagcactatggttgcatggtggacctgtattgtagagccaatcacttgagaaaagccatggagcttattgagacaatgcctttcccgccaaatgttatcatttggggatcccttatgtctgcttgtcaaaatcacggtgaggttgagttaggagaatttgctgccaaacaacttcttgagttggagcctgatcatgatggggcccttgtggttttgtcaaacatttatgccaaagaaaaaaggtgggaggatgttgggctgatcaggaaattaatgaaacataaaggaatctcaaaggagaaggcatgtagtaagattgaagtgaacaaagaggtgcatgtgtttatgatggcagatggatatcataagcaatcagatgaaatatacaaaatgttggatgcggtagtcagtcaactgaagctggttggctacacacccagtactttgggcatcttggttgatttagaagaggaagagaaaaaagaagtagttctctggcatagtgagaaattagcactgtgctacgggttaattggtgagagaaaagaatcatgcattcgcatagttaaaaatcttagaatatgtgaggactgccattcctttatgaaattggtctcaaagttgtatcgaatagagattgtcatgagagataggacttggtttcaccattttaatggtggaatttgttcttgtagagactattggtga

SEQ ID NO: 9388 - DNA, 360 bp, Glycine max
  Peptide Sequence Number=SeqID_126166
atggacgacggtgacgatctggcggcaggagttggcggcggcgcgctcggagtagtggctcttggtgatgatgcggtcgaagagctcgccgccggcgcagagctccatgacgaggttgacggagtggcggtcctcgtaggcgcccttgagctcgacgatgttgcggtggccggtgaggtggtgcatgatctgcacctcgcgccggatgtcgtcgatgtcgtcgcggttcgagttcggagggaggacggtgatgccgttgcggcggggatggtcgtcggagtaggtggtgctgccgattccgccgccgccgctgcagttgcccatggactaaggactaaaatggactttgctgctgcataa

SEQ ID NO: 9389 - DNA, 2172 bp, Glycine max
  Peptide Sequence Number=SeqID_126167
atgttcattttggcagatgtttcagttccgaccatgtggttcaatgcaaacagtatgagtgcttccatgatggatcgtcgtgatacttcaggatttgtcagtgggggtggtttcatcactttcatggacgcgaggttcaagaactttttaggatttgctgctaatcattctgcaaatgcattcaagattttgggcaattctatgcaagttgaaggaaggggagctaattatcatgggacagataccatcttacgacttgattcccctggttcttcaattcccacctctgtgccctcttataagggaacaaaaaggaagtgggatttaattgatggatgtatgggtcaaagagttgactcttctttgtcacttgggcttgggcgttcaagcagttcctcagacagcaaggggagttcagctgctgcctgcactgctatgtcttcagccaaagatattgatgaggaatcatctttagatattgaactggacttttctcttcatcttggctgtgagaaggtacacagccagaagaaacctgttaatccaagtttgaagacaatggagctgcaaccaaaatttgatttggagttaagcctttccactgggccctgtgagtcggatattacaagtgtacatctaaatccatcacctcttcaattgaatatggagatgccattagcattcagtgggacacaaaatacagatgagggatcaacttcatgtagttggaagccagggattgctttgccatcttctaagacatcatcaaatacaggcactaattttcttttaaatcagtcttcaaagcagtttgatcatagtcctattgttgtggaactctcgtctaccagaccaaaaagtttggtcacctgcatttctgagcttacacagcagcaacaggcactacatcgccccagtaattctaaaacatgtcaagtagagggatgtgggaagggtgccagaggtgcttctggacgttgtatatctcatggtgggggtaggaggtgtcagaaacctggctgccacaaaggagctgagggccgtacagtgtactgcaaggcacatggaggtggcaggcgatgtgaattccttggttgcacaaagagtgcagaaggacgtacagatttctgtattgcccatggtggtggccggagatgcaatcatgaaggttgtacccgggctgccagagggaaatctggattgtgcatccggcatggtgggggcaagagatgccagagagaaaattgcaccaagagtgcagaaggcctatcaggcctttgtatctcacatggtggagggcgtcgatgccaagctcctggatgtacaaaaggggcacaggggagcacaatgttttgcaaagcacatggtgggggtaaacggtgtactgcaccagggtgcaccaaaggtgctgaggggagcaccccatattgcaagggccatggagggggaaaacgctgtacataccagggtggtggagtatgcactaaaagtgtgcatggaggtaccaacttctgtgtggcacatgggggtggaaagaggtgtgctgtaccaggctgcacaaagagtgccagaggaaggactgatcattgtgtccgccatgggggaggcaagagatgcaagtttgaaggctgtggaaagagtgcacaaggcagcactgacttttgcaaagcacatgggggaggcaagagatgctcttggggccatccgggttcagaatatggcatccaacaggatggtccttgcaattcatttgcaagggggaaaacaggtctatgtgcacttcatagtgggctagtgcatgacaagagggttcatggaggcatctcactgggatctgttgttcaggatcctcattccagtaaaacagatgaactaaagcaggtactcgttgacaaaaacatgggtatagatatgatgaaaatagggagtagtctaggcactgcaacctgttccgacttcgaacagtttgaagctgcaactgctcatgtctcagccaaggaaggtagtcacttgccagtgtcagttgctgttcctgaaggcagggtgcatggtggtagcctgatggcaatgctaacggggagttctagccgtggctcaagcagcggcagaggtctagttggcgatccatctgaaccaatcaaaggttacgccatgccccagagttggatttaa

SEQ ID NO: 9390 - DNA, 546 bp, Glycine max
  Peptide Sequence Number=SeqID_126168
atgcacagttgtggagatgtgtttagagaccttgttgggagtgcttactatgttgctcctgaggtgctgagaagaagttacgggcctgaaactgatatttggagtgcaggagttatattgtacattttgctttctggtgttccacctttttgggcagaaaatgaacagggtatctttgatgctattcttcgtggacatattgatttcgcatcagatccttggccttccatatcaagtagtgccaaagatctggtcaagaagatgctacgagctgaccctaaagaacggctttcagcagttgaagtacttaatcatccctggatgagagtggatggagatgcatctgataagcctcttgatattgctgttttaaccagaatgaaacatttccgggcaatgaacaagctaaaaaaagtagccctgaaggtgggccaagcccaaggggcagatgttttcgctccattgcactttgctccactatattccagcatctgcccgctcataacatatgagccatgcacaacatcatgcaatggaattatttag

SEQ ID NO: 9391 - DNA, 745 bp, Glycine max
  Peptide Sequence Number=SeqID_126169
aggactacacgtcctcgcctccaaagggctacatgccctcgccttaaaaggacggcacgtcctcgccttcagagggctacatgccctcgccttcagaggactacacatcctcgccttcagaggactacacgtcctcgccttcagaggactacacgtcctcgccttcagagggctacatgccctcgccttcataggactacacgtcctcgccttcaaaggactacatgtccacgccttcagagcgcaaaatgccctcgcctgcagaggactacacatcctcgcctttagaggactacacgtccttgcctttagaggactacatgccctcgccttcagaggactacactccctcgccttcagaggactacacgtcctcgccttcagaggactgcacgtcctccccttcagagggctacatgtcctcactttcatagggctacacgccctcaccttcagagggctacacgtcctccccttcagaggactacacatcctcaccatcagagggctacacatcctccccttcatagggctacacgccctcaccttcagagggctacacatcctcccctttagagagctatatgccctcgccttcgtagggctacacgccctcaccttcagaggactacacgtgctcgccttcagagggttgcacgccctctccttcatagggttgcacgccctcgccttcatgggactccatatctgcgccttcagagaactcaaggtcctccacccttaa

SEQ ID NO: 9392 - DNA, 1295 bp, Glycine max
  Peptide Sequence Number=SeqID_126170
atgtccgtggctgaagatgaaaacagtgtaatactccatgaggtactagctctaagcaacctcaacttggtttatgagagctttctcacccagaaagtcatcgaacaaaaagctctttctgaacatctcagcagcaatcttagccgtttaaacagtgacctcaatcaggaacttggtgtgttaaggaagaagtttgagctgaaagaagaagagagtgtttatctgaatgaggctactaagaggatggataaagagctgcgggaaatcaaaaatgcaaattgtcgtttaagtcatcaagttgaaaattcagagaatcttctcaagaagaaagacatagagctgctagaaatggagacaaggctgaaggctgcagagaaattgaatggggagttttgtagatatattgaggagctgaagatggatcaagaagaatcaagattgatcagagaaaacctagacaggcagattcttgaactatcagaaaattgcatgaatcagaaaagagaaattgaacactttaatgaagaaaatagaagctttcagtccatgatgagatcattacttcatgaagttgaacaacacaaggttagagaacaagcactgaatacagagttgcaggacaaaacaaatgaatgccaactttgtgaggctgaggcagcttcgttctatttggagcttcagatttcatccattagtgaagaactgctgaaaggcaaggtcactgagcttactggagttttcaagagacttgatgatgaaagtgctggaaaaggcttgttgattgaacaaatgagagaaagaatcagtttactggaaaaggaaattagaggactgaaggggcagttatctgcatatactccaatgattacttctttgaaagaggattttgcatctctagagcacacttactttcttttgaccaataaaacttttgctgtaggcaacggagaacagaaggatgtagccattgagacttgtctccatgaagaacttagctatcaaagtttaaaaggaagtgaaagctccttaacaccagatggggttgcagatttgctgagcatgcagacgaggattagagtagttgaaaagtttatgatggaagaacttgaaagacgtgtgaagaaggaaagtttgaccgcaaatgtcaaagcagaagctgtaacagaaatgaatgagcattcaaatttggaagttggcacatatccagaaattgacgacagaaaagtggtgatgaaaattaagaaagacaacagcaaacgaggccataatgcatggaggacaaaatctcagaaaag

SEQ ID NO: 9393 - DNA, 1566 bp, Glycine max
  Peptide Sequence Number=SeqID_126171
atggagcttaaatatgggcttcagttgttgaaggatttgcagtttccaaaacagggttttaaggaagaaatgcaagagaatgtggaagaaaacaggatcctgaatgaacttactttctcttccactaggtcgttattaagaaggcagcaaacagaaatctctaaattaaaggagatcaaagagaaactggaacgagagcttgttgtaaactctgaagaaaacaatgccctccagcaggaagctcatcaaataaagaataatatccagctcttgaataataaatatcatgctatgctggaacaactacagactttaggtttggatcctaaatgttttgcagcatctgtgaaagatttacaaaatgagaactcaaatctaaaggaggtctgcaagatggaacgtaatgagaaagaagctcttcatgaaaagtcaaaggatatggatgaacttttgattgagaatgcctttatggaattttccctctcaagattaaatgatgaattagatggattaagagtaacagtgaggaaatctcaagagtcttgccatgttctccaggaagaaaaatctacggtcgttgatgagaaattagctctactttcacagttacaaatagtcactgaaagtatgcagaaactattggagaagaatgccttgttggagaagtccctctctgattcaaagattgagctggaaggtttgaaggctaaatcaactgacttggaagaattctgcaagttgctaaatgatgagaagtacaatcttctaaacgaaagaagcatcctggtatctcagttggaaagtgttgaggctaaactaagaaacctggaaaagttgtttaccaaattagaagaaaaatatgctgactcggagaaggacaaagaaagcacgggcaatcaagtagaagagctccgtgcttcatttttggtgcaaaaggaaaagcatgcaaatcataaacacttgagtgaagtccgactgacaaatttggagaatctttttcatgcactacaggaagaactgtggttggggaagattgaatttgaaaaagaagttgacaaagctgtaaatgctcagatggagatgttcattttgcaaagttgtatagaagatctggagcagaagaacttggccttgttaactgaatgtgaaaagcatgttgaggcatcaaaattttctaacaaagttatctctgagttggagactgaaaactttatgcaactgatggaagaagagtttttgttacatgaaattagaaagcttaaaatggctattcatcaagtgtgtggggctcttcagattgatccatatggtgtgcacgacaaaggaatcaagcaagaggaaatgccaatattgcatattttagacaacattgagggcttgaaaagttcttatgtgaaaagccaagaggagaagcagaagctccttgtagagaattctgtcctcctaacttcacttgagcaaaatcgatctgatagagaaaaaatggagtcagagaaaaagatcatggagcaagagtttgagagcatgagacagaagaatgcaatgttgcagaaaagagaaggttga

SEQ ID NO: 9394 - DNA, 276 bp, Glycine max
  Peptide Sequence Number=SeqID_126172
atgttgatgttggatcaatttcatccgtgcattcatgattccattgaaaatatgatcgatgtcaaagctgacggtaatcgtggatatcgtgcaattgttgccttattaggtatgggtgaagattcatggtcattggtgcgtaatcatttgcttaaagaacttgtcgaatggtttgatgagtatattaacctccttggtcgcacagacagatttaaggaattaaagaggtccctacttgttgatggattatccatgtttttatggataagtggatga

SEQ ID NO: 9395 - DNA, 261 bp, Glycine max
  Peptide Sequence Number=SeqID_126173
atgggtaaagcgaaggaggtacaagagcagatggaggccgacatggaggccatgaaagagcaaatggccgcaatgatggaggccatgatgagcatgaagaagataatggaagccaatgcggttgcagttgccactaccagcgctgttgctaaggtgaacccgacgtccccatccggcatcaacccaatgaatcatccaacctcagatatgataggcaaagattttggaagtatgggcggcccccattatgcgcaaatttaa

SEQ ID NO: 9396 - DNA, 192 bp, Glycine max
  Peptide Sequence Number=SeqID_126174
atggtagacacgcgagactcaaaatctcgtgctaaagagggtggaggggatctttcaattgagaagatccatcgacctgagacgaagagaaagaaaggaagatctgtttgggaagtaagaagttcccttgacatctcttcatctgtaaagaattgtcgatgtgaaacacagagacaaaaggctgatctttga

SEQ ID NO: 9397 - DNA, 312 bp, Glycine max
  Peptide Sequence Number=SeqID_126175
atggttaatatgaatgaacaacatgttgattgttcggatgcgttcaatacttttcagtggactcgatcagttgctcatgaaaacagatttgtgacggtcattatgagatctgacacaaacactgataataaaggaagaacttcatttgtgttaattggttgtgaaaggagtgttcaggataggtctaggaataaagattctgttagaagagatgctaggagtaggaaatgtgagtgtcctttcaagcttcataggaaattagtgcttagagggcaagggttggatggtgaagttgttgtgtgggagtcataa

SEQ ID NO: 9398 - DNA, 288 bp, Glycine max
  Peptide Sequence Number=SeqID_126176
atgaagatcaggctaccacactttgctactttgagtattgagaggaaacaatatgccaaaatccaatcttcctttgatatacctcaaaattcttttggctaccaagatgggaggtttcctccacttctctataatttttcttatcaggccaacactgttggccagctggagtgtggttggattgcaattagtcatgttgaatctcttcaggacaacagtcgcatacttcttctgatgtgtgaaaattcccttcctagtggtaggaaactctattccaagaaagtatga

SEQ ID NO: 9399 - DNA, 173 bp, Glycine max
  Peptide Sequence Number=SeqID_126177
cttcttctagattcatcttctccttgaagtggcgtctccaatcatccttctacttcttcattccactgccatcaaactttaagaagcaaaggactccactgatgaagaagatccaaggcctacaagctccacatggagctacatcatgtggtatcaagagcatcttcatctag

SEQ ID NO: 9400 - DNA, 297 bp, Glycine max
  Peptide Sequence Number=SeqID_126178
atgtattacaacgggaagtggaacataccacgtcaaggtgagtttttgggttactcctttactggaactaatccaataagatttggcattccttcgggatgtggcatggagaaactcaaggatttaatcaagcaagttgcacctataggggttccccctaatggaattcacggatcacaattggttagacgattattctttcgacaaccaggtcattctaagtattccgaaaatttgattgaatatgacataacagaattgaaaaatgatgaagacgtgctaaaggtgttagcataa

SEQ ID NO: 9401 - DNA, 399 bp, Glycine max
  Peptide Sequence Number=SeqID_126179
atgggggaggaggttgccgcccagctcgcccaagcgatttgtaggctttctccagaagcaacatgctcgcccaggcgagctggttgcttcctgttgaagcttcctgatgggccaagtgctctcaacgtgactggcaaaaatccgcatgtcaacaaacaattgtcctcagacgaaattaggcaaggaaacttaaggctttgggatcgatcgtgtgccccattgaaggatggcaatggattgtcacactttggtatgggtcgcaacctacccttcggcgggagggcgacacgtgactcgcgggtgcgtgtcccacgaaaggaatacgcacggagtcaccaccaacatttatttgaggaaaacgtcggaaaaaccggaaaagacgtggtctacgaactttaa

SEQ ID NO: 9402 - DNA, 1449 bp, Glycine max
  Peptide Sequence Number=SeqID_126180
atgacgcaattcacacccccacttcctcctttgcaccaccaaatcacatccctcctcccaaaccctaacatgatgaacaaaaaccaaatccctaggcctaggccttggcctgcttcaggcttccctactacctccaaggccctttccaacttgggcaacgcgaactgcatggaacagttacttgttcactgcgccaacgctattgaaaccaacgacgtaaccctcgcacaacagatcctttgggtgcttaacaacatagccccccatgatggcgactccaaccaacgccttgcctctggcttcctccgcgccctcaccgcacgtgcggccaaaactggtacgtgcaagatgctcgtctccgccggcaccaacctctccatcgacacgcacagatttaacatcattgagctcgctaacttcgtcgacctaaccccgtggcaccgcttcggcttcaccgccgccaacgccgccgtcttggaagccaccgaagggttctccgttgtacatattgtggacttgagcttgacgcattgcatgcaaattcccacacttgtcgacgccatcgccagccgccagcaccacgacgcgccgccgccgataatcaagctcacggtggccgacgcttgctgcagggaccacatccctcccatgctcgacctctcctacgaggaactcggcgccaagctggtgagtttcgctcggtcgagaaacgtgatcatggaattcagagtggtttcttcgagttatcaagacgggttcgcgagtttgatcgaacatttaagagtgcaacaagaacaacaacaacaacaacaacaacagcattttgtttatgcagcagaacctagtactccgagtgaggctttggttataaactgtcacatgatgcttcattacatccccgacgaaaccctatcagatacaacagacttgacctcttatgtctacgattcttcttcttctgctgccgttagtgttactcccacttcttcactgcgatcactgttccttaagtccctgcgaggtttggacccaacggtcgtgatcttggtcgacgaagacgcggatttgacatcaaacaacttggtatgcagactaagatcagcatttaacttcctatggatcccttacgacaccgtggacacgttcttgccgcgagggagcaagcagagacagtggtacgaggcagacatatgctggaagattgagaatgtgattgcacacgaagggcttcagagggtggagagggtagaacctaagaacaagtgggaggagcgaatgaagaatgcgagttttcaaggggttggtttcagtgaagactctgttgcagaagtgaaggcaatgctcgatgaacatgctgctgggtggggattgaagaaggaagatgaacacattgtgctcacttggaaaggacacaatgtagtctttgcctctgcttggttacctgcttga

SEQ ID NO: 9403 - DNA, 606 bp, Glycine max
  Peptide Sequence Number=SeqID_126181
atgaaggcaaagatattagagaatgttttaatcatgtctagattattgcgatccttttcccgtatctcttttcgctctaattcctcctcttcatcttcttcaagaaacaccaatctcttaaatgatcaagataaccagacccaagaggtcgccccaaaacacaatcccttcgatgaggaagtccgattcgaagatattaatcaaaacatggatgactggaacattccagaaatccctcaggatcaactatacgttcctgaaacaattaaagacaaacacaactttgattacataatcaaaacagtagaaaacaatattcctctaggacaagatataggggaagaatttcatctactttcaaaaaattcaatttatgaacatagccgtaagtataaatatctacacatcggttgtgtacaagtagctatcaagcccttaattgatatgggcatagatgcagcagttttaatgtgtctaagagatattaggcataatcaatttgaagactccctaattggaacagtcgaaaccagcctaggacaaggtccaatatattttaattgttatccaaacaaaacagtgagtctgatggacagaaacatctga

SEQ ID NO: 9404 - DNA, 270 bp, Glycine max
  Peptide Sequence Number=SeqID_126182
atgtccagacttccaagtaggcatgggacactctcaacaaaaggccttgtcattcacaccctaaatgggctaggtgttgagtacaaggaggtttctacagctcttcgcacttgtgaaaaactaattgactttgaagacatttatgatcttctctctgacattgagagttatctcaagagggatgacaacaataatgatacatcatttgttgccactactcatgcagcacacaagggtaagcaaccttaccacaaaagtcctacaatctaa

SEQ ID NO: 9405 - DNA, 981 bp, Glycine max
  Peptide Sequence Number=SeqID_126183
atgccagcggcacggtatttttctcctgcagacacgatagagcaaaagttacaaattgaaaggaggcttggtagtgtgaaaacacgcaagtactttaatcttctggagagatttctgagtttcaaaattagcaaacatgagtttgatagggtctgcatcgcaactattgggagagaaaatgtccctcttcataatcattttctcaagtcaatcttgagaaaagcatgtctctccaagacagccgggtcaagagaaagcaaagtagaaagttctttgaacgtgaaaacaccaaatgggtgtagcaaccttcagatactgtgcaaggattttcctcaatctcctcgaaaaggcaggactccaaatttgcgtgatcgcagatccagggaccgtccgagccctcttggtcctaatgggaagaacaacagcattgggtgtagtagacttcctctctctgtggaagatggggaggaggttgatcaggattatgaaatcctgaaccttttcaaaaagagtcctattcaagcacctcttgctattcccacttacaacagaagaccacagccaaaatatttatcccaaggattatcatctggtactgttagtgatacctgtcaaagcattgctcagctacctgatacatgttctttgacaaaaaggttggagcagaaattggaaatagaaggacttaagatctcaacggatgctgccagcttgttaaataatgcacttgatgtttacctcaaaagattgataaagccctgtttggatttagctgcttcaaagtctgtaaataagttcagtggtccaatacaacctggtttgaatgaactaccactgagaagatgtgtgcaaaagcctattagatctgcttctgtatctatatcagactttagaacagcagtagagttgaatcctactatattaggggaagattggccactaaatttagagaaggtttgtctatgtgcattagaagaatga

SEQ ID NO: 9406 - DNA, 735 bp, Glycine max
  Peptide Sequence Number=SeqID_126184
atgggtcggcttaatctcctacttgtgtggtcactctcattaacactgtccctttattatctacacccaatctctgctcagctcagtccaaaccactatgctaaaacatgccccaatcttgaaagcatcgttagacaggccgttaccaagaagttccaacaaacctttgtcaccgtcccagccacccttcgtctcttctttcatgattgctttgtgcagtattgcagtcatgattggtggcaaaaaggttgtgatgcttctgttttgattgcatccaccggaaacaaccaagcagagaaggatcacccagacaacctgtctttggcgggtgatgggtttgacacagtgatcaaagcaaaggctgcagtagatgccatccctcagtgcagaaacaaagtctcatgtgctgatattctggccttggccacccgtgatgttattgcactgtctggtggaccttcatacacggttgaattgggaagatttgatggtttagtttcaagaacttcggatgtgaatgggaggcttccacagccaacgaacaatttgaaccaattgaattcactgtttgcggcaaacggcctcacccaaactgacatgattgctctctcaggtaatctccgtgcaactgtttgcaaatgggtcccatttgcgtttgtgcacgttcttgggtccttgttagagtggttgatatttgataatgtatcttctcatttatgttattgcaaagtatag

SEQ ID NO: 9407 - DNA, 225 bp, Glycine max
  Peptide Sequence Number=SeqID_126185
atggggatgtacatcaagtccacccaatatagaatttggctcatcatcattaatggggatattcctattaccaaacctgaagctgaatggagaaatgacgatctgaccattgtggaactcaacactaaagccaaatatactctgacatgcttttggacagatgtactccaaggcttagataaacttaaaggtgctggacaactttcccaaggtgtgggaacctaa

SEQ ID NO: 9408 - DNA, 510 bp, Glycine max
  Peptide Sequence Number=SeqID_126186
atggaagaaggattctccatcaatacaccaccactattcagagaaataaaatatgattactggaaggagtgtatgatagctcactttgaattcattcatatagatctatgggatgtgattcctaaagggcaacggatgaaggagaaaaaactcaaattcctgctcaactccaaggttcgaaatgtgatgatgtatgctctattcatagaagaatacaccaaggctgatgattcatttgatgatgaatatgaggaagattctgacaaagatgagcttacctttatttcacaaaagattcgcaaaatgtggcaaaacaaaggtagctccaagtggaaaactcctcaagaagagtacccaaagaaaagaaagataaagacaagagctccatattctactatgaatgcaaaaaagcctagacacttaaaatctgaatgtctagaactggagaaaggtcaggaaaagaagaaatacttcaagaccaaggaaaagcagggtcttatgagtaactag

SEQ ID NO: 9409 - DNA, 753 bp, Glycine max
  Peptide Sequence Number=SeqID_126187
atggatctatttggactaactagaacattgagtctaggaggaaaaaagtatggctttgtcataattgatgactattcaagatatacctgggtatacttccttgctcataagaatgagtcttttaaggtctttgaaatattctataaaatagtccaaaatgaaaaaggtttttacatctcttctattcggagcaaccatggaactaagtttaaaaatgctgagtttagatcattctataaaaagaatggtattttccataacttctctacatcaagaatacctcaacaaaatggggtagttaaaaggaaaaatagaactctgcaagagatggctagaactatgctctgtgaaaactcacttcctaaatacttctgggcagaagccgttaatacaacatgctatgttcagaacaaaatattgatcaaaccattgataaaaaatactccctatgaattatggagaagaaaaagacctaacatttcatactttcattcatttggatgcaagtgttttatcttgaacactaaagatcaacttgctaagtttgattctaaagtggataaaggaatttttcttgggatttctaatacatctaaagaatatagggtttttaacactagaactttagttgtggaagaatccattcatgttgaatttaatgatggactaacatctgataagagattattagatcttaaggatgattttacagatatgcagatgagatcgtctatacatcctaaagaaagatag

SEQ ID NO: 9410 - DNA, 246 bp, Glycine max
  Peptide Sequence Number=SeqID_126188
atggaagatgctaagcctatgaaaactcctatgcatgattccaagcctctaagcaatatgaaacataaacaagatttcagtttagtaggatactatgatgcagaagacagagtggaaagaaagaacgcaagtagaggatgccactatattggaccttctctgatatcttgggcaagcaagaagaagaacttcattgctttatctacaactgaagttgctacaagttgttgttcacagctgctatag

SEQ ID NO: 9411 - DNA, 213 bp, Glycine max
  Peptide Sequence Number=SeqID_126189
atggcacctccaaggaagaacgagtctttcaacaatcccatcatcaacaacgttgaagatgccagtcaagctttccctaaagaatggtttatccctgggaaggaacaacaaggcaagatggagtcaacatcaaggggactgttgttgagacttaagtggcgatctctcctgccactattgttgttgtgtctggatgtgctctggatggtctga

SEQ ID NO: 9412 - DNA, 471 bp, Glycine max
  Peptide Sequence Number=SeqID_126190
atgaaaaagaaggcacatgaagaagaagcaaataagattcttgaaaaaatcattattgagtctctgaaaatcttaacaagggaagaagagctaagacaaacaactattagtgatcaagtacctgatgaagtggtgcttgaagttgtcaaagttgcatctgaagaagagatgcagaaggagaagtttgatgctagagtgcaatcaaccttggaaacaatgccattgcaagggtctaaggttgttgctagttcaaacttgattgaaacagaccctagagttgcaccattgcactctcgtttagtcatagttgatgatgaggctgttgttgatgctctacttgctcaacctatgttagaagcagacatatcaagactgaaaggcatttatggagctactgagtatgtctccttcaatgaaatgaagattagattggaaatcaagaagagagtggagactgatgctgcaccttaa

SEQ ID NO: 9413 - DNA, 204 bp, Glycine max
  Peptide Sequence Number=SeqID_126191
acacaagggcccggaaaatcatctctccttactgcgcatttgggggcgcagtgccccatgtgtgcagttaagaagacgttatggatctttcgacttcccacgacaaaagacgagatccacatacaacgcatgtgtgacggcatgatgcagatgcgcaaaagtgcaacaaggggatgcacagagtacgacaatatccataaataa

SEQ ID NO: 9414 - DNA, 351 bp, Glycine max
  Peptide Sequence Number=SeqID_126192
atggatgagtttgacacgcaggtggcctggccaggagcccagtcttctccttttggagggggtggggcctccgcagcccaggagcctgagccagaggagccagcagcaacagcaaagggggaggatgagcttactcctcctgagccattttattttgatgcaaatgtacacatggctcaagaggaggagacttccatagaccagattccagagccatctctagtacccatacctgatgattccatgccatttgcaccagcatttgagctagagcaacctatccctcaagattcaccagctgctcaggtgttggatctcaatgagcatgcacaggagcaatcacaagagtag

SEQ ID NO: 9415 - DNA, 729 bp, Glycine max
  Peptide Sequence Number=SeqID_126193
atgagcgctttagggcgtcctcaagatatgttttcagatacggctatacaattacaaccggtctttgctcaatggatacaaaatacccatgctttagcaccaggcacaacagccccagtgggcggtaaagttgctttgttacctattccgttaggaactgcggattttttggtccatcatattcatgcatttacaattcatgtaacagtattgatactcctaaagggtgttctatttgctcgtagttcacgattaataccggataaagcaaatctaggttttcgttttccttgtgatggacctggaagaggggggacatgccaatcagatgtttggggtagtataagtgatcaagggatagtaaatcatatcacaggaggaaattttgcgcagagttccattaccattaatgggtggctccgtgatttcttatgggcacaggcatcccaggtaattcagtcttatggttcttcattatctgcatatggtctttttttcttgggtgcacattttgtatgggcttttagtttaatgtttctattcagcgggcgtggttattggcaagaacttattgaatccattgtttgggctcataataaattaaaagttgctcctgctactcagcctagagccttgagcattgtacaaggacgtgctgtaggagtaacacattaccttctaggtggaattgccacaacatgggcattcttcttagcaagaattattgca

SEQ ID NO: 9416 - DNA, 315 bp, Glycine max
  Peptide Sequence Number=SeqID_126194
atgtcgatgcctagtgtagaatgtttttctaccatgtttaagttgtatgtagcttgtgtcttcttcacaaatggggcatgcacaatggccaataacaatgtacccgctcaaattcccatatgctggaaagtcattaatggtactgtcgcaacctacccttttgcgggcgagcgaggcgaggctcacgggtgcgtcttccaaaggaggaaaatgcgcggagtcgccaccaacgtttatttgtggaaaacgtcagaaaaactgaaggaaaccggtcatgaagaatattccagattcgggagttgtatttatgtttga

SEQ ID NO: 9417 - DNA, 528 bp, Glycine max
  Peptide Sequence Number=SeqID_126195
atggttgtgggcgatactgagggccccccaaagtgtttggtaggggtatgccaccaaacgcctgcccctcagtggcatatccgaggcaaggctcggagtcggctagagtgtggtctcggggtacttcatgtgtctcccccatgggttgagggacctgtgcctgaccagattggggttgttatcgacattcttagtaagtataggagtggagttatcgacattctcatcgagagcatgtgcaatattgggtggtgtatagttgggaggcaagccatatggtgggaaggaatgcttgctctggacctgcacaaaatgggggtcgcccgcacttcccaacgctttgccttcctgacctaccatatccaagtaatgactgtagtcgtgttgacctccatcatttttcttatactcatcatggcttccatcattgtggtcattttttctttcatgacctccatgtcggccttcatctgctcttgtacctcctttatttcactcatcactcaagctttggcatgcgtttggtaa

SEQ ID NO: 9418 - DNA, 1752 bp, Glycine max
  Peptide Sequence Number=SeqID_126196
atgaagagagcaagtgaatgggcttattctcatgagattccaagtgatgtcaccattcaagttggcgaagtttccttttcgttacataagtttccattagtttccaagagtggatacatagggaaactggtctcagaatcaagtgatgccttcattgaactctatgatgtccctggtggagcagaagcatttgaactggcaacaaagttctgctatggcataaactttgaaataagcatcgaaaacatcgctatgcttcgttgcgtggcagagtaccttgacatgacagaggattactcagttggaaatttggtgggaagggctgattcttacttgaatgaagtggcactcaagactatttccggggccgcgtcgatcttacacgtgtcggaacgcctccttccgattgcagagaaggcaaaactggtgagcagatgcatagatgctattgcattcatagcctccaaggagactcaattctgttcatctatgagaggtgacattattggtactgatggcattggcatggcttctcaccaaaggccagtggttcattggtgggctgaggatctcacagttctcagaattgacatctttcaaagagttcttattgcaatgatggcaagagggtttaaacagtttgctcttggccctgtcattatgctctatgcacagaaatctctacgaggtttggagatatttggaaaggataggaagaagattgaagttgaagcacaagaagagcatgaaaagagggttgttttggagacactagtgagccttctgccaagggagaagaatgcaatgtcagtgagctttctttctatgttgcttagggcagcaatatatcttgagacaacggttgcttgcaggcttgatttggaaaagaggatgtcactgcagttaggacatgctgttttagatgatcttctaattccttcttattctttcactggggacacattatttgatgtagatacggtgcagcgaatcatgatgaattaccttcaatctgaaaaggaagatcattcaccatataatgcagatgatgagtatttttctcctcctcaaagtgatgtttattgggttggaaagttgatggagaattaccttgctgagatagccactgacagaaatttagctgtttcaaaattcatcactgttgctgaactaattcctgaccaatcaagagaaacagaagatgggatgtatagagccatagacatctatcttaaggctcatcctattctaagtgatatggagaaaaagaaagtgtgtagcgtgatggactgccagaagttatcacgagaggcgtgtgcacacgctgctcaaaacgacaggcttccagttcaaatggttgttcaagttctctactacgaacagcaacgccttcgcgattccatggatagcagtgcaggctgggattctcctaacttccttgacaaggtaaattcatctcccaacgagctctccatcttgcgaagagaaaaccaagacctgaaactagagatagtgaaactgaaaatgagactaaaagagtttgagagaacttcaattagatcagcatcaagtagtcctgtgatttatgcttcacgctctgctgataagcctcctctgcctagaaagtcattcattaactctgtgtccaaaaagcttggtcgtctttctcctttttcacgtggcgatgctgccactatacctcccaaaggtcgcgtaaaacctgataagaatcgacgccattccatatcctaa

SEQ ID NO: 9419 - DNA, 699 bp, Glycine max
  Peptide Sequence Number=SeqID_126197
atggagaagcttgtcaggtccagttgcaacaaagaatacatgaggatggccatgttaaaacatgaagaaactttcaaagaacagaaggttgacttaaagtgtggtatcaacttcactaatgtgattgctcatggtctattgctgaaaatctccccggtatacgagcttcatcgtttgtacaggattcagaagatactgatgcaaaacatggaagccagaagaggaatcgaagcgagcgaagaagaatggcacttcaagaatggcattggtttaactcacaaaggtgcacaagaaaagcctcaaattaaatttgaccttgaaagtcctgcagaggaacacattgcagaatcagaagatggggtgctagaagtcatcgatgagaccgagattgagctgacattaggcccgtcgagttacaaccgaaggaagaaagttgagacaccgctaacttcagattcaggacacagcttgtcttcttcttctagtggatccagccatgtgaacaagacaagatgtcatggcagtcacactagagaagaatcaagtggaagcataattcggcttgtccaggtgccgggttcaacaccaggataccaaagtggaattagaaacagttttgatattgaagaacaattaagacaagagagattaaaacagtcaccttggcttttccaagtgttgaatctgaacatgacttga

SEQ ID NO: 9420 - DNA, 174 bp, Glycine max
  Peptide Sequence Number=SeqID_126198
atgtgggagcaaaagaacattcagatggacaatgaacaccttttgcagcaaggagagtggttgggaggcaatttcgaggggatctccacaagaagagtgagggaggatgagaaggaaaagaaggtgtgggagagtgtgaaagaagaagagagttacatgggtgagggtttttga

SEQ ID NO: 9421 - DNA, 189 bp, Glycine max
  Peptide Sequence Number=SeqID_126199
atggatagtgctcacgtgatagtggaaaacaaaggtagcggtaccaacatgtcctttaacctcggcaaagatctcaactacttagtcttaccatactctgatgaggaaaatttgaagggagccgcaagcgttaagttatactttgacttgaagcattttgatggcaactgggatgaggctgagatgtga

SEQ ID NO: 9422 - DNA, 165 bp, Glycine max
  Peptide Sequence Number=SeqID_126200
atggttttgtccatgacatatgttgaggtggactacgatgttggttgtcacgagttccttctagatgctccaaagcgtgaaagccaaggtgttttgttgatgttgtggaatggaatggaggaggtagaatataagctgattgtagtcatctacagaatccaatga

SEQ ID NO: 9423 - DNA, 579 bp, Glycine max
  Peptide Sequence Number=SeqID_126201
atgttcgtacctcaccaatggaacttaccttcttctccttctcgtcctccctcactccaaacgcaatccaaatctcccccaaaaaactcaatcccgcatttccgcagtaaccatagacccaccgcaggagcttcccaagaacagcccccagcgcctcctaagggagctcaccgagcgcaagcgcccttcaccccgaactccacgcgcgccccgcggaggttcatcctcacgcgcccgctagacgacaaaagagtcgcggacaggttcctcagcagcccccagctagcgctcaacacattcccgttcctaagctcatgccttcccttcgccccgctcggccacgtggacaacatctggatggagaagcacgcactggggtaccctctggagccctcggtgacgctcagggacgatagcaaacccgccagggagctcgacacgctgttgtacttggcgttccagcatgaagtgtgcgagaagagtagggcgcggcacgtgcggttcgggcactcgaggctgttctttctcgggcagtatgtgttggagttggctttcaccgattattttttgcagaggtaa

SEQ ID NO: 9424 - DNA, 258 bp, Glycine max
  Peptide Sequence Number=SeqID_126202
atggagttgttagtgggagaggaagcaggtggaggcggtggcgggcgtgggtgtggatgcgttcagaaatgggaaattgggtgtgagtgtgtgaaggatgagagagctgtgccgcgagagagattgggagagcatgcaaaaattgagggaattgaaagcgtaaatgaaaaagggaccaaacctgctttgcatgggaacaattataaaacacatgccattcattttcaaaattttcattgcaaaaaggaaagattctag

SEQ ID NO: 9425 - DNA, 543 bp, Glycine max
  Peptide Sequence Number=SeqID_126203
atggatgcttatgccttgtttgcacacccacgactgttcagagcttgtgttcctccaagcatgcatcagtttagaggaaatttatgggattatgattgcagaccccagattatgcaagtccttggatatccattaaaaatgaaagatagaattccagaaattactaaagccaggaacatagagcttgatcttgggttgcagctatgtttcttgcatccatcaaagtacaaatttgatcatcctcaatttttctatgagagattagaataccttggccaaaagatacaggattcggtaatggctgaaagattgttgatgaagcatttagatgctccagggttatggttacaaaataggcatcgcaggtttcttatgaacaagtattgtggaagatatttgaaggccaaaaattgccaccattttactatatatgacgaaaaggcccttcacgggctttcatatgttgtttatgggaaacgtgatgtgagacgtctgatgtttgaggtttttgactttaagcaaacccagcttgaagcgaagtaa

SEQ ID NO: 9426 - DNA, 614 bp, Glycine max
  Peptide Sequence Number=SeqID_126204
atgtccaaggcacgcgtctacaccgatgtcaatgttcttcgccccaaagagtactgggattacgagtccctcaccgttcaatggggtgatcaagatgattatgaggttgtgcgcaaagtgggaaggggaaagtacagtgaggtttttgaaggcataaatgttaatagcaatgagcgttgtgtaatcaagattctcaagcctgtcaagaaaaagaaggacagtgtggttcttggtgcactgcagcaacctgtttctgcaaattctagtttggaaattgttattgttattggtagccaaaccttaattctaatcggtgatcttcttgatattgtcagagatcagcactctaaaactcctagcttaatatttgagtatgtcaacagtacagattttaaagttttgtatccaaccttgactgattatgacatacgctattacatatatgagcttcttaaggccttagattactgtcattctcaaggcataatgcatagagatgtcaagcctcataatgttatgatagatcatgaattacggaaacttcgcttgatagattggggtcttgctgaattttatcatcctggaaaggaatacaatgttcgtgtggcttcaag

SEQ ID NO: 9427 - DNA, 516 bp, Glycine max
  Peptide Sequence Number=SeqID_126205
atgtgcgaggactgttttagacaaaagggacaaggaagaacaaatggggttccaagaactgtgttggggctccatgaactgagatactttaagggccctgaacttctagttgatttacaagactatgactactcattagacatgtggagtcttggctgcatgtttgctggaatgatatttcgcaaggaaccttttttttatggtcacgacaaccatgatcagcttgtcaaaatagctaaggtgcttgggacagatgaactgaatgcatatctgaataagtatcatctggagcttgatcctcaacttgatgcactggttggaaggcacagtcgcaagccttggtctaaatttatcaatgcagataatcaacatcttgtgtctcctgaggcaattgattttcttgataaactccttcgatacgatcaccaggacaggctaacagcaagagaagcaatggcacatccatatttctctcaagtaagggcagctgaaagtagcagaatgaggacacagtaa

SEQ ID NO: 9428 - DNA, 270 bp, Glycine max
  Peptide Sequence Number=SeqID_126206
atgcagatggcatcatttttgctatatttaactgatgttgaggaaggtggggaaactatgtttccatttgagaatggcttgaacatggatggtaactatggttatgaggattgcattggtttaaaagttaagccacgccaaggagatggtcttctattttattcattgctcactaatggtacaattgatccgaacatactttgtgtcgaagctataaaacagcaggtttcacagttttacctaagatcatccaacagtcatcatggttaa

SEQ ID NO: 9429 - DNA, 504 bp, Glycine max
  Peptide Sequence Number=SeqID_126207
atgtcgatcttcccctgcgaaagtatcggttggtctatgccgtcacgacatagggattgtgcccgcaagacacccagcggacccggagaagcccaacagggccctggggtttccagctctggttacgggcctctgttagtcctacagggtgcccgttccccccagcaagggatcgtgctcgcaagactcccagtggacccggagaagtccaacagggtcttggggtttccagctctaattacgggcctctatcagttttacagagtgctcatcgcccccaacaaggtcattaggccccttactaaccgagctttcatcaagaagtactacgccccccagtcaggcgcaaggcgaaacaccacagcagcctggggatggccagcaacaggcaacaaatgcactgccgccacctccagagcccctcagctcatccacaaaaaggttagagtattgcctacgacacatggtcgaccaataggcgacctagtccaaagccaaaggtaa

SEQ ID NO: 9430 - DNA, 237 bp, Glycine max
  Peptide Sequence Number=SeqID_126208
atgtcatgggggtcaggagaccttggggatgttaggtggggtgctattgcccaaaaccaagcttggctaatcctgacccaatccgggcatagtcagtcagtgagaacctgtgacgtacctaaacaggcgagctcctggcagtcaaccaataaaagaacaaagtccacgaagcaaggagacttgtgtggtggctggccagctatgtatcttgggtggtatatgaaaattagcctctag

SEQ ID NO: 9431 - DNA, 864 bp, Glycine max
  Peptide Sequence Number=SeqID_126209
atggcgtaccaccataacccccaagagcttccacttcaccatttcactgaccaacaacaacaccataaccaacctctcgttgacaactccttgctctccgaccctgcttccaaacctgcctccgatcctcatcaacccgcgccaaattggctcaacaacgcccttctccgcacgcactacactgacaacaacaacaacaacaacgttaacgctgctaacaacaacaccaacaacggcaccaacttcctcaatcttcacacttccacttccgactccggccaatggcttgctcgcccgatcctcaaccgcaaccacagcgaggtcatcgacgacgtgaccggcgccggcgactccaacatggcggccgccgaatccggcgatttgaagggtgatgcggcggcggtggagggaggaagcgacgggcttatgaactggcagaatgcgaggctgaaggcggagattctagcgcatcctctgtacgaacagcttctgtcggcacacgtggcgtgcttgcggatcgccacgccggtcgaccagttgccaaggatcgacgctcagctcacacagtcccagaatgtggtcgccaagtactctgccttcggacaagccatcgttggcgacgataaagaactcgatcagttcttgtcccactatgttctgttgctctgttctttcaaagaacaacttcaacagcatgtccgggtccatgcaatggaagcagtcatggcttgttgggagattgagcaatccttacaaagtttaacaggtcaactatcagtcaatattgcaaggttcagattaacaatcaatgatatgcaagtccttaattgttgttggactaagaagcatggctacagagattaa

SEQ ID NO: 9432 - DNA, 450 bp, Glycine max
  Peptide Sequence Number=SeqID_126210
atggaagacaggcaaagggctttgttgcagttgcagttgaaagtgatgagtgacaagcccaaagaggaccaagaagtgaattcaaaacagactctcagtcatagcctctgccagggaataaataccttgaattcaagaaaatcagacactgcattcaaaggcggttattacataataaccgtctttgaatctcgaggagatgtaacattcaaaggcggttattacataataaccgtctttgaatctcgaggagatgtaacattcaaaggcggttattatgtaataaccgtctttgaatgtcgaccagacgtaacattcaaaggcggttattatgtaataaccgtctttgaaaatttttcactttcaaagacggttgttataataaccgtcataaaaagcaattgcgtttcaacgacgttatatacaacgacggtttacaaccgtcgttaa

SEQ ID NO: 9433 - DNA, 645 bp, Glycine max
  Peptide Sequence Number=SeqID_126211
atgcattggatgtggaacatcgtcggtgggggtttaaagaatgattggagcatgtggtttcttgatggaacggcgttagacaacgaaacaattacaacgattcgccagaaatgggcagcatattttcttaaagttcaaagcattcaatgtacaaaatttagagtgaatgatggggaggacaactacacaactcttccaagaatagacccttctgtgagccaaaggatcccgacacaacatgttgttcctcttgataaaaagcttcttataggtacatccgatgggtgcattaaggcatggaatgtggatgcaaagagagttgtctgtgacctcaacacaaccgaagcatttccaagtgtattggacataaagtgcagtcctgtggaacctatttttgtgtctgcagcagcatctggaggggctggttctaactatattgacaacctgggttttgcttcacttactgtgtggaacatgaagacatggaaagccatgacagtccttcctcttggagaagatccaccagcaattacttctctatgctttaatcacaatggaaagattttggcagcttctgccgttgatggaatgattcacatgtttggtatccttaattttgttcatttgattgtttccttggtttga

SEQ ID NO: 9434 - DNA, 393 bp, Glycine max
  Peptide Sequence Number=SeqID_126212
atgatgaacaaaaaagccacgctggcactgctggttgcagcggtattaatcaccggctgtgcatcgcgcacggcaccgatccagaacgtcagccagacggtcgcgcagagctacagcgatcagcagatgcagcgggctatcgtggaagctggcgcggccaatcactgggtgatctcaccggcgggttcgggcgtgatgaatggtctgctggcagaacgcggccacacggcgaatatccgtatcacctacactgctaacagctaccgcattgattacgtcagcagcaccaatctgaaagcaggcagtggccagattcaccgtaactacaaccgctggattcagaacctgaaccagggcatccagacccgtctggcggtgcaggcggtaaaataa

SEQ ID NO: 9435 - DNA, 872 bp, Glycine max
  Peptide Sequence Number=SeqID_126213
cagcgtgcggcggcctcggcagccgagctgacggtggccagttcggtcgcgtccggttacctcagcctgtgcgcgctcgacgagcagctgcgcgtcaccgaggccacgctggaaacgcggcagaactcgctgaacctggcgcagcgtcagttcgaaaccggctatacctcgcggctggaatggatgcaggcggcgtcggagtatcagacggcgaaagcgcaaattccgcagctgcagcatcagatcgcccagcaggaaaacgcgctcagcattctggtcggcatgaatccgcgccagatcgcgcgcagcagccactgctgaatcgccggcctgacatagtccaggcgcagcgcctgctgctggcgagcgacgcgtcgctggcggcggcacaggcacaattgctgccatcgctcaacctgacggcgtccggcacgctgcagagcagccagctacacgatctgctggataatccgttccgcctgtggagcatcggcggcagcgtgctggcaccgctgctcaaccgcgaagccctgaccgcgcaggtggatgtggcgatggcgtcgcgcaaccaggcgctgtacggctacgaaagggtggtgcgcaacgcctttgccgaggtggataacgcactggatgccatcacgcgcagccagcagcagctgacggaactgcaggcgcaggaacgctacgttgccgaggcgtggcggattgcgcgcaaccgttatcagaatggctatgcgtcctatctcgatgagcttgatgcgcagcgcacgctgttcagcacccagctgaatattgtggcggtgaaaaacacgctgctgctggcgcaaatcgatctttaccgcgccctcggcggcggctggcagggttga

SEQ ID NO: 9436 - DNA, 441 bp, Glycine max
  Peptide Sequence Number=SeqID_126214
agcaagactgaaaagacaaaccaatatccatcaccacaaagacacgcatttgtaaaatggtggacacaatttgactcatccaaagcggatccagaacaagtaaaactatggttccaatcccatccagaattcctcaaaacagctgatccagagacttctgtgtttttgaaccaaaagtctcatctggcagcatttttagcaggatcgacatcaaaggaggtcttagctaaaaatctgaaggaagttctacaaatgttacaacaggaagaagaagcttcatcctcaaagaaggaagaaacaagttctactgaagacgaagaagatcccttttaccaaaacgaagatgattgttttgccattaaagtcccggtcaaaactacttgtcttgtaacaaacagtcaaatagtcccggtcaaaactaccggcaactaccggtcttag

SEQ ID NO: 9437 - DNA, 984 bp, Glycine max
  Peptide Sequence Number=SeqID_126215
atgggcagctctagcccaatcctcttggagcctcttgctcatggctctagtgactggtcccttcctagggaggattgcatcatgatgaacaaaggatgggtacaagagagcatgagctcgtgtgttgttctattgattttggtacctaaaaaggatggaacttggaggatatgcactatttgcagggctatcaataatatcaaggtcaagtatagacaccctatccctaggttagatgatttgctggatgagttgcatggtgcttgcatattttctaagattgacttgaaaaatgggtaccatcaaattaagatgaaggaagaggatgaatggaaaaccgcctttaaaactaagtatggtttatatgagtggctggtgatgccctttgggctaactaatgccccaaacacttttatgaggttgatgaacaatgtcttaagggaatttttagccaagtttgttgtggtgtattttgatgatgttttgatttataacactgatcttgatttgcatattgaatatttgagtgttgtaatgaatgttcttagagaagaaaacttgtttactaatattaaaaaatgtaccttttgcactaatcatgttgtatttttggaatttcttgttagtgctgagggggtacaggtggatgatgaaaaggttaaggccatccaagagtggccctcgcctaagactatgagtgaagtgaggagctttcataggttagccatattctataggagggttgttttgatgcaagaaggtcatccaattgcttattttagtgagaagttaaatggggcttccctaaactatcccacttatgataaggaattgtatgccttggtgcgtgctttgaaaacttggcagcattatcttttgccaaaggaatttgtaattcacatcgatcatgaatccctcaaatacttgaaaggacaaggcaagttgaaaaaaggcatgccaaatgggttaaacttcctagaatag

SEQ ID NO: 9438 - DNA, 189 bp, Glycine max
  Peptide Sequence Number=SeqID_126216
atgacctttcaagcaatagatacaatccagaatccgaaaaatgtgagtgtcatcaccttgaggtctggcaaccaaattcaagtgcctccatcagtagcagcacttgcacctaaacctgtcaagcttccttctacacctgagaaagaggatgagatagtcactgatcgaggccgtacccaaatcaaataa

SEQ ID NO: 9439 - DNA, 225 bp, Glycine max
  Peptide Sequence Number=SeqID_126217
atggttattcccaagttcaaggtgccggactttgacaagtacaaggagactactttccccaagaaccatctaaagatgtattgtcggaagatgggggcatacgcaaaagatgagaaactaatacgcccaaaggtgaagagacctggcagctccagtggttccctcaatcacggagaaagaaatgataacaacgatagtaggcacattaccggtgttctactatga

SEQ ID NO: 9440 - DNA, 855 bp, Glycine max
  Peptide Sequence Number=SeqID_126218
cttgagaggattgatggggacccggcgttgagaggaacgaggataagggctacgtgggagtacgtgagctcaattggaggtgggcaacaggggatggtgggtttatacgtgatttgtggatgtggagaattgtcttgcaccattgctcgaccgccacctagtaccacatgtgatggagtggtacctggagatatgtcgcgggggtcaggagaccttggggatgtcaggcgagctcctggcagtcaacagataacaagaactaagaccacaaagcaaggaggcttgtgtggtggctggccagctgtgaatcttgtgcttaaaaagggaactggaagattgtggaggcctctggtaatcgattaccagtctgtgtattcgattacacagaggaatgggtcactggtaatcgagtaccagatcgtgatggcggcgcagctaatccatgatcgagtggagatggagtgcctagagggagcttgggagaccctcgaaggcaatacgaggtgccgatttcggggcacgattcgatttacggctacttcattggtgcatacagatgaacccgcacgcacgcttcagcgtactgtggagtggatactacccacgcctacaccataccgtctagtggagcccgtccaagtgattgaggtaacgtcatccgaggaagaccctgaggaggatctcgaggagctacctcctgagcctattgtggatgcccttgactttctagagggtgatgaggacccactccctgaggtggattctcccaaggacgtcatgtcggcatccgaggcatactctacggaggatagtggccctggagagatggcgatcaatggaggctcttcatcatag

SEQ ID NO: 9441 - DNA, 1104 bp, Glycine max
  Peptide Sequence Number=SeqID_126219
atggccgcttcatcaggtaaaaaaacgcagatcggcacgcgtgaactgcatccggaaacgcagatgctcaactacggttacgatccgcgcctgtcagaaggtgcggtgaagccgccggtgtttctgacgtcaacctttgtgtttaacagcgccgaagagggcaaagaatttttcgatttcgttgccggccgccagcaaccgccggcgggcaaaagcggcgggctggtctattcccgcttcaaccatcctaacagcgagatcgtcgaagatcggctggccatttatgaaggtgccgaaagcgccgcgctgttctcttccggcatgtcggcgattgccaccacgctgctgacctttgcccgtcccggcgaagtgatcctgcactcgcagccgctgtacggcggcaccgaaacgctgctgagcaaaacgctgcacgatctggagatcaaagcggtgggattcagcgacggcaccgacgaagataaagtgtatgaagccgcgaagctggcgtggcagcgcgggcgggtggcgatgattctgattgaaacgccagccaaccccaccaacagtctggtagacatccaactgatgcgtcaggtggcggaggtgatcacccagcagcagggctcccggccgattctcgcctgcgacaacaccctgctcggcccgctgtttcagcgtccgctgcagcacggcgcggatatctccctctactcgctgaccaaatatgtcggcggtcattccgatttgattgccggcgccgcgctgggtagccgggcgttaatcaacaaagtgcgttcgctgcgcagcgcgattggcacccagctcgatccgcactccagctggatgattggccgctcgctggaaacgctgtcgctgcgcatggagaaagccgccagcaatgcggaacaggtcgcggcatttctacgcgatcacgcgcaggtggcgaaactgcactggctgccctatctcgacgccagcagtccggcaggagaaacctggcagcgccagtgcagcggtgccggttccaccttctcctttgatattgagggcggccaggctgcggcattccgctttctcaacgcgctggcgctgttcaaactggcg

SEQ ID NO: 9442 - DNA, 1032 bp, Glycine max
  Peptide Sequence Number=SeqID_126220
atggcgaatcaagaggagtgggtcccatttgcggatgtactagctttgctaatctttggggttgtcctctttccaaacgtggacggtttggtggacctagccgcgattgatgctttccttgcatatcaccatagcaaggagagcccggtggtagctatcttggcggacttatttgatacatttgaccgaaggtgcgagaagaacagtgcatggattgtctgctgcttacccgctctttgtgtgtggttggtttcgcaccttttccaacaagacataaggcacccgtgtccgctccaaagttatcgatcgtgtgtcaaaaagagaagagtagattgggaccaatacttggctgggataagaggcagaacaatcaattggtttcctcgatggaaggaaggaagggagggagtcctcttctcatgtggggactacccaaacatttcattgatagggacgaggggttgtattaactacaatcccgcactttctataagacagttagggtaccccatgaggggagcacccacggaagagagcctctcgcctttccttgaaagcccgttaaggaaagataaagaacttaggggtatccgtaatggcatcatcggtgattatcatgaattgctgaaagttcatacacgagggttagattggctctccaaattgaaaattatcaacgaggagaacttcgaagctccggaagaggatgaagaagtccgagctctaaaaatagagctaggaaaggcaagacttgccaaagaaaaattcaagttagtcgctacagacgtccggaaagagtgtgtcgagttacgagaagaaaatgcagctaccgcaagagcccttgaacaagaaaccaagagggctcgcaaggaagagcatggtcgagataaattccgaggagctttgtggggcagcaacaatgagctcaagctccggagaaaggaaagagaccagtcacgagtacatggcatggtcttaaaggaggaattagctgtctgctcaagatccagaggagtttggcccaacacttag

SEQ ID NO: 9443 - DNA, 238 bp, Glycine max
  Peptide Sequence Number=SeqID_126221
aggattgtttggaggagcaggcatcacagggttcgtctatccccaatggatgtcaggatctcctaattgctgccattgggcgactagaacactgatgcaatcctaccccgcaagggcattggatagaaaactccaagtagattgggccagagatgcaagagaaggccctagggttcttatgagccttagggtagatttcgggcccatgggctacgtacgagcctacttatctttgtaa

SEQ ID NO: 9444 - DNA, 1863 bp, Glycine max
  Peptide Sequence Number=SeqID_126222
atgaccggtgcatgctcagctcaattgtcttacgaccaaaacaattgtactctgaatgaaattgggcaaggggcaaggtacagttgcaagtcaactcaggattcatgcagaacattcttggtgtatagagcaaataagcatttcaacaccatttcacaagtttcaaagctcttcaacatgaactctgatgaggtgctacaaaaaaacaacctcacatcttcttctttgtttgatgtactcaaacaaggtaaagaggttcttattcctgttaattgctcctgctctggagggtattttcaagccagtttaagctataaagtccttgacaacacaacatactccgagattgcttgtggtgtttttgaagggctgctgaaacatctcacactggctgaggagaacctttcacaaggtaataagccagaagctgattctgagcttcatgttcctctcgtatgtgcttgttctgaaagttacaatttcacaaggagcatgaaggtgaagtaccttgtcacataccctttagtactaggagatgatcctgacaaattgagtaaaaaatttggcatttcaattgaagaattctatgcagttaatagcttgaatcccttgtcaactgtttatcctgatacagttgttttggttccattaacggatggtcctatcagaatacttgatattcctgattctccttctccacctcctggttttcttctcacaaatccagtggttacaactgaggaatcaacgcaatcgtcgaatatgtacattgcaggatcggttataggattctttttgttcatagcattgcttgcaagtggattgtacatgaagagaatgaggaaaagtgatgttgtccattcttttagtcaaacaaactccctcactttgttgtctccaactagaagctctcatatatctacccaaacgggtaaaagctctacaacttggtgcctttccccggatcttcttgttggaataaagtactacttactcaattacagcatggaagagctccaaaaggccaccaagtatttcagtgaagaaaacaagatctgttgcaaccagggtcacgacagtgactttgtctacaagggctcggtcgatgatcatgaggtgatgataaagaagatgagattggcagacacacaacaggtgattgatttacattctaaaatcaaccacactaatattgtgaacttgcttggtgtttgttatattggtgatgagagcaatgatgactcatggtcttatttagtttttgagttgcctaagaatggatgcttgagggactgcttatctgatccatgcaaccctctaaattggtacaaaaggacacaaatagcctttgatattgcaacatgtctttactatttacattgttgttcttttccttcctatgctcacatgaatgttagtagtaggaatatattcataacagcaaactggagggggaaactggcagatgttggaagagcattggctgccagtgtcacacctaccaaaagaaatggtgtggaaattcccaaaggattggtggcaccagaatacctcttacataatggtttggtttctgaaaaagtggacatttttgcatttggggttgttttgcttgagttgatctcaggaagggacaactttgatggaaaagcaatcaaagattcccttggattttggttgggggaagccagtgaagggggctgttttgaagggttaaggagcttcatggatccaaatctgaaggatttttctcttcctgaggctttatgtttgtctttcttagcaaaggattgtgtggcagatgatcccctgcataggccatccatggatgatatcatgaaagtcctttcaaaaatggtttag

SEQ ID NO: 9445 - DNA, 1008 bp, Glycine max
  Peptide Sequence Number=SeqID_126223
atgtgggggagcctggcagaccgcaaagggcgcaaactgatgctgctgcgcgcctcccttggcatggcgatagcgattttgctacaggcttttgcgaccaacgtttggcagctttttattttgcgtgcggtaatggggctaacctcaggctatatacccaacgccatggcgctggtggcctcgcaggtgccgcgtgaacgcagcggttgggcgctaagtacgctctcgacggcgcagataagcggtgtgatcggcggcccgctgcttggcggttttcttgccgaccacgtcggcctgcgggcggtatttttcattaccgcgattttactgactgtcagcttcctcgtgaccttgtttctgattaaagagggcgcccggccgcaaatgagcaaagctgaacgcctgagcggtaaagcggtctttgcttcattgacccatccggggctggtgattagcctgtttttcaccaccctggttatccagttgtgtaacggctctatcgggccgattctggcgttatttatcaagtcgatggcgccggatagtaacaacatcgcgtttcttgcggggatgattgccgccgtaccggggatttcggcgttgatttccgcgcctcggctggggaaactcggcgatcgcatcgggacgtcgcgtattctgctggcgacgttatgttgcgcagtggtgatgttctttgcgatgtcgttcgtgacttcgccgctgcagctcggggtattgcgcttcctgctgggctttgccgacggcgcgatgttaccggcggtccagacgctgctcttgaaatactgcagcgataacgtcaccgggcgtattttcggttataaccagtcatttatgtatctgggtaatgtcgccgggccgctcattggcgcttcggtctcggcaatggcgggtttccgctgggtgtttattgccactgcgttgattgtcctgattaatatctggcaactggcgattatgttacgccgaagccgccgcgcggccgtttaa

SEQ ID NO: 9446 - DNA, 288 bp, Glycine max
  Peptide Sequence Number=SeqID_126224
atggttcgatcggcgtcatccagtgatgcttcgtttttaaaaatcgatcggtcatctttcctggcggacgtcggcaagcattttttccgatcagtattggacatgaccaagagcaagggcggtgatccacttgaaggacttggaggacctatgacaagggctagagcaaggaaagccaaggaagctcttcaacaagtgctgtccatactatttgaatacaagcccaagtttcaaggagaaaagtccaaggttgtgagttgtatcatggcccaaatggaggaggactaa

SEQ ID NO: 9447 - DNA, 504 bp, Glycine max
  Peptide Sequence Number=SeqID_126225
atgcatgagctttgcctgattctgatttacattgctactgtttatgcctttctgttcgttttgatgcctacaactgtttctattttgttttttttaaacaggtttctattttcgtccaactttttttgccggattgctcctgtttgccactgtttgcaaaaccaaaaagtgatgtctcgcaaagaaaatatgatatctgagttacacaccagaaaaggaacatggaaaatagctgtgcgtatcactgatctttggcaagctcgaaagcaaaatagtaaacaaacaattgagatggtgttgatggaccaaacgggttcaaaaattggagctactctctaccaagaactcttcactgaattgcgggacaagttacagtgtggttcttcgtatttgattcagaacctgaggattgttgacaaccaatctgaatacagagtcagcccaactccatatttggtttatttcctaaaaactacattcgtcaaggaaattcatcgtccataa

SEQ ID NO: 9448 - DNA, 138 bp, Glycine max
  Peptide Sequence Number=SeqID_126226
atggcaacacacaggaatgaggaaagaagaagcattaaacacggcaatgagcaaaagatgagcaaaagaaggcctacaattggacaggcacacatgatatctaataagtggaaatctcgtgtcacgaaaatggtgtaa

SEQ ID NO: 9449 - DNA, 729 bp, Glycine max
  Peptide Sequence Number=SeqID_126227
atggctatcatgaatgattccaatccatttctgattcatccttctgataatcccagtttgatgctggtttctcatcctttatctggtgacaactacaattcatggaaaaaggcaatgaagatggctttccttggcaaaaagaaatttggtttcgtggatggttccattcttgaacctcctcctggtcacatcaactatctcaaacctgctcattcgtgcccatgtgatgggattcaaccttggtgtgattatgatcggatggaaaaaacagagattggtacatctgcttcacatgaaacttctcatgtttttgctgtgaaaaatggttttgattccaagaataaaggtggacaaaaggatcatcctatttgtgctcattgtggaattcagggtcacactaaagcacaatgttataaacaaaatggttatccaccaaattacaagaagaacaagccttcttctaattcagccaatcaagtttcttctaggtcagtgaatcaagtctctttgagttccatgagccaggattctccatcacaatttcaacttacagcacagcagtacaaccagttgatgagtctcctacagggtcaaacttcaaatgtcactgttccccatcagaatcatggtgattctaatggtatgattatgtctgcctcctcctttaatctccttcgtgattgctggcttgttgattcaggtgctagcactcatgttgcttgtcaatag

SEQ ID NO: 9450 - DNA, 336 bp, Glycine max
  Peptide Sequence Number=SeqID_126228
atggccgtgttaaaaatggctcagcataacaatgccaacattaacaacattgtgagccaacaacagcagctagtgaagccaatgttccatgactttcttggcatcaagaacaagaaccccattgactccaatgtcctttatgcccctaatctccacgtcacctcctcctcctcctccctctcttccaccaccgtgtcccgcggcggtgccacctccgacctcgcttccgaaagacaggttggaaatcatcttgagggagttccattctatggcgcaagaagcaatttttctggcattgagataggcaacaggactagtgggaaacaagagaaataa

SEQ ID NO: 9451 - DNA, 1635 bp, Glycine max
  Peptide Sequence Number=SeqID_126229
gctggcaaccttgtgggcggagtatttcgacggcagtgccccaagatgggtacccttagagtagcagtcaacaaccaccaagatggtgatgcacccatgggatggcggcagtcccgtgatgaagttgagaatgcgacactccgataccatgcgacgaacatcgcggcgcatagtgtcctagaagaaggtttctttgagccttcgcaaggtcttagtttctcccatatggcctccaagtggcgtggagtgaaattcattcaacaacatggggatataaggattatcgagttggagccaaagcttgccgcgatatcgaatccatcccaacaatcaagagtggggatagagagaatgaagcattgtcccggtggcacaatgcgtgaaagggcatctatcgcgatgttgccgactctagtggtttgtgatgataatgaaatggtggttgaggagatagtgctgccatttgcgaacgacagaggtgatcgcatggagttctctaacgatggctcccattgccacaccggaggcgtcggtctccaagcaaaatggaatagtgaaatccggcggagtcaacagcggtgccgtggtcatgacttgtttaagtttatcgaaagcaccttgagcttcatcattccaatgaaaattgtccctgcaaaggagattggtcaaaagggctgccagaggtgcatatccatgtatgaaacgcctgtagaacccggtaaggccaaggaatccgtgaaggctggctttggcgaaaacgcacttagaggcacacaggaagaagaagccttgggcgatcgtggcaaaaacagcttccagatgccggagatgatcagttgccggagcattgcacagcccaaaaggcatgacgcagtactcataatggccgttgtgggatgccatgcccagcttgtcgaggagctcgtcaatggtaggcatagggaagcagtgtttaatggtaataacattgagggtgtgataatcaatgcatcagcgccaactaccattctttttcttggcgaggagcacagaggtggatatggtgggaaattggacggactggagggagctgggttggttcgcggagaatatgttggaacttatccaggagggaggacagggttgtgggtggcggacggtcatctgaaattaaggtgggggaggtggttagggatgaaggtgagggtgtggtgcggaggtggaatagggccgagaccgcctgggcccatgtgggtgaagaacatggagaatgaggtctgtgataaacctgtgcccttgaatctcaatggagacctgagggtagcggcgggtacactgcatgactccgccgtcaccaaccataatcgagaaagggtctatcgaggtagagggaagagcaagaaacttagcgacatgggattgcacaaaattgtgcgtactactgccatcgacaagtatggctcaattggggctgagagtcgtctgagactggtggcggggaggggtcgctgtgtggttggggcgattcgggtggtccggtgggcacagtcccttatcgcgtttgatggcgatcgcctcaggggacaagcggcggaaaggcaatttggaggagggtgtggtggttataggccttgtggctggtggtgggtggggtaa

SEQ ID NO: 9452 - DNA, 483 bp, Glycine max
  Peptide Sequence Number=SeqID_126230
atggcacaaaggtgggacaaggtcacactgtcttcacttggtactgctccaatagccataataggcatccctgattgtttcattgaatgccatcaaactgatatttttcaaggggaggaaatttcggccatggcaagaatggcaaatatttcagtcttgagaagagtttcactgcaattctttcaagaaggaaattggacccatgatgatctctttgaggacacggagcttgaaggggacactgaggaggatctataccagagactcctatattgtagcaattgcatacagttcattcacactcgtagaggttatatgatagcaacaggacacaagctgatggaaggcccaagagacttaccaagaggccagcccattacgaagactacgtctgaagcgcaccaaggattcttgctgaatattcaatcatcattctgttttcattctgttatgagaattatccttctgttatttcctttttag

SEQ ID NO: 9453 - DNA, 1869 bp, Glycine max
  Peptide Sequence Number=SeqID_126231
atgctctctcgctctctcagacctcgtcacatactctcctccctccgttcattaccctttaccctaaacccaaacccaaaccctaaccctaaccctaaccgaacccctccaatccgagcctccacacaccgtcccttctcttcttcatggctgtccgaacctggaaacccaatcatccaatggccctcactacccccaccaaaacccactccgaacccaaacccaaacccaaacctaaaccccacacccgaccctccctctcccaacccaaacgctctctccgtcatctccaacctcttcgccgacccttccctctcgcccggcccggccctccacgccgagctcgaccgggctgggatcgagccggacccggcccttctgctcgccgtgttcgatcgcttcggctcgtcgcccaagctgctgcactcgctcttcctctgggcccagacgcggcccgccttcaggcccggccccaagctctttgacgccgtagtcaacgcgctcgcgaaggcgagggagtttgacgccgcgtggaaacttgttctccatcacgccgagaaagacggggaagaagaaggagaaaaagaaaggttggtttccgttggaaccttcgctatcatgattcggcgctacgctcgtgcaggtatgtccaaacttgcaattagaacatatgagtttgccacaaataacaagtcaattgtggattctggctcagaaatgagtttattggagatattgatggattcactttgtaaagaagggtctgtgagggaagcttcagagtatttcctttggaaaaaggagttggacttaagttgggttccttctattcgggtttataacataatgttaaatggatggtttcgattgcggaaactcaagcagggagagagactttgggcagagatgaaggagaatatgagacccactgttgtgacatatggtacccttgtggaaggatattgtcgaatgcgccgtgtcgaaaaggcacttgaaatggttggtgatatgaccaaagaaggaattgcaccaaatgcaattgtgtataatccaataatcgatgcactggccgaagctggaagattcaaagaggcattgggtatgttggaacgttttcatgttttggaaataggccctactgattcaacatacaattctctggtaaaggggttttgtaaggcaggagatcttgtaggtgctagtaagattcttaaaatgatgataagtaggggtttcctcccaagtgctaccacttataactacttttttaggtacttttcaagatgtagaaaaatcgaggaggggatgaacctgtatacaaagttgattcaatctggttataccccagatcggttaacttaccatcttctggtgaagatgttatgtgaagaggagaagttggacttggcagttcaagttagcaaggaaatgaggcataatggatatgacatggacttggctacgagtaccatgttagttcacttgctttgcaaagtgcgtaggttggaagaggcttttgtggaatttgaggacatgatacggaggggtatagttcctcagtatctgactttccagagaatgaaagctgatttaaagaaacaaggtatgactgaaatggctcaaaaactttgcaagttgatgtcttctgttccttattctccgaatttgccaaatacttatggtgaagtcagagaagatgcatatgcacgaagaaaatctataattcggaaagccaaagcattttctgatatgctgaaggactgtaaggaccctagtgaacttcgtaagcatagaagttcatcagaaaatactgtctcaagcacaaacagtttgatagaggatattgagagaaaaagaaatacaggatga

SEQ ID NO: 9454 - DNA, 948 bp, Glycine max
  Peptide Sequence Number=SeqID_126232
atgccagaacataatacgcgccaaacctccattgagcgactggaagaggccatccacaagcttacccagcatcaatccaccctatcccaaaaccagcagtccctaacccaagccaatgcgaacctcaacctcaagctcgattcggtcctcgatcgactcgcagccctcaccgaatctccaccctcaccgaaaccacccccttcaccaccgcccaacaccatttccagaccacacatgaaacttgaagtcccacacttcgatggccaagatcctctcgggaggatcttcaaaatcacgcaattattcgattatcaagggattcctgatgcagagcgtatcactgtggcgtccttctatatggagggacttgcactctgttggttccaatggatgtccaggaatggcttcctgacatcatggccgaccatgcttcaagccttggagtcgcgctttgccccgtcgtactacgacgacccacatggtgcgcttttcaaactccaacagcgaggcactgtcaacgactacctggcggagttcgagcacctcgctaatcatgttatcgggctgtctcccccgttgttgatgagctgttttatttatgaattgtcgctagagctccgccgaagacaagttctccaaccgccgtcgcagcaaccgagccacttaccccacccaccaccagccacaaggcctataaccaccacaccctcctccaaattgcctttccgccgcttgtcccctgaggcgatcgccatcaaacgcgataagggactgtgctattattgtgatgcaaagtggttgacggggcatcgttgccaaccccgtatccacctcctaatcgcggaagatgacgtggatctgctcaccccaccggaccacccgaatcgccccaaccacacagcgacccctccccgccaccagtctcagacgactctcagccccaattga

SEQ ID NO: 9455 - DNA, 507 bp, Glycine max
  Peptide Sequence Number=SeqID_126233
atggcttccatgagtatattcaccaccatttccctcgccgccgacgcccggaatccggccatctattttccccggcggcggcagcccaacacggtcattttcgccgccgcctcatcgccggaatctcctccagaaatagagctcgagttcatcgggccaaaaccgggaagtgatggatcgtacccggtggagagagtgaaagcaataagcggagagaagctgttgaggaacatcatgttggataacaagatcgagctttatgccacctatgggaagctgatgaactgcgcgggaggtggtagctgcggaacatgcatagtagagattattgaaggaaaggatcttttaaatgaaagaacaaacactgaactcagatatcttactttcgccattttaaacagaaacccgaatcttggaggctggcttgtcaaactattgttggaaacaaagaaaactctggcaagcaagagtggtgtcacgagtgtaagagcacagcatataccatga

SEQ ID NO: 9456 - DNA, 810 bp, Glycine max
  Peptide Sequence Number=SeqID_126234
atggttagagaaaatgctgtaatgggtggtgccagtgaagagcgtggtgttcgggtcactcgagcaatggctagagctgttttgggtggggtctctgcctcttctagaccgtccttcaagaagcaacacaagaacaacaagggtttcggtagggtagcactagcagatgtcactaacataagcaagaaagggtgtgctacatcaaaatctcaggcaagaggaggttacaagaagactaacacaaagggagcttccaatgtctccattcaagttttgtcaactcaagaagatgttagagcaaaattagcaaaagatttaccctcaatatcaatggtacagtcacatgacgctaatgtagctgaaaggcaggaaggcacagaggtagtgcaaccttctatgtctgttatggcaggtcctctgctttcaatgcaggactctatgaagtctgatgaaatccttcgctctccaaacaaagacgttgatatgatgattactgagaaactaaaactttcagatggtttggacattgtggacattgattcagtggagttaaaggatcctcaagtttggagttcatatgcccctgatatatacaatagtatatttgtcagggagtttgaaaggagaccgtcaagtgattacatggatatgttgcagcaagatatcactccaagcatgcgagggattctgattgattggcttgtggagttaatgtcaaattttgatgagttgagggtgagccttggtacaatgataagattgttgttgcctcatgagtcattacctagagatcaagaattcaactcctag

SEQ ID NO: 9457 - DNA, 381 bp, Glycine max
  Peptide Sequence Number=SeqID_126235
atgaccgccctgctctctgacactcattccttccattggcggaatggagctacaatacatcaactcattacggcacaggcatcgttcccacaatacctccctgggtcttccacaatcaaggcagctgattctatagtgttgacccgacaagaattgcacaacaaactacaacgccgcttagctaaggcccaggctgctatgaaaattcatgctgactgccaccgtcgcgatgtgcagttccatgtcagcgatctggtctatgtccgactctggccttacctccaattatccatcaggccccattattcaaaattggccaaacgattttatgggccttattgggtcaccgagaagattgggcttgtggcttaccgcctctag

SEQ ID NO: 9458 - DNA, 573 bp, Glycine max
  Peptide Sequence Number=SeqID_126236
atgtggatcaagttgatccatgcgaagcgtgctagaatgctaccaaatgcggatcaactaaaacctacgaggatcatctaccctaagctacacaaaaaacctacaatggaaacgcaaacgacatcaagggagaagagtacttacctcgacaatgtcaacgcgctgaagaagaagaagaatgaaccaacgagccaagtagtggaggagaagacgacactgcaaaatagagctaggtggaagaagaagaaggtcgcggaagaagaagaagaaggtcgcagaccaaagcttgtagctgttatccaaaggcttaagcctttttttaatgatcgggtccttgacattctcatttggaacgagaatctgaatgggagttataccacaaagtcaggctatcaatggcttctgaggaggagacttggagatgatttatgtaatggatggaactgggtttggaaagttaaggccccagagaagttgaaatttatcttctacaggatgaaaccttccaacattgttttagagactactccttacccagacagctatgggaaaaattgggtttacaaaggatga

SEQ ID NO: 9459 - DNA, 495 bp, Glycine max
  Peptide Sequence Number=SeqID_126237
atggagagtgaggttctaaatctgttgcattttcagttatctgttcccaccacaaaaacatttctcaggaggttcatcctagcatcacaatcttcttacaaggtttcatatgttgaactggaatttctggcaaattatttagcagagcttactcttgttgaatacagcttcttgcagtttctaccttccttgatagctgcatctgctgtattactcgccagatggaccctcaaccaatcagagcatccatggaattcaaccatggaacactatacgaattacaaagtgtcagagcttaaaactaccgtccttgcactggcagatttgcaacatgatatgaaaggctgttctctgaattctatacgcgaaaaatataaacagcagaagttcaggagtgtggcaaatttgtctccgaaaccggtgcagtcacttttcaaggctcaagatctgaagatcgtagctaaaagggcatcttgcaatcttcagattgactaa

SEQ ID NO: 9460 - DNA, 1986 bp, Glycine max
  Peptide Sequence Number=SeqID_126238
atgcagaagattgaggttcagaagttaaattgggtcaagctatggaaaaaaggtgtaccaaggattgatcccttttcttattcatcttttgagaccttgcaagaagcagaggctgcctcttatgaaatgcctttcttcactcctttaaacctacaacaacttcttactctaatggctaccttcaatctagttcttccctggaatcgtgctaagttggaggaatccttctacatagaagacatctaccttgaagatcctgagatgagtccaaccttctcagaatgggataactacactgcatcaaaagatggaactcataagcagggattggcaacctttgcaaaggtattacagatttttgtgtatgggcaaaatttgtcattcactgttcaacttccaaagtctacattcaccttcattcatcaagtacaactcatcattaaagatgtgaattctaatgatgaggctcctactgttgctgctaatatggccatggaagtctacaattgtccttctccatcccaagaagaagctaaaagatggaagatctttggagagtacctttttaataagtgtgttgacactttcttgaataattcatctgataacaaatctggggataagttctttcgcaagcttgaagaggaagaagaagttgtcaaacaaaagggggagaataacaagcttcctcggaagtcgttgaagcccgactcggacgagtcaccccgagtcgactcggctcgttccgccgattcgccacgtgctgccggcagaagcaacaagccacatggcggaagttcttccgccgccaagcgagcttcttcgtcggcggtgtttccggcgagcatggtgtccggaattgaacctttggtgccgtttaaggatgttcctaatgctgagaagatgaacctgtttgtgagcaaattgagcctttgttgtgtcacatttgatttcactgaccctagtaaaagcagtgcagataaagatgtgaaaaggaagactttggttgagcttgttgattttgtggcttgtgggacaatgaggtttagtgagcctgctattcttgctatctgtagaatgtgtgctattaatttgtttagagttttccctcctaattatagggcaagtggtggtggtgagaatgatgatgatgagcctctgtttgatcctgcttggccacatttgcagcttgtgtatgaattgctgcttaagtttatctcttcctcatgcatcgatgcgaaggtggcgaaaaaatatattgatcactcctttattgccagattgcttgaattgtttgattcggaggatcctagggaaagggattgcttaaagactattctgcataggatttatggaaagttcatggtgcatagaccgtatatacggaaatctattaacaatatattttatcggttcgtgtttgagactgataagcccaatgggattggtgagctgttggagatttttgggagcgtgattactgggtttgctttgcccttgaaagaggaacacaaaatcttcttgtggagggttttggtccccttgcacaagccgaaatctattggggcctactttcagcaattgtcctactgtgttatgcagtttatagagaaggagccaaagttagcgagcattgtgataaggggattgttgaaatattggccagcaacaaatagccagaaagaggtagctgaaagggctcttttcttatggaacaatgaccacattgtaaacttgattgcgcataaccgacaagtgatcctgcccatcatattttcagctttagacaggaatgttcaaagccattggaacccggcagtcgtcaacctaactaacaatattagaaagatgttcttggagatggatgagaagttcttcatttcttgtcataatcactttaaggaggaagaagcaatcttgatctcaacaggggagaagcgaaaggaggcatggaaacaactagagcatgcagccagtctaaggcca

SEQ ID NO: 9461 - DNA, 429 bp, Glycine max
  Peptide Sequence Number=SeqID_126239
atgcataaatgccccaggtgtggggtatcatggtacaaagtgaagaatcatgacaagtgtagtagtgatgaaagcacaaagaaaggccacacaacgaaaggtgttatggtttcctcctatcattccaaggcaagaaatcttaggcttggacttgccattgacggaatgaatccctttggcagtttaagcaatcagcacagttcgtggtttgttttgctagtaatttacaacttgcctccatggttgtgcatgaagcgaaaatacatgatattgtccatgatgatatccgacccaagacaatcaggaaatgacattgatgtttatctcagttcgttgattgaagacttgacaaatttgtgggacgagggggttgctgtgtatgatgggtatcaaaatgagatattcaagttgtgtgcaatgctattttga

SEQ ID NO: 9462 - DNA, 324 bp, Glycine max
  Peptide Sequence Number=SeqID_126240
atgccgtcgcgggcaatgatgctgagaggtgagagcgacactttagtgctgagaagtgagattgagagagcgatgctaaaaggtgagactgaaagagcaacactaagaggtgtaagtgagactgagagcgacgctgagtcaagttttagtggaattgggcttctaccaattattgggcccaagccttatatgcaagactacaagcaatatgcatggttgggtcgggttcagtctaagaagtccaaaccgaacccaatcgtcctaaaccattttaaattgactacccgacctgatttaacctgcaacctgttcaaacccacctga

SEQ ID NO: 9463 - DNA, 516 bp, Glycine max
  Peptide Sequence Number=SeqID_126241
atgccgaatcctgatgtcgaacccttatacatgatggcattgaccatcccgcagcttttcctcaagcttttgcagatgttgtgggatgctaccatgtttgagggattcaacgatagtcaaggaagtaaatccaaggttgcggctagatggattctagttaaacaaaaaggaagcattgagtacgagtactacgtaatgcattggatgtcaacgatagtcctaggagaattcaaggataattgggaaatggcatattgcatgcttgctttcatggacaaaggccgcaacatactagtagcaagccaatcatgtggcatcccaacagaaatggaagttatgttctcaatgtcaatggaagaaaattgggtgagtctggaagagcgaggtttggtggtctcttcagaaccagtgatgggcaatggattgctggttttagtggctatttgggtcagggaaatatccttcttgcagagcttaatgcaatttattgagggcttctacaagctcgtcatatga

SEQ ID NO: 9464 - DNA, 4785 bp, Glycine max
  Peptide Sequence Number=SeqID_126242
atggaagggagagcagagaacaccaatgacactgcaattctcaagaaatcaagatcactggatcttaaaagtctatataaatcaaaattgacagaaaacactgcaaagaagaacttaaagaggattggaaatagtagtgggggtggtgatgagaagaggaagaaaaaaaaggctagaaagaaagtctttttaagtagcttagaaaatggtgatggtagcagtgagttgaagttaggggtgagtcagagattgagtagtagtagtagtacgctaaatagaatttcatttagtgttggtgatgatgatgttcagattcccaagaggaagaggagttttgtggggaggaagaaatcagaacttgttcaagcatcaaaagtggtggagcagtctggtctgaaaattggctatggtgatcaggtgcctaagttaggcagtgatgatttgggcagtggggttgagtctttcaagattaagcatacgaaagaatttgatgaatttaaggaaaataggaatagtgattcaaattcagttcagcatgttaaggaggatggggattgtgcatctcattctgttgtaaatagtggtgattcttctttatcaaagtcacgaaggaagaataggaagcgaaaggcttcagctttagatagaactaaggtttccaaggaggctgaacctttggtttcaagttgtaaaatacctggcgatttgcaagatgaagaggaaaatcttgaggagaatgcagctaggatgctatcttcaaggtttgatccaagctgtactggattttctatgaaaggtttaaatggtttgcccttttttggatcctctagtcaaagtattgttaaccgtggtttaaagtctcagtcaggttcagaatcagcgtcagctgatactgctggcagaattttgaggcctaggaaacaatataaaaacaagggtgattccaggaagaggcgccatttttataaaatccttttaggtgatgtaaatgcatattgggtactgaaccgaagaattaaaatcttttggcctttggaccagagttggtattacggcttcgtggataactacgatgaaggaagcaagctttaccatatcaaatatgatgatcgagatgtagaatgggttaatctacatactgagagatttaaactcttgttacttcgtagtgaagttcctggaaatgcaaagggtgaaagagccttaacaaaacgtaggagttctgatcaccaaaagggaagcaaatccagtaaagaaaggcaaagaactacagaggatgatcgtagtggtgagagcagtatggactcggagcctataatttcatggttggctcgatcttctcatcggcttagatcttcttttcaaggcattaagaaacagaaaacttctggtacaattccaagcacaatgtcatcattcttatatgatgaacctgttacagcaaagggccatttagctaagatttctttgagaggtgttaaaaataatttctctagtgattctgtatcacaagataaattaagtgatgattttagggacaagtcctcattgctaagtgccactgccactaaagatggaaaacagcctattgtctatttcagaaggcggattcgaaagccagctccaatatcccctcatatctctgaagaaaactatgctattacaggtgcatctggttccgttgcctttaaccatatgttttgtggggttgagaaaatgaaaaatccaagtaatggcagggctgaggttgggggcccattgtgcttcactttaaaggcgggagtatcaaaaattttttgggacatggagtcagcatcattcaaatttggcttaaactttccaatgcgtttggtgttgaatgacttttttcaatcagaaaatttgtggttgctttacagtgttttgctgcttcggttcggtacagttatgaccaagtggcctagagtttgtttggagatgctttttgttgataatgtggttgggttgaggtttctattatttgaaggctgcttgaacatggctgcagcttttttcttttttgtccttagggtatttcatcaacctgcttaccgagggaagtatgttgacttgcaatttccatgtacatctattggattcaagttttctagtgttcatgttattaagaagccgcttgtgtttgagttctataatttctctgaagtgaagaattcaaagtggatgtgcttagattctaagcttaagaggcattgcctgctcagtaagcagctccatctttctgaatgcacatatgataacatccaggcacttcaaaatggatcatgtaggttctccataacatctgtcagtgggtcctcctcagtcaaggtcaggcagaagaggagtaggccagggattaacatcatgggtatttccaaagtgtccgctcaagctgatactcatcagtattctgatgctggcaagtggaaacttcctccatttgctctttctttttctgcagcccctacattttttcttcatttgcatctcatgttgctgatggagcagtctacaaatcgtataagcttttgtgatcaaacaccaatattcgatcaggaagaccctggtttggtgacaaatggatgtactaacaccagtggttgctcacacaggaattctgaaattattctgaggaaagatatggagactttgtcaaatggtgttgcaggtgatggagggtcttgcgctgactcagatcatccctctacctgcagtgataaaattctcattcaaaattacctgaacattggtcttaacagtactggtactgccatttcccatgattctgagaggcttagtacaactcaggtaccagaatggaaatgccaccaccatttggagcaagagttaggctctttaccttcaagttctttaatacgtcaagataaggctgatgatggttctcattcttctattggtgatctcagcattcaaattcctgcagttgatcaatttgagaaacctggtgatgatggtgatttatgtgatgctgaacactctcctggtttctcttggaatataaatggaggtggtattccaagctccaatccaactgctcgcagaagttcttggtattggaaccggaatagttccttgtcattgggatttcagtctcatgtgtggtctgatggcaaggctgattctctttgcaatggaccgaaaaaaccgcgtacacaagtgtcatactcagtgccttcagcagggtatgaattcagttcaaagcagagaaaccatcatcagaaagggcttcctcacaaacgaattcgaaaggctagtgagaagaagtcatcagatgttgctaggggccttgaaaagaatgttgaatgcttatcttgtggtgcaaatgtcttgattactcttggtaataagggctggagagaatctggggcccatgttgtactagagctgtttgaccacaatgaatggagactctctgtgaaacttttaggaattactaggtattcatacaaagcacatcagtttctgcagcctggatcaacaaatcggtacacacatgcaatgatgtggaaaggagggaaggattggatcttggaatttcctgataggagtcagtgggctcttttcaaggagatgcatgaggaatgctacaaccgtaacatccgtgctgcttcagttaaaaacatacctattcctggtgttcatttgatagaagaaaacaatgataatggatgtgaagcaacttttgttcagagctgtatgtactaccaacaggttgaaacagatgttgagatggctctgaatccatcccttgttctgtatgacatggatagtgaggatgagcagtggatttcaaatgctcaaaattctgtaaaagacaacaacgacttgagttggatctcagaggagatgtttgagaagacaatagacatgtttgaaaaggttgcatatgctaagaagtgtgatcattttactcctaatgaggtagaggaactcatggttaatgttgggcctttgtcagttgtcaaaattatttatgaccattggcaggagagaaggcagaagaaggggatggctttaatacggcactttcagccccctctatgggaaagatatcagaagcaagtgagagagtgggaactagccatgaccaagaacaatgcccattctaatggatgcctggacaagtttacaactttggagaagccagccatgtttgctttctgtttgaaacctaggggtctggaatcactgaacaagggattgaaacatcgatcccaaaagaagatttcagtctctgggcatgcaaacagtaatctagatcaggatggcttccacactttcagaagaagacagaatgctttaccttttggtgatgaaaagttcctataccaaggccacaattacgattcttttgatgattcatcattggctctgacctcaccaagggtattcttacctcgtgatgctggcagcttgaaatactatcctactagtaatggagcgggatatagaaatcatatcccaaaatttcacaagtccagatatgatacgcctggtagcaggcatcaccttcttgctggccctatgaggcaagggactgaacaattggatacttcagtccttgaggagttaagactacgtgatgctgtggctgaggctcgttttaaacgccatgtggcaaagttgaagagagatagggctaagagattgttatataaagcagatgtagtaattcacaaggccatgagtgctctaatgactgcagaagcaatgaaagcttctgaggggactcccttggtgaaatga

SEQ ID NO: 9465 - DNA, 348 bp, Glycine max
  Peptide Sequence Number=SeqID_126243
atgaagggaagtgtgctggaaattttctcttccaaggcctcctctaagattcctccaaggcttcaagaactcacaaacttactagaacctctcattttctcattgttttggaacactgagagaataagagaagttgtcaaagcaaagaaggcccgcccaatgagagctcgtcccaagaaggccacgtggcaacttaggaatggaggaaaaaggatcaagtcatttgaagaactcgtccagcaagcaaagtccactgatatgaagaagtttcaattcaaattggaaattttgaaaaattctccgagcgagtttaactcacccaatgagcaaggacagttgagaaagtga

SEQ ID NO: 9466 - DNA, 726 bp, Glycine max
  Peptide Sequence Number=SeqID_126244
atggttggatcgatcctaattgatcttgatagcagtcaactctatggtacaatagaggctaattgcagcctctttcacctcaaacaccttgatgttgttgataataactttaatccttctcaaatcccatctaggattggtgagctttcacagttaagttatgtgaccatttcctcgtctttgcaacgactctctcttgatcactgtgaactacacggggaatttccctctggaatattccaacttcaaaacttgagatatctgaatatgggaaataggcaaaacctcactgggtctatgccttcttcatttggaaacctcactcagcttatggttctagatattgaacacaacaaattcaggggccatctttcatcattcttggaaaatctttccaaattacgcaccctaatagttggttggaatgaattcattactggcactttctcatggatttttggcatggttctctcatgtttcggaagttctagtcaatctctgaaagttttggtgctaaaaggaaacaaattcattggcctcattcctcaaacatatatgataacaagtgatatgagaatgatggatttaagcaataattatctgcagggtcaattgcccagagaatcggtcaactgtagaatgctagaggttattgatgtcaggaataaccaaattaatgactcatttccctgttggttgggaacacttccggaagttgttgtttaa

SEQ ID NO: 9467 - DNA, 309 bp, Glycine max
  Peptide Sequence Number=SeqID_126245
atgctacttcttcgacgcactcgccctctccccctcaagaactatgtcgacaccaaaaaaaacacaatcccgattccctcacgcaagaaaaagttgttgatcagatctctgttgtcctcgacgtcctttgcctccaccaccgcaacgtctggttcaagtggcagcggcgcctcccatgcgtcctcttccgacgagtggggagaagttggaaacgctctacgaatgcacccaagtcctccttggggagctgccggcgccggctgcgataggtctcagccagaacggcctccgacgagtcctaatcaatga

SEQ ID NO: 9468 - DNA, 303 bp, Glycine max
  Peptide Sequence Number=SeqID_126246
atgtcgcatgagccaagtgggagaatgttagaattaatgtctcatggtcctcttcctgacagaaaaatattctctctaacctctagccatcacaaatgtagagagacaaaaagaatagtcaaggaagtgaaatcttatttctatcctcttccaaggaatcaaagtgcaccagagaaaagactcactatggagaaagggaagtcacttatttcatcattaggttcgcaacaacagagcatgccttttgatgaggatcaacgtcttccacattctggactttatttattcttcataggactttga

SEQ ID NO: 9469 - DNA, 1455 bp, Glycine max
  Peptide Sequence Number=SeqID_126247
atggcgttgtttgacaacgaagattcgtcaaaagaaagaggatggatcatgtggtttgatggtgcttccaacatcataggccacaagataggagttatattactctccccagagaagcagtatatcccaaccacgactaggtccttcaatggtgattttccaccatggaggtgcaatggaagacaaaggagaagaggtgagaggaggcgccaaccactagggaataagccttggaagaaggagcttcaccaccaagaatgtgccttggataagaagcttggagaggatgcttcaatggaggaaaagaaatacaaagagaaagagaaaggggggagcacaaaattgaaggggattgcatcaccatccatgttcgcattgagcaaggatgaggacatgacatttataaagatccaacatcatgatcagtctatgtattgtcacttggtagaagaggaatctgatgggaaaccatggtactttgacgtcaaagagtatatcaaaagtcgaaagtatcctccaaatacctctgagaatgacaaaagaacattgagaagactagcagtgagctttttcctaaacggtgatgtgttgtataagaaaaatcataatatggtgttgctcaaatgcgcagatgtcattgaagccaaaaagatcatcaaagaagttcatgaaaggaaacgtcacaagtgccagacatatgtcgataacatcaatgctccaccaatgtcgttgaatgtactatcatctccttggcctttttctatgtggggaatggatgtcattgggcccatagaacccaaagcgtcaaatggacatcacttcattctagtagcaattggttatttcactaaatgggtcaaagtcgcttcatatgccattgtaactcaaaatgtgatagtgaaattcatcaagacagaattgattggtcgctatggcatacaaagcaaactcatcaccgataatgcaactaatttgaacaataagatgatgacaaagttgtgtgctaacttcaagattcaacatcataattctaccccatattgcccaaagatgaatggggcagttgaagcagccaataagaacatcaaaaagatcattcaaaagatggtggtgacatacaaagattggcacgacatgctcccattcgccttacatggatatcgtacatctgcctgtacctcaattgatgcaaccccattttccttggtgtatgggatggaggtagtccttccaattgaggttgaaatcccttcattaagagtattaatggaggtcgagttaaaggaagcagaatgggcacaaatgcgatttgatcagttgaatctccttgaggaaaaaagaccttatggggttaagaaagcattctctggaagagcttttatcctcacaaacatggatggcaaggagttaccataccttgtgaactctaacgcagtgatgaaatactatgcttaa

SEQ ID NO: 9470 - DNA, 744 bp, Glycine max
  Peptide Sequence Number=SeqID_126248
atggttgtggttccaatccagactgaccaaccagttcattccacgcctccaatcaaccacaacatgatacaggtcacaaaaggagtcccagtggcctgttcaaatgagcacctacagatgttggaggaaagtttgaaagttatcgagggtagtaattatggcatggtggaagctgcaaatctttgtttggttcccgatgcaatcattcctccaaagtttaaagcaccagagtttgataactacaaaggaactagctgcccaaaaagtcaactaactatgtattgtaggaagatggcggcacacacaagagatgataagcaacttatccattgttttaaggacagtttaattggggcaaccctaaaatggtatatgcaacttgagcaaggccatattcgctcatggaaagatttaggtgaagctttcatcttgcaatacaagtacaacatccacttgactcctgaaagatttgagcggctaaggaagttcaaactgaggctaaatccagccaaatgcacttttggggtcaaatctggcaaattgttaggtttcattgtcagccaaagaggaattaaagtggatcctgacaaagtttgtgcaaatgttgccccctcacatggaaaaggagatttaaggtttcctgggaaggttgaattatattccccgatttatatcccaacaaacggcgacatgcgaacctatcttcaaattgttgcgcaaaaatcatcctttagagtgggataa

SEQ ID NO: 9471 - DNA, 309 bp, Glycine max
  Peptide Sequence Number=SeqID_126249
atggaacgtgtggagcataagtataggctctttggagttgtcgagcagatgtcaggcttgagttcaggtgttgaatacatttgtcaagaagattctgggcttgtagcaagagtcaggttaattttgggcttgaatgttggtgctgggctgttctcaagattgaatgatggtgtcgagtcggcttcgacctcgcctgttggtgttagactcgactgttgggtctgggtcggttctgggcttgactattggtgccaggtcggttctgggatttcaagatggaatgttgatgttaaactgcttggtcattga

SEQ ID NO: 9472 - DNA, 216 bp, Glycine max
  Peptide Sequence Number=SeqID_126250
atgaggggatgcttaggtgctttaattggtccatggtcttgggcacttacttttggccgtgatcatagctcatacgacacaggaaatagagtaactgtggccaaggaacacctttgggctcccaggctgatcacctatgggaggggggctgttacgtgcacaaccgggtggtctcaacaaactcagcacagttccctaagtgagagtgtcgagtag

SEQ ID NO: 9473 - DNA, 591 bp, Glycine max
  Peptide Sequence Number=SeqID_126251
atggaggtagacatacccttggggtggaaatcacttaacctcgagcgtgttcagtacgccaccagtaggtctcattgcatgaccttggctgccttggccagtctacgacaagcagacgatgaatccctcagaaagttcattggcaaatttgggcgcacagtcgtccagatccgaaatctcaaccctgagataaagttgcattccatgcttctcgcactacaccctagcaagttcgtagatagtttgtgcaaaaaactacctggtagcatggatgagccgcacgaacgagccaagggttacatccagatagaagaaatgtccaaattctggaatgaagtctaccaagtcaaacaaaagtgtgaaaggtgcaaagcaaacaccaagaccgacttgcacaagtcggacaagaggccacaagctagacaagcgccaacctctctccaaaaggcccggtatgagcgttacataccattgacggccaatcgtaccacgattcttgaggaagccttcgacctggaggctcagacgcaaccaagtactgcaggtttcaccgcggtattgaacacaacaacaaagattgttgggccttga

SEQ ID NO: 9474 - DNA, 654 bp, Glycine max
  Peptide Sequence Number=SeqID_126252
atggctaccccacccagctcttctccttctcctcttcctcctcctactgaggtagcatcacagtcgtcctctaccttgaagcagacgagaaaagccacacgactaagatcattggcgactagactagctggggcaaatagaccgatggtgcacatcgatcttgcgaccgggaaggctgacggtccccacaagaagaaattaagaacatatttagcgattgttgcttgtgataaggtcaacgtgacatacgagaattggaagcaagtccctgctgctcagaaggatttgatatgggaggatattcagggagctgtgggaccagcaaaacatgcagataggttggatcatgaggtcgatgatccactatatctaatgacattgactatcccacaactttttttaaagccgttgcaagttatgtgggatgctatcgtgttccagctgtttaattcatactttcccttgtacataaagcatgaagatctgtctgaaataacacacggtggtcaatgtatcagcatctctattatacagttgtggattcttcatctatctgagataggtatgcgagcagggaatttcgatgtgtatggattcctcgagccacagtccatccagagatctgggcaatcgcaatttgaatcaaaaagttga

SEQ ID NO: 9475 - DNA, 514 bp, Glycine max
  Peptide Sequence Number=SeqID_126253
atgaaggtggttggaacatcaatggcattggaatcatggaatttcaacttgctgtgtcagcctttagcattaaactttgttgcatctatggctgacagctcagcagtggagctaaggcagaaggaatgtactgagtcagtcatggtgattaaagttatatggtgtccgcccttgtccctcccaccactgaagctgctggacctcagtttgcttgcaggggcagtgggtcgttcccagttaagttacaaggggaagggtgttgataagcataagcataagccacacatcaccaaggtgtacacccacaaacagcgagcaagagaagcaataaccatggaccaccagcagcagggcgcacaacacccaaggggtgcaaaccacccaacagttacgacccacccaaaaggtgcaaggggacatgacccttgggaacagtcacaaccaaccgttatgatccaccccagggttgcaaggtcaagagatgcgaatcaagggggcatgacccttggaaaca

SEQ ID NO: 9476 - DNA, 423 bp, Glycine max
  Peptide Sequence Number=SeqID_126254
atggggagagtttatgagggatccactcttgttcataacactcctttgttgcctggccaagtaaaggtgagtgtggaggaggttaaagatgcagatgctccagttcctgtacccactgttgaggtttccttagtgggtcaggcacttcacacgttccttgcttggccgacacatcagatcaagtctttatcaaaccaggttagatgggatgccaccgtgttcggggtagttaatccagatttccccctgtacataaagaacgaagacctctctgaaatcgcacacgatggtcaatgtctcagcatatcagtgttacagttgtggattctgcatctcactgcaacatgtatgcgagcggggattctgatatctatgattcctcgagcctcagtccattcagaggtctgggcaatcgcagtttga

SEQ ID NO: 9477 - DNA, 579 bp, Glycine max
  Peptide Sequence Number=SeqID_126255
atggttaagttcgatcctgagatagtcatggagttttatgctaatgcctggcccataaaagaaggagttagagatatgtgctcctgggtgaggggccagtggattccctttgatgagcatgccatcaatcagtttctggggcatccgctagtgagttctaccagaggaggagtttggcctccaactttcatgaggaggatatcagtcagttgctatgcattttggggatggcgttgttgcttcgcaacattctccccagtgaccataactaggaccttcccttgccgaagttttgaagggtttatgcctctgagacaactagtggacccagagaagtccaatagggccctggggtttcttgctctgattacaagcctctgtcagttctatggagtggcagttgtggaagcaatgccttccaaggttattttgatgatgcaaaagaatcaagagttaagcaaagtttcaagcaaagattcaagaatcaaatttcaagattcaagaatcaagttgcaaagatcaagattcaagactcaagattcaagaatcaagagaagcctcaatcaagataagtattaa

SEQ ID NO: 9478 - DNA, 471 bp, Glycine max
  Peptide Sequence Number=SeqID_126256
atgtcgaagagcagggtgttgaaagagcataacaagactttcctaaattggtttaaagatataatctttggtgacgataatgcttctgaaatgttaagaaagctagcagatgggcctaaaagaaatgttataacttggcaaggatatgacataaacatgtattcattttatacgaaagcacaagacgacaagaataaaattcaaaatagcagggttagtctaagggttaaatctcaacactttgcgagtgtacatgatggcaatccccgtctagctttcaacccttactctggtgtcattgaagaaattagggggcttaattatgtcaaattcattgtatgtgttttcaagtgtaagttggttgacaacaatattggtgtgcggattgatgatttaggatttatgttggtagatttgaagaaactcgcttacaagaatgaccctttcatcatggcagaacaagctaaatag

SEQ ID NO: 9479 - DNA, 473 bp, Glycine max
  Peptide Sequence Number=SeqID_126257
atggcaggaaacgattggctgaacagctaccttgaagctatacttgacgtgggtcctggcctggacgatgccaagtcctctcttcttctccgagagagaggcaggttcagccctactcgctacttcgtccaagaggttattggcttcgatgagaccgatctctatcgctcttgggttcgggtaccctcccatactactctctcctttcttctttcttcttttattccatcccttcctctgatttccttcctccaggcttcctccaccaggagtcctcaggagaggaacaccaggctcgagaacatgtgctggcggatttggaacctcgctcgccaaaagaagcagctggagagtgagactgcgctgagagtcaacaagcgtcgtttggagcgcgagcggggtcgcagggaagccaccgctgatatgtcggaggacttgtcggaaggagagaagggcgatcccttgagtgactt

SEQ ID NO: 9480 - DNA, 2316 bp, Glycine max
  Peptide Sequence Number=SeqID_126258
atggagactccgaaactctccttcgtcgtcctttgttgtcctcccaaagatccattgtcaactccacgtcccaggttgctattgtcggctccaatgattttcgagaacgagttcttcaagcatgattggaggagcagagggaaggctcagatatttcagttcatgattatgaagtggctcttgtgccttctaattggcatgatcgtttgccttgttggcttctgcaacaatctcgcggttgagaatctcgctggcatcaagtttgtggtcacgtccaacatgatgttggagagaaggtttctgatggcctttttagtattttttgtttcaaatttggttctcacggtttttgcgtgcacaatcacggctttgatagcacctactgccaccggttcaggtatacccgaggtgaaagcttacctgaatggtgtggatgcacctggaatatttactgtacgaactcttcttgttaagattattggaagtattacagcagtgtcatcatcgcttcttattgggaaggcggggcctatggtgcatacaggtgcatgtgtggctgcattgttaggtcagggtgggtcgaagagatatgggttaacatggaaatggttaaagttttttaagaatgaccgagatcggagagatttaataatatgtggatcagcagctggaattgctgctgccttccgtgcccctgttggtggcgtgttgtttgctcttgaagggatgtcatcttggttggcttatatcaaactaatgaggccttcaaccacttatatggcctctgttgcccacactgcagggctttcattctacatgtctcttctttccagtaaaccaaccggtaatatgtggagaagtgcccttttgtggagagctttcttcacagcagcaatagttgcaattttgcttcgtgccctgattgatttatgtttaagtggtaaatgtgggttatttggtaaagggggactgataatgttcgatgcttattcagcaaggggaatacttggcagcttatttaatttgattttgagtaaagttcttcgcatatacaattttatcaatgagaaaggcaccattttcaaaattttgcttgcctgtttaatctccatttttacatcctgtcttctttttggattgccatggttaacatcttgccgaccttgtccgcctgatccatctgagccttgtcctacaataggtcggtctggtatctacaagaaattccagtgcccacctaatcactacaatgatcttgccagcctcattttcaacacaaatgatgacgctattagaaatctatttagcaagaataccgacgatgagtttgagtttaaatcagtgttcatctttttcatcacttgcttttctttaagtatctttagctatggagttgttgctccagctggtctttttgtgccagttattgtgactggtgcatcttatgggcgtattgttggaatgttgcttggcaaaaaggacagtcttagccatggtctttatgctgtacttggtgctgcttcctttctcggtggctccatgaggacaacagtttctttgtgtgtaattattctagaactgaccaataacctgttattgctacccctaatcatgatggtgctgttcatttctaagactgtagcagatgctttcaatgcaaatatatatgacattataatgaaagccaagggtttgccttatttagaaactcatgctgaaccatatatgaggcagctatcagtaggcgatgtagtcacaggcccacttcagacatttaatggggttgagaaggtttgcaacatagtgtttattctcagaactacgggacataatgggtttcccgttatagacgagcctcctatttcgcaagctccagttttatttggcataatcctccgtgaccatcttctcacattgttgaagaagaaagcttttatgtcctcacctatggcaacaagtggtgatgtcatcaatgagttttcagcagatgattttgcaaagaagggttcaagcaaaggtcgtctaaagatagaggatatacagttatcagaggaagagatggacatgttcatagatctacatccatttactaatgcttctccttatactgttgtggagacaatgtcactgggaaaggcccttacacttttccgagagctaggtttaaggcatctgctagtggtacccaagttctccggtagatcacctgtggtgggtatactcacacgacacgatttcatgtcagaacatatattgggtttgcatccctttctggttgaaggtgcttcgcttctcgtttgtagaaatagggagtaa

SEQ ID NO: 9481 - DNA, 234 bp, Glycine max
  Peptide Sequence Number=SeqID_126259
atgtatgccttgctcaaaaagtatggggctggtgatgctctttgggcgcataggactgccaataaagcacccataggaatgtctccttatcgggctggaaaggaaaggaagttgcaactaagtgagctagatgagatccgtttagaagcctatgagaattccaaattctacaaggagaagaccaagaagttccatgacaacttgatagctaagaaggacttcgtggttggatag

SEQ ID NO: 9482 - DNA, 246 bp, Glycine max
  Peptide Sequence Number=SeqID_126260
atgtggagtgggattgcaaggcagtctctgaagaaggttgtcgatggtggtggccaaggtgtcgatggaagcaacgagcctcaaggcggtcctcggtggtggacgaaaattcaaggtggtgttgtgggtggtagtggagggtggtcttgcagttgtggagggcagccatggaggctccgtacgactggtagtgtggatggtggtaggcaaccatgggagcttcgtatggtgagtggtatgggttaa

SEQ ID NO: 9483 - DNA, 1419 bp, Glycine max
  Peptide Sequence Number=SeqID_126261
atgatgcaggccatgttgcttaatttagttcttgtttcctttgtcctcttgagttctatcagagatgggagtgcagggatcaccagctctttcgttcggccacagtggccaggagttgacattcccgtggatcatgaagtatttgcagttccaaagggttataatgcacctcaacaagtgcacatcacgcaaggtgactatgatggaaaagcagtaatagtctcatgggtgaccccagatgaaccagggactcgccatgtgcaatatggcacatcaaaggataagtttaaaactagtgcagaaggcacagttgcaaactacactttctataactacaagtctggctacattcatcattgtcttattgaaggccttgagtataagacaaaatactactatagaattggaagtggtgattctgctcgagacttttggttcgaaacacctcctaaagttgggccagatactccctacaaatttgggatcattggtgatttggggcaaacgtttaattctctttcgacccttgagcattatttggagagtggaggagaggctgtgttatatgttggagatctttcttattctgatgaacatgactacaaagatatgggtttacggtgggatacatggggccgatttgctgaaaggagtgcagcatatcagccatggatgtggaatgtgggaaaccacgaagtagagtttttgcctgaagtgggagaagttgaacctttcaaaaactatctttaccgatatactactccctattcggcttccaaaagcaccagccccctctggtatgcagtcaggcgtgcctctgctcatatcattgtgctatcaagctattctccatttgtgaagtacacgcctcaatacatatggcttaaagaagagctggcgcgggttgatagaaagaagacaccttggctcattgtgctcgtgcacaagccactctacagcagcaacgtagctcactacatggagggtgaagccatgcgatcagtttttgagacatggttcgtccaatacaaagttgatgtcatctttgccggccatgtccatgcttatgaaagatcatatcgatactccaatatagactacaacataactggcggtagaaggtatcccatacctgacaaatcagcacctatttacataacaatcggagatggaggaaatctagaaggtcttgcctcaagttatttggatccacagccagaatattctgcattcagagaagcgagctatggacacgccacactggagataaaaaacaggacccatgctatctaccactggtatcgcaatgatgacggaaagaaagtcccagctgactctctcgtattgcataaccagtattggggaagcaatggaagaaaacagaatgaggttattgatgaagttgtcaatgttaaatga

SEQ ID NO: 9484 - DNA, 297 bp, Glycine max
  Peptide Sequence Number=SeqID_126262
atgttagggtttcgtagcgaggcggagaggcggtggagagtttcgcggtcgatccaggcttggatttcggactcgatttcggcggcgacgcgtgagagggagtgcgtggagaggggggcgcgtgaagaaggatcggaggcccttagagttgttgagggagtcgacgagggttttgaggcggttgaggtggtcggagagagcggagaggttggggtcggaggaggagaggatggtgtggagttggaggagtgcctttatgggtggggaatccgaggagtggtgtcgttattcttttaa

SEQ ID NO: 9485 - DNA, 1026 bp, Glycine max
  Peptide Sequence Number=SeqID_126263
atgtcctccaagatcaacggtcagatttctcccctgccctgtccccacttggccgagttccaccgcacctccgccaagccattcctagccctccacaactgcctccggatcaagcctcccggcggccgcgcctccctccgccgcaatcccgacgaggttcctcgctgctgcgcctgcggcctctccgcaccttcccgcctctacgcatgcgtcacctgcgccgccgtatcctgccactcctccgccgccggagtcctctcccacgccgccgctcacgccgcctcaatgccgcccggccaccagatcgccgtcgacgtcgaccgtgccgagctcttctgctgcgcgtgccgcgaccaggtctacgatcgcgacttcgacgccgccgtcgtgatcgctcagactgctgcgtcaactctcggcggcgatcctccgccgccgatcccgtcgccgcaaccagagaatcttcgaaagaagcgccgtgtggattactggccttgggcgccggatctgcgcgaacgcgctctgatcggaagcttctctggcccgattgccggggctgaaaccgtagtcgatcattcgccgggtttgccgcgcggattacgcggattgaacaatttgggaaacacgtgcttcatgaactcggtgttgcaagcgctgcttcacacgccgccgttgcggaattacttcttgagcgataggcacaatcggtttttctgccagaagaaaaacaacggtgacgttgacgttgacgctgctgtgaagagaagtggcggcaacaatgggaacaagaatgcgcgaatatgcttagcttgcgatatggatgctacgttctctgctgtgttttctggtgatcgtgctccttatagccccgctaagtttttatacagttggtggcagcacgcagcaaaccttgccacttatgaacaacaggatgcgcatgagtttttcatttccatgcttgatggaatccatgagaaggtggagaagggtaggcgtaagccacatactgaaggtaatatgttctga

SEQ ID NO: 9486 - DNA, 363 bp, Glycine max
  Peptide Sequence Number=SeqID_126264
atgccagaaggctacggttgggattcaaatccaagatttgagctaggttcagatcactcagctaattcagtatcatcacccatcccttccaactcatcaaactcttcatatggtgatcagagtaatcagcatagttcctccttgcagctagtttcagatacagaaatctatcagtatcaacataacactaatggaagacggaaggatactttggccaaggttgaggaactccaagttaaattcttccgattgctccaacgccttggccaatcacaagaaaatcttttggttgctaaggttctttatcggatgcacctggcaactttgattcgtgccaaggaattagatctgaaaaagagttaa

SEQ ID NO: 9487 - DNA, 462 bp, Glycine max
  Peptide Sequence Number=SeqID_126265
atggggtacgaagttttaaaagaacaacagtccactttatttttggggaaaggaaggggggagtggattggatatctgctgactaatgacactaattcagtgtcaccaaatttgacagcagcgaatggaaggtttcctttagaagacctttttgggaggaaacatgcttatctagaaaacaagaatagtgaaacagaggacgacgacgaggatggagatgaggatgatgaagatggacatgatcaggatgatgatggagaggacgaagaattctcaggtgaagaaggcgatgaagaaggggatcctgaagatgatcctgaggctaatggtggaggaagtgatgatgacgacgacgacgacaacgacaatgaagaagatgatgacgacggggaagatgaggaggaggaggaggaggaggacgacgaggagacttcacagccacctactaagaagagaaagtga

SEQ ID NO: 9488 - DNA, 438 bp, Glycine max
  Peptide Sequence Number=SeqID_126266
atggtttatcattctagttttgtgaatgaagatggagtgagtagagcttgtgggtgctctcttcttcctctcaagagccacattaagggacctgctcctgtttcagatcaagacagaactgatattgtggatgaagccataaccttcttccgagccaatgtgttcttcagaaactttgacatcaagagccctgctgataagcttctcatatacctgaccttttacattaatgttgctctcaagaggcttgaaggttgcagaaccttggctgaaggaaccaaggcaatcatcaacttgggtctcgaaaaggttcctgtccctggagagtctggctttccatttccgggccttttcccccttcctcaatcacataaggaagcaggtgaatcctgtcatcactattctttcatcttgattttcttatcagcagatgcataa

SEQ ID NO: 9489 - DNA, 657 bp, Glycine max
  Peptide Sequence Number=SeqID_126267
atattgaaaccacttcaaaataatcctgatctggaagaaggctactgcaaagcgctgttgtgtcgattacgttttcgtaagcatttttaccatcttttgatgtctatgaaacgaccccaaggaaggggtttggagttagcaagaaaacacatagcttcatgcatttcagagattgattacattcgaaaatgttcggagtttcttagagctaatgcacatggaatttctgagcaaaacttatacaatacaactgcatctggattatctgccccaacaccaccacggtcaatcaaaattcattcttgggaaaagaaatctcgacctgatttggttgctagagctcatcttcagggaaacagcctctttgcatatgcaagggcaagacagcatacaatgactttcccccatactttgcatggcaaggagcctcctccagacactaggcttctgctggtccaggatgggaaactctatggtcgggatcctatgttttctatgatcactggagctgctggattacctggagtcacagagaattatgactttcagaaaaatgaatttatggtgcaactaggacagacatgcatactttcgatgacgatgatgataatctttttacctgaaattatcaaggctcaattacttccttttatctaa

SEQ ID NO: 9490 - DNA, 327 bp, Glycine max
  Peptide Sequence Number=SeqID_126268
atggggtctgacacacatattggtagtagaggcagaacttcatttgtgttaattggttgtgaaaggagtggtcagtataagtataggaagaaagaatttgttagaagagacactgggagtaggaaatgtggttgtcccttcaagcttcgtgggaaaccagtgcatggagggaaatgttggatggtgaagttgatctgtgggattcacaatcgagaattggccaagtccttagttggacatccatacattgggcgattgactaaggatgagaagaatattattgctgatatgacaaagtcgatggtgaaaccaagaacatcctgttaa

SEQ ID NO: 9491 - DNA, 897 bp, Glycine max
  Peptide Sequence Number=SeqID_126269
atgcctgaatctaactggggttcgcggtggtggaggaactggataggaaaaaagagcgattctagttgtaagatatctaatgaaaccattgctggaattgagatctcattcaaagagaaagatatcaaatatctggagttcctttttgtatattatatggatgatccgatccgtaaggaccatgattgggaattttttgatcgtctttctccgagaaagaggcgaaacataatcaacttgaattcgggacagctattcgaaatcttagtgaaagactggatttattatctcatgtttgcttttcgtgaaaaaataccaaaggaagtggagggttttttcaaacaacaagggactgggtcaattattcaatcaaatgatattgagcatgtttcccatctcttcttgagaaacaagcgggctatttctttgcaaaattgtgctcaatttcatatgtggcaattccgtcaagatctcttcgttagttgggggaagagtccgcacgaatcggattttttgaggaacaacatgtcgagagagaattggatttggttagacaatgtgtggttggtaaacaaggatcggttttttagcaaggtacggaatgtatcatcaaatattcaatatgattccacgagatctagtttcattcaagtaacgggttctagccaattgaaaggatcttctgatcaatccaaggattatttcgattccattaggaatgaggattcgaaatatcacacattgatcaatcaaagagagattcaacaactaaaagaaagatcgattctttgttgggatccttcctttcttcaaacggaacgaacagagatagaatcagagcgattcctaaaatcctttctggatatcctcaatgtgccgactattcatggaacgtga

SEQ ID NO: 9492 - DNA, 816 bp, Glycine max
  Peptide Sequence Number=SeqID_126270
atgtggatcaccattgattataccaacatcatcgcccacaggtacccatactggaacaggaccagaggagcagatcattttctagcctcttgtcatgactgggcaccaccagatatctcacgagcggaatcaggcaaagagcttttcaagaacataataagtgtttcctattctcccttggatttcatcttcttttatttcttagtgttatataatgccaacaagtcagaaggatttaagcctgaaaaagatgtgccaatgcctgaagtgaacttacaaggttttaagttgagttcaccaattcttggccttgaccctaataatcgttctatacttgctttttttgctggaggggttcatggtaggattagggagatactactacaacattggaaagacaaagatgaagaagttcaagtgcatgaatatcttcccaaaggcgttgactaccacggtctcatgggacaaagcaagttttgtttgtgcccaagtggctatgaagtggcaagtcctcggattgtggagtccatcaatataggatgtgtccctgtaattgtttcagattactatcaacttccctttagtgatgttcttgacaggagtaaattctcattgcatattccctcgagaaggatagctgaaatcaagacaatgctgaaaaatgttccacatgctaagtacttgaaattacagaagagagtgatgaaagttcaaagacattttgtgttgaatcgaccagccaagtcgtttaatgtgtttcatatgattcttcattcgatatggcttagacagctcaatatcaggctataccattaa

SEQ ID NO: 9493 - DNA, 1179 bp, Glycine max
  Peptide Sequence Number=SeqID_126271
atgaaacttggatggaatttagagactggtctagaaagatatggattatcttggaaaagtgtcgagaatcctgctgagggagactatactgtaaaaattgacctaggaggatatcctcaaatggttatattcagggaatttgtgatcaatgaaaaagaggtgtattatgagtacgagcttcttgatagatcagtcttcagcttatatacactggctccttcaggtactgggcagggtttgttttggacaactgaaataagcacccggaaagttgtctccattggggagcaagatcaatgcgaaaattacgccttttgtggtacaaattctatatgcagttatgaaggaaactattccacttgtgaatgtgtgaaaggatgtgttcccaagttccctcaatactggaatttatcaatttggtctaacggttgtgttccaaggatcaagtctaattgcaaaaacggctatacatatggcttcttaaagtacacacagatgaaattgccagacacatcttcatcatggtttaataagaccatgaaactcgaggattgtcacaagttgtgtctagaaaactgttcttgtttagcatatgcaagtttagatgttcgtggtggaggaagtggctgtctactttggtttaataacctggctgacttgaggaaattctctcaatggggacaagacctttatatcaaagtccctgcttcagatctattggtgacttatcatgctctgcatcttttagatcatgttgcaactggccatgaaaacatcaagaaaaagatagtaggaatcactgttggggctgcaagaaaaatttacaacaagcattacaaaagtaaacagataatagaagacattgatttgccaactttcgctttgtcagccttagctaatgccactgaaaacttctcaaccaaaaataagctcagagaaggtggatttggaccagtatacaagggcacacttatggatgggaaagtgttagcagtgaaaaggctttcaaagaagtcaatacaagggttggatgagttcaaaaaagaagtggcattgattgcgaaacctcagcaccgtaatcttgtaaagcttcttggttgttgcatagaaggagaagaaaaaatgctgatctatgaatacatgcccaaccaaagcttggactactttgtttttggttag

SEQ ID NO: 9494 - DNA, 756 bp, Glycine max
  Peptide Sequence Number=SeqID_126272
atggccgaggatggcagcctccctccacgcgcctccattccatccggcgataactccgtttgggccgatgtctcccctctcctccaagccgcctgccaagatcttcaagagggagagcttattcatggagacaacttcaatctttttgccgccatgtctgcattggagataatggacccgaagatggattctggtattgcttgtacatactactctctcgatgaagccattgagaatggtgttgctccaattcctattagtgctgataaaactaccgatgttcgatgcatgattgacatcatggaccatctactagcctgtgaggtatctctttccaagggggctgaaaaattcctctctttctccaaaacatactcaaacatcagcattgtgaggctgacaaatgcaacatggcacaagggtcattcattggcacaaactgtctattcttgcctctatctcctacgacctgaaaggacatcgtcgcatgccctgttgcactcttactgtaaagtcatacgtgcaacctgcaaagcaatcctttcagttgtctcacaagctcgaacacatgaagaagaggatctatttaccatggcatatggccttcctttgagtggagatggagatgaaaagtgtttatcaatgctaaatgctgtcgaagaaacaatatctcgccaattgcgtgcttgtaaggtttcatcgtcaaaaagaagagtgccagaaggtctcatcaaagttgtcgtaaggttcaaatag

SEQ ID NO: 9495 - DNA, 1107 bp, Glycine max
  Peptide Sequence Number=SeqID_126273
atgtcaccgtgtgcatctactcttgctttgactcaaaatgcatgtattggagtttgtgacaagaagaaatcgagccagaaagagatgttaaagagattcaaggtgtgggtgtatgaggagggagaacaaccattagtgcactatggaccagtaaacaatatatactcaattgaaggccaatttattgatgaaatggataactatcataagtggagtcacttcagggctagaaatcctaaccaggcacacgtttttctcattcccttcagtatagttaatattgttcagtatgtttacaaccgtaatctaaggcaaccgggctcccaatctattcagctcttggtggaagattatatcagggttattgcacataagtatccttattggaatagaactgaaggggcagaccattttttactatcatgtcatgattggggtcccacaatttcgtatgccaatcctaaactcttcaagaactttatcagggtactatgcaatgctaacacctcggaaggattcagacctaacaaagatgtttctatacctgaagtgaatttattacctaggggaacgctaggctcacccaatcgaggacaacacccaaatgaccgtaccattttagctttctttgctggtagagaacatggtgcaattcgaacaatcttgttgaatcattggaaggacaaagataatgatgtccaaatatatgaatctcttccaaaaggcaaagtctataccaaactaatgggacaaagcaagttttgcttgtgcccaagtggttatgaagttgcaagtccaagagtggtggaagcaatttatgcagggtgtgtgcctgtgttaattagtagtagttactctccaccctttactgatgtcttgaattggagccaattttcagtagagattccagtggaaaaaattccagaaatcaagacaatattacaaagtgtttcaccgaaaaagtatttgaaactgcaaatgaatgtcttgagagttcaaaggcattttacaattaatcgaccagcaaagccatttgatctaatgcatatgatacttcactcgatctggctcagaaggctaaaccttaaacttgttgattctagatag

SEQ ID NO: 9496 - DNA, 474 bp, Glycine max
  Peptide Sequence Number=SeqID_126274
atggtgtcacgtgtaagattgcagtgtgtagtaagtggtaaccttcggtgtcacattcttagtttcgggtattctttcaactgcaatgaatttactccttttaaccacatcactgaaaggcaaagagtaattgtcacaaattattactgggacacaccccacatagattgcttccaccaccctaggacttgccacttgcactgggacacaagcagaactttctttggcccatcaactttgtatactctagaccctttggaagcaaaaaagactaataatattgtgcggttattagggtgttgggccgtattcggtgggccaagctttctagaaggcaaatacacttcagtaatggacacgtctctgctgggctggaatccttctgaagtgttggcattgcaaagtgccctgatgaagtacttgaagacttcaggattagcatctgatattcatggaccccgaatcatcaagtaa

SEQ ID NO: 9497 - DNA, 1080 bp, Glycine max
  Peptide Sequence Number=SeqID_126275
atggccgggttgacaaaattctactgtaaaatgttgggcagcaggagccacatagagatggtgaaaagattcaaggtgtgggtttaccaagaaggggagcaaccattagtgcatgatggcccagtaaacaacatatatgcgattgaaggtcaatttatggacgaaatggacaataatggtaagtggagccaattcagggcaagacatcctgaggaggcacacgtgtttttccttcccatcagcattgccaatgttgttcactatgtctacaagcctatcctaaagcaatctgactacgaacctgtccggttgcagcacttagttgaagactatattggtgttattcaagataaatatccttactggaatagaagcataggtgcagaccattttttgctttcttgtcatgattggggtccaaaagtttcctatggcaatcctgaacttttccaaactttcattagggcactttgcaatgctaacacttcagaaggattccatccaaatagagatgtgtccatccctgaagtgtacttgcctgttggaaagctaggtccagcaagccttggtcagcacccaaacagccgcactacattggcttttttcgcaggaggggtccatggtgaaattagaaaaatacttttaaaacattggaaggacaaagataatgaggttctagttcatgaatatcttccaaagggtcaagactacacaaaattgatgggacaaagcaagttttgcttgtgccccagtggacatgaagttgcaagtcctagagtggtggaagcaattcacgcagggtgtgtgcccgtaataatttgtgataattattctctaccttttagtgatgtgctaaattggagccaattttcagtggagattccggtggagaaaataccagaaatcaaaagtatattacaaagtatttcaaggaataagtacttgagactgcacatgaatgtgttgagagtcaggaggcattttatgattaatcggccaacaaagccatttgatatgatgcatatgattcttcactcaatttggctgagaaggctaaacataaagttgattgcttcttga

SEQ ID NO: 9498 - DNA, 453 bp, Glycine max
  Peptide Sequence Number=SeqID_126276
atgctgtcctctcgatgctccacagcctctatgttactcccattacttttccccatttttcttttccttttcatcattcacctcgagggaaatcatctttccttcgagtttcctaatttctccctttccagcataaagggcatcacaacacaactacaaccccatggtcagtatctggctaactctgcatatagaagccttgagcatagaattaagaaaaggactagctttgatgtagttgaagaaggtttggcaaaggctcgagcctcgatccgggaagcaattctgtctaggaaccacagcaattcagggaagcaagaagactttatcccaaaaggatccatttatagaaaccctcatgcttttcaccagttaagttcgaaagattttgacatattcatcttcattacttataatcaaggttttaaactgtggtcgtggtcgggttgttga

SEQ ID NO: 9499 - DNA, 162 bp, Glycine max
  Peptide Sequence Number=SeqID_126277
atgctgctagagaggaggcagaacatagagcctcctaggaaaacaaagaatggccatcttgctataaccagtgctgtggattcaagttcgattgtcaaagatttgctgggcttaaatataagaaaactgattaacatcacaggattgattcttgaagtataa

SEQ ID NO: 9500 - DNA, 749 bp, Glycine max
  Peptide Sequence Number=SeqID_126278
atattcatcattccgcctggcgtccgcggccggggcagaatagatttccgtccggccgccgatcgcggatatgatagaaaaccaagccattgccggatagccgttttgacagacagtaaccccccatccaccgcctttactctgtacgacctccacagccacacaaccgcctccgatggctacctgacgccgacgcagctggtgcagcgggcggtcgagatgcgcgtgggcgtgctggcgatcaccgatcacgacaccaccgcaggcctggccgaggccgccgccgccattgcggagcaggcgttaccactgtggctggtcaacggggtggaaatctcgacgctgtgggaaaatcatgagatccatatcgttggattgggcatggacgtcgcgcacccggcgctggtggcgctgttggcggaacaaaccgaacggcgcaatcggcgtgcgcaggagatcggcgtgcgtctgggtaaggcgcgcattcccgacgcctatgccggtgcccagcggctggcgggcgacggcgcggtgacccgcggtcatttcgcccgttatctggtggagattggcgtggcgggcaacatggcgcaggtgttcaagaaatacctggccaagggcaaaaccggctacgtgccgccgcagtggtgtacaatagaacaagccattgatgcgattcatcaatcgggcggccaggcggtgatggcgcatcccggccgttacgatctgaccgcgaaagtggttgaaac

SEQ ID NO: 9501 - DNA, 417 bp, Glycine max
  Peptide Sequence Number=SeqID_126279
atggaggctgacatggaggccatgaaagagcaaatggccacgatgatggaggccatgatgagcatgaagaagataatggaagccaatgcggttgcagttgtcgctaccagggctgttgctaaggtgaacccgatgcccccatctgatctcaaccaaatgaatcatccaacctcagatatgatgggcaaagatttgggaagtacggacgaccccatgatgtgcaaattcaaaacgagcatgccttcccgccatatggcttgcctcccaactatacaccacccaatgtggcgcacactcccagtgagaatgtcaataactccactcctatacccattgagagccaacaaccccaaactggtcatgcacatgtctcttaaaccgtgggggagacacatgaaattgcccaccataatctag

SEQ ID NO: 9502 - DNA, 261 bp, Glycine max
  Peptide Sequence Number=SeqID_126280
atgtctgccacggatccatccctgaaatccacatggaatcgtgtgatcgaaataccaaaaggatactgtgtttgtttctggaacaaggcgacaagggtgatatccagagaatcgccaacgctgtcttttttcccgggcattggtcgtagaacaatgtttgggtttggctatgatccgtcaagtgaaaaatacaaggttgtagcaattgcgttgactatgctctcacttgacgtatctgaaaagactgagatgaaagtttaa

SEQ ID NO: 9503 - DNA, 225 bp, Glycine max
  Peptide Sequence Number=SeqID_126281
atgactctttcttcggtggacatggcggaggctcatgcacttacacttaggaaagattcatctcaggtcttgaaagcttttcatagtcaaaagtcgtctacagatcgcagtctgaggcctattgttagtgatgtgcagcaactccggatgtcccaccacagctggtcgagtcctccaccagctattcttgctattttaagagaagatcatcattgtctgacttag

SEQ ID NO: 9504 - DNA, 276 bp, Glycine max
  Peptide Sequence Number=SeqID_126282
atgtcggccttcatctgctcttgcacctcctctacttcacccattactctagctctagcacaggacatggggttgaatcaatttagatttttcaacatggttcatgacatcttggtcaaggtgaaactggaagtaacaaggacatcaacagtcctaaatgtttttggcagtgaacaaagcagtgataggaaaatgcaaggattacgcatgagcaaacatgaaaaccaaaggtatgtagtttgtagaacaaaaagtatgttgaacgcatatgcctga

SEQ ID NO: 9505 - DNA, 729 bp, Glycine max
  Peptide Sequence Number=SeqID_126283
ccatcacgaacggagagagacagaaaagaaaggcctaaggaagtgaaatcttatttctctcctctttcaaggaaatcaaagtgcactggagagaagttcctatggagaaaggtacaagtcttcctatggagaaagtctaggaaactccttaagaatttttacaatttattgctgaacatcaattcaaaaatatacttagatgccatccaagtgacccctgatagtcgtggtcccatctcaaactattcgggtagggccttctataaagaacaactaaagctatgggacagtcaaagaggcatcaaagcctcagtcaattcaacttttgttttcaatgttaatcctcaaacctccccaggttgtgagggatttactttcatgttgccagatgacacctctcttccaagcaacagtgcaggtcaatggcttgggattgtcaactccacaagcataggggtaagcaacatagttgcagtgaagtttgatacaaggaaaagctactctgaagatattgatgacaaccatgttggggtggatgtaaagagcatctattccatccagcaagaatctcttggaccacatggtgttaatatttctagtggcactaattcaattgccactatatacttcgatgctaaaggagggaaattgatcatatatgtttctacatcaggagatttgaagggaatatacccagctcaactcaataagatcatggaatttctctag

SEQ ID NO: 9506 - DNA, 546 bp, Glycine max
  Peptide Sequence Number=SeqID_126284
tcattcgttttcgggaaccggacacacgaattccagagcattgcggagaggttgaagaagacaggatcagcgccaaatggacaaagcagcagctcatccagatcggaggaacagcgatcggcgattgcaaatcaatcagagttcaacagaagagcttccaagatcggcttggggattcaccaaacgtctcagaagctcgccaagctcgccaagttggcgaaaaggacttcggtttttgatgaccctactatggaaatccaagagcttacgggggttattaagcaagatatcactgctctaaactctgcggttgtggatcttcagttactctgcaactctaggaacgagagtgggaacgcttctaccgacacgactagccattcaaccacggtggttgatgacctgaagacaaggttgatgagcaccactaaagagtttaaggatgttctcaccatgcgaactgaggtaccttatttgtcgtattggtgtgcttctgtgtacttgctaattgccgatgacactgatgtgatgctattgtttttgtga

SEQ ID NO: 9507 - DNA, 357 bp, Glycine max
  Peptide Sequence Number=SeqID_126285
atggtcattctgcgccctttatcattcaggagcagcgagtcgagtgataaacgcgcagagacaaattatggtcattctgcgccctttgtcattcagaagcagagcagcaactcaagtgataaacgcgcagagacaaattatggtcattctgcgccctttgtcattcaggggcagcccgatcatgcccgatggcgcgcagagacaaattatggtcattttgcgccttgtgtcaaccaaaaggaacaaatttggcagtatcaggatgatgttggtcattcggtgctgatcattttcaaaatttttgcaagtttcgctggcggggagattgaccggccaaatggtgtttcgctcaaatga

SEQ ID NO: 9508 - DNA, 306 bp, Glycine max
  Peptide Sequence Number=SeqID_126286
atggaagttcttcgtcgttctttgttcgttcttcatcattcttcgatcttcaatcggagcaaaagccccgcttttgtcgaccccatgagatcgttaaagatccaacgccttaacatttctctcctctcaaaaaacaagatatcgttaaagaactacgtaggtctaattttgatggaagcttgcttgtgtggcttctatggagactggatctttgagcttcaattaggtcctttaatggtgattttccaccatggagatgcagcggaagacaaaggagaagaggtgagaggaggtgtcatccactag

SEQ ID NO: 9509 - DNA, 348 bp, Glycine max
  Peptide Sequence Number=SeqID_126287
atggcttccttttgcgattttggagcagaaatggtgtgcaaaggttggagctttgatggagcttcaatggtgaggaagaagaaaggaatagcaactttgcgtgtcatttcactggttccaatccctcgcgtttctctgcacccgtcggggccagttttcgaaagtaggcaatatatatatcaaaacactcagaatgaaaccccgagcgtggttcagagaccgaagaacgacgaagaacgaacgacgaacgatgaagaacggttgaaaatctttgcgaaatcacccacggaaacgttacggaagcgcctcggcttggattttcttcacggaaacaattttcctcactaa

SEQ ID NO: 9510 - DNA, 370 bp, Glycine max
  Peptide Sequence Number=SeqID_126288
cttgggaggattgatggggactcggcgttgagaggaacaaggataagggctacgtgggagtacgtgagcttagttggaggtgggcaacaggggatgagtggtacctggagatatgtcgcgggggtcaggagaccttggggacgtcaggcgagctcctggcagtcaacagataaaaggaacaaagaccacaaaccaatgaggcttgtgtggtggctggccagctgtgaatattgtgtgatatatgggttatggcttctggtaatcgattaccaagggcttgaaaacaaggttgtggaggcctctggtaatcgattaccagtctgtgtaatcgattacacagaggaatgggtcactggtaatcgattaccag

SEQ ID NO: 9511 - DNA, 531 bp, Glycine max
  Peptide Sequence Number=SeqID_126289
atgctgctcgaccgccagctgcccgatggcgatggcgtggctttcgtcgccaccgcgcgcgcgctgcgcccgaacctggcggtgatcatgatgaccgccaagggcacgctgtcggacaaggtcgaggggctggacgtcggtgccgatgactacctggtgaagccggtggcgatcgaggagctgatggcgaggatccgcgcggtctcgcgccggccctcggcgatggtgacgccaagcctgcatctgggccggctggatttcgacttcgaatcgctgcaggcgcaggtggagggccagctgttggcgctgccccggcgccaggtgctggtgctgcaggcgctggcgatgcggcaggggcgcacggtcacccgcagcgcactggaggcggcggtgtacgggtttgatgatgagatccagtccaatgcgcttgatgcgcacatttccaagctgcgcaaggcgctgcagcaggccggggccggcgtggagatccatgtgatccgcggtgtcggctacctgctggcggaggcctga

SEQ ID NO: 9512 - DNA, 558 bp, Glycine max
  Peptide Sequence Number=SeqID_126290
atgcaaatctaccggctggcgtgggacagcacgcgcgatccgcagcagctggcgcaccatatgcagcaatatcagcagacgctggagtcaccggcgctgcagcatctggagcgtccgtgggtgccgattgaggtcagcagccgctatcgctatctgcgcgacagctggccggtactgcaagagacgctgcagccggcgcgggcgcaggtgtaccagcagcgcgtggcgggctacgtcagtgagattgaccgcttcgtgctggcggtgcagcactatgccgagctgaaaatgcatctggtggccgccagcagcctgttcggctttctggcgattgtcgcgctggcgctgtggagcattggctttattcgccgcaacgtggtgcgtccgctcgattcgctggtcaccgctagtcaatacgtcgagcaggccaacttcagttttccgccgctttcagtgcatcagcccaacgagctgggcgtgctggcgcaggcgtttacccaccatggcggagcggctgcattcgcactatcgcctgctggagtgcgcggtgcgcaataa

SEQ ID NO: 9513 - DNA, 552 bp, Glycine max
  Peptide Sequence Number=SeqID_126291
gcggaaggtggtgagcagctcgcgcagctgctgataggcctcggccagcgcgcgatcaaaatcggcgatgatcgcctgtgcctgcggctggctgctatcgacattacgccgcagcaacgtcagctggatacgcagaaaagagagcgactgcgccagcgaatcgtgcagctcgcgcgcaatggtggcgcgctcttcaatcagcagcatctgctgatactgcttctgcgtctgccagatccacagtgcacgcgccagcatgttggccaggctgtgcatcagctcatcggccggcggcgcgcggcgggtttgccagcacagttcgccgaggtgctgctcctcctgctgcagcggcagccgctgccagctgagatcgtcggcgggcacgccggcctggaaggcgatatcctcgctggcgatttgcagcacctccagcgcttcccgtcgctgcaccagccgaagcaggccctgaaacagctcgggattgagcgggctgccggtgagaatctgcgagctttcatacagcagcgacagcgtgcggttggcctgggttaa

SEQ ID NO: 9514 - DNA, 219 bp, Glycine max
  Peptide Sequence Number=SeqID_126292
atgggagtttggccttttcttgaagcttctgcatgtctagatagttctagagagagaaaggtgctcatagtcggaggggcgttgggcagggagaaggaccgatattggctgagtagtggtactgatatgggtgatgtagctctatgtggagcttgtaggccttggatcttcttcatcaatggagtcctttgcttcttgaagatcatggcagtggaatag

SEQ ID NO: 9515 - DNA, 183 bp, Glycine max
  Peptide Sequence Number=SeqID_126293
atggcattcagaagacaagggtcaatggcccctgcacactgcagaggaaaaactgaaagggataagatcttgatggcatggtggtggcttatttatgagtgtgcaactttcaaactctttggagggaggaagagtacaaaacaaaagggtcattttgggaaaaatgattcttcttcacaataa

SEQ ID NO: 9516 - DNA, 504 bp, Glycine max
  Peptide Sequence Number=SeqID_126294
atggctgaagccaaaccaatctcttctcctatggtgattaacttgaagctttccaaagctggtaatggtttcttacaagatcccactctgtacaggtcagtagtaaggactcttcagtatgccactattacaaggccagagatcagtttttctgcggctgaccctgatgaccacaggtccacgtcaggtgcagctatcttcttgggaccaaatctggtctcctgggggtccagaaagcagcaaatgcctctcattttctgtgataatcaaagtgcagtggtggcccaggcacacaacccaattcttcattcaagaaccaaacatatggagattgatcttttctttgtaagggagaaagttctcagcaacaaactctatgtggttcatataccagctcaggaccagtgggcggacctcctcactaaacctctctctcctactaggtttcagtttattagggacaaactgaaggtgttggagctctctcaagctcacccaccttaa

SEQ ID NO: 9517 - DNA, 1470 bp, Glycine max
  Peptide Sequence Number=SeqID_126295
atgactcaagataatgagcttgaagatcctgcaatggccgaatctaatcctccttcttctgttcctccttccttctcttcatcttttgctttcgtgcactcaatcactaagaagctcactgattcaaacttcttgctgtggaggcaacacgtagaaccagagatcaaagcgcatcaattacacagatatctagtgtatccaaacattcctctcagatatgcaaatgaagctgatcaggattcaagccccatgaatcctgcctcaattttatcgtgtgtactagggtccattcatgcgtttcaagtgtgggagaaaattcacgatcattttcagaagttaactagagcaaaagctcatcaactttgcacaaagttgcgatctactactcttgataacaaatccgtctcggaatttcttctgcacatcaaagctttggctgatgcgctagcttcaatcagagatccgatcataccggagcaacatgttgatgttattctaaaaggactaccttctgattacaacttggtgatttcggttatcgaaagcaagttcgaactgatgcaaattgaggaagttcgaactggtgcactagcagcacttggttcccagactccagagcatcttatcatgtcactgcagatcagaataacatctgccaactcagctcttttgaaggtccagaccaaattttcattggtaatggacaaggaaactacagaaatactgcttcaaggcacagtggattctgatggcttgtaccagtttccaagcctccacttgcagcctcagtccaagttgtgttttccagcaaattgtttagtctttaattctgattcacaaacaaaatatgtatctactgttgtttctcctagttataggtttatgtggcatgtccgcttaggacaccccaatgatcatacactcaaacttgtattaaatcattaccttgcaactctcaaattggaatttcgatctcatgagtcccttttcctaggatactcctctaaccataaggactataggtgcttgtctccaaatggaaaagttttcatttccaaagatgtggtttttaatgagaccaaatttccataccctgttctattttctaaaccaagttcttctttatccccatcatcctcatcttcattttctgcaaacattccccttgctgatccagcaaccttcattcatacttcaaccaccattcagtgtccatcaacttctgcacaaaataatgtttctaatccctcttcccctcctcaagactttgcacccaatccacctccttctcagtctatatatatagtttctgaacctgtcactcaaccagttgaccctgtcacccaatcagttgaccatgtcactcaaccgttggctactgattctgtctcagaacttccctctaccactgcatctgtctccagttcagattcttcttctgagtcaaccttccattttcctgttccttaa

SEQ ID NO: 9518 - DNA, 1152 bp, Glycine max
  Peptide Sequence Number=SeqID_126296
atgaagccttcatttccaaccagggggtctgagttgcctcaaaggcagtctccacgaggtccacatcaacatcggacatcaagttctgattctgatccgttgcatcatcggctgattgctgaccgaagtccaaagctaggagaccggcgttccccaagaggtactcaatctgagggattaaatcagaagaagctaggaactcgtattgcagatttggaatctcagctcggtcaagcacaagtagagttgaaagttttaaaggaccagctagcttctgctgaagctgcaaagaaagaagctcaagatgagctagtgaagaaagctgtgcaatcagtattgccagtggtagagaagctccaagagaaatccacttccaagaatgctccagagtctaataaaactgaaatcaaaccccaagatgttatacctgatgacgaccaactagagactgatgtgtttgaagttccaattgagaagttgacaattgaattcagcaaaccagctgatcaatcagaaaaggaaactcaaccatttgaagacacaaatgcagcagcaatatcaaagccagaaaagctttctgtggatgaacatgaactgacactaaagaatgatgaaattgcattgttgaaaaccagtttggaagagaaaggtaaggagttagagtccatgagtaatgaaaaggagaatctgaagaaccaactgaatgaagcagtttcaaaagtgtctgctgctcaaaccaaggaagaaggaatgactttgcagttgaaccaactgagagaagagttggaaaccagtaaagccaatgcagacaagttggatgagaagttgaaatctgtggaagcagaaaaggaggggttggagtcagagatgaagaagctaagggtgcaaactgagcaatggagaaaagcagcagatgctgcagctgcagtgcttgctgggggtgtggatatgagtgcaaggattcctgaaaggtgtggctccatggataagcactttggtggcacatttgagacacctgctggtaggtacaatggctatgtggggtctcccggtatggctgatgacttggatgacagttttggaggtggaaagaggaagggttctgggattagaatgtttggtgatttatggaaaaagaagagccaaaagtga

SEQ ID NO: 9519 - DNA, 675 bp, Glycine max
  Peptide Sequence Number=SeqID_126297
atgggagagaggaaggtgttgaacaagtattacccaccggactttgatccgtcgaagcttcccagagcaagaaggccaaagaaccagcagatcaaggtccgcatgatgcttccaatgagcattcgatgcaacacttgtggtaattacatctacaaaggaaccaagttcaattccagaaaggaagatgttattggcgagacatatctgggaattcaaatattcaggttctactttaaatgcactaagtgctcagctgaggttaccatgaagactgatccgcagaattcggattacatcgttgaatctggtgcaaccagaaattttgaaccttggcgtgcagaagatgaagaagctgataaaacgaaggagaagagggatgctgaagagatgggagatgctatgaaatcattggagaatagaaccctggattctaaaagggagatggacatccttgctgcattggatgagatgaagtcaatgaagtctaggcatgcaactgtcactgttgatgaaatgctggaggctctgcagcgcacagcagctgacaagtgctatctcagtagtgcttttggaaccaaaatactggagaaaaggctggaacaagaagatgaagctctgataaaatcagttgtctttcatgcaaaattcagacggttttgtcagaagaattcgtga

SEQ ID NO: 9520 - DNA, 714 bp, Glycine max
  Peptide Sequence Number=SeqID_126298
atggaggcaaaccgcttcattttgaaaattcacaaaccaatagtgaaaagagacagagagggaaaaagaagaagaaaagaaaaagaaaattgcaaaaagcgaaaccgaaaaccaaatccgaagagtgaaggttcgttgaatcccatggcgagagtgaagcacacgccagcttctcgcaaatccgctaaaaagcaagcgccacgcgcatccacttccacgcagccgccaccacaatcccaatcgcctgcaactagagagaggaggagagctcaacaagtggagccgcagcaggagcctgaggctcagggaaggaagaagaggcgcaataggtcgggaactgtggcgcttcgtgagattcggcattttcagaggagttgtgagcttctcatcccggctgctccctttatcagatgtgggtgtttggaaaactgtttgattggtgtggaatggaagttttacatattagaattccaaagcataaaagtcaaacagattacaaatcaattctctacggaggtgtctcgttggacacctgaagctgtggtagcacttcaggagtatatagagggaaaggttatgggtgtctccaaaagggagggggagtggaaaaggttgcagagtgtattgcagggttttaacatgttcccttgcactttccttgcatgtctcagagctcttccaactaagttatctccaagggtgattattaattga

SEQ ID NO: 9521 - DNA, 426 bp, Glycine max
  Peptide Sequence Number=SeqID_126299
atgtctagagaagaagacttggaagttcatggtgagggattcttgaaaacatggagtcttaaagataccatgaaagaggatttttttggacttacaccaaaaaagacacttcaaggtcttgaagattgcaaagaggaaatcttgaagatgttccattctgaaaaatacctatatgtaattgatgaggtctatgtcaagtctagtattgaaaattcttcaaaggaagatggaattttgttggttacacctactaaaacaacttcttcattaattccaaagattaaaaaccaacaaaatggttcaccttctaggaaaaattcttcgtctacaacaacttcaaagatgcctatttttacagatatggatgaaggattgatggatcaacatgacatgaattcagatgaaaatttcaagacaagttcataa

SEQ ID NO: 9522 - DNA, 381 bp, Glycine max
  Peptide Sequence Number=SeqID_126300
atggggtcgtttccaaattatttgcaacatggggcagttttttacgtgaaatgcatggggacatgcagccaaaccgccattgccaatggcgagtttggtctcagtgaaggactcgccactgccagtggcgatatgtccatgcaagacacaaatcgccaatacgaatggcgatatacacagcgcaagggaaccgccagtcaaactggcgagttccatggtctgatggtgcaggcctacgtcgcaggcaattgcacttttcagtggctagattgcaggagctttttcagggaaaggggagttgcaactgccattggcgagttgcctgcaagttgcaactcccattggcgatttaggcagaaaaatagccatcacgaatggtga

SEQ ID NO: 9523 - DNA, 597 bp, Glycine max
  Peptide Sequence Number=SeqID_126301
cctaagcttaagcttatccctccccacttgttgcctctgccgtatgttatagccaaaaggatagaggagaagatgaacggtggtgaatcttacggtgctattgagacacaatacataaggaggcatcacaaacatgaaccaagggaaaaccagtgcacctctgcacttgttaaacacataagagctcctgttcaccttgtgtggtcactggtgagaagatttgatcaacctcagaaatataaaccatttgttagcaggtgtatcatgcaaggggatcttggcatcggaagtgttcgagaagtgaatgttaaatctggccttcctgccacaacaagtactgagaggttggaacaactggatgatgaggaacacattctcggcatcaggattgttggaggtgaccataggctgagggtcatcgatgggagacccggtacaatggtgatcgaatcatttgtggtggatgtgcctgatgggaacaccagggatgaaacttgttactttgtggaggctttgatcaggtgtaacctaagctctttagctgatgtctcagagaggatggccgtgcaaggtcgaaccaatcctatcaaccattaa

SEQ ID NO: 9524 - DNA, 1209 bp, Glycine max
  Peptide Sequence Number=SeqID_126302
atgatatcaggctgttgtcaaaatgagaactacacggatgccctacagtttttcagccaaatgcaagaagaaaatgtaaaacctaactctactaccatttccacccttcttcgggcatgtgctggcccatcactgttaaagaaaggtgaggagatacactgcttcagtatgaaacatgggtttgtggatgacatatatatagccacagccctcattgacatgtatagtaagggaggaaaacttaaagtagctcatgaggttttcaggaatattaaggagaaaacactaccatgttggaattgcatgatgatgggatatgctatttatggccatggggaagaggtatttactctatttgacaacatgtgcaaaactggtatcagacctgatgctataaccttcacagctcttctatctggctgcaagaattcaggtttagttatggatgggtggaagtactttgacagcatgaagacagattacagtattaatccaacaattgagcactactcttgcatggtagatcttcttggaaaagctggttttcttgatgaagctttggatttcatccatgccatgccacaaaaggcagatgctagtatttggggtgctgttcttgcagcctgcagacttcacaaagacattaagatagcagagattgcagcaaggaatcttttcaggttggagccatataattctgctaactatgtgttgatgatgaacatatattccacttttgagagatggggggacgtggagcgccttaaagagtcaatgactgccatgggggtgaaaatcccaaatgtttggagttggatacaagttaggcagactattcatgtgttctccacagaagggaaatcacatccagaagaaggagaaatatattttgacttgtatcaattaatctctgagataaaaaagctggggtatgtacctgatactaattgtgtgcatcagaacattgatgacagtgagaaggagaaggttctgctcagtcacacagagaagttggctatgacgtatggactgatgaaaattaaaggaggaacaccaatcagggtagtgaagaacacaagaatttgtcaagactgtcacacagcagcaaagtacatctccttggctcgaaaccgcgagattttcctcagagatggtggtcgttttcaccatttcatgaatggagaatgctcctgtaatgatcgttggtaa

SEQ ID NO: 9525 - DNA, 684 bp, Glycine max
  Peptide Sequence Number=SeqID_126303
atggctcttcctcatctcttgaagaggaggatttacttcataggagtacaaagaaaattaaggaggttggaaaatactatggaaggggatgtgttggctgaggctcggaatggcatcattcagataataaatctccacgatggttattatcaagttgtctttacaactcatgatgattacaattttgctctgtttgaaggtccgtggatggtggttgatcactaccttatagttcagcgttggcttccttttttcttgacaaatgtggagaaaatgaaaaatgtagcagtttggcttaaggttcaatgtttacctattgaactctataatgatgtatttttgaaaagaattggaatgagtctgaggaaatcccttaaggcagataaactgacatctatccaatcgagagggaagtatgcgaggatttgcatggagttagatttgtataaacctttggaatcacatatctatgatccctccatggatagggtagcagtgccaaccgaaagtccggtggagaattcgtcggaggcaagaattgagttagtggtgaacacggtggttgtgcaacataccattagggctgacattatatccacatctgccaaccctaatgtttccattaatgcttcacaaggcaataatgaggatgagagcctttttggtgcatggatgattgtgtaa

SEQ ID NO: 9526 - DNA, 351 bp, Glycine max
  Peptide Sequence Number=SeqID_126304
atggatttgagggtggaagcgtatttgaaatttgttgaggtccaagataaagaaatggagaactttgttgctgaaaaggagaagatgctacatgctcatggcacgggttatgctgcaatgaagtggaggcattgggaggaagaagttcagtatgagcataagtttgttgaggaattgaccaacctcatggaaatcactatgttcaggggtggagtagtcactaactctagggcatctttgggttggtttgcttttgagcctgaatggtatgacacaaactatacaaactttgctcagtttgaggctcagtctttttctctacttgttcaatacctttcaaatatgaaatga

SEQ ID NO: 9527 - DNA, 435 bp, Glycine max
  Peptide Sequence Number=SeqID_126305
atgaagatgctagacataacattcacaagtttggatattaagggcttggatccgaatcaagatgatctcatggtcatcaccgtggagatagccaattgtcttgtgaggaagacactcgtagaccaaggaaactcaattgacatcttgttttggaaaaccttcaagcaactagaaatacctaagtcaacactcacctcgtataatatattactcgatcaactatcagtcaatgctcttggggctatagtatccaccccacatgtcgcaatgaagttcctttcttatcaagggtcaatcatagcaatccatgaaaacttaaaagtagctcgagattgctacatggcaagcctaaaactcgcccctatgtctgagtttgatgaattcaaagcaatcaacatggtatctttggtcgacatggaagatgtagaggtataa

SEQ ID NO: 9528 - DNA, 1971 bp, Glycine max
  Peptide Sequence Number=SeqID_126306
atggcctattctgcagtttcagttcccatctctataacttcgtctgcaacgatggacatcacaaaagagaataaatttcttctccattcactctccaacaaaggcttattatgcaaacattcaacaagtgtaaggtcttactctactagcaataactgcatccaagccacatcaatgcaaccaaagcataaaagcaggaactccataatagtatttccacttcaactttcagtttccattcttccaaatccacttcgctccttcttatttgacacagaaacgaggagggaaatgaacatggggcagaagggtatcaataatattaaggaaaacatggtggaaagcagtgaagaagtgatgataaatagagctcgctgggttcagagattaacgggaattaagagatactggagaagaaaagtacctaaagagagcatggaaacagatataatatgcaaacacaacacgaatagttatgaagaaggagatgaaaaagaggaaaatggacaagaagtggcatgtgatcgtgactcattctcaaagtttctggtcccggttccttggcctgataccaaactattctctaagctggctttcctgtgcagcatggcttatgtcataccacaaatcaaggctaaggacttggggagaaactatggtcttgaattcgtaacatcatctttggaaaagaaaggtgatgtgactaagataaaagcaaaacttgatcaggactccatttgtgtgcctatggatgcctcagactcagcagcctctcaagatgattcagagaaagagaaaggtgatgataatgaacagaagcatcaaatcaagcttgcctatgatattactgcctcagctgcttcttatgtccaatcacgcactaaggaccttctgtctcttgcttcgaagtcaaagaagcatagtggcaatggggatttcagtggaagagaagactctccatatgaggaggctgatgaaacaccaccggtttacaagtcaaagtatggagttaatgctgcagcattaacaatgactgttgtggctgcagcaggaacagcagtggaccttcagtcacttcgttcatcatcttgtgaatggtttgtttgtgatgatcccgacacacacactcgatgctttgccattcagggatcatattccgtggcatcttggaaagcaaacctctactttgagcctactacatttgagggcacggatgtacttgttcacaggggaatatatgaagctgccaagggaatatatgagcaattcatgccagaaataatggaccatttgaagaaatatggggatagtgctaagctccaattcactggccattccctagggggtagtctctcaattttggtctatttgatgctactgactaggaaggttgtcagtccctcaactcttctgccagtagtgacttttggttctccatttgtgttatgtggaggccaaaaattactcaatgagcttggcctggatgagagctacattcaatgtgtaataatgcatagagatattgttcccaggatcttctcatgcagttttcctaaccatgttataactgtccttaagcgcttaaatgggtcatttgtgtcacatccttgtcttgtaaaaaataagctattgtactcaccattgggtaaaatattcattctccaaccagatgagaaaacatctcctccacatcctttactcccattaggaagtggcttttatgctgtagacagtagcagatgtggatactctccaaatgttctcagagccttcttcaatcaaccacaccctattgaaacactaagcaatccaaaagcatatggctcagatggcacagttttaagagaccatgattgtaacaactatctaaaagcagtcaatggagtttttggacaacattcaaagattgttgtcaggacagggagatcaaagcagccacgaaaaacatttaagaaaaagatgagaaaataa

SEQ ID NO: 9529 - DNA, 291 bp, Glycine max
  Peptide Sequence Number=SeqID_126307
atggcgatgctgctgagcgggatgagagggagggcaatggccatgaaggatataagggcggagagtgccagagggtccatccccaccttggagacgttgagggcaaagatggcagtagtaaagtacatgggtgacatgagggggaggtgctctacgatgaggttggagcaaagggcggtggtggtggcgatgctgcggcgtggcgaagttggcgtagcggtccatgagttgctggcaaagagaattttgttctaccgtttggtgtgtggatggagaagacaaggctattag

SEQ ID NO: 9530 - DNA, 186 bp, Glycine max
  Peptide Sequence Number=SeqID_126308
atggattactcaattcgtaactatatgagagtggtgtggcatggaggttcatgggtcatagtgatacacatggtgatggtggatggtgacattgcggtgggtttggtgtgtggtcatggaggtttgagggagaggcaactaagtttgctttgtagaggaagggatctatgcggtgcaaatagttga

SEQ ID NO: 9531 - DNA, 4101 bp, Glycine max
  Peptide Sequence Number=SeqID_126309
atgggagaacatgaggggtgggcacagccaccaagtgggctattgccaaatggcttgttgcccaatgaagctgcctctgtgatacaggtgcttgactcggagcgatggttgaaagctgagcaaaggactgcagagctgattgcctgcattcagcctaatcctccctctgaggagcgccgcaatgcggttgccgactatgtccaacggctgatcatgaaatgcttcccttgccaggtgttcacctttgggtcagttcccctcaaaacttatttgcctgatggagatattgacttaaccgcattcagtaagaatcaaaatctgaaggattcatgggcacatcaagttcgtgacatgctagagaatgaggagaagaatgagaatgcagagtttcacgtcaaggaggttcagtacatccaggctgaagtagaaacttgcggtcatagggcactagacctggtgaaaattataaagtgtcttgttgagaatattgtagtagacatttcatttaaccagcttggagggttgtgcaccctttgttttcttgaggaggttgataatctgattaaccaaaatcatttattcaagcgtagcattatcctgataaaagcttggtgttactatgagagccgtatacttggtgcccaccatggacttatctcaacttatgccttagaaaccttggttctttacatttttcatgttttcaacaattcttttgctggaccactagaggtattgtaccgatttttggagttttttagtaagtttgactgggaaaatttctgtgtaagtctatggggtccagtacctattagttcactcccagatgtgacagctgaacctcctagaaaagatggtggagatttactgctcagcaagttatttctcgatgcctgcagctcagtttatgctgttttccctggtggccaagaaaatcaggggcaaccctttgtttccaagcatttcaatgttattgatcctttgcgtgtcaacaataaccttggccgtagtgtcagcaaagaattgaacaaaaaggaaccttcagcatgtttatctggtcataaccaacaatgggagtatgccattttttatgcattctgtggaagtaatttctttaggatacgcagtgcctttgcatttggggcaaaaaagctggctagattacttgattgcccagaggaggaattgttttctgaggtcaatcagttcttttttaacacttgggagagacatggaagtggggaaaggcctgatgttccaagcatcgatttacggcatttgagtttatccagtcatgaccaattacagaggtctgagaatctccggaacaataaccataaaattgattatgcctcaaatcatgaatctaatgaagaggaacatgtttcacaaagtggtctatctcagtatagtaatttcgcatcagaaaagacagctagaagtgttgtttctactgtttcgcattctcagaatcaaaataattcacggacctttgatgaagtcctgagggaaactaattctaatacaggttctcatgtcaataaaggtcagagaaatgttaaagccaataacctagtgagtgatgttcagggaaggtttctatttgccaggacacgttctagccctgagctgactgactcatatggtgatgtttcaacccaaggaaggagtacaaaagcaacagaaagtagtaaaggccagagttctgttgcaaagttggagaatagtcgtaggaagaatgttgaacctgatgtagctgtaagaattgatgagtcatctgctaggcacatctcatctcgtcaagttcttgaaagtgctgctgattcaaactgtaatcacgatgaatcaagctcaggtgtcatgggtgaagagtttgcatctgttgtgggtgcaggtggaatgcagatgatgcatcaggaggagcaggaccttttgaacatgatggcatctcccacagctcagggtttcagtggtcagactcatgttccaatgaatattgcaccaggtcacctaccatttcactttccaccttccattcttgcatcgatgggatatgctcagagaaatatgggtaacattccctttattgaggctccttggggtacaaatatgcaattttctcaaggtttcatcccaccattgactccatatttccctggcataggagtgacttcaaatcctcaagatttacttgaaactaacaatgagaatttcagttctgttgagatgaacgtagcagaagcagattatgagtactggcatgaacaggaaaggggttctgctagtgaggttgaagttgataatggaaattttgaaatgcttccagaggatagacaacagtctacttcaggtagttataataactctgccccattgtctcgggtaggaagctccaacagcaacagttctgccagagttcagcagaagtttaccaaagaaaaccgaggttcaacaagagaagagcatgttgacaattttcattatcaagatggccgacgaaacgaggtttattttgatgatagaacagcaaattctgaattgtccagtgcacctcctttgagctccttcaggagtaggacctcttctgaaagctcttgggatggatcatcagccaaatcctcaaaatcaactagggagagaagggggaggaaaaatactaactcaatggcatctcctgtttatgcaaagggtaagaatgtttcagaaatttcatctaatcgattagatgatgaaaatagagagtggactcctttgtcgaccatggcatctaacataccagaaagaagcaattggcccacatctggtacttccatgcatgttccaaggaatcaaatatctggttttgaaactgcccagacaagtggatcagattctccattacccatagctccggtgcttttaggtcctggttctcgccaaagagagaattctggggttgttccatttacattttatcctactgggccacctgttccctttgttacaatgcttcctttatataattttccaactgagtcttctgacacttcaacaagcaacttcaatttggaagaaggggcagataacagtgattcaagtcagaattttgattcatctgagggatatgaacaccctgaggtgtcaagcccttccaattctatgacaagggtggctattgagtcatcagagcacaggcctgacattcttaatagtgactttgttagccactggcaaaatttgcaatatggccgattttgtcaaaactcacgtcatccgccttcaatgacatatccctcacctgttatggtgcctcctgtttatttgcagggtcgatatccttgggatggccctggaagacctatttctggtaacatgaatattttcagtcagcttatgagctacgggccacgcctggttcctgttgctcctctccaatcggtttctaatagacctgccagtatttaccaacgttatgtagatgatatgcctcgatatcgaagtgggactggaacttacctgccaaatccgaaggtttctgctcgggatcggcactccactaataccagaaggggaaattacaattatgatagaagtgaccatcatggtgatagagaaggaaattggaatacaaactcaaaattgcgaggaactggacgcggccataatcgcaaccaaacagagaagcccaactcaaagatggagcggttggctaccagtgagagccgtgccgagagaccatggggttcacataggcatgacaccttcattcctcaccagaatggtccagtccgctcaaattcctcacagagtaatccttccaatgtagcttatggaatgtaccctatgccggccatgaacccaagtggggtctcgtcaaatggaccaacaatgccatctgttgtaatgttttatccttatgatcataatactggttatggttcaccagcagagcagcttgagtttgggactttgggatcaatggggttctcaggtgtcaatgaactgtctcaggcaaatgagggaagccaatctagtggagcacatgaagatcaaaggtttcgcggtggtcacggccaacgatcttcccctgatcaaccctcctcacctcatgtctcaaggtag

SEQ ID NO: 9532 - DNA, 672 bp, Glycine max
  Peptide Sequence Number=SeqID_126310
atggcatttcagttttcagcaggggatcggcctgcgcgggcgctggctcctgacccgcccggggacgctgatgatgacgcggctgtgctcctgtccattcatgcacagcacgatggactggttggtgccggcattgcggccgtcgggccggaaccggatgtcgggccgatgatcgctggtgcgcaggtcgacatgacgccggcgtgccctgtgcacgcggagttcccttgcggcgccggtcgcgctgttggccggttcgacctgcacccgccagccctggctccatgcctggtcacatctcatgccatccgacgaaccgcagaccgtcacacggcggcgttcggtgatggcggcgttgcgtgccatcgacaggctggcgaccagttcggcgcgcagcgtttccgcctggaagtgccgcagcgtgcgttgccaggggccccaggccaaagccagcaggaccgacagcaccatgacagcgatcagcagctcgatcagatggaggccgcggtggagccgggcagggcgaagatgaagggacatgcctccagcctcgttccgtgctcgcgcattcaccatcggccaatgccgcggctgcctgctcggaaacccctcaacctgccgtcaccgcttgccccgtatactcacccttcccgggaactggcaacaccatga

SEQ ID NO: 9533 - DNA, 312 bp, Glycine max
  Peptide Sequence Number=SeqID_126311
atgaagaagatgaagggacggaaccaaaatggagaaccaaagcttgtgccggcaagaagaagactgctgcgaggaagaccactgaagaacacgaacgaggaaggagcgcggaagaagactctggaccaagaagaagaaggcgaagaaggggagaaaaatgttgggtgcacggacgaggaaggagcgtggaagaagaaagggcatttttgtaacttcaatgaattgctgggtgcaccagcaattttgctgggtgcacctagcatcagccttttgttggcggtgctattggaagagtacagcaaaacccgctag

SEQ ID NO: 9534 - DNA, 3375 bp, Glycine max
  Peptide Sequence Number=SeqID_126312
atggagatcgctcacgagccaccgccttccctcgacggaagcccctccgccgccgccgatactctcgcgaattctccgtcgtcctcatcgtcttccccttcctcctcatcctcctcctctgcctcttcgccgcgcggcgcgaagaaaaaggagatcgaatccaccgcgtcggcgccgtcgccggcaccagctccggcgccgtcgaagttcgacgatgaggaggaggaagaagaggacgtgtgccgaatttgccggaatcccggtgacgccgagaatccgctccggttttgctttgcacctacacctaatatgtcaaaggtctgcaagcatgcattctccttctctccagtttatgctgagaatgccccagcgaggttaccttttcaagagtttgtggttggaatggcaatgaaagcttgccatgttcttcaattctttttgcgcttgagttttgtgctatctgtgtggctcttaattatacctttcataacattctggatttggcgattagcttttgtgaggagtttaggtgaagcccagaggttattcttaagccatttatcgacagcaattattctgactgattgcctccatggtttcctactttctgcgagcattgtcttcatttttctcggggccacttctttgagagattactttaggcatttgcgagaaattgggggacaggatgctgatagagaagatgaagtggacagaaatggtgctcgaattgctagaaggcctcctggacaagttaatcgtaacatcaacaatggtgaggggaatggtgaagatgctggtggagtgcaaggaattgctggggcaggtcaagtaattagaagaaatgctgaaaatgttgctgcaaggtgggagatgcaagcagcacgacttgaggcacatgtcgagcagatgttcgatggtctggatgatgctgatggagcagaagatgttccctttgatgaacttgttggcatgcagggtccagtttttcatttggttgaaaatgcatttactgtgctggcaagcaatatgattttccttggtgttgtaatctttgtgccattttcattgggccgtatcatactccattatctatcctggttcttctcaactgctagtggccctttgttgtcagctgtggccccacttgcagacacatctctttctctagcaaatattactttgaagaatgcattaacagctgttaaaaacatgtcatctgaaactcaagaaagtggatcaattggtcatgttgctgaaatgctgaaagcaaatgctagtgaaatgtcaaacataacttctgcttcagctgttatcttgaaaggagggtcaattggaacttcaaggctttctgatgttaccactctagctattggatatgtttttatattgactctaattttctgctactttggaattgttgctttaattcgttacacaaagggtgagcctttgaccatgggaaggttatatggctttgcttctatagcagagacaattccatctctcttcaggcagtttttggctgcgatgaggcatttgatgaccatggttaaggttgctttccttttagtcattgaactgggggtatttcctttgatgtgtggatggtggctcgatgtttgtaccattcagatgtttgggaagacaatggttcacagagttcagttcttctctgcatcccctttagcaagctcattggttcattgggttgttggtattgtgtacatgctactaattagcatatttgtcagccttcttagaggggttttacgtaatggagttttatactttcttcgggaccctgctgatccaaactacaatccattccgtgatctgatagatgatcctgtgcacaaacatgctcgcagggttctgttatctgttgcagtttatgggagtctgattgtgatgctggtattcatgcctgtcaaacttgccatgcggatggcaccttcgattttcccacttgacatatcggtatctgatccattcactgaaattccagctgacatgctgctctttcagatttgtatcccatttgcaattgagcattttaaattgagaacaactattaaatccctacttcgctattggtttactgctgttggttgggcacttggtttgactgatttcttactgcctagacccgatgagagtggtaatcaagaaaatggaaatggggagccagctaggcaggaaaggctacaagtagtacaagctggagtgcaagatcagggtatggtgccatttgcaggcgatgatttgaacagggccattaacacagtgggagaaatgaatgctggagaggattatgataatgatgagcagtctgactcggacagttatgccttcgtgcttcgcattgtgcttttactggtgattgcttggatgactctccttgtcttcaactctgctctgatagttgtaccaatttcacttgggcgggcacttttcaattctattcctcgccttcccataactcatgggattaaatgcaatgatctgtatgcatttatcattggaagctatgtgatctggactgctgttgctggagttagatactcaattgagcaaataagaaaaaggagatcttcggttttgtttggccaattatggaagtggtgtggcattcttgtgaagagttctgcacttctgtctatatggatatttgttatcccagtgcttattgggcttctctttgagcttttggtcattgtgccaatgagagttccagtggatgaaagtccagtattcctcctttatcaagactgggcattaggccttatatttctcaagatatggactagattggttggtaagaatgaatataattggataatgagagttttattagaggggaaacacttggttatgttggaccacatgatgccgctggtggatgaaagttggcgagtcaaatttgagcgagtgagagaggatggtttctccaggctgcaaggtctttgggtccttcgggaaattgtacttccgatcataatgaagctgttgacagcattgtgtgtaccctacgttttggccaaaggtgtatttccagtgcttgggtatcccttggtaataaattctgccgtctatcggtttgcatggttgggatgcctctctttcagttttgtgtgcttctgtgccaagagattccatgtctggttcacaaatctccataattcaatacgcgatgaccggtatctgattggccggaggttgcataactttggagaacatgctgagaaagcaaatgtagcagaaacttctacaggggagcaggaagctattttactaggtacaggtttaaaccaacaagatcacgaagcagatgttggactacggttgaggcacgtaaatcaacaggtgggctga

SEQ ID NO: 9535 - DNA, 561 bp, Glycine max
  Peptide Sequence Number=SeqID_126313
atgtcagaacttaaagttagcctctctaggttatgtgcgtatgcttctaagggagtggccagaatgaggaaggataaattggtgagcactacggaattcctttcacagatcgattggggaagtatttgggtaagaataccagtgtggagattcatcaagaaagttattcctttcttagaagataaattctggttaaagctggggatgggcatagcagtttttggtgcccggtttgccaccttgaagatgaatctatttggcattgtctcttactttgccctcgagtgcccaggctttggagtaattaagttgggttctttacagaacctagggcaagctgggtttggaggccttgttggtaacattgagggacaattcttgaaaggattctatggtaatattggttggtctgacaacctgcatacagagatttacgcattaagacaagggttggaaatatgtttggatctgggtataagggagttaacgtgcgaaacagactctcttcacacccttcagttggtgaataatgtcattgacccccacccacaacaggtttga

SEQ ID NO: 9536 - DNA, 1456 bp, Glycine max
  Peptide Sequence Number=SeqID_126314
atgaagttgtggaacaaaaaacagtttggaaacacatttaagaaggaggatctgtggactgctgcccaatcacacgagtccatgttaagacaaaaggcaagaacaaaatggattagagagggggactgcaattcaagatactttcacatgctcatgaactctaaccgcaggaacaatgcagtcaaaggggtgcttattgagggatcacgagtcgaagatccaaccagagtgaaggaggaaattcataatttcttccagtccagattcaatgagcctgattatggaagaccagaaattaacgggaccagattcaaagagttagctgtatgtgattgcagaagtgagaaaagcccaagacctgatggtttaaatttcaagttcataaagtttttttgggagttactaaaacccgatatcacccgattccttgatgaatttcatgtcaacggtatcttcccaaagggatgcaatgcttcgtttattgccctaatccccaaagtgaaagacccacaatctcttaatgaatacaaaccactaataggctgtgtttataagatagtggccgagatcctagcaaacaaattgaaaaaggtgttgacggacatcatagatgagagacaaaccgcattcataaagggaaggcatctgttgcacggtgtactgatagctaacgaagtagtggaggaggcaaaagggtgcaaaaaaccttgcttagtgtttaaagtagactatgaaaaggcctacgactctgtctcaaaggacatcaatgttgttttggttaatggaagccccactaatcaatttactccgcaaagaggcctccggtttaactgcttcctaatggggaaaaataaggagccagttagcattttacaatatgctgatgataccattttcttcagggaggccacaatggaaaatgtgaaggctataaaaacaattctcagatgctttgaattaacatcaggactcaaaatcaattttgcaaaaagccgctttggggaaatctacaaatctgaccaatggtggaaggaggttgctgaggtccttaattgcatcaggttgtccatgtctttttcctatctcggtatcccaattggggcaaatccaagacttagtgagatatgggatcctatcattaggaaggtacctaacaaaatagtagagaagctgatcaacattcagcgcagatttctatggggcggaggaacagagcaaaggaaaatagcgtgggtcaattgggagaaagatcttatgttgctcaatcaacagcatgagacaagtgcactcaaaaaccaaatagaatggagggtgggacagggagacaagatcagattttgggagaacaattggacagatgaagacagaccactaatgacaaaatatcctaatctgtaccaaatctcaaagcaacaacagcaaaccatcagcctcatggggagccataatgatgcag

SEQ ID NO: 9537 - DNA, 384 bp, Glycine max
  Peptide Sequence Number=SeqID_126315
atggccaagtccctccatctccgctacctctccgaacccttccaagaaccatcgcaaccagaggcgggctctcccacttcccttggcttcaagaacactcatctgtcaagaaccacacgcggaagagctaggagaagccagaagaaggagagtggcgagggtggattgaagttggaagcggagaaagacaatggattggataactgtgctccgtctgtgagatacattgttcgtaggctcattcgcgatggatgttcgagaggcaccgcaatgccaaaatcgtatattgttccgttgtttgctgtgcaagcacctgtagatgtcgtttcctggatcaagtatgtcgttcttatgttttgctttcttgttcaatttgtatgctga

SEQ ID NO: 9538 - DNA, 1560 bp, Glycine max
  Peptide Sequence Number=SeqID_126316
atggacgtcaagtctcaaagcatagctcaacacatgacagacctggaagaagtctttggggaactctgtaaatatgacatgcgcctcaaccccaaaaaatatactatcgaggtaggcggaggaaagttccttggcttcatgatcactcaccggggaattgaagccaaccctaaaaaatgcattaccatactagagatgtgcagcccaactaacatctatgaagttcagaaattgaatggtaggctagcatccatgtctaggttcctcccgaggcttgctgaaaaggcaaagccattttacaaattgctcaaaaatcctgagcccttcctatgggatgagacttgcgaacaaactttcctagctttcaagaagagcatagccacaccactagtagagtatgaggtgctcattgcaagtttgaagccatcaagagaagtcggagccaagaggttacgatgctacacaaacttgcagcttgtccaaggacaagttgctaagagataccaaactaaggaaacaatgttgctcaagtactatcacatcatgaagactttcattgaaaattttgaatgtttcaaaatgtactacatacccagggagaccctccaagctggccagcaccaaaaagagaacttcatgaaaggatatgtggtctccacaacggaggatgctcccttgcgaccaaagtggtgcgagccgactactattggccaacactcagggcagacaccatcaactttactaggaggtatagatctgccatgcacccctcctaacaatctccacaatctaagctccccttggcccttcgccacctggggaatgaacatattgggatcactgccaaaggccccaggagtagtcaaatacttgctagttgttatcgactacttcaccaattggataaaagcaaaaccactgtgggaaattacggccaacgaggtggagaaattcacctggaaacaccttatctgtaggtacgacctctcatatgccactatcacagacaacaacactcaattcaaagctcagacttacaaagacttcttgacaaggctaggcataaagcacctagtcacctttgtcgaacatcctcagaccaatagtcaggtagaggcaattgatagagtcattcttagggtgctacgtactagactcaacaagtctaagggtctatggaaaaaggagctctccagcatactctgggcgtaccactgttcaccccagatagcaaccaatgaaaatctttaccgactcacatatggcacaaacgccatgatccttgttgaagtcagggaactgtcaataaggagattgttgttccatcaacagcaaaatgaagaaaatatgaaggtagaactcgaaaccacagacgaagtccaagatatggcgaggatcagggaagaagctgccaagctccgagcagcaaggagatacaatgcaaagtccaaggtgaagccagaaaagattcccaagcgggaaagcttggccccagctgggaacgagcattcagggtcacaaccaaccttggcaacggagcatatagactacaagacctag

SEQ ID NO: 9539 - DNA, 1761 bp, Glycine max
  Peptide Sequence Number=SeqID_126317
atggttagcacttggtctagccttagacgcaagactcctttcgaagactttcatcctcattcggcagctgaccatgatcagctggaggctcgtatcagacgtccccaaggcaatgagcacttcgctcacacattgcttgagcacatccaaggggaatcacacccccgacgcacagtcaacactgtagatgacttaagtctctcccacatgcattgtccagtagggcggactactcgtcaacatccctttgttgactgcatcatggaggctgacatacccttggggtggaaaccactcaacctcgagtggtatgatgggaccataaacccagatgagcacctaaatgccttcctgactcgggcgaacctatacactaatgatgacatgctacatccagatggaaaaatgtccaaattcaagaatgaagtcaaacaagtcatacagaagctcgacaagtatgagcgttacacacccctaacggttaatcacactacaattctagaggaagctttcaacttaaaggttcccatcaggctacccccaacgaaacctcctaggtcggggttagacgtaaccaaatactgcagacaactaccaagttggaacaagacccagaggagcaataaaggattcacaatgcaaatagaagaagagatagagcggaagaccgaggaagacagagacaccaacaacaacggtgtgaacgacaacctccacaagaacaggaatccgcctaacaaattagggcgagcattcgctaagcgtgacactcaatggctaagcacgaggaagaatctagaagaagatgatctgtcaggttcgctgagggcaccactccaggtcatcaagcgcaccacttcagctcatccgctaagtgagagaagcgtgggtatcaacctcgtcaaccaggacgatcccatggttgtctccatcatcattgcaaacttcatggtgtctaaggtcctcatcgaccagggcagttccactgatatcttgtatttaaaaactttccagacactcgaggtctcccccgacactgtccaccctcacgctggtccactcctcagctttacaggggaaagagtagagaccagaggctatactgacttaatgaccaccttcgatcaaggcaagctttctaggagattcaccataagatatctacttgttgatgcagatacattatattttgctttaatcggcaagaagacacttaatgagcttagagccataatctccatgccccatttgaaaatgaaattccataccctaaccagggagataataaccgtcatggcagaacaaaagcaagcacaacaatgctatgcaaaaagcttgaaggtagcaccatatcctcaccccacaatagctgaaggcactcaagtcatgagcgtgaataaagggtctccaatccgagccctgaccgtctaccaagcaagcctagaaattcgacatagatccgtggacctcaccagccatgagcaccggtgcatcgctgatgtgttacacaaaaattttgatttgttttcttggcacccatctgagatgccgagaatccatcccaacatcatcttccacaaactttccatctatccccaagccaaaccaatatcacaaaagaaaagaaagatgggtgaagaacgatgcaaagctatcaaagaagaagtcgacaaactccccaacgctaacttcattagagaagttaggtgctccacttggctcgccaacgtcgtcatggtcaaaaagaccaacgacaaatga

SEQ ID NO: 9540 - DNA, 1709 bp, Glycine max
  Peptide Sequence Number=SeqID_126318
atgaaccacaagccatggctttggaggaaaaaatctatggagaaaagaatccttgcagttgacaaagttgcctgtccttctaaatccattgaagaagaggcacacaaacttccaacaaataaagaaactggattggaaagatcatcaaaaagtctaaatgagaagttggcaacagtcctccttgattcccattctggagatgactctttagaaaaagatgcccaaaagtcccaacaggaaattagaggcaatggcaagacaaaacaggaagtagaatctgttgaagacttacatgaaaaagcatctgctgagactgttactcctgcagatgcaacattggaggaacctttgcagccaccaagtggggttcaagacgaacaagagcaaaagttgagtggtgccattgcaaagatatcaatagagcatgaaaagattcagaaagaattggaagagaagttgagggaaacaagtaaaatgctagatgacttaactgctgagaatactcatcttgctagtgcattgctaaccaaagagaaatcaattggggaactggttaaatgtaaacaagaagcagatgctgagtttagtacattgatggctagactagacaccacagaaaaggaaaattctttactaagatatgagtttcatgtgctggagaaggaacttgagatccggaaggaggaaatggactatagccgtcagtatgctgatgtctcacataaacagtaccttgaatgttctcagaaagcctcaaagttagaggccgagtgtcagagactgcatcttttgctacaaaaaagctcacctggttctgctggttccgagaatatgaagaatgaagttggaatggtgagaagaagaaagtcaaatccttccagagaattgatctacaaaaaaaatgatgttggaaaacctactaatgtgtctgagaaaagtttcagcttaatgatcaaacgcttgcaagatctggacgaggagaacaaggctctcaaaagaattttgaccacgaaaaactctgaactagaatcttcaagacttaagtatgctgaaacagcttccagattatcacaggctgagattctgcttagaaagatatccgaaaatcagaagtctatggagctagctaggtgttatcccatgtcaaatgaacttcctctgatatcaaattatgacatttatagtgacgatgaggctatctcttctggatcctgggctaatgctcttatgtcagaacttgagcatttaagaacttcagaggctaaaattcataaaagctgtagagacactgaagtttcagacatgagtttcatggatgattttgtcgagatggaaaaacgagctatagtttctattgatacacctaaaagaggatacatctctgatgtaagtggtagggagctagtgccagttgaacaagatcatcttggcattagtgagaggaaacaggagatccaattcaaacatacaacaacagaaaattcatttgactggcttcagattgttttgaatgcaatcttggaggagaaacgcatatcaagacgaagtcttcccgaactctttgatgacataaaaattgctttggattgcgtagaccacccaactgcttgtaaatctgatacagaagcagaaagcaagcaacacttcaattcaaatttgagaaagtcagtccacagaattatcaacctcattgaaggaattgctccaaa

SEQ ID NO: 9541 - DNA, 768 bp, Glycine max
  Peptide Sequence Number=SeqID_126319
atgaagaagaagaaggttgaagcagctagtgtctcgctaagcgaggcatatgcacttagtgaagaccatcagtgctcttgtggtgtctcctccttcctcttcggctccaatggtcatccctccactgcgttggcggcgacatcaccttcttcgtcttcttgtccccgtgtctccttggatcatttgtacacctttagtgatactgattcactatggggtacaagttacaagctggagcagaagaccccaattggctttgttttagcctttgataagaaccttattaggagaacggatagtggcaccaagaggctttgcataaggtggcatccttggaggcagaggtcgccaaatgaagggctactgctcgcacagtttggagagtggaccaccctaaggtcaaatcgccaactgccttccaaagttggtggtgtgttggccaagttgctacgcaccaagttggatggtgatgaattgttcaaatgctacaaggacttggacgagcttgtgaaggtgaatgttgatttaaaggctcgacttaaggagtcaaagtctcggttaaaggagtacgagctggaggccagcaagaagcttaaggaggagttgctcgtttacaagaaggaagccatggagcaacatgaaaaaggattcaacaaggccgatgtgaaggacgatgtcttgcttgacgaggaagaaattgttgtggacaaggaggctattgatgaagagcagagtgctgaggagcaaggcgatgatacttgtgtctag

SEQ ID NO: 9542 - DNA, 402 bp, Glycine max
  Peptide Sequence Number=SeqID_126320
atgtccagcgacacctccttcgcggaccgcaagctctgcggtttcctctgtacggttctcacactcactccccgcgacgactcagacaccaccgacatacccttccccgagccatgcgaaatcttcggcgaagggggcgaggtcggcttccggaccccgaacggcgtcgttctgggcccggtgctcgattcgttgcaatgcggcggtggcggcggtggcggctccaacaagatcaagagaaggaacaagattggaatggtgaacgggagcgtgagcgtggttcaccagctccacgccatggtcactcgcaagtgcgccagaatcgacgctcgcgtggtgtatggagtggctggcagtttccgagatcgggacccgtcgctggcgccgtttttcgccatttga

SEQ ID NO: 9543 - DNA, 204 bp, Glycine max
  Peptide Sequence Number=SeqID_126321
atgagggaggtgaatgtcaccaaagaaaatggcagagttgggggtggcgataatggcaatgttgaagaaaggtctcatcaagagacatgggggaaatacgataacgacgacactaatagtgaaggtaaatcacagacacgaagtagcagagggagatttccactggcgattgagagtcacccaaaaaactactctcaagtgcag

SEQ ID NO: 9544 - DNA, 741 bp, Glycine max
  Peptide Sequence Number=SeqID_126322
atgaaccgaaccaaaaacaaaaaaacacaaaaacaccaccattctccttcaacggtaagacttctggaacctcgcacgtgcgccacgcccaccaaacttcttgggctcgcagcgcctgggatccgcgacgagcaaggtacgatcgtacctcaccagaatgtccttgatctccttcttactctgttcatcaacgtacttctggtagaacgcgacgagcgccttggcgatgctctggcgaatggcgtagatctgggaggtgtggccgccgcccttgacgcggatgcgcatgtcgacgccggcgaagcggctctttcccaacaggaggatgggctcgaaggccttaaagcggaggatctccggctcgacgagctcgatggggcagccgttgatcttgatgaggccgcgcccgcgcttgcagtaggtcacggccaccgccgtcttcttgcgaccgaagcactgcacctgctccagcgccgcttgcccgtgttgcggctgcgactgaggctgcggctgcgacattgttggtttgtcaaccaaaaggtagacatagtagataaagaaaactatgtgtaccaatacatagtagatgaaggtagtgtattgttggacacattggagaaggtgtgctatgagtataaattggtagcaagccttgatggaggatgtataatcatgtccatagtcaaatactacaccaaaggtgatgcacaactcacaaaagagtttttgaaggataattga

SEQ ID NO: 9545 - DNA, 1173 bp, Glycine max
  Peptide Sequence Number=SeqID_126323
atggaagggagagctgattttgaaaattttatcaaggaattggcatttgctttggactggagcattaataactgtgcgacctccacaaatgctgccattgcaagggataagatcaagaagcattttagcagtcatttgtcaaaaaatgaaaacaaagtagatattgaagataaacagtcttctcgctcaccttcatttgcatatcctgatgatcagtgtgagctcttcaacacaaagaatgatcagggtgatctccttgaagaaattagaaaagtaaaatatgatttgaggagcacaaaaactgcgaagaaagacttggaagaaaagctgctgtcagtaactgatgagagtcaaaacttgacaaaacaatgtcaagaagcacaaaataacatcagaggtttagaatcagaaatagagacactgaaagaatccaaagcaacactggaagatcagattgagaaacagaagatcataaatgaagatcttgatacacagcttacaatagctcaggccaaattaaatgacatctttcaaaagttttcgtccttagaagttgaattagaggataaaaagaactcctgtgaggatttagaagcaacatgtctagaacttcaactccagctggaaagcattgcaaagaacgaatctccaacatatggcaaatacgatgtagaaaagatatatcaaactggctgggagatcacaacagcttcatcgaagttggcagagtgccaagaaaccatcctaaaccttgggaaacaactcaaggcacttgcttcatctagtgaagtagcactctttgacaaatttgtctctacaactaatactatggccaatccaacccagaagaagaacttgatcaaacgatcctctctacgcaatcaaatgcaagccgaggatgaagctaaaggagggatgcataagtctgtccaaactgaagaaactaaaagtgataaagatgtgcagagaccaccccttcttcaatctgaaaccgaaaaatctctccaaagtcccaaaagtctcaattcagagcaacatgatagaagcaaaaccgcgggctctttggcaattgtaccaggtaaaaagcaagtaggctttggttttctgaggaagctgctgtcaagacgaaagaaaggaaggggtaagggaactaagttattagccaaagcatga

SEQ ID NO: 9546 - DNA, 342 bp, Glycine max
  Peptide Sequence Number=SeqID_126324
atgaagaagtgtgtggcgtttcttgccacaaccatttggaaaaggttccacgtttctcctcctcaaactcaatgtcgattctactgttctcccccctctcatgcttcctccaacaagctctttgtgggaggtctctctctgtctctcttccattttgcttctcctgttgtgtcattcttccttcgtttattgactctgagatcgtttcagggttgtcatggtcagtggaccacaagtccctcaaagaggctttctcttccttcggggacgtcactgaagactagtaatattttaaacctacctgagagtggagccaacactttatatgaatgtagtttgtag

SEQ ID NO: 9547 - DNA, 1398 bp, Glycine max
  Peptide Sequence Number=SeqID_126325
atggaggaagggaggtctcgtctgttacatttacttcaaaaatgcatgattagtgctagaaagatagatttacaaagcattccaccatgcacgaagaaagttgtttatctagattttaatgaggagcatgctaggagttacaatgaattggtaatcactgtacgacgtaatatattgatggctgattggaatgatccttcacatattgagagtctactgaatccaaaacagtggaaatttcgtagtgcaactttaaaaaatgtgaggctttcatgctgtgttgctggacatattaaagttacacatgctggagaagatattcaagaaacaatggatatgttagtacaaagtggtctggaccctacttcaggagagtatacctccgtaagatataatctcttgtatggtggtcactgtgtcaggtgcaaggaatggtgtcgccttccactcattaccccatgtcggcatctgttgtgccttgattgtgtttctatagacaataccaagtgtacttatcctggctgcagtaaattgtatgagatgcagagtagagaggcccgacctgaaaatcctaaaccgaagtggcctgtacccaaagatcttattgagctacaaccttcatataagcaggcatggttaatggagaactcagataattgggatcctgattggcaatctacatctagtagtaaagtctcctatctcgtccagaggttgaaagctttgcgaggaaccaatgaagagacatacttcaatacagaaaatagcaatgatgatttgcatattgagaatagtttgcatagaagtgatgacaaatcatcaattcagacatgttctatgagcagcactaagaccaatttgaaccctgagaaagttctgatattttctcaatttcttgagcatatacatgccattgaacagcagttgactattgctggtatcaaatatactggaatgtatagcccaatgcattccagcaacaagaagaagtcattagccatgttccagcatgattcaaattgtatggcacttctgatggatggaagtgctgcattgggtcttgacttgagttttgttacgcatgtatttctaatggagccaatttgggaccgaagtatggaggagcaagtaattagtcgtgctcatcgtatgggtgcttctcgtcctatttatgtggaaacattagcaatgcgtggtacaattgaagagcaaatgctagactttttacaggatgctgataactttagaagatcaccaattaaggatgctaccgaatctgttgatgatagtgggggacgaggatatagatcattgcatgattttgctgagagtagttatctactgaaacttagatctgtgtatactaatttggaaagtccaaaagtcaaaaacatttaa

SEQ ID NO: 9548 - DNA, 306 bp, Glycine max
  Peptide Sequence Number=SeqID_126326
atggcttcctttgtatccttcctagtgctgcttcttgcagcccttatcctcatgcctcaagggcttgctacttactacaaaccaattaagaagccaccagtgtacaagcctccagtgtacaagccaccagtgtacaaaccaccggtttataagccaaaaccaccggtttacaagccgaaaccaccggtttacaagccaccatataagaagccaccatacaagaaaccaccttatggaaacattgtgacttacaacttcgtagcaatgcatattcttgactcttgcatgcacttcaatccttcgtag

SEQ ID NO: 9549 - DNA, 594 bp, Glycine max
  Peptide Sequence Number=SeqID_126327
atggcatttttgtttgcgacattgcttcaaacaacaacatccaaaacaacaacatccagcacccacgaaggaagaagaagaagcaccaatggagtgaaacgacatagggaagaggaagaagaagaaccacagcggcacgggaagtggaggaagaaggaaagaagaagaaccatagcggcacgggaagtggaggaagaaaaaggaaagaagaagaatcacaacggcatgggaagtgaagggcattttggccctttcaccttcgttgctggaagtcccagcaaaaatgctgggtgcccaaagcaacgacgaaaattatttgattatctcacggcttgtatgttgagaggtccacttcagctggcgtgggcgcgacggtgtgtgcaacgacagtcactgcttaacggtggcgctgcgatgtgtgatagcggcttcgaaaactcttccatgagtggcataacgatggtggagctcgtgcggtggcaacgtgacggtggtggaccttgtgtgtggtggcgtgacggtgttggactcatgcgcaacgacgcaatgatgagtgtgaaggattttgaaaatcaccaaatgcaaattcgttga

SEQ ID NO: 9550 - DNA, 177 bp, Glycine max
  Peptide Sequence Number=SeqID_126328
atggcgagtttgctctgcgaaagccacgtggcctggaaaccaccagtggtgatggcaattcaagcgcaggtgcaagtcgccagtttctctggcgagtctggtcacaggtttccagtttcacttttcagagggaggcacatggttgaagcttttccagaaggcacgtttttcaggtaa

SEQ ID NO: 9551 - DNA, 630 bp, Glycine max
  Peptide Sequence Number=SeqID_126329
atgggcagttcagatagaatcaaactttcgattgattcgggtacttggaatcctatggatgaagacatggtttctctggatcctattgaatttcattccgaagaggaaccttataaagatcgtattgattctttgagaactaaagaggaactgagggttacaaagttactcactgctcggtttatttgggagatcgagtacacaacttggttgtcaaatattgtcatggtcaagaaattaagtgaaaaatggaggatgtgcaccaattacaccgatctcaacaaggcatgcccaaaagatgtttatcccttacccactataaaccgactagtggacagggcagcatggcatcgcctacacaactttctggatgtgtattcaggggtcatgccttttgccttgaaaattccaggagccacataccaacgcttgatggacaaggttttcaaaatcaaatcagaagaacatgttgatgataaggtggttaagttcgaagaggctaaatcacatgcacacgatctagcagaaatcactacaagaaaaatcgttattaccgatggaatatttcccatggaatgttttctactggaaatgattacattactgacaaaatttatcgacggaccatag

SEQ ID NO: 9552 - DNA, 309 bp, Glycine max
  Peptide Sequence Number=SeqID_126330
atggctaattcctacttatccttgcttgtcttgatccttgtagctctgctcctcacccctcaagggcttgctgatgaatctgattcttactataagccaccagtttacaagaaaccaccagtgtacaagcccaagcccaagccacccattcacaagcccaagccacccgtttacaagcccaagccacccgtttacaagaaacccccttatgggatgagacattcttggctagctctgcacttcaatcctttatttgtacaatgctatggccaagtcaataccatgcatcttatctatgtgtgtcattga

SEQ ID NO: 9553 - DNA, 216 bp, Glycine max
  Peptide Sequence Number=SeqID_126331
atgaaccataggacggtcattgtgggggggggaggggtcttccatggccaaatttggaatgtcttcatctgtaggcatgttggctacagccggggatgggaatggcatggatgtaccggggactatccacgtgcatcaagatgtgatggagataatctaacttcaattggaggtggaggtggtgtaagtgcaacatcgaaagatctgactgcatag

SEQ ID NO: 9554 - DNA, 186 bp, Glycine max
  Peptide Sequence Number=SeqID_126332
atggagagaacatcagttgaatccgggcccaacgggggagcaaaagagccaaagtgtggccagcacttgtccttagggttccaagtggctacaaaaggttttctcaccaacaaaggatgcagacacaatgaagaaagcatatcatccattctagttggaacttcaactttcacatttgccatttga

SEQ ID NO: 9555 - DNA, 156 bp, Glycine max
  Peptide Sequence Number=SeqID_126333
atggctgctcaggagccaccagccagccttttcttatccaccataagccaagggaaggaaagcaaatctctagtaccagttatcccattaatggatgctatcaaatttaaattcaaaagcaggcatacttctgatgatgtaattgtttgcatataa

SEQ ID NO: 9556 - DNA, 1263 bp, Glycine max
  Peptide Sequence Number=SeqID_126334
atggagcctagaactagtggcaagaaagggattgtatgcggagttgaagtagcaatttctgaagaaactattgaatgtcagaaggaagataaaacaaagttggataatgccagtaaaaagaataagtgtggtgggaacaaaggaaaaaagaagaaagcaaatagaaagaagagagcagaaaagaacaaacaactcggtgtcaagagattgcagttaaagcatgtacagagaccaaaagttgtctcacattgtcgccattatctcaacggaaggtgccatgagccatgtactcactttgctcgtcagtcttgcatgaaaggggatgattgcccatttgatcaccagctttcaaaatatccttgtaccaattttgtgtccaaaggctcttgttatagaggtgatgcttgcttgttttctcaccaggtatcaaccaaagaagatatccctacaccttcaaatatgtgcagaccagagttgtctccacttctgtctggaaatgcaaattccagcgcaccacttaacaacaatcatggctctagttctgtcaagcagaaccacttaactaattctgcaggaattcattcttgcaccagtgttgaacataaggtgacaaacactgtacttaaacagcctacaccacctaaaggaattagtttcatcaatcttgcaaaattatcacccagccttagttcactgaaacaaggcacagtaacaaccaaggaaagtcctgtacaaattgggacccgtgaagatcaaagtgtgtttcacaaaactcaaaacaaggtggatattcctaagaaattgccaactgtgacacctaagggaataaactttctttcttttggcaaaggctctgtctgcagttttaaaagtgtgaatagggacaatggtatcaaattgcctcagttattcaattttggtctgcccgagcaggcaaaatcctctctaaataaagatgattacaacaaagctagtgacaaaacaaaacaaaatgcaccgcagactgatatattcttaactgagattttaggaaaaaatcaatctgttgcagaagaaatgaaatcaaagcttccagagaaaacctccgtagatgtttttatgagggatcacagccatagtaaatcagttcaagaggggataaagtcatctgataattctcaaagttcaaagggacaaaaggcattcttatcaactctagcatttgcagctgaacatgaatctgacattaagatgaaataccctattggtggtttgccgatatga

SEQ ID NO: 9557 - DNA, 744 bp, Glycine max
  misc_feature (717)..(717): n is a, c, g, or t
  Peptide Sequence Number=SeqID_126335
atggatagttcaaaagcctctgaattggcaatgtatttcccaccataccgtcgatcccaattgcgtagcaacacttaccgtgccttcgttcacctcctctctcacctttctgcctacaacgcttcaattcaagcctcaactcaacccctcatctctcccaataatggcagtggtagaatggatcaagaaaacccggaaaaggagcctaagtgctatgaagttgttcattctgattgtttggatcccaaggatcctatatgcctgaaggatatacaggaggtccaggaaatcattgaaggggttggagacaaggatgtggatttcactatcaacaagatggtcctagatgatatagaacatatgatgggaatggaggacatgtctacccaagcaaatggttttgataaggagcaggagctaatgaatgagtttgagcagattatgaaaggaactgaggatcttatttgtgatagtgaattcatccccttgaacttgggattagataacacacagtgtgatggtggtgaagttgggttgatggattaccaagcagaaatggaagaaggagaactctctggagacttgggaatagatggcaattcatttgatgtggcttctgcagatgctttaatattacaacagatggaggtagatgaggttcaggagcccgaaaatgtaactggaaacatgatatatccttctaagattgagattcangaaaaggaaaaaggctgtgactcttaa

SEQ ID NO: 9558 - DNA, 618 bp, Glycine max
  Peptide Sequence Number=SeqID_126336
atgctggaagaagagttcttgatgatcttttggaattgctccccaataggcacgttccctacagtcggggatgaggatggtgtggatgtagatatcagggatgattcatgtgcattaattggagatggagatggtgtaggtgcaacatcagaagatctagttggcatagatacagtagacgatgatgggatagacgatgatagattatctctaggtgatatctgttatgccaaaggttgctatccaaatcttcaatacacctttcttaaccctgaatgttatatgaagttgctggatgccattttgaaggcgctggaggtgaccttcaaggctctgaccctgtccctcagaatgttggatgcgactttgaaggagccggaggtgacttttagaatggcgtcgaaactgttcttcacaattttgaatgcgactttcgaggtgattttcatggtgttgaacttgtacttcaggattttgcatgcgacattcatggagctgaaaatgatcttggcaatctttaatgcgacttccaaggagctgaatgtgactttgaagtcactgaaattggttaaactgttcctcagaacggtgaatgtggccatcatgacgcctctctag

SEQ ID NO: 9559 - DNA, 678 bp, Glycine max
  Peptide Sequence Number=SeqID_126337
atggtactcagtactttagattttgatgattttgagacttgtgtggtttgcattaaagacaaggatgaaagtagtccgagatactttaacaccttcatagatgattactcacgatatatgcatctttacttactttgttctaaggatgaagctttggatgcctttagattttttaaggttgaagtagagaaacaatgtggaaaacaaattaagattgtgagattagatagaggaggaaagtactatgctagagttctaaccaagactgcctcaaagacaccttttgagttattcaaagtgagaatttataacccacaagagaagaaactagatttaaggactattattaggtatttcattggatatgctaaaaagtctaaaggttataggttctatttttcatctcacaacactaggattaatgcaaaatttcttgaaaatgacttgatcagtgagagtgatcaatttctagacattgcttttgaaaagggtcactatgacgctcaaccttctggatcaagtgaaaaaattgtagtcattcatgcccctcaagttcaagcgggtgtaagacaaccaatcattgacgttccacaatttgctgaatatgatcatgtagatcaaactattgatgaggaacaagttcctcaacaatatgatgaggcaacattaagaagatga

SEQ ID NO: 9560 - DNA, 504 bp, Glycine max
  Peptide Sequence Number=SeqID_126338
gccattgcatccaccacatcagcagctgcatcaatgctactttcaggatcaatgctaagctcagatggccttatatacccaaacatattagaaagtgcatcacttccgttttctcagaacttagcaaccctctcaacttcagctccatttcccactataactttggatctcactcaaagtactaccaataattcctcacagctactacaaggggcaccacaggataaccaacatatatatagcctcctttccccacttttggctcagaagtttatgtcatcagctaccaacattttttatcagaatcaccagactaaggtttctagcttgcatgggtctcagggaacagaaactgcttcatttgtggacacggtaaatgcagctacagctgctatcactggagacccgaaattcagtgcagctgttatggctgccataacatctataattggaagttcacatccaaacattaatggtactagtggagatccagcattgcaataa

SEQ ID NO: 9561 - DNA, 867 bp, Glycine max
  Peptide Sequence Number=SeqID_126339
atgtcgttcaatgggaaacgacttgtcgtggatgagatagatttcttcacagagaagaagaagaaaagtgaagacgttgataatcaattggtgcaccaccaaatggagcttcctattaataccaatttagatctccttattacgaagagttcaaccagcaatagatcaaatatggaagaaggaccgtccgagtcaagggataatacgagaaataagtttgcagctatgttagctgagttgcacatcataaatgctgaaaatcaacacttgagagagctggttgaccagattaatggagccatagaggagaaggataagagagatgatatgattatttcaaggtctttcttggatattggaattgctacgaaggaagatccttctcaacaacattcagaagcaaaactgcaagaaagcaaaaacattactgagttgatggagtgcaagaatagagatgttgttgagttggattctggcaaggatagtgcaaaatctaggagagataagcatgagagttcagaaaccatgtcaatgatcaagaaagctcgcgtatcagttcgaacaaaaacagattcatctatgatggatgtcaatggagaaagtatgggcagaagatggcaaaagggaatccatgtccgcgatcttattatcgttgctcaatgggaactgcttgtccagttcggaagcaagtacccatttgttgaaggtcgttcgagcttttcctggaagtatggtatggattacttcagcgctgtagcgcctgatactggaactttgactcgagacattttctctatcccttattaccctgaaaaagcaggggcaccttgcatccttgaaccgataaccatctttcggctaacctag

SEQ ID NO: 9562 - DNA, 357 bp, Glycine max
  Peptide Sequence Number=SeqID_126340
atggatggtcacatgggtttggctaattcagtggcactaatgttggtcgggataacaaatttaatagatgatccaaaaggaggaattgtaatgaggactgctgttggagatcattcagcagatgaccggagggaagcattgcttagagcaagcaatcttgctttgacaaggggtgtaacaacagttgttgatatgggaagatactttcctggggttacagcagatctctcttgggaggatttttcagatgtttatctatgggtcaattctatgtcaaaaatgaaagttagagtgtgtttattttttccattggtgacatggtcatgcttagcggagaacggcaaaaagattaactaa

SEQ ID NO: 9563 - DNA, 273 bp, Glycine max
  Peptide Sequence Number=SeqID_126341
atggcacatccccgttccattcaaaattggagcgatgccggaaagtgcactcaccattatcggagtgccatcaggtcatcggaagagatcgactctgacgacagcgatagcagcacaccgaatgcaaagacgatcgaaacccctgaactccaccactcgcccaacagcttagccggcgaccgtatcgacgaagtcgagacccagcagcgtgcaccattacccaacggtcctcgagacatagaggacccaatgggtaacgaccgcggtagctag

SEQ ID NO: 9564 - DNA, 252 bp, Glycine max
  Peptide Sequence Number=SeqID_126342
gtgtttgctacccatgatgatgttttgaattgggctcgagttgttgtttatgaaattggttttgtggtagtcattataagatcaaacacaaatactggtatgagaggaaggacgtcatttgttgtaattagttgtgaagagagtggttggtatagggctaggaagaaagatttggtaagaacagatactagtagtagaaaatgtgggtgtccctttaagctgtgtgggaaaccagtggttggaggtcaatga

SEQ ID NO: 9565 - DNA, 312 bp, Glycine max
  Peptide Sequence Number=SeqID_126343
atgtttggcgaaggatcctatacggaagacagcatcaaaacaggtttccaagtcaccaatggctttgagctggataaaggcggacccacgatcagggctagggagggcccatcatgggactcccaattaagtgggggagaaaaaagggttgcgaatggagaattgcccttaaacaatcatgaaacacagctccaaactcgaaggtggaggacacatgaacgaaaacgcaattcatggggctccgaaaaagggttgagaatggaaaattgcactaagcaatcactacgcatggctccaaactcaaaggtgtag

SEQ ID NO: 9566 - DNA, 210 bp, Glycine max
  Peptide Sequence Number=SeqID_126344
atggtgaaacaacaggaagcgttgcttttgctgcttgatgtgggcccgtcaatgcatcccgctctttctgaaattgagaaagtctgctccatgcttgtgcagaagaagctgatctatagcaaatatgatgaagtgggaatagtcttatttggaactgaagtgttactacctattcagactgctgtgtcactggaaaaatcctgcttctaa

SEQ ID NO: 9567 - DNA, 264 bp, Glycine max
  Peptide Sequence Number=SeqID_126345
atgatcttaaatgatctgaagcatgcattctggccttttcaacatgatcacaccaaaactttattcttgagggcggcaactgctgctaactgtgttgacagatctgattttgttggagaaagtggctcacaaattgcattagctaaggctgctcaacataggctagatcgaggtgtttggaccagtgtgcgttttggggacatgaggcgatctttgtcggattcagatttggttcctctccctctagacgtcaagaaatattag

SEQ ID NO: 9568 - DNA, 612 bp, Glycine max
  Peptide Sequence Number=SeqID_126346
atgaaggaaaaaccgttccttgtttcgagccatgggtggaaaaggcagagagagagagtgagagacagagagagaagcttgttgaagaaggagcgttacttatattttgttcttcccccattgcattccctttttgtcagtgattgttcatcttcgcgcttggcaatcagaagctgtgaaaatgaggatgatttagatgatgtacctgttgttggccatgaggaagatgttggtggtagagagagagaggttggtgctggtgagcatgttggtgctggagagcagagagatgctggtgagcagagggatgctgatgctagtgagcagagagatggtgttgaagttgaagttgagacaaatggttatcattcagaggagcttaaaatccccattaatagtgatgatgaagataaggatgttgaagtttatcctcaatatagtcaaagtagtggagttggtgaacagaagttggaattagggatgaagtttggtactttggatgaatttaaatttgccttgagggagtatagcatattgatgggcaaggagttcaagtggaagacgaatgataaacagaggagtagagcaaaaatgcaagaaggcatcttgtga

SEQ ID NO: 9569 - DNA, 162 bp, Glycine max
  Peptide Sequence Number=SeqID_126347
atggggtcttttatcgtgggagcccgatcttcatatcttgggcaaaacaaattcgtgtgtcaaggtgttggtctcgggccaaacttccatattattccacaaggcacgcgcaacaatgatggtttggaaacaacgtgcaaaattggtcatggccacagccag

SEQ ID NO: 9570 - DNA, 309 bp, Glycine max
  Peptide Sequence Number=SeqID_126348
atggaaacaattttcctcagcaatttcaagagaatacgaagtgccaagaaggctgaaccccttccttcttcattcctccccctatttatagcaaaacagaggaggagcttgccacccagctcgcccaggcgagccaggttgcttcctccagaagcaaccgccttctggaggaagaatctggaaggcccaagatgcatgaacgacaatcaattcatggagctccgaataaaagtggagaatggagaattggcgaacaacactaggcaatcaattcgcggggctccagactcgttggtggaggatgcatga

SEQ ID NO: 9571 - DNA, 204 bp, Glycine max
  Peptide Sequence Number=SeqID_126349
atggaagtctcatgtagtggtttacgcatcatgactacctatggagtgtactattatcagcaatttttattctctctagctagtttaatacaagagacattgtctcgaaaagtacctgagacagagtcacgaaaggtggcaagttgtcaacatctcgataaggttgcaaagacagagagatacagtcgcgaagaagaagcttaa

SEQ ID NO: 9572 - DNA, 171 bp, Glycine max
  Peptide Sequence Number=SeqID_126350
atgcaaaacactttgtggtacccttgccttgttggttggtcgtggctgtgggaaatcagcgcccttggtttatctattgctggtgctgtcgctgtcgctgtcgctgtcggagataatatcatcgatcctgtcaaagacgaggtacttggtcctctgaatttttttctctga

SEQ ID NO: 9573 - DNA, 255 bp, Glycine max
  Peptide Sequence Number=SeqID_126351
atgcaatcacagggacttgcactgcctcctaagcctgaggttggtcctttagttactcgtgttagcacaaaggagagttgtgtttattcctcagggaatgatccagacacgggtgatcatgatgtcgatgatctcctatatttgatgacattgatcatcccacagctttttcttaagccgttgcatatgactgagacaagtatgcgagcgggaaatgtcgatgtgtatgaatttctcgagccacagtccatatag

SEQ ID NO: 9574 - DNA, 897 bp, Glycine max
  Peptide Sequence Number=SeqID_126352
gatgatggggaaattgaaggggatgtgaatcatcgcattcaagcaggatggatgaaatggagaaaagcatcgggggtgttatgtgatgcaaaggtaccggtcaagctaaagggaaagttttatcggactgcggtaagaccggtgattttgtacggaacagaatgttgggcggtcaagagccaacatgagaataaagtaggtgtagcggagatgaggatgtcgcggtggatgtgtggtaagactcgacaggataaaattagaaacgaagctattagagagagggttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagagaggttatcaaaaaggatctcgaaattaatggtttggatagaaatgctgacgatggcggtgtgggcgccgagggtggactcagtggcaatgtgaaggccgttaggaagcgtggtcatgcgcgtctcgggggaggagaggatgcgcgtgtggctagaaagggtaggtcgggggacccgtgcttcaggaaccgggggtcggggttctcgagctgccgaagcttgtacttcacagcctcggcgacgcggtcattgatcatggcggtggggggaagagggacgggaggtggagggagccacagtggcggcgaaggcagagagggattggagggaggagagggcggaggctcgccgatcgaagcggcgggcctcagagaggaggcggttgagggacatggcttggctccacacttgcagttgggtctagagtttcacggtggaagagaaattgcgaagtga

SEQ ID NO: 9575 - DNA, 498 bp, Glycine max
  Peptide Sequence Number=SeqID_126353
atggacgtagagataaagggtttaaaactgcaaatgggtatatttaccttacgacaaatcaaagcagcaacaaacaacttcaacaaagcaaacaaaattggagaaggagggtttggtcctgtgtacaaaggaaatttatcagatgggacaataatagcagtcaagcagctttcttccaaatcaaggcaagggaaccgcgagtttctaaacgagttaggcatgatttcagctttgcaacacccttgtcttgttaaactctatggcttttgtgtcgagggagatcagttattgttggtatatgaatatattgaaaacaatagccttgctcgagctttgtttggtccagcagaataccacataaaattggattggccaacaaggcaaaagatatgtgttggtattgctagaggcttgacataccttcatgaggaatcgagattaaaaattgtccatagagggacatcaaggccactaatgtgttgcttgataaaaatctaa

SEQ ID NO: 9576 - DNA, 104 bp, Glycine max
  Peptide Sequence Number=SeqID_126354
atggttgagaagcattgtagcagtccatctctgcctaggatccttcacaaaacacttgctctagaaattcttgcaatcccaactcagtccattgggtatttcag

SEQ ID NO: 9577 - DNA, 270 bp, Glycine max
  Peptide Sequence Number=SeqID_126355
atggctaaaaataaaaatattactacctgtcaacccatggaattgcaaaaagatgcatgtaactcgaatcctgtgtgccaggcatttgatcaagatgctaaggatgggcatgatttgctcattggtttgaactctggtgatgtctactcagtgtcattgagacagcaattacaagatgttggtaaagcctgtcggtgcttcatagtctattatagattatttattgttcatgttgtggtggctgccaataatgcagtcctttatgtgtga

SEQ ID NO: 9578 - DNA, 624 bp, Glycine max
  Peptide Sequence Number=SeqID_126356
atgcctagtgttgtcgatgaggaagattcccaaaagggttcttctgggctttggatgtggaacatggtaaaaggtatcagaattgctaaaattattagaggtctgcttggacagaaggatgcattggatgacatgcccttttgtggttgtgcttttggagctattgatggatgtctttatgttctagggtggcctgttaagcagacaggtaccaaattgagtgttgtagtgaatggtgaattatatgcttttgatccttcaaattatgtggatagtggaaggatcaaggtatatgatcaaggagaggatgaatggaaagttgttattggaaaagtccctgtatatgattttactgaatcggagtctccatatctactagctggtttccgtggaaagcttcatttcatcacaaaagatgccaatcatgatatttctgttctgcaggctgatcactgcagtaatgtggattcttcaccatcaacctcagcacctcaatcacccaaatacatggaagatgaattgttgcgagaatcagccgaaacaaatgaagttgtttggaaactagttgcatgtaagggttttgagcaggctgaactgatcaattgccaagttattgatatctag

SEQ ID NO: 9579 - DNA, 996 bp, Glycine max
  Peptide Sequence Number=SeqID_126357
atgagcatgttaggcctgcgagacctagttctcatagctccaaccccttcttcccttaaccaccaccaaggccaacccttttcagaaaaccacactaacactcacactcccaataacattcctttgccttcttcagcagcttctctcagtgttggctttggcattttccctctcctcactgcgacaccatgtgtgccacagtctcatcatcatcatcataacaatgaggttcaagagttgggtggtggtgccaatagtaacaccaccaccaactattggaacctcaagatgtgccaacaagaagtgaataatcctccaaagaagggtgtgatcaacgtggctgatcatgatgatgaaaagggtataatggagaatgaagaaaacggggtttatgggcctaactttagggtgtgccaagattgtggcaacagggctaagaaagattgcatctttagaagatgcaggacttgctgcaagggacgtgggtatgattgcaacactcacgtgaagagcacgtggatcccatcggttcgccgccgcgagcgcgagatcacggtggcttccggcggtggtggtaagaggccaagaggtatagtggggtcatctcaaaaggccactgtcacttctcatagttccaactctaatgctactacacctaggagcttagctacgagctcctttcaccaagatggtagcctgaagcagtcattactgggtcatgttcgagcaccagcagtgttcaagtgtcatagagtctctgccattgggaatggtgaagatgagtttgcatacttggccacggtccacattagtggccatgtgttcaaagggtttctctatgaccatggtgttgatgggaaaaccgcaaatgcagtagtgccttgtgtctcggaactgcaggtgggaaacaattgcagtgggaagaacagagaatgttcctctgccattgcaattggggttacaaacaacaatgcataccctgcttctgcgacttga

SEQ ID NO: 9580 - DNA, 300 bp, Glycine max
  Peptide Sequence Number=SeqID_126358
atggctaaaaatcatgagaacgcagctgcaagagcgaatcctattcatgcaaagaggaaatacacccgttggactgaagaggaacagatgccacaggccaggccatccatgcataactcttccatccagagtggtaatcatcagaatgtctccatcctccagcaacttcagacaacaatttgcattcagctgaagatgcgcctggttatagtcttaattcttaatttcttcctttcagctgaagatgatgtttcatcagtggctgcaaacatagagcattttccatttgtaagtgtgtaa

SEQ ID NO: 9581 - DNA, 747 bp, Glycine max
  Peptide Sequence Number=SeqID_126359
atggatagaaacattcttgactctctgttcttaaacatccactttcatggccccgacatgaaggaaggatcaatcccaacagctctaatctataggatccagtataaggtcatgaacactcgtgtgtctagagtcctattaaaacctcaaagaggagaaacaactttgtttattacagatttgacaaaggccaatgtttctcttccaagaacgataaaatgggatgaggtaactcttcctaaaaaatgggtcatggataaggccacatcgtctgttccccgacccactctaacaattgaacaaatcaaacaggataacttcggtaagataccacatctagcatacccagaacaacttacaaccaagaaaaggaggatgaccaaaagtcgatccaatccccaacttattcttctatggaaccttatgttgctatctgacaactttagcattgataaggaaacccttaggaaagacttttattctccggaggatgaacctcaaaggagatggtttttccaagactacaagggtacaaatagaaaacagatccaagacaagttctatgaatttgtcgaaagagtcaaaattaatgtccttttctttgattggttccatgcttataccatcaaaaaggatatagattacccatggaagcaagacatcataggtgatccaacaacaaatgttataacaaactggcaaatgaaggatgctgagttaatccaatcggaattacctgtaaattaa

SEQ ID NO: 9582 - DNA, 132 bp, Glycine max
  Peptide Sequence Number=SeqID_126360
atggattcagtcgatcctctgactttaacccccagggaagagattattcctacacttaatgacatcacctgtataagtgccaagtggaaccgcttgtatgagatcatggcgagatctctaaagcactcttga

SEQ ID NO: 9583 - DNA, 219 bp, Glycine max
  Peptide Sequence Number=SeqID_126361
atgggttgtgacgaatggcaaaaccctcaccgccaccatgacccccacctcgccaccaccaaacgtccaaatctagtctcatatggccaaaaccattttgaggatctgcaacgtcctcatttcgcctccttgatggtgggatttagtgagggtgatgacttgtggtggtggtcactacgatggtgcaaggaggaaaaggaagaagaatgtggagtttag

SEQ ID NO: 9584 - DNA, 793 bp, Glycine max
  Peptide Sequence Number=SeqID_126362
aggactacacgtcctcgctttcagagggctacacgccctcgccttcagaggactacacgtccttgccatcagaggggtgcacgccctcaccttcataggactacatgtcctttccttcagagggctacacgtccttagcttcagagggttggacgccctaaccttcaaaagactgcacgccctcgccttcagaggagtacatgtcctcgccttcagaggagtacacgcccttgccttcagaggactacacgtcctcaccttcagagaactacacgttctcgccttcagaggactacatgtcctcatctttagaggactacacgttctcatttttatagggctacaagccctcgccttcagagggctacacctcctcgccttgagagggctacacacctttgccgtcagagggctacacgccctcacctttagaggactgcttgccctcaccttcagaggacttcacgtcctcgccttcagaggactgcacgccctcacctttagaggactacacgtcctcgccttcagagggctgcacgccctcaccttcagaggacttcatgtcctcgccatcggagggctgcacgccctcaccttcagaggactacacatcctcaccttcagaggactacatatcctcacctttagaggactgcacgttcttaccttcagaggacttcacgtcctcactatcagaggattgcatgtcttcgcctttagagggctacacgtcctcaccttcagagggttgcacgccctcgccattagaagggtagcacaccctcacctttga

SEQ ID NO: 9585 - DNA, 451 bp, Glycine max
  Peptide Sequence Number=SeqID_126363
atggaggccatgaaagagcaaatggccacaatgatggaggccatgatgagcatgaataagataatggaagccaatgcagttgcagttgccgctaccagtgctgttgttgaggaggacctgactcacccatctggcatcaaccaaatgaatcatccaacctcagatatggtaggcaaagatttgagaagtacgggcggcccccatgatgtgcaaattcgaaacgagcacgccttcccgtcgtatggcttgcctcccaacttacaccacccaatgtggcatacactcccaataagaatgtcaataactcctcttctatactcattgagagccaacaacctcaatttgatcatgaacatatttctcaacccatgggggagacacatgaaatgccccaatctagtggactttgagccttgcctcagatatgccactgaagggcaagcagttggtg

SEQ ID NO: 9586 - DNA, 234 bp, Glycine max
  Peptide Sequence Number=SeqID_126364
gttacaggttgtaccatttatggtgaggctcatgaaacaggccaatgtattcccattgaagaaaacactcaagaagttcactttatgggaaatcaacagagacaaggatatactcaaggaggattttcaggcttccagcagggtccttataatcaacaaggacaatggaggtcacactctggcaatcaattcaacaaagaccaaggtggaccttcgaacatgccaatccaataa

SEQ ID NO: 9587 - DNA, 405 bp, Glycine max
  Peptide Sequence Number=SeqID_126365
atgatgcacgtggacggctctaccaaccaacatgggagtggaactggggttatcttggaaggacctaacggcgtggccatgacacaatcgttacgattcgacttcaaagccatatgcaatcaggccgagtacaaagctctcctcgcaggactaagactcaccaaagatgaagtacaagtgactcatataagccgggaggtcaacgagaaggctgaccaaaaactcaatgagttcttgagtggcctcgatatcaagcatagggtgatgtcggtggagcaccctcagacgaatggacaagccaaggcatctaacaaggtaattctgggtgagttgaagaaacgggtggatggagccaagggaagatgggtcgaagagctcgcaaaggtcctttgggcatataggtga

SEQ ID NO: 9588 - DNA, 132 bp, Glycine max
  Peptide Sequence Number=SeqID_126366
atgagctgtcagcgcaccgcttcagctcattcgctaagcgagagaagtgcgctaagccataatccacttatgcgtgctaagcgatccagatttgcgctaagcgagcgagcacagaccaacccaactatttaa

SEQ ID NO: 9589 - DNA, 444 bp, Glycine max
  Peptide Sequence Number=SeqID_126367
atgaccggcagactgcttgccgggtcattgacatttgattgtcgcatcatgcactatatcattgttagaattttgatgctccgttcttctaatctcgctcaagcctttgaggaggacatgattctgatgtgggctttcttgaccaattgtccaatcgactgggcccatttgattcgttaccgcatgcataaggcattgcggtctagtgcacctctaccttactctcaacttgtgactttgtttcttcgactttttgaaattcctttggattctgagccttttgtgcaagttaaacgttcctttgctattggtgtcgatgcggtaacttcctttggctactatgccattgatgcttgctttgaaggaatggatacccgcatcactcagcttgaagaggatgtgagttatcttcgtcggtgcttcgaccttccaccaccttcctag

SEQ ID NO: 9590 - DNA, 675 bp, Glycine max
  Peptide Sequence Number=SeqID_126368
atgcatagcccaaccaacatccaagaagtccacaagctaaacggtaggctagcttccctatccaggttccttctaaagccattttacgaattgcttaagaaaactaaacgtatcctatgggacaagacttgtgaacaagccttcctggcttttaagaggaccatagccacattgccaattttgagtcgacctaggccaggagcacccctactcttatatctctcaataattgacgaagtcgtgacactagcactcatcacctcggctcaacaacttaagccctacttccagagtcatcaagtggtagacaagatgaactacctcatcaagcaggttttaggaaaggctaaacttgcaagaagaatgaattcgctggaaatgacacaacctccccagactggtggacccttttatgttgatgatgcatccaacgtaaaaggaagcagggcaaggatcatacacgaaggccctgacaatatcactctagagcaagcccttgagctcaacttcagagcctcaaacaaccaggaaagcaatactcgagcaaacttgctctccaagctggccaactccaagaaggtcgggcactttaagaacatcatccaggagacgctccaaactcctaccatagatgttgaggaaattatggctagagaagaggaggaaccaaactag

SEQ ID NO: 9591 - DNA, 189 bp, Glycine max
  Peptide Sequence Number=SeqID_126369
atgactttctctgttgggtttgcatacctaaagggtgtgcatgtgaacaatcttgtatgggcattggaacgacagagacctagcccttatgaatgcactgaaaattgtgtttccagagtgtacaaacttgttgtgcaggtttcacatagacaagaatgtgaaggcaaagtgcaaattgttaattggtaa

SEQ ID NO: 9592 - DNA, 198 bp, Glycine max
  Peptide Sequence Number=SeqID_126370
atggcggaaccatcgaagaagcggaaaggcacttcaagtcaaatcaaagctttctattctaatctagaaatccatgaaggtaccctaatgtctgaggtttatgggattaagatggtcattgaccaatccctattttatgatttaacaaaattgcctagtgaaggtgtgccttttgagggtgcactgattgatgattag

SEQ ID NO: 9593 - DNA, 243 bp, Glycine max
  Peptide Sequence Number=SeqID_126371
atgtatgatagcacggaattcccttttgaatgcaagaaatggccccaaggaagcttgcctcaaagagatccaggaaggataaagcggctgaaggaaccagttccgctcccgaatatgacagccaccgttttaggagcgctgagcaccagcagcgcttcgaggccatcaagggatggtcatttctccgggagcgacgcgtccagctcagggacgacgagtataccgacttccaggaggagatag

SEQ ID NO: 9594 - DNA, 261 bp, Glycine max
  Peptide Sequence Number=SeqID_126372
atgggtgccaaatacctcgaagtggtcaaacgagggtcgcatcccaacaacggatggtctccggacgaaattaggacgcagaatgaccataatttgtctctgcgttttgttggacacgatcgagcctgggcggcgagacacagaatgaccataatttgtctcaacatgccaccggacacgatcgcttctggatggcggaaaggtgtgcggaatgaccataatttgtcttcgcccacctctcaacttgctggtcttgaatga

SEQ ID NO: 9595 - DNA, 480 bp, Glycine max
  Peptide Sequence Number=SeqID_126373
gatggtgtggatgacattgtctgtgagaaatacggcataagcaaggaaaaatgggcccaattttgccagactcgtagagacccttcttgggaggatgtgaggaaaaaagcacaggccatccagaaacagaacattgccccccacattttgtctcgtgggggttatgaatatttggagcaaaagctcctggttgagaagaccaagaagaagctggaggtagctgcacagtcaggaagcgttgatggcatcatcgaccctccatcccccgttagacgccacatgaagtggaagatggtccgtaccaagaaaacaggggagatgatgactgaggccgcaaaggaaatcgctgagaagatcgtatgtcattttcaactaaccattagaattatatttctttattttgtgaatgccatgcgtcacagggatcctttgtcccccatggacgtcaggatgttctcaccgctgctattggacgtctag

SEQ ID NO: 9596 - DNA, 171 bp, Glycine max
  Peptide Sequence Number=SeqID_126374
atggcagctcatgcaaattcaactgcaacaaacagttcacagtgtgatgaagaggttaggaaggtgcttttgggtaaagttgttctgcctgtttgtttgggtggaaatgagccgagcagcttgtcgagggcctttggctcggcctatgtaaggctcggctcggcttgttaa

SEQ ID NO: 9597 - DNA, 315 bp, Glycine max
  Peptide Sequence Number=SeqID_126375
atgatgcacctcaatgggagagaagtaaaaaaaaatcagaaaaacaaagaactcgagaatattacgcaaggtgatccacctaaacagaagagaagtcaaggaaatgagaaaaagatagaagacgacaatataactcaagtgaatgtcactctagaagcatttgagaaacatgctttaagggaagggaatggaaggtggaaaagaaacatctgggttcattgtgaagatgaagacaaagttccactctggaagacacctcaaataaaatattacacgcaccaggcaaatgtggctaacggaatgactctgcaatga

SEQ ID NO: 9598 - DNA, 210 bp, Glycine max
  Peptide Sequence Number=SeqID_126376
atggtgcagaatgaccataatctatctctgcgtgccatcggactcgatcgtctctggatggcgaaaagaatgaccaaaatttgtctctgcgtgccatcggattcgatcatctctggatggcgaaaaggtgtgcggatgaccataatttgtctccgcatgtcacatgacctcggggtcagtatgaccgagattgtggggcggccgacaaaa

SEQ ID NO: 9599 - DNA, 594 bp, Glycine max
  Peptide Sequence Number=SeqID_126377
atggtgagaatagccaaggtagtcaaaatctcggtgcaagaattggaccgagtaaaacaaaatagaaatggggtggtcggaataccgaggaagcacttggaggagaaagcgaaggctttggcggatcaagcgatcaacgtcttccttgcttatcaccatagcaaagaaagtccagtcgttgctgttttggccgatgcctatgacacatttgatcgaagatgcgagaagagcgacacaaggattgtctattgcacacccgctctttatgtgtggctggtcttgcacctctttcgtcatgaaagtagacccatctgtcccctgcaaggtcatcacatgtgccccgagaaagggaaggcagtttgggaacaactcttgactagtatggtaggggcatccgtcaattggttcccccgatggaaggaaggaagagccagagttttgttctcatgtgaggggttctcaaacgtccccttgataggaacgaggggttgtatcaattataatcccgtccttgccataagacaacttggctaccctatgagaggagcgccatcggatgaaagtatcacacccttcatcaccacagggttttag

SEQ ID NO: 9600 - DNA, 363 bp, Glycine max
  Peptide Sequence Number=SeqID_126378
atggatgagttcgatgcgcaggtggcctggccaggagtccaaccttccccttctagagggggtggggcctccgcagcccaggagcttgagccagaggagccagcagcagcaacaacagagggggaggatgagctcacccctcctgagcccttttattttgatacaggtgtacacatggctcaggaggaggagacttccacagaccaaatcctagagccatccccaacacccatacctgatgatgctataccatctgcaccagcatctgagttagagcagcctatctctcaggattcaccagctgctcaggtgttggatcttaatgagcatgcacaggagcaaccacaggagcaggacatttaa

SEQ ID NO: 9601 - DNA, 180 bp, Glycine max
  Peptide Sequence Number=SeqID_126379
atgccctcctttcgcgatttggagcagaaatgggcaccaaaggttgaagctttgttgggaaacaatggtggaggaagaaaagaagaagaaggctgcctatgccacatgtctccatttgagtggagcaaaaagggtccactttcccttttgattgcgacccatactcagccacaaaagtga

SEQ ID NO: 9602 - DNA, 551 bp, Glycine max
  Peptide Sequence Number=SeqID_126380
ctcctcccacatatgctactcctacaccagctcctccaggcccatctgcccaggactctcagtgctttgagtccatgcttctgagtctttatcagagacaaatattgttaatgcaaagcctgcaggtagtctggccaggaactcagccttctcttgtgagggaaggtggaggttctggtgctcaggtacctcagcaggtacaagatgcatctttagaggccaccatccttgtgccatttgtttttaaggtaggagggacacaggtaaggcaggaggctgctactccagagaggtcaccacagatttcaccagatccaccctcaccaatgatggatcaatcttctcctcaacagttagcagattctcctacaacagtgcatgagatgccagcagacctttctactccattactagagattccagaggaccctgccacaccagtcctgggactgactaccactcctccagccactcctgtgctacattttacagatgaggaggccactcaggatcaagatacccaacaggatgaccagtcacaagagttttaa

SEQ ID NO: 9603 - DNA, 441 bp, Glycine max
  Peptide Sequence Number=SeqID_126381
atgagcgagatagaggaagttcaggagcagatgaaggctgacatggaggccatgaaagaccaaatgaccaccatgatggaggccacgatgagcatgaggaaaatgatggaggtcaatgcagctgtagttgccaccacaagtgtcgccactgagagcaagcatcatttcccgtcgtatagcctacctcccaactatgcaccacccaatgctgtacatgtgctcgaggagaatgtcgaccactccactcccataccccttcagagccaacaacctcagtttgggcacacacatgttgctcaacccataggggagacgcatgaggtacccctaaaccatgctttggccgattttgagccttaccctgggtatgccactgaggggcaagcatttggtggtataccccagctaatcactttggggggccgtcggtatcacccataa

SEQ ID NO: 9604 - DNA, 141 bp, Glycine max
  Peptide Sequence Number=SeqID_126382
atgggtgccaagcacctcacgaggaccaaagaatggtcgcacgtcatcgagcaaaggtccccggacgaaattaggggaaagaatgcaatgagcaatgcaaccaatgaacaacatggatgtatgcgaatgatgcataattga

SEQ ID NO: 9605 - DNA, 213 bp, Glycine max
  Peptide Sequence Number=SeqID_126383
atggggagaaaagagggaggtggttgccggttacttccaccagaaggcaccgccttctgtcggaaccccatggaagaatgttgtggaactttaccgattgtgcaacaatgcttcctttcgatttctggaatgttgcggaacttcacggattacctaacaatgggtgttaagtacctcgaggtggtcaagcgaagcttacatgccaccaaataa

SEQ ID NO: 9606 - DNA, 348 bp, Glycine max
  Peptide Sequence Number=SeqID_126384
atggagagggagatgataacaacgatagtaggcacattaccagtgttctactatgagaagttggtgggttacacaccttcaagctttgccgatttagttttcaccagtgaaaggatcgaagtgggcctgagaagaggcaaatttgattatcctgctttgatggatagaaagtctggggcaaatggagagaatgagaaggagggagaaacccatgcagtgattgtcattcctatatggccaaatttctaccaactcaacaatatcaatactcaaccaatatcagcccttctcatcacccaccatcctatcagccaagaacacccaatcatccacaaaggtgacccctaa

SEQ ID NO: 9607 - DNA, 513 bp, Glycine max
  Peptide Sequence Number=SeqID_126385
atgatgttttgcagtgggcttgatcagttgctcctgaaaacggatttattgccaatcattatgaggtctgacacacagattggtagtagaggaaggagttcatttgtgttaattggttgtgaaatgagtggtcagtataggtgtaggaagaaagattttgttagaagagatattgggagtaggaaatgtgggtgtcccttcaagctttgtgggaaaccagtggttggagggcaaggttggatggtgaagttgatgtgtgggattcataatcatgaattggccaagtcattagttgaacattcatatgctggacgattgactaaggatgagaaaacaattattgctgatatgaccaagtcaatggtgaaaccaagaaacattatgctaacgttgaaggagcacaatgtcaatagttttacaacaatcaaacaaatatacaatgcaagaagtgcatatcgttcttccattagaggaagtgatactgaaatgcaacatctaatgaaaacttcttga

SEQ ID NO: 9608 - DNA, 417 bp, Glycine max
  Peptide Sequence Number=SeqID_126386
atgttggaagagaagtttgttactattattgatgctagtagcaatgaagagaaagttcattataaaacttgggcaagatctgatagactcagcctaatgttgatgagaatgactgttgcagacaatattaagacaactctctctaaaatcgaaagtgctaaaaggtttataggattagtgggagagtattctcaaacagctgataagtctgttgttgggacattaatgagtacattgaccaccatgaaatttgatggttcacatactatgtatgaacatgtcattgagatgacaaacattacaggaatcaaggagcttgaaaagaaatttatgaagaagcatgataaaggcaaagggtcattaaagaacaatgacgattctttgcaaatccagaagaaaggtgtcaaagggaaataa

SEQ ID NO: 9609 - DNA, 906 bp, Glycine max
  Peptide Sequence Number=SeqID_126387
atgaggattgatcctcaagagtttgctgcccgtctctgcatccctggtaggggttttgttctaaatgcagagggctatccttggaagcttctgaggaaagatctcaccactcttgcgcagacatggagtgtcctctccaacagcaacatgactcccacttcccacacctctgaccttaatatggacacagccgggttggtttacggcttagtcaaaggcatggacatgaatatcggagccctaatctcaggtcagatttctaccattgcccagagtaactcctctaggctcggatttccagccttgatcactgccttatgcagagctagaggagttacctctgacagtctgacctatgagagcctgagcctagccattaacttggcctacattaagaaaaactattcgaatgtggatgatctaacagttaactttagaggggccaggaagagcctacaggtggtagctcctccagggtccattctgtcagtagaacagttcattaagaaagtatcctggcctggacccgtaccttctgctgtaagagagggtgagggccccagtgctcaggtacctcaacagccagttgtgctagttatacatgagactgctgaagcaagtgagtcacaattgagacaggaggctgctactcctgagaggacaccacagaccccagaagatccaccctcaccaggggtggagctatcttttgctcagcaggtagcagatcctcctgcaccagtacatgagagactatctgacccctctacacccatcatagagatgccagaagaccttaccacgccagtcctgagactgtcatccactcctctagctaccccagttttacatctgacagatgaggaggatatgcaggaccaggacacacagggcacacaggactag

SEQ ID NO: 9610 - DNA, 870 bp, Glycine max
  Peptide Sequence Number=SeqID_126388
atgaaggtgttagaccaagcttttgtggagagggacgtgactgttaatcaattggacagtatagtaggaaacattactgcctgcaataatttaagttttagtgatgaagagcttcctgaggaggggaggaaccacaatctggcgttacatatatcggtgaactgcaagtctgatgctctgtcgaatgtacttgtggacactggttcctcattgaatgtaatggccaaatccacattagatcaactcttctaccaggggcctcccatgagaagaagtggggtggttgtcaaagcgtttgatggatcaagaaagtctgttatcggggaggttgatttgcccattacaattgggccgtttgttttccaaattacattccaggtgatggatatccaagccgcatacagttgccttttgggtaggccgtggatccatgaagctggggccgtgacatccaccttgcatcaaaagctgaagtttgtcagaaatgggagattgatcactgtgagtggagaggaagccttgttggttagtcatttgtcagctttttcctttatcggtgctgatgaaacagaaggaacctctttccaaggcctgactgtagagggtaaaaagccagagaagagtgaagtgtcttttgctacttggaagagcgcacagaaagtggtgcaggaaggaacaggtgtaggatggggaaaagttgtgcagttgctagagagtaaaaaccgtgaaggactgggatttgcttcttttgcaggatcctcaaagaacaatgttggatcaagttccattactagcaccttttgtagcgccggttcatcaacgactcgccagaagccaatgctgtcttggaagatgttcctgaagagatag

SEQ ID NO: 9611 - DNA, 192 bp, Glycine max
  Peptide Sequence Number=SeqID_126389
atggctgatgctcttgccactttatcgtccatgttcaaaataagcccccacggagatttgtcatgcatagaaatcgaatgtcacattaagcatgcacattgttgtttgatagaagaagaggaggatgcgagagtcaaactcgctaagtgcaccgcttgcacctccaggctgagcgaagaagaggcgcactaa

SEQ ID NO: 9612 - DNA, 141 bp, Glycine max
  Peptide Sequence Number=SeqID_126390
atggcatcaaggtcggaccaagggtcgggcctccaccgatctactgataagatcatgatcggaggggacgaccggagaaagataagtcaaggaggacccgaagaggaaggaagagcggtcgctgagagcgaaatgaactga

SEQ ID NO: 9613 - DNA, 255 bp, Glycine max
  misc_feature (9)..(9): n is a, c, g, or t
  Peptide Sequence Number=SeqID_126391
atgcttacnttggatgatagcaaaatttttcctgtaattatatttgcctcccttgctgatgagcaagaggagaagttgttatcagttctcaagaagcataagaaggctataggctggaccctggcagacattcctggtattagcccatccacattgaagaaggaggtaaccaagcttttgcaagctggaatcatttatcctatctccgacagccaatgggtgagtcccgtccaggattttataggcgctttataa

SEQ ID NO: 9614 - DNA, 141 bp, Glycine max
  Peptide Sequence Number=SeqID_126392
atgcccagggcacagaattacatagcacactacagtgcctatttcttgaaaagagctctggaggcagcaagagaagcagcttttgtagagatacctaggttttacctagtcttacaagaaggatctgcagacgaagcttag

SEQ ID NO: 9615 - DNA, 132 bp, Glycine max
  Peptide Sequence Number=SeqID_126393
atgaggtgcgcatgcaatgctaagcgcaacttcagcgcgcttagcacgacagaagaatctggcagagcatcaatattaaggccgcgcgctaagcgcgacgtttgtctcttgccaagctcagcacacgaatga

SEQ ID NO: 9616 - DNA, 233 bp, Glycine max
  Peptide Sequence Number=SeqID_126394
gtcggcatccagaaacccatggcgtaagcgctgagcagaatcgagaagtcgatgccgccgagcatcaccacgcgaatattcagcagaccatcgcgcaggctgtgtttcagccctttggcgtcaccttcgtcgcgcgccagttcgcgcagcaccgcctgcttctcactgctgctgagccagctggcgctctcgacgctgttcggcagcagccagaacgtcagcacacccagtaa

SEQ ID NO: 9617 - DNA, 1199 bp, Glycine max
  Peptide Sequence Number=SeqID_126395
atgccatcgctgccggcggtggcaaaagtggaggcgcagaccggcaagccggtaattacggccgccattgccactacgtacgctctgctgaaggcgctggagctggagccggtggtgccgggcgcgggcgcactgctgtccggtgcgtgggctacaccacgccgggcgccgcgctatttgccccgggcgtggtagaggcagtggccgctgcacagggcctgctggcggcggcgcgccagtgcgcgattccggtgatccatacgcagattcgctaccacccgcagcatcagcaggacggcgggatctgggtgcagaaagctccggtgatgcgtgacatggtggaaggcaatccgctggctgagttttgtccggcggtgcagccgcttgccgcagaagtggtgatcaccaaacagtatgccagcgcgttttttggcacgtctctggcatcgatgctgatggcgcagggcattgatacgctgctgatcgccggctgctccaccagcggctgcatccgcgccagcgcagtggatgcgttgcaatacggttttcgcgccatggtggtgcgtgaatgcgtgggcgatcgccatgatgcgccgcatcaggccaatttgtttgatatcgacagtaaatatggcgacgtgtccgtttcggctgcggctgagacgcataacaacatctccccgacgacggggttattgcgcccggagaacaccatgactgacgtttcaacccgtcctgctgcgctggcagccgaagacaccgcttcgatttatcgcaaaatcacctggaagctgattccgtttctctgcctgtgttatctcgcggcctatcttgatcgcatcaatatcggcctggctaaactacagatggcgagcgatctggcgctgagcgagaccgctgccgagcaacctgatcctgcagcgggtcggcgcaaagatctggatcgcgcgcattatgattacctggggcctgctctcgaccgccacgctgctggtgcaaacgccgacccagttctacatcatccgctttttcctcggcgcggccgaagccggttttctgcctggcgtgctgttctatctcaccaaatggtttccctcgtggcgccgcagccgcatcattgcgctgtttatgattggcctgccgctctccagcctgattggcggaccgctttccggctggatcatggggcattttcatga

SEQ ID NO: 9618 - DNA, 153 bp, Glycine max
  Peptide Sequence Number=SeqID_126396
atggcagataaatcaacccttgacgcaaaagcgcttagcaaactcaaatgcaccacagtcaacttgcgcatccgcgatgacaacatcattaccgagcacatggattgggacacatcaactaaagtggcttttgaacgagacctaccggcttag

SEQ ID NO: 9619 - DNA, 369 bp, Glycine max
  Peptide Sequence Number=SeqID_126397
atggagaagaaagaaagcacggaagaaacctcgtgtagcaaacaaaaaatggaaaacctcaccaaggggaaaactcaacggcaagtgaagctggaagaaacggaccacaaaaatgaagaaaaaaagcaaacgggagaaggtgaggaaatggcgaaacacagttcagaggaaacaacgggagaaggctggagaaggaggcatgtggagcaaccaaagcttgaagcgggttgtggctggttgtgttcgaattggaagagaagagaagaaaatagaagaagaaagaaaggaagaggcacgagagaaatagagagagaaatggaattaggcatagaagaaatggacagttgtagggtcacgtgtcaatcttaa

SEQ ID NO: 9620 - DNA, 912 bp, Glycine max
  Peptide Sequence Number=SeqID_126398
atggcggaaattccttcagcactcggcaacattaccgtgatcaacggctatttcccgcagggagagagccgtgaccatgagaccaaattcccggccaaagcgaagttttatcaggatctgcaggattacctgaccaccgaactgaaaaaagagaatccggtgctgatcatgggcgacatgaatatcagcccgacggatctggatatcggtattggcgaagagaaccgcaagcgctggttgcgtaccggcaaatgctctttcctgccggaagagcgtgagtggatggagcgcctgctgggctggggcctggtggataccttccgcaatgccaacccggaaacgcaggaccgcttctcctggttcgactatcgctcaaaaggttttgacgacaaccgtggcctgcgcatcgatcttctgttggccagtgcgccgctggcagaacgctgcatcgaaaccgggatcgactacgatatccgcagcatggaaaagccgtccgatcatgcgccagtgtgggcgaccttcaagctcgccatgatcttttttgcgctctacgtgctggtttccgccctgtcgataccgggtgcagcgatactgaccctgctgggtgggacgctgtttcccctgggtgaaggcatcgtgctggtctcgtttgcctcgacgctcggggcaacgcttgcgatgctcgccagccgttatctgctgggtgagtgggtccagcagcgatttgctcagcagatgaaaacggttaacgctggcatgacgcatgacggcgcgggctatctttttgccctgcgcctgatgccgctgtttccgttttttctggtgaatttgctgatggggctgacccgcatgggggtattccgctactggtgggtgagccagtgcgatgctgcccgcgacgtgtctttctga

SEQ ID NO: 9621 - DNA, 609 bp, Glycine max
  Peptide Sequence Number=SeqID_126399
atgattgagttgcgaaaacttctggataggtatcctacatctgaactgaattctttctggttaaagaatctctttctagttgctctggaacaattaggagattctctagaagaaatacggagttttgcttttggtggcaacatgctatggggtggtggtcccacttatggggtcaaatcaatacgttctaagaagaaatatttgaatctcatcgatctcataagtattataccaaatcccatcaatcgaatcgctttttcgagaaatacgagacatctaagtcatccaaaaagacgtatattccttgctaattatcagacaattacttattcacaaaccttgcggggggctaatagttttcatttcccatctcatggaaaacccttttcgctccgcttagccctacctccccctagtaggggtatttcagtgataggttctataggaactggacgatcctatttggtcaaatacctagcgacaaactcctatgttcctttcattacagtatttctgaacaagttcctggataacaagcctaagggtttacttattgatgatagtgacgatattgatgatagttacgatagtgacgatatcgaccggtga

SEQ ID NO: 9622 - DNA, 228 bp, Glycine max
  Peptide Sequence Number=SeqID_126400
atgagaatagcgtggaagacgaaatggatgctggaattggagtatcttgagacccaaagctctgttggcttctactcaaagaaccctttcgcttcttcgatggttcttccatttgagggagtttttggaagttttgatcggtggaaaagaaagagaatgaaaaatgatgaattttgggctttgtggggcttgatttggacaataattgagggagaaatcgcgttttga

SEQ ID NO: 9623 - DNA, 330 bp, Glycine max
  Peptide Sequence Number=SeqID_126401
atggatcaagctggtgaggaaaaaaatttgcacctgagtaatttagatgagatacgcctaaaagcgaatgagaatttcatgttctacaaaaaaaagcccaagaagttccatgataccatgataattaagaaggatttcagggtggggcaaaaagtgtttttgtatatttttaggctgggattcatgagtgtggagataaaaagggactccaaaaacaagagcttcaaggtcaagggacaccgacttaaccctttcctcccaaccccttttttggtggaggtagtggtggaagagacttccttactcccccctattcttcctcccccatga

SEQ ID NO: 9624 - DNA, 272 bp, Glycine max
  Peptide Sequence Number=SeqID_126402
gctacgttgaggaagtggatgatggacagagatacactgggcgcgagatactcacaagcctcactttgctacttctgacggactctgagactatgctttttgagttggaagatgagggatcggcgtacaatgtatctgagcagagggctcacccttgcaaccaccattttagtgggaggtcatggagcatctacagaggatgttcacttgaatcagtagctaccactacagctacacgatggaggaagaggcacaccttcatgctcacttag

SEQ ID NO: 9625 - DNA, 1053 bp, Glycine max
  Peptide Sequence Number=SeqID_126403
atgacaacgaagtttaactacgtggtgtgccctattgaagaacccaacaacatggataccatgacaatagacgaactacaaagtagtctattggttcacgagcagagaatgatgtctccagcagaagaggagcagaagaaagcaaattatgctgagatggaagataaagaggaacaagaggatgagatcttgttaatgaccttcgtagactacaaagaagggaagaaggatgagtggtttctaaactcaggatgcagcaaccacatgagtagtaacaaggagaggttctcagaattagatgagaactttcggcacaaagtaaggcttggtaatgatactcacatagttgtgaaggggaaaggtagtgttcagatggttgtgaatgggattatacatgtaatcacacatgtatattatgttcctgaactcaagaagtgcaatgttgttcatcctaagagaggcctgatcatggaagtaaacatgagtggaaacataatgtttgtgccgacagcaactatgggagcggaaactacaacatgtcttcaggtggatttagaggataattctcaactatggcataatcggctaggacatttaagctatgatggattaaaaactcttctctctaaacaaatggtgaaaaggttgtcttctatcacaactcccagaaatatttgtgcacattgtctagcagggaagcaacaccgaaatgcaatgccaaagaaaattctatggagagcatcaaagaagctacagtttgttcatgctgacatatgcgggcctattcagccaacattaagcagtaacaagagatatatcctgagttttattgatgatttatcacgtaaaacttgggtatattttttgagtgagaaatcaaaaactctttctttctttaaaagtttcaaagcactggttgaaaaaaaggttggagaaagcattatctgcttacgaacagataggggaggagaatttacttccaaggtgtttgaagaattttgtagaaaccaaggcataaggagacaattgatctctacctacactccccagtag

SEQ ID NO: 9626 - DNA, 216 bp, Glycine max
  Peptide Sequence Number=SeqID_126404
atggtggaggtaactgagggcgccaacttggacgagtttggggacgaggtggccggagacgtgaagggcgacgagagactcgaggccgccgacggagtcgccgccgatgaagacggcggggatggggttgcggtggttgttgtcgggaaaggggagggcggcgatctcgtggtcgtccaattcgatgacggtggggttgacgccgatggtggctag

SEQ ID NO: 9627 - DNA, 189 bp, Glycine max
  Peptide Sequence Number=SeqID_126405
atggcccaagtggggacaacaaaattttatttaaccaatggcaagagagagaagttcatcagcgcgagtgggggaaaggtagcaaggagagtggtagtggggttgaggccagaaaggaaagaaagaaacactagtactacacaacacaacacaagcatagtgatcttaaaaaaatttgagtaccattaa

SEQ ID NO: 9628 - DNA, 480 bp, Glycine max
  Peptide Sequence Number=SeqID_126406
atggagaggggtgatgttgttgacagtgggtggggaccaaaagtacaatttagccttgcaaatatcatcatggagatcaatgcatccccccacagcattaattcagtcaagtataggaatattccaaggcaagtttggcttcataaaagtgggaagtggttgatgcagtggccaaatgaagaggtagaaaaactacgtgacaaacaagttagcataatgagagagaaattggttggtgaatcaactattgaagtctctggtatccctgcatcacaaatgaaccgctcaataattgaaagtcttcgggagaaagggagaatttgtattactagtagagtttatccctcgtttgttattgacaaagatgcccatctttatgttttctacaatggaagccagagtgtggtgatctctgaactgaatgcttggagcatgaagcaagcaaaatttggccaggaagaaagcatagttaagctgtaa

SEQ ID NO: 9629 - DNA, 390 bp, Glycine max
  Peptide Sequence Number=SeqID_126407
atggattcgagcgacagtgatcgcggttactccaagcgcgagagggaggatgaggattgggagtttagtgataagcagaaggataggtctaggaagttcggtgccaatggcaaggatgacggcgagggtttcgatggaggcgcgaaaaggaagcgttctagcagaaccaccacagatggcgacgattatgattcgcgctctaagcatggggcctcaatccatggatacaaaaagccacctcatggagaagaccaagatctaaaaatagaaaaaggggggaacgaaacagaacaaatcttggcacaaacaggagtgagctgtttcctccaacttgcagttgcatataacatggagttcgaaacaagcaaggacagagtatctggagtttga

SEQ ID NO: 9630 - DNA, 186 bp, Glycine max
  Peptide Sequence Number=SeqID_126408
atgggtgccaagtaccttgaagtggtcaaacgagggtcgcatcccaacaacggatggtccccggacaaaattagggacgcagaatttgtctctgcgcgtttatcacccaactcgcgaaatctgaatgacaaagggcgcataatttgtctctgcgcgtttatcactcgcctcgctgttcctgaatga

SEQ ID NO: 9631 - DNA, 552 bp, Glycine max
  Peptide Sequence Number=SeqID_126409
atgaaaggaatatcctatcgagggaatcatatttgcttcggaagatatgctcttcaagcacttgagccagcttggataacatctagacaaatagaagcgggacggcgggcaatgtcacgaaatgttcgccgaggtggacaaatatgggtacgcatatttccagacaaaccggttacagtaagacctactgaaacacgtatgggttcaggaaaagctgataatagcggagcacgcgaactgatgtgtattcgaatcctaggagctagtaatcgacgatatgcttatattggtgacattgttgttgctgtaatcaaacaagcagtaccaaatacgaacttagaaagatcagaagtgatcagagctgtaattgtacgtacttgtaaagaactcaaacgtagcaacggtataataattcagtatgatgataatgctgcagttgtcattgatcaagaaggaaatccaaaaggaactcgaatcttttgtgcaatcgcccgggaattgagacagttaaatttcactaaaatagtttcatttgctcccgaggtattataa

SEQ ID NO: 9632 - DNA, 1071 bp, Glycine max
  Peptide Sequence Number=SeqID_126410
ctgtgcgatgagctgcggcaatacctgctgaacagcgtcagtcgctccagcggccactttgcctccgggctgggtaccgtcgaactgacggtggcgttgcatttcgtctacaacacgccgttcgatcatctggtgtgggacgtcggccaccaggcctacccgcacaaaattctgaccggccgccgcgaccgtatcgccaccattcggcaaaagaacggcctgcaccccttcccgtggcgcgccgaaagcgaatacgacgtgctgtcggtcggccactcgtcgacttcgatcagcgccggccttggcatggcggtggcggcggaacgtgaaggcaaaggccgccgcacggtgtgcgtgatcggcgacggcgccatcaccgccggcatggctttcgaagcgatgaaccacgccggcgacatcaacccggacatgctggtggtgctgaacgacaacgagatgtcgatctcggaaaacgtcggcgcgctgaacaaccacctggcgcagctgctgtccggcaagctttactccaccctgcgcgaaggcggcaagaaagtgctggccggcgtgccgccgatcaaggagctggtgaaacgcaccgaagagcacctgaaaggcatggtggtgccgggcacgctgttcgaagagctgggcttcaactatatcggcccggtagacgggcacgacgtgcaggggctggtcgccacgttgaaaaacatgcgcgatctgaaaggcccgcagctgttgcacatcatgaccaagaaaggccgcggttacgcgccggcggagaaggatccgatcagcttccacgcggtgccgaagttcgatcccgccagcggcacgctgccgaaaagcgccggcggtctgccgacctattcgaaaatcttcggcgactggctgtgtgaaaccgccgccaaagacagctcgctgatggcgatcacgccggcgatgcgcgaaggctccggcatggtgcagttctctcgtgactacccgcagcaatatttcgacgtggcgatcgccgagcagcatgcggtcaccttcgccgccgggctggcgatcggcggctacaagccg

SEQ ID NO: 9633 - DNA, 243 bp, Glycine max
  Peptide Sequence Number=SeqID_126411
atggttgaagcattctcgcaaaacatcgtgaccctgactggtctccctatgatcttacttagtgagagtgacctgacaaacccatggtctgctaggaatgtgataactcactccctgtatgttgttgtgtttggatcctgtgatgatcttgaacttgtgttcggggagcagatgaataggtggatgactatgaaaaacctcatgctagaggacacgggaacacaacgctctgataggatgtga

SEQ ID NO: 9634 - DNA, 255 bp, Glycine max
  Peptide Sequence Number=SeqID_126412
atgaagattgcatccatattggatttcagcttgtgttgggttatatgtggtggaggttttggtcatttttatgagatcctcggtttaaatctcaccattgtacaccaaaaaaaacatatagaaacagagtgtaagacactaggcaaggatgagaatatggacttatgttcattaagcttgttgttgcaagacgacagattaaaagtgtgtttgctacaagctatttttctgtcaataagcttggagatcgtgcag

SEQ ID NO: 9635 - DNA, 574 bp, Glycine max
  Peptide Sequence Number=SeqID_126413
tattgctcgtcgagcacgtgatgcagatgaagccactgaagttgcttatctcaaagaactttaccatcagaatgatcctgaggctgtgattagagtatttgaaagccagccatctctgcacaatagtccctcagctctatctgaatatgtaaaagcattggtgaaagttgataggcttgatgaaagtgaattactgaagacattaaggagaggcatgtccaattcagtgacagaggaaaaaactgtaggtggtctttctgctttaagaagtttgggaaaatcaaccaaagacaatactattggaactgctagtaatccaatccatatggtggctagagaaggtgggaatataaaagatcagctatggcgtacatttaggttcattgtggtgtcctttttcatgatttctggtgtaggagcactcattgaagataaaggaattagtaaaggacttggtataaatgaagaagttcaacctagcatggaatcaagtacaaaatttagtgatgtaaaaggtgtcgatgaggcaaaggaagagctggaagaaattgttcactaccttcgagatcctaag

SEQ ID NO: 9636 - DNA, 1722 bp, Glycine max
  Peptide Sequence Number=SeqID_126414
cgctttactcgtcttggtggtaagcttccaaaaggagttttgcttgttggtccacctggcactggaaaaactatgttagcaagagctattgctggagaggctggggttccattcttctccagcagtggtagtgaatttgaagagatgtatgttggtgttggtgcacgaagggtgagggatcttttttctgctgcaaggaagcgagcacctgctataatattcattgatgagatagatgctattggaggaaaacgaaatgcaaaggaccaaatgtacatgaagatgacgttaaatcagttactggttgagctagatggattcaagcaaaatgagggcataattgtgattggcgctactaattttccacaatcattggataacgcattggtgagacctgggcggtttgatcgccatgttgttgttcccaatcctgatgtaaaaggaagacagcagattttggaatcacacatgtcaaagaatactaccaaacataattgtcccataacacccccatcttccctacataactttaaaggggaagtagtacatacttcagcaaaaatttccattgttcttatgcaaaatgttccctttaaaccacaccagattacagaaattacagcaatttcttgctgtctcaaagctcagaaactcctagcaagattgaattggatggcatatgacgcctttttcagagttatatgcttctttctttgggctatgattggctatccattggatacttttgtgtatgagctcacccccatttactttgaagtttacgttctgaaggctgatgatgttgatctaatgatcattgcccgagtaacacctgggttctctggtgctgaccttgcaaacttgattaacattgctgctatcaaggcggcaatggatggtgctaaagctgtgagcatggctgatttagagcatgcaagagacaagatccggatgggaagtgaacgcaagtcagctgtcatatctgaggagtcacggaagttgactgctttccacgagggtggccatgcccttgtggccatacatactgatggggccctccctgttcacaaggcaactatagttccccgtggaatggctcttggcatggttactcaattgcctgacaaggacgagaccagcatttcccgtaaacagatgcttgctaggcttgatgttctcatgggaggtcgtgtcgctgaagagctaattttcggagagaacaaagtcacatctggtgcatcctcagatctcaagaaagcaactagtctggcaagggagatggttaccgagtatggcatgggcaatgaagttggactagtcactcacgactacgaagatgatggtaggagcatgagctcagagactaggcttcttattgagaaagaggtgaagcaattcctggagagggcctacaacaatgcaaaaactattctgaccactcacaacaaggagcttcatgcacttgcgaatgcccttctggagcatgaaaccctttcaggaactcagataaaggcattgcttgcccaagttagatctcagatgcagcagcagcagccccaaacacttgaagctcagaacagttcacaatccaacacagtgcctccatcatctagcaacccggcatctgctgctgcttctgcagcagctgccgccgccaccacagccgcagctacagctactgctgctgctgccaaggctaaaagtgctccagtgggatcttag

SEQ ID NO: 9637 - DNA, 768 bp, Glycine max
  Peptide Sequence Number=SeqID_126415
atgaattccattggacccaaaaatgatacattggaagaatcatctgagtcttccaatatcaataggttgattgttccgctcctgtatcttccaaaaggaaaaaagatctctgagagctatttcctggatccgaaagagagtactcgggttctcccaataactaaaaagtatatcatgcctgaatctaactggggttcgcggtggtggaggaactggataggaaaaaagagcgattctagttgtaagatatctaatgaaaccattgctggaattgagatctcattcaaagagaaagatatcaaatatctggagttcctttttgtatattatatggatgatccgatccgtaaggaccatgattgggaattttttgatcgtctttctccgagaaagaggcgaaacataatcaacttgaattcgggacagctattcgaaatcttagtgaaagactggatttattatctcatgtttgcttttcgtgaaaaaataccaaaggaagtggagggttttttcaaacaacaagggactgggtcaattattcaatcaaatgatattgagcatgtttcccatctcttcttgagaaacaagcgggctatttctttgcaaaattgtgctcaatttcatatgtggcaattccgtcaagatctcttcgttagttgggggaagagtccgcacgaatcggattttttgaggaacaacatgtcgagagagaattggatttggttagacaatgtgtggttggtaaacaaggatcggttttttagcaag

SEQ ID NO: 9638 - DNA, 252 bp, Glycine max
  Peptide Sequence Number=SeqID_126416
atgcagcagtggtgcaggacggaggtgcagcagcagcagcagaatcgccagtacggttggcgaattggtttgcaaaggaaccaccagcctggctggcggtttgctttgtttaaaaaatttccacccttcccttataaaaagaagaagctcctgactgcacaggcaagccttcttgcacttcgttattcttccaagttctcccaacgtttgttcttgtgttttgtttttgacagtaactctctcctctcctaa

SEQ ID NO: 9639 - DNA, 279 bp, Glycine max
  Peptide Sequence Number=SeqID_126417
atgtatgtagtttttgtactcatgatgagcatgctcacaagcagcaacaatgtgagagcaaggcatgtgcaacttctagaattttccacaatcacaccactttacattcagcctgaccatggaatctctaatggcccgaacctttcttgggtttactgtctcttggaccaagaatcgtgtgtcacatcaatcgaactcaagaacagtgtgagtgtttgcctttctaagtgcgtcttcgatggcctgtttaaactgttggatcgagtgccctcagaataa

SEQ ID NO: 9640 - DNA, 291 bp, Glycine max
  Peptide Sequence Number=SeqID_126418
atgcatgagggatcctttggaacacatgccaacgggcatgccatggcccgaaagattctgagggttgtcattgactacttcaccaaatgggtcgaagtggcttcatacgccaatgtgactagtagtgtggtggatttcaagatccaacaccacaattctactccttacaggcccaagatgaatggggcagttgaggctgttaataagaatgtcaagaaaatagtccagaagatgaccgtgtcatacaaggattggcacgagatgctcccctttgcactgcatggttattga

SEQ ID NO: 9641 - DNA, 153 bp, Glycine max
  Peptide Sequence Number=SeqID_126419
atgctggtgcactcacaaatttttgaggtccttgcttcaaattttgagagcatcaatgagttcttgacaagtgttaaacagcatgacctggcaaaagctgaggttctaaacatattaaacattgggccagctgctgattttgaactataccca

SEQ ID NO: 9642 - DNA, 201 bp, Glycine max
  Peptide Sequence Number=SeqID_126420
atggcccatgagcacaaagtggcagacgaatatgcccgagtgtacgcggaaaaagaagctagagggagggggaatctcctcgatagtcagatgaggtccacgaggatcgtcgggagcatgcccaaggagacatcgattcccactccccgttccccatcgaggggccggcgcccaatgcactacctcagcccaacctcatag

SEQ ID NO: 9643 - DNA, 228 bp, Glycine max
  Peptide Sequence Number=SeqID_126421
atgaatgggagcacttttctacgtgaacagcatgcatgcatgaccaactcgccagaaccagtggtgactttggtctgcaactcccacgtggcatggaaaccgccaccacgagtggcgagttgcttgcagcttgaaaccgccaccaccaccagcgagtctgctcctggttttggaaaccgccagtcaaactggcgggttggctttgctgaattttcaggcgtagcatag

SEQ ID NO: 9644 - DNA, 582 bp, Glycine max
  Peptide Sequence Number=SeqID_126422
atgactaacgttgcggccagaaaagaggaagagcgtacagagattgaaacacatcaagaaagcatttgtcaagttacctcaatccatcatcaattgaccaatgaagaggaaacgcctgaagtctccagtactccagaatatccctacatggctactgctagctatgttggagggaaagataaaggtaggttggaactcagcatagacgatcaaaatatctcttttgatctctttgaggccatgaaacacccagatatgggtgatgcctgttttgaagaagaagaggtggagcaggaaataacattatcggccgcaaccatgatactacagtctcccttggaaaaagaacctggctatgggagagattgcttagcttgtgatgaagagcttgatgattcaaaagacagttgtgttgaccaggtggtttttgaagaattggaaaaactaagaccagcagaaaagaccaaagcagaattaaagacctttctggcacatttaaaatatgtatttttggaagaagatgagaccaaacctgttataattagcaactctttgaagaaagaagaagatcaactggtttag

SEQ ID NO: 9645 - DNA, 573 bp, Glycine max
  Peptide Sequence Number=SeqID_126423
atggtttggtgtactcagaggatgagaaactcgtgcattttcaagggatccaagtttgatgtagagggtttgattcaacaggttcttttctttgcatggtgttggatgagggaaggtgtgaaagacttcagccaatcattctctgtatcctcaatgaatacaggaacaacttcaaaagggacaacacagaagtcaggtcccggtgacaaccggttcagttgtgtcgaagaccttgaaggcctattgttcgtggagggggcgggtctgggtggggccggtgcaaaccctagcctgggcctccaacaccgtctgattgggcctgggcaatgccgaacggcgatacgacgacgacagcgccgggtttcgaacgtcgaactcgggaagcccgaattgctcgatggtggtccaatccaacgcgaccctcgtcaaacagagccttcactcgatccactggcgtttggggaatgggagaaggtgaaagcgagggttgttgttgttgcggaaaatggagtttggtggggagagaaacggttcgggattgttaatcagaactttcatggtgttcgagtgtga

SEQ ID NO: 9646 - DNA, 990 bp, Glycine max
  Peptide Sequence Number=SeqID_126424
cgctttactcgtcttggtggtaagcttccaaaaggagttttgcttgttggtccacctggcactggaaaaactatgttagcaagagctattgctggagaggctggggttccattcttctcctgcagtggtagtgaatttgaagagatgtatgttggtgttggtgcacgaagggtgagggatcttttttctgctgcaaggaagcgagcacctgctataatattcattgatgagatagatgctattggaggaaaacgaaatgcaaaggaccaaatgtacatgaagatgacgttaaatcagttactggttgagctagatggattcaagcaaaatgagggcataattgtgattggtgctactaattttccacaatcattggataacgcattggtgagacctgggcggtttgatcgccatgttgttgttcccaatcctgatgtaaaaggaagacaacagattttggaatcacacatgtcaaaggttccctttaaaccacaccagattacagaaattacagcaatttcttgctgtctcaaagctcaaaaactcctagcaagggttacctatttcttatgctggatttttgtttcccatcaaatacaggttctgaaggctgatgatgttgatctaatgatcattgcccgaggaacaccggggttctctggtgctgaccttgcaaacttgattaacattgctgctatcaaggcggcaatggatggtgctaaagctgtgagcatggctgatttagagcatgcaaaagacaagatccagatgggaagtgaacgcaagtcagctgtcatatctgaggagtcacggaagttgactgctttccacgagggtggccatgcccttgtggccatacatactgatggggccctccctgttcacaaggcaactatagttccccgtggaatggctcttggcatggttactcaattgcctgacaaggacgagaccagcatttcccgtaaacagatgcttgctacgcttgat

SEQ ID NO: 9647 - DNA, 558 bp, Glycine max
  Peptide Sequence Number=SeqID_126425
atgaaagatgaagatgcagtttctagagcacaacttggggcatttttcgcggggatgaaaatacttgcgaatgcatttcctaaggcgacacaatggagtgaaggggaaacacgtgcaatgaagacattctggccacttctggttagagttcttccgcctgaggtgatattcattgcagacccggaaggggagctgttggctggtgaccatcttggatttgaggaagtgcaaggtgtgttaaaggatgtccttcccatccaagagggtgatgaaaagcctcagggaatgattctcaggtccccccctcctgttgctgatgtcagatcattgactcattatggtgaaccttatgatggtaacacgcgcttcttcaggaggacgctattcattgctgctgttagatcttgctatggagagtcttgcttgcttcatggtgtagattggatggcacctaagaagcaaactaagatgcttaatgatcataaagtcttggaaattctatccttggagatgactaaggcatgtatgtatataacaatgacaaaaccgatagcgtga

SEQ ID NO: 9648 - DNA, 114 bp, Glycine max
  Peptide Sequence Number=SeqID_126426
atgccgccattcataagagcgagaagcttgctgactaggcaagccgccaacagcaatggcgggacactccacgtagcaaccaatcccgccagtgcttcttgcgagataggctag

SEQ ID NO: 9649 - DNA, 156 bp, Glycine max
  Peptide Sequence Number=SeqID_126427
atgacacatttgttgaaccagatgtgcatcaacaatggatggcggcaacgacatctgatgaagcagacgtcgatgtacatcatcttggacatcagtgcaattgctgttaagttggagaggctactgaacctgaggattttgtccgaaggaacataa

SEQ ID NO: 9650 - DNA, 258 bp, Glycine max
  Peptide Sequence Number=SeqID_126428
atggaaaccatatggaaacgatttgagcagctcaatgtttgtggcaaagtacatttgaagacaaagctgcgagaaattgcttatcctgaaaaggattctattgaaaacattattgatgtcaaagcggatgatagttgtggttattgggcaatagctgccttattgggtatgggtgaagaatcgtggtcattggttaccatgggcaagtggatgaatgttacagatatgggatatgtcttgcttcacgatacaatgtga

SEQ ID NO: 9651 - DNA, 366 bp, Glycine max
  Peptide Sequence Number=SeqID_126429
atggattattggcacaaagcaaacgaaagtacaaagagtgccacacaatgttggatctgtgagcatttcccgattgttggttccgccctaactgtcgaggattatgacgagaggagaccacgtgcatgccgatggacttcttgcaaggtgttgcctgtgtcgacatatcgcaagcgtctggacagactgacccctgacgttccaggggatactcctagagttccgctggttcagcaatatgacacatttgttgaagcagatgtgcatcaacaaccgatggcagcatcgacacttgatgaagtagacgtcgatgtacatcatcttggacatgtagtgcaatcgttgataagttggagaggctactga

SEQ ID NO: 9652 - DNA, 438 bp, Glycine max
  Peptide Sequence Number=SeqID_126430
gaaaagtttactcctgatgctgatgatttggaaggaactaacctgaacttattattggaccatgggatgttttatgcttccaagtcattttttaactatgccaagaacagaaggatattatggggatggtcaaaggagtgtgaatccacacaagatgattatgagaaaggatgggctggtctacagagtattccaaggcaagtttggcttcataaaagtgggaagtggttgatgcagtggccaattgaagaggtagaaaaactacgtgacaaacaagttagcataatgagagagaaactggttggagaatcaactattgaagtctctggtatccctgcatcacaagattctattgaaaacattattgatgtcaaagcggatggtaactgtggttatcgggcaatagttgtcttattgagtatggatgaagaatcatga

SEQ ID NO: 9653 - DNA, 351 bp, Glycine max
  Peptide Sequence Number=SeqID_126431
atgtccaattcagtggttgaggaaaaaattgtagttggtctttctgctttaagaaattcgagaaaatcaacaaaagacaatactattggaattgctagtaatccaatccatatggtggctagagaaggtgggaatataaaatatcagctatggcgtacatttaggttcattgtggtgtcccttttcatgatttctggtgtaggagcactcattgaagatgaagaaattagtaaaggacttggtataaatgaagaagtgcaacctagcatggaatcaagtacaaaatttagtgatgtaaaaggtgtcgatgaggcaaaggaagagctggaagaaattgttcactacctttga

SEQ ID NO: 9654 - DNA, 531 bp, Glycine max
  Peptide Sequence Number=SeqID_126432
aatgtttatacggataaccactcgggtatttccgcccgtcagcgtgactcaaaagtcagtatgacagatcttgtgagcacggaagatgacacttttcatcttacagatagcaaaaaggtttatacggatgaccactcgggtatctccgcccgtcagcgtgactcaaaagtcagtatgacagatcttgtgagcgcggaagatgacgcttttcgtcttacagatagcaaaaaggtttatacggatgaccactcgggtatctctgcccatcagcgtgactcaaaagtcagtatgacagattttgtgagcgcggaagatgatggcgcaggagacgacgttagtctctgcgtgctatcaggcttttcgtcttacagagagcaaaaaggaatttatacggataaccactcgggtatttccgcccgtcagcgtgactcaaaagtcagtgtgacagatcttgtgaaggtggccgacaaaagggaggctcttgctcatacgtatcctccaatgaggaactcagacctacgtagttcttga

SEQ ID NO: 9655 - DNA, 314 bp, Glycine max
  Peptide Sequence Number=SeqID_126433
gtgtgccgaagccttcagtagctagttaccttagccaggagctactggcagagcaagaagttgatagagtgcatggattactagcgcagcctccagtgaagctcaacaatatgttggttatatcactgtcaatgaaactcaaggaagagatctgttctattggtttttcgaggccacccataaatcggaacaaaaacccgttctcttatggctcaatggagaatcacaaaccagaaggtcaggaagtgagtgcagcaggagtaaacattgataatcacatgaatgaaggtagtggctggattaactcagcataa

SEQ ID NO: 9656 - DNA, 272 bp, Glycine max
  Peptide Sequence Number=SeqID_126434
cgatgcggatgaggcgccactcgaggtttccatttgcctgcatgcctttggtattctggggtttggttcgtttagtggtgtcaagtcttgtgaacgtgaggacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactctta

SEQ ID NO: 9657 - DNA, 600 bp, Glycine max
  Peptide Sequence Number=SeqID_126435
atgaacttggcctacatcaggaagaactgttggaatcccgaggatctaacaggttcaatccgaggggctaggagggcaagggcgaggccagctgagcttcattctacttctacagctcctactctagcatccacttcatcaaccccttctatcccagctcagatagattctcaacgctttgaagccatgcttcaaagcattcatcaggaacaaatcattttattacagagtttacaggtggcggcgcctccaggatctattccttcagttgagcatttcagggagatggtagcctggcccgggacccaaccttttcttcacaaggaagatgaaggagaagaggcagaggagacacaggtgagacaggcagttgctgccactcccgagagatcccttgaggccacttcagagcctcctacaccagtggtggacctaccctcacctcagtatacaacagacccttccactcctatcttagagataccagaggacccgaccacaccagtcctggctatggacacttctcctccaactacttcagtacttcatctgacagacgaggaggatgttcagacacaggacacccaggaccagtcatag

SEQ ID NO: 9658 - DNA, 225 bp, Glycine max
  Peptide Sequence Number=SeqID_126436
atgggtgctagggttattatggaggatgggagtgtcacctacattgttagtagagagtcaccatacatctccacaacctcccccgttgaaaccaccgcgataagtggctatttggcgaagttgcacatggatctagtgtgcaaggggcttgtatgcataatggagggaggtggtggcaatcatgtgcacaaatctaggtggtgtggaggttactgtggtgcataa

SEQ ID NO: 9659 - DNA, 189 bp, Glycine max
  Peptide Sequence Number=SeqID_126437
atggcccaagttgtaagtatcaaacataatggtggcattcatgggaacatgagtggattgaaagaaaataaggtgcagagtgcagatcaagacaatgccgaatttaaggttcatgagatcaaagatattggtggttcggctagtgattcaaaggatgcttatgacgagcttgtcagagtgatgaactag

SEQ ID NO: 9660 - DNA, 209 bp, Glycine max
  Peptide Sequence Number=SeqID_126438
tgttagaaccggatcagttcaacccgacccaacttgtaattaagcaacaggattggaaaaatcataattgcttaaccccaaaacggtgcgggaaaggaggccgctaccacagagggcggtatgccccctcttgtcaccaccgacgcagggcttgcgacgcgagaccgctatgggaacgacggtggcttgacggagtcttaggagcataa

SEQ ID NO: 9661 - DNA, 204 bp, Glycine max
  Peptide Sequence Number=SeqID_126439
atggagacccaacataagcttggtggaggtgatttcttgagagaagcatcactgatgaagattggagaaggaataaggcctagaagggataatggttgcggaggagggtttgccgtcaactttggtgtcaccatcatgcactatttagaggtgaaagagaatgggaaccaaaggtcaaataaggaaaggtggagaaaaagataa

SEQ ID NO: 9662 - DNA, 339 bp, Glycine max
  Peptide Sequence Number=SeqID_126440
atggcaccacaagcagattttgcaaaatttgggtttgaaatagaaaagttatttggcaggcaaaagagttttggcaatggtggcaacaaccctccagcaactcatcaaaatctctgccaatacaaattttatccaacttatggagctaccaaggtggtccacatgcatgtagaagatgtcaagtgcaatgaagctgcttcaagattcatatcagaaaagagaacggagctgcagatgaaagctcgaagacaaacaggaaggtcttctgcagcttcaagagttattaggctctttctatggcttagaaatgagtttgagaaatcatggacatgggtttaa

SEQ ID NO: 9663 - DNA, 408 bp, Glycine max
  Peptide Sequence Number=SeqID_126441
atgttatgggtcggtggtgattgttgtagtggttggtgcggttgcacgtcatcggagatggacgaagatcaatggatgtatggcagtataatgtctgacgaagttcatatgaatgatgaaaataaacatgaagctggcatgaatgaagaacaacatgttgattgttctgatgcattcaatacttctctggtgtttactacccgagatgatgttttgcagtgggctcggtcagtcgcttatgaaattggatttgtggcggtgattatgaagtcagacacgaacactggagtggttagtataggtctaggaagaaagattttgttagaagagatattggccgtaagaaatgtgggtgtcccttcaagtttcatcggaaaccagtggttgaagggcaaggttgaatggtga

SEQ ID NO: 9664 - DNA, 315 bp, Glycine max
  Peptide Sequence Number=SeqID_126442
atggtggcccaagcccgggctgttgatatgctcgtggagacgtcatcatcgcgattgtggatggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaaccccatacctgtcgggacccgaaagatggtgaactatgcctgagcggggcgaagccagaggaaactctggtggaggcccgcagcgatactgacgtgcaaatcgttcgtctgacttgggtatag

SEQ ID NO: 9665 - DNA, 318 bp, Glycine max
  Peptide Sequence Number=SeqID_126443
atgggggagcacaaaattgaaggaagaaaaagggagagaagagagtttgaagtggctagtgcataccaaagactagataaattggaagttcaaagctccccaaaggattcgtgttttatatgggagtcgtccttctctaagccccactccagcaccgagttactcggtgttgctgttccatttgactctctgggtaaacttagccatgcggccaccatagttgaggccattccatgccactccgacatggcacttggcaaaaactcagccatgcgaggtgagccaagttcacccatgatattcaatacaatatcttaa

SEQ ID NO: 9666 - DNA, 270 bp, Glycine max
  Peptide Sequence Number=SeqID_126444
atggaaagttcccaatcaaagagtgggagaaagcaaaaaaagaaaagaaggaaagttcccaatcaaagagtgggagaaagcaaaaaagaaaagaaggaaaattcccaaatcaaagagtgggagaaagaaaaggaaggaaagaaaattcccgatcaaggatcgaaggaagacagaggaaatgtgcagaaaggttgttggaccagacgatatctgaacaatacagaattgtcaccaaataaacaaaaagaaggaaaggaaaccacgatctaa

SEQ ID NO: 9667 - DNA, 433 bp, Glycine max
  Peptide Sequence Number=SeqID_126445
ggcgagggcgaggccatctgatcttccttccacatctgtagctcatactccagcatccacttcagtggtggcgcctgcaggatccattccttccattgagcagtttctggagagggatgcctcatctgaggccactataccagagccattcattgtaaaggaggagactagtgagacacgggttagacaggaagctactgctactcttgagaggtcacgagaggtcacatcaaatccacccacatcagtggtggacttatcctcacctcagcatgcaacagacccctctactcctatactcgagataccagaggacccaaccacaccagtcctgactctgaacacttcttctccagctactctagtacttcatctaacagatgaggaggatgttaagacacaggacactcaggaccagtcacaggaattctaa

SEQ ID NO: 9668 - DNA, 225 bp, Glycine max
  Peptide Sequence Number=SeqID_126446
atggatagtccccggacgaaattagggtatgactcccgtgaactccgatgttgtcaagagatactacgcttaggatcttgggcaattgaggaagtcgttgagcagaatcgtcttaggcagtggtcaaatgttgggccggatccaaaggcagaaaccaatcaaggtaaaacggtaatgcagccacagtttgttgcgccatgtcgtttcctgcttttaggcagttag

SEQ ID NO: 9669 - DNA, 246 bp, Glycine max
  Peptide Sequence Number=SeqID_126447
atggcttacacccttgccactatatcgtccatgatcaaagtaagccctcatggagatttgccatgcatcgacatcaaatgtcgtgttgagcttgcacactattgtttgatagaagaagagaaggatgcctcatatgctaatgtgactaggaaggtggtggccaggttcatcaagaaagaaataatttgcagatatgggttgcctaggaagatcatcaccgataatgccaccaatttgaacaactaa

SEQ ID NO: 9670 - DNA, 216 bp, Glycine max
  Peptide Sequence Number=SeqID_126448
atgctccaaccatatgggatcaacataggcttaaaggagcactcaaaccgggtgacccccaaggcctacgctccgaagagtacgtcagggactctccctactgattcaggacttaacattaactcatcgtccttaaagggacttaacattaactcgtcgcctttaaagggtcttagcattaactcgtcgcccttaaagggacttatgattgtatga

SEQ ID NO: 9671 - DNA, 347 bp, Glycine max
  Peptide Sequence Number=SeqID_126449
ggtggaccttgggtactagtaccctcacctttagagggctacaagccctcgctttcagagggctgcacgtcctcgccatcagagggctgcacgccctcaccatcagagggttgcaccccctcgccttcaatgggcgacacgtcctcaacttcagagggctgcacgccctcgccttgagaggactagacatcctcgccgttagaggactagacgtcctcgcctttagaggactacatgtcctccacttcagaggactacacgtcctcgcctttagagggctacgcgctctcgccttcagtgggcttcatagccacaccttaagagaatttaaggtcctctacccttaa

SEQ ID NO: 9672 - DNA, 567 bp, Glycine max
  Peptide Sequence Number=SeqID_126450
atgaaaaaaattagtgttatcgcgttagtaggagtaggattgcttatggcatcatgtactaaagagaaatcagcggaggcttcggctgctggccaggaacaggctgttgctgagagcaaaggagaagtgcttgccgtagatacagtagcttctgtggttaactggaaagcttaccataaaggaggttttgctccacgttggggaactcttaatgtaaagtcaggtgaccttagtgttgaaggaaatcaggtttctgcaggaaattttgttatcgacatgacttctattaaagtggatcctgcttcagtaactgaaaaagacaagaagccggaagatctggtaacgcatttaaaaactcctgacttctttaatgtagagaagaatccggtttcagattttaaaattacaagtgtagcggacctcaaagaagctcctaaagatgctgtggcaggtgcaaataaaacaataagcggtaatcttacgctattgggaaaaacaatgaatgtaactttcccagccaaagtagaagcaacagctaattccgcttctatagatgctaaatttact

SEQ ID NO: 9673 - DNA, 246 bp, Glycine max
  Peptide Sequence Number=SeqID_126451
atggctagacatgatacatgtcagggtttggtttggttcaaggataaaagggatgccccacattatttccatgacacaaatgcaaaaatgatgatttggaaacttcatgcaaaattggtcatgcatgcacctatgtggttatcgataaccagatccacccttattggacgtagcgggacaattctttctgcgcgcaacttcctctacactaagtctaactcagtgggccaattcgtgctgaactaa

SEQ ID NO: 9674 - DNA, 237 bp, Glycine max
  Peptide Sequence Number=SeqID_126452
atgtctcctccacctctaagacctcacaatcactcacaaactcatctcaagctctcaggatggcttcctcttcaagctctgcgcgggcttttctcgcttagcgaatggactgaagcggtgcgcttagcaggatggcccttcgctcagcgaacatgcacaactcatccttcttccagattcttcctcgcgctcagccgaggagtgttgcactcagcgaatggctcgctaagccaatag

SEQ ID NO: 9675 - DNA, 913 bp, Glycine max
  Peptide Sequence Number=SeqID_126453
atgaccattgtgaatgataagctttattactatggaaatgaattcaattataatacccattcttacactaaaacttttggaattattgatgtaaagaccgaacaggtgatttctgataaaattatcgatcaggaatatgcagatgcaatcaaggctccttatggaattgctgtaaatcccattactgaggatatttatattaccgatgcgaggaattatgtatccacgggatttgtctattgctttaataaaagtggtcattttaaatggaaaacggaaggagggaatattccggctcactttacctttttaaaaattttaaaaataatacctgctgtactggttatatttcttttaaccggaatatcaggatgtaaaagtgacagagatgaagagtcttcatttaagggattggaagagtcttacacgatcaatcgttttaaggtactgaatattcccgcaaatgttcctggtaaactcacctggagtattaaagattccattatttctgaaggatctgaactcgattttatcagcccttacgcgaagacatatccactgacactgaaaatagaacaaaatggaaatgtgaaaacatatcaatctaccattattgtaaataaggagccgggttcctacagtaaatatattgccagtgtactggatttccgccctgcaataggacagtttaccaatgaaattcctgaatatcttgctggaaatacagccaatactatgttgcaaaaagccagggaatctttaatcggctcaaattccacaatgatcagtttaggaggattcgggggctatgttgtttttgggtttgatcatacgattccaaatatgaacggccgggattttaagattcttggaaatgctttctggggaaataatgctaacgatccacgttcgg

SEQ ID NO: 9676 - DNA, 174 bp, Glycine max
  Peptide Sequence Number=SeqID_126454
atggtttattggtggcatgacaaatacaggcctaagaagccgaagtatttcaaccttgttcacactggatatgagtggaacaaatataatcagactcactatgatcatgacaacccacctccaaagatagttgttcgcttctggcaagtgtaccggatcgcgcaagtagtataa

SEQ ID NO: 9677 - DNA, 489 bp, Glycine max
  Peptide Sequence Number=SeqID_126455
atgaaggtcaatatatcatcacttgtgagtgtttccctaagtgtcccttggggagtggaaggtggaagagaaacatatgggttcattgcgaagacgaagacacctctgataaaatattacacacaccaggcaaatgtggctaaccggaaagactctgcaatgaggaaacaaaacattcacagggatgagttcctgcattgcaagagatgcgggaaggagcgcaggttccatctcaagagcacaccagacattaagaactaccatgatgctttaaacaacaaatgctggacttgttctctttggccttatcaaaaaataacatgcgatgatgatgaagagggatcaagtctgaaagcaagcaggggctgttctcattcttcaacttgccaagactgctcaactttttactgtgaagggtgcatcaagtgccgctttgaggattgcaattgccaagaatgcagagaccttatgctatatgctaaaccttaa

SEQ ID NO: 9678 - DNA, 342 bp, Glycine max
  Peptide Sequence Number=SeqID_126456
atgtctcctccacctctagaacctcacaatcactcacaaactcatctcaagctctcaggacgacttcctcttcaatctccgttctctggaggtcttcgcacagcaaaatctctcaaaactctctggcactttgctccgggtgacttacaaccctttgatcctgaaatagaaaggacatttcatagattagttaggcatagtgtgcatcatgattaccctgaacattttgtacctcatcctgggcattatgttattggtgagtttgatcattctgtggttggtgattttgaacatcctgattttgagaattctgactttgagcattctgattttgaacattaa

SEQ ID NO: 9679 - DNA, 561 bp, Glycine max
  Peptide Sequence Number=SeqID_126457
atgcaatctcagggacttgcagtgcctcctgagcctctggttggtcctggtccctccggtccgagagtgagcacaaatgagagttgtgttaatccctcaggaaacgatcctgagacgggtgactctgacaggtgcggcttgtacatagaagcagatcctgcccgcctggttgccgtggggagagtttatgagcgatccactcttgttcataacactcctttgttgtctggccaagtaaaggtgagtgtggacgaggttaaagatgcagatgctccagttcctgtacccactgatcaggtttccttagtggggcaggcacttcacaccttccttgcttggccgacacatctggtcaagtctttatcacaccaggtaactgtgtctccggctaaaccacctccgaagcccgatccagaggtcgatgatccgctttatctgatgacattgaccatcccagagcttttattgaggccttatcaggttccactgcagtggacactggcagatggtggtcatcctgcccaaggcacacctagttgtctggttttgttcattggataa

SEQ ID NO: 9680 - DNA, 393 bp, Glycine max
  Peptide Sequence Number=SeqID_126458
atggatcaagaaaaggttcaagcagtcttgaattggccatatcctataaatctgaagcaattgagaggcttcctcggtctgactggatactacaggaaatttatcaaagctgcaattaccaaggcaccagtactggcattgcctgatttttccaaagcctttacattggaaactgatgcctctggtataggcattagggctgtattgagtcaggaacaacacccaatagcttttttctctaagaagctcacacctaggatgcaaagacagtcagcttatataagggagtcctttgctatcatagaagcagttgcaaaattcagacattatttacttgggcaccgatttgtgatcaaaactgaccaaagaagcctcaagtcactcactgagtaa

SEQ ID NO: 9681 - DNA, 435 bp, Glycine max
  Peptide Sequence Number=SeqID_126459
atgggctcaaaatctaccttaaggttcaatgagaaccctagggcattcgcttggatctctagcccaatctacttggagtcttcttacccaatgcccttgtgggataggattgcatcaggtggacccttgggtactagcaccctctccttcagaggactgcacgtcctcaccttcagagggatgcacgccctcgccacccttggggctacatgccctcaccttcagaggactacatgtcctcgcctccagaggactacacgtcctcatcttcagaggacttcacgccctcaccttcagagggttacacaccctcatcttcagaggactatacgtccaccccttgagagggctacacgccctcaccttcagaagacttcacgtcctcaccttcagagggtgtcgcaacctacccttcgacgagaggacgacgcgtga

SEQ ID NO: 9682 - DNA, 318 bp, Glycine max
  Peptide Sequence Number=SeqID_126460
atgcccagtactcatgacgcgatcatgtattacaacgggaaatggaacataccaccgcagaacaaatttgttggatgtgctttcacaggaaaaaatcctaagaaatttcaaattccttcaacatgtaccatcgatgaattgaaggatttaataaagcaagttgcacctaaagggattccccctcatggaattcacgaatcacaaacgaccaacgaagaactgctgaaggtgttagtacaatctaactactggaaaaaatatggaccaatagaaattttagctgtctttactaaatatgttgtggaattcgaagacgag

SEQ ID NO: 9683 - DNA, 327 bp, Glycine max
  Peptide Sequence Number=SeqID_126461
atgatggtatttccatcagctactgaaacatttggaaatgttgtacttgaatcgcttgcatgcggtacacctgtcatcggtgcaaatagtggcggggttaaaaatattattacagatggaaaaacgggagttctttgtctgcccaaaaatgaggacgtatttctatcatccatttattctttattacaaaatgaagaaaaactggagcagatgggaatagcagcttcatcttatgcgaaatcaaaaagctgggatgagatctttcgtggcttgcttagccactatgaagaagtccttcagcataacgcatcagagttgcttgcttaa

SEQ ID NO: 9684 - DNA, 444 bp, Glycine max
  Peptide Sequence Number=SeqID_126462
atggagtggggaaacttccggtcatcacaccttccattaactgagtatgactgtgcattagatgctgagagtttcagccctggtgatcaggtgagttttttgtgttacttcttagatcgaattcctgcagcccgggggatccactatgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 9685 - DNA, 699 bp, Glycine max
  Peptide Sequence Number=SeqID_126463
atggctccttctttagttcgattatatgaacaaatgcccgaacctaaatatgttattgctatgggagcatgtacaattacaggggggatgtttagtaccgattcttatagtactgttcggggcgtggataaactaatcccagtggatgtctatttgccgggctgtccacctaaaccggaggctattatagatgctataacaaaacttcgagaagcaaaaaaatgcaaggtcgtttgtcttcttgggctagtcaaacatggactaattcatagatcattgggtttcgattaccaaggaatcgagactttacaaataaagcccgaggattggcattccattgctgtcattttatatgtatatggttacaattatctacgttcccaatgtgcctatgatgtagcaccaggaggactattagctagtgtatatcaccttacgagactagagtatggtatagatcaacccgaagaggtctgcataaaaatatttgtcgcaagaaaaaatcccagaattccttccattttctgggtttggaaaagtgcggattttcaagaaaaggaatcttatgatatgttgggaatctcttatgataatcatccgcgtctgagacgtattttaatgcccgaaagttggataggatggcctttgcgtaaagattatatcgccccaaatttttatgaaatacaagatgctcactaa

SEQ ID NO: 9686 - DNA, 116 bp, Glycine max
  Peptide Sequence Number=SeqID_126464
gacgatgaacttattgatgctactggtttggggctagttaatgatgcctgtgtcctgtactgtgagaggtttatggaatttctaattgacctcttgagtcaattgacaacgaggag

SEQ ID NO: 9687 - DNA, 222 bp, Glycine max
  Peptide Sequence Number=SeqID_126465
atgaaagtcttctctagtaaaggcgaaatgtgcagaatccgttataaggtttcaattcccctgaagaggattaagtacgtgaaccaaagtagaaatgttgagaagccaacacagaagtatatagagatagtcacagaagacaattttgagttttggtttatgggattcttaaaatatcagaaaactttcaattatcttgagcttgcaatttctcaagcttag

SEQ ID NO: 9688 - DNA, 207 bp, Glycine max
  Peptide Sequence Number=SeqID_126466
gcatttgcatcacagtatgtttattgcctcaagaaattgggacttgatcccagaaaggtcaatgtcaatggtggtgccattgctcttggacatcctttgggtgttacagaggtaatgctaaaatcttcagagaggcacctgcaactggaatctttatattactgtgacatgtttgctcatgtgcacgctgtgttgcaactttgttga

SEQ ID NO: 9689 - DNA, 1638 bp, Glycine max
  Peptide Sequence Number=SeqID_126467
atggacaacaaaacgcagcagtccgagagtaagcaaaacgacaacgacgaggaagttgcgccaaaacgacaagaccctaacccgtcgtctggcgggtggggcttttcaccgctctcgtttctctccgatcttcagaaggccgccgctgttgcagccgaagagatctctcgcaatgctgctgtagttgcagagacagcatcaaagagcattgtggagttgcaaaacaaagatgaagattcaaaatcttccaaaaaggttgaaggggctgaaggatctgcagatgagaaggaaagtgacgatgagggttccaaactgcgaaaatctgctctcgaaagattggagaaagctagtgaagagtcactgcttagccaggcaagcataaaaggatactttcccttggggggttgggcttttgtgaagagcatttttcttgcactccctcctattggtgccacattatttacaatttctgagttggcaagtttgttaggccatgcagcatggttatttggggagggggagtgtagagaggaggtggccatgaacctgaatgatgtccttgtgttctgtaggctcgagaattctgcaacaaatctttcaggatctccgaagcatgacgggccaggagctgcaggtgctaatgcatcttctctattagagacaggaaaagcttttactgcaaagggaatgcaagttcttgaatatgttggtaaggagacaatggacttattaatcagtgaaactggaattgaggttgagaaggataaaaaagaaggtgaagaacaaaatgatgaggatcaattattagaggaagtgacttttgatcgatgcttttacatttatggaggtccagaacaattggaggaactggaggctttgtctagtcattatgccttgttatttaaccgaagaaaagcaaagttatcagctgagcagaagtctgtatatgatgggaagcttaaagaggtccaacaaatatttaatttgaatactgaaattgatagaagcaatgctgattcaaacaaaggaaagacaataaagaaaggaaatgagggaagcagtgatgagatgaagaatttacacgattctagtgttggcaaggctgctgaaatggctggaggttttgctaacgccttggctggactagctgctaatgatatacttcagagaactaatgcaagattggaatctcttcattctgagggagttcacagactatctgaaatgtgctgttttgccgtgtctcaacttctggtgttgggaaaatccatcatttctcgtgccaacaacactgaggatgaagctgatgatgataaggcaaacgttgagtggcccgaagatgtttccgcaaaagctaatatcataagaataaatgcccaaaccatgattggatatgtgaaagcagtttcccacagtttcattacaggcatatctgatgtaactgaggcctatcaagctgccattaaagctgttacttctgagtctctttcagttgttacccagaaatcagttcaggaaaaagccagtgccttctctgagcaccttcgagcggatcaaaccacagcagcttgcaaaatccaggacgggatgcaatttttagctcacgttctcatttcaacctctatgaatgctgcttga

SEQ ID NO: 9690 - DNA, 564 bp, Glycine max
  Peptide Sequence Number=SeqID_126468
atgtctcaccttctatctgctgctactactttttctcgtttccaactcttgaccctcaacaacacattcacaacccaacctccctttctcggattcaagggtacatcatgtttttttgagaagcacagttgctgcttgagtgttaaaccattttgtgcatcccagaagagaggggccaatatcttctgttctatgaatatgtcagcacagcaatcagatgatcatgggaaaatgaagctggaccaattaatagacaaagtgcaaaagctttgggacagttctcctgagccggtgaagaaattcccgcataacaaggctttagacaacttcattcaacttattcttgatcttattttggttgttgtcaaatacctagctgtacctgtattcgcagttacctccctcagtgaaatgtcgtactgtgcacatgaaaggaagctagtctttgttcctcttccggttctctttggagttgctgtggctgggatccttaaagagactgcccttcagttatctccacgtctaagggtaagatcattggttgggcaccattttatattttag

SEQ ID NO: 9691 - DNA, 192 bp, Glycine max
  Peptide Sequence Number=SeqID_126469
atgagctcggcgacattgatcacttgctccttgtattgcttcacttcgcccgtggggaagatcacgcgtgctgcccttgtgttcttcatcaaaggaggagccaaggaagagaaaattggggttaagagagaagaaatgggttttgggttgaaaagaaagggctcacatgaggaatcgaagatggacgattga

SEQ ID NO: 9692 - DNA, 4563 bp, Glycine max
  Peptide Sequence Number=SeqID_126470
atggccgatcaacctcacaacacctcatcctctccgctcgaaacagccatcctcaagcttaccaccctacaggtctcccttggggaaactgttcattccatggcccagaaattcgatgagctcttactccggctaccctccacttccccttctccatcacctcaacctacaccttccatttcccctgtacctgcacataaccacagaatgaaattagacattccgcgttttgatggtactgaccccttcggctgcttcatatcgggcttgactcccgaaatccgccgtgaggtgcaatcgctgcagcctctgactttggtgcaagctgctggactcgcgcgtcttcaggaggagaagctcctcgacacgcgttcatccttccgcaaccgcgctcctccggttctctcggttcctccaccgcgacagaactccacacctgctcttctccaggccccttcgtctcctgcgacgtcagcaaggcctcctccggtgaagcgtttgtctccagctgaaatcgcttctcgccgtgaacgcggcttgtgctttacctgcgaggagaagtaccatagaggtcacagatgtgcctctagggttttcctcctggtggctgctgaggacgaccaccctgaccctcttatagaggacttggacccaggacccgacccacccgacagtccaaacccaactgcggcccaaattagttttaattcactatcgggtaatctagcacccgaaactctccgcttattgggtctggcctccggccaccatgtcgtcattctcgtcgatgggggaagcacccataacttcattcaagaagaattggtgcagagcattggtcttccaacccagaccaccacccctttacgggtcttagtgggagcaaacattgtccttggagtacaatggttaaagacattgggaccgatccttattgattactctctcatgactatgaagtttttctatgaccagcgtttaattgagcttcgcggcgacactgacctcaccattaacatgctcactccacctcagcttcgcagatttttgaaacacaatgaacatgcatcctgcttccacattgcggtcctcacagaggcagttcctgatgagccttcacaattattggaccctcaaattcaagcattaattgatcactttgggccattgttccagacacctacatcccttccgccggcgcgcattaccgaccaccacatccatttatttccccaggctactcctgttaatgtaagaccctacaggtacccccattaccagaagcaggagattgaactcaaagtcgaatccatgttgcagaagggcttgattcgacccagcaccagtcctttctcctctccggtgctccttgtccgcaaacatgatcagtcctggaggttttgcgtggattacagagcccttaatgccattaccatccgtgatcgatttcctattcctacaattgatgaactgttagatgaattgggccacgcatgttggttttcgaaacttgatttgctccaggggtatcaccaaatacgaatgcattcctcagacattgcgaaaacggcgtttcgaacgcaccacgggcattatgaattcaaggttatgcccttcgggctatgcaatgctcccagcacctttcaggcgacgatgaacatgcttttccggccattcctccgccggtttctcattgtcttctttgatgatattttaatatatagcatcactttcactgatcatgttctgcatttacagcaagcttttcaggttttattagaaaatcaatttgtcctcaaactttccaaatgcactttcgctcagacagaggtcgaataccttggccatgtggtgtctcagcgcggtgttgagccagtctcttctaaagtggatgccgtccgacaatggcccctgcctcagtccgccaaagctcttcgtagttttttgggtctcgccggattttatagacgctttattaaaggctatgccaccattgcggcccctttagttgcggccaccattacagagccctttcagtggaccccttcagcccaggaggcctttgaccaactgaagcaagccttgtcggaagcccctgtgcttaccctccctgactttcagctgcccttcacgatcgagacggatgcatccggcattgggatgggcgcggttctctcccaaaagggacaccccatagcctatttcagtaaacaattcccacccaagctccgccattcctccacctatgttcgagagttatttgcagtgacttcggcggttaaacggtggcgtcagtaccttctgggtcacaaattcacgatcataacggaccaccgcagcttaaaggagctactcacacaagtggtgcagacccctgagcaacacacatacctggctcgtctaatggggtatgacttccaaattcagttccgttccggcgccactaatcaggcggcagatgcgttatcacgactctctgaggaagactcctctttgtccctcattttgtcggtcccttgtttgacatttatggaggaattgaggaagcagttggctcagaatgagtcttatcagtccaaacttcaggacattcaagcaactcccgccaactttcctgatttcagtatttcaaacaacctcatcttacgcaaaggccgcatctggcttcctcctcacctgccattgcttcccacactcctcactgagtatcatgctactcctaccgacggccaccttggcgtcgcaaagaccatagcccgactgacggacaatttttattgggacgggttgcgagacgatgtcgcacggtttgtctctacctgcttagactgtcaacactccaagtatgaaaccaagcgcgccgccggcctcctatgccctctgccggtccctcaccgaccatgggaggatctctctctagactttattactggtctgcctgtctttcaggggaacaccaccattctggtggttgtcgacaggttctctaaaggcatccatttgaaaatgcttcccacctcacacacagcatataccgccgcagctctattcatgaacattgtcggtaaaattcatggtctccctcgtagcatgatttctgatcgtgatcccctgttcctgagcaggttttggcaggacctattccgtctcagtggcacccatatgaggatgagctcctcttaccatcctcagagcgatggtcagacagaagccctgaatcgcgccattgaacaatacctcagagctttcattcaccggcgaccaagctcatggggcaagttattattgtgggtggaatggtcccacaatacttcttggaatgccgctactggttccactccatacgagattacatttggaaaaaagccctttaactaccctgcatatcttgccggagattcaaagatcgacgctgttgacgatatgattacgaacagagaagacaccttccgcttgattcgtaaaaagctcctcaaagctcaggaattgatgaagaaatatgtagatgctaaacgaagacatgtggaataccaggttggtgactgggttatggtcaaactcagaccccatcgtcaaaattcggccaagccttcttcttcttctagctccgacaaactccaaaagtgcttctacggtccatttgagatcactgagcgcattggtcctgtggcctatcgtctgaaactccctgagggtgctcgtattcaccccgtgtttcattgctctatattgaaacctttcaaagggtcaccggcatctgcagattctgtttgtctccctgaccaatttgctcacggtcaactcattgtatctcctttggccattttggattaccgttacaattcagataaccccgactccccgtgggaggtactggtgcaatgggaaggcttagatcctgatgagacctcgtgggaatcctggactcagttgagtcgtgactatcaccttgagggcaaggtgaatttccaaggcccgtgggatgatagacaaagaggggtgcagcaagtaatagaggtgcaacaagcaaacccaagacagggtacaaacaacaacacagagacccaaatagaaggcagagcaaagaggataattaacaaaccttcatatctgaaggatttcgttgcatatcgtactgccatctgcaaagcaaagcgtgggggctttaaggatacccttccagatgacctgcttgccacagttctgaaggctgtaatagagaaaacaaatgtgaacccagcagaagttggagacattgttgtgggcactgtactggcacctggatcagatagaggaattgagtgcagaatggctgccttttatgcaggtttcccagagacagtgcctcttcgaactgtcaataggcaatgttcatctggacttcaggcggtttctgacgtagctgcttatataaaagctgggttctatgaaattgggattggggctggattggagtctatgacagtagatcgtgtgaataggcttcgcaacattaacccaaaggtagaaacctttgcagaagcccgggattgtcttcttccaatgggcattacttctgagaat

SEQ ID NO: 9693 - DNA, 252 bp, Glycine max
  Peptide Sequence Number=SeqID_126471
atggagccagaaacagcaaagcttggatcctctcttcttgttgattctgtgaaagaactagcaaaggaagcactaatcaaagttcctgagcgatacgttcatccaaatattgaacccccaattttatttcataaagacactttgccacagctccctatcatcgacctaaacaagttattgtctgaagatgttacggaactggaaaagctagactttgcttgcaaggaatggggcttttttcagatgcagtaa

SEQ ID NO: 9694 - DNA, 666 bp, Glycine max
  Peptide Sequence Number=SeqID_126472
atggcatcctttcttcaagagcttctaattggatttccattcacctcagcagcatatttgggtgagaaatcatcaaagaggtacctgccagatcctgccacccaatatatcacatctaccacaagctcaaagcaaggtggagtaaattcagttcttaccaggatgaacaagcttggaagaaagactaacatctttgcaactggactcaaggaacatgtaaaacttgggcaaaaaataactgatacagtgaaaggaaaattaagcctaggagctagaattcttcaagttggaggagtgaaaaaagttttcatgcaactattcagtgtaaaagatggagagaagttactaaaagcatctcagtgctacctatcaaccacatctggtcctctagcaggcctcctattcatatccaccgataaagttgccttttgcagtgagagatcaatcaaggcctattcttctaagggtcatttgatcagaatccattacaaggttgtgatcccacttgaaaagataaggagcattaaccaaagtcaacacgtgaagaagccttcgccaaagtacatagaaatagttacagtggatgactttgacttctggtttatgggtttcttaaattatcagaaagctttcaaatacctgaagcaggttatttctcaagcgtag

SEQ ID NO: 9695 - DNA, 645 bp, Glycine max
  Peptide Sequence Number=SeqID_126473
atgccagaattgagacatgacaaaactttgctcccaactactactgcagttagggtttgtcaaagagataaaggtaaagacactttttcagatgctaggaaactcagcaggcaactagtgtcaagaccatatcatgctggatgggccatgtgggatgccaatatgaaaggggtgcataatgaggggtcaacttcaagttctatatacaagagcccgagaagatgtgatgctatgatggatgttgcgtgcacatgggaattggctaaaaacatgggagctttagatggaagagatgaaaatggagtgttgactagaatggttgctttagatggaagagataagtctaaatttgagaagttgggaaatagggagggttcggggaggggtgttaaatggggagcagtaaagaaactggtggtaaatgaacaagttgatatgctatgtctacgtgaaactaagaaggaaatggtggacagaactacatgtcaggctttgtggggggatttagaggtgaaatgggcaaccagtccagcagtgaacagtgctggaggcatcctatgtatatggagtgaatcatcttttgtaccaaagaaggagcttattggcagtggacttaatttcactagaaggtatttggaaggatga

SEQ ID NO: 9696 - DNA, 582 bp, Glycine max
  Peptide Sequence Number=SeqID_126474
atgggcagcgagggcgtgccgtcgacggtggcggaggtcatgtcggtggcggccgtcgagctcactgacgcctccagctggtggcacgacatcgacgactctccgctgtggcaggatcgtatgtcctacactctcgccgtactctacggtatcgtggccaccgtagctttggttcaactggctcggatacatttgagagtgccggagtacggttggaccacgcagaagaggttgaagccagaggtattcgagtatagggaatggaatattgttcaacacatcttgcttgacgtgccgagtcttgctttctttacaacatatgcacttttggtcctgttctgggctgagatttattaccaggcaagtttgatttgtggtgcatttgcttctacatggttggcacgtgctgtatcaactgatgggctgaaaccaagtttctatacgattaatattgtggtttatgttgttcagattactttatggttaatattgtggtggaaacctatcagtggactgctcattttgtctaagatgttctttgcagagaaaaatgaagtagaatctagaataacgactccttga

SEQ ID NO: 9697 - DNA, 1086 bp, Glycine max
  Peptide Sequence Number=SeqID_126475
atggaaccagaaacaacagaagagcttgttattccttattctgtgaaagaattactagcaaaggaggcactaaccaaagttccagagagatatgttcgtccagatattgaccctccaattctatctaacaaagactctttgcctcagctccctgtcattgacctaaacaagttgttggctgaggaagtgaagggtcctgaactggagaagctggaccttgcatgcaaagaatggggtttctttcagctgataaatcatgcaactagctctgaattggtggaagatgtaaagaaaggtgcacaagaactcttcaatctttcaatggaagagaagaaaaaactttggcagaaaccaggagatatggaaggatttggtcaactgattgacaaacctaaagaggagccctcagattgggtagatggcttctacattttaactcttccatctcactcaaggaagccccacatatttgctaatttaccacaacctttcagggagaatttagaggtttattgtaatgagatgagagaccttgccatcaacatgtatgttcttattggaaaagcccttggtacagaaccaaatgaaattaaagatacattaggggaatcaggccaagcaataaggatcaattactatccaccttgtccccaaccagaaaatgtccttggcctaaatgctcacactgatgcatctgccctcaccatccttctccaaggcaacgaagtggaaggcctccaaataaagaaagatggaacttgggttcctgtgaaacccctccctaatgctttcatcgttagtcttggagatgttttggaggtagtgacaaatgggatatacaagagcagtgagcatcgagcagtggtaaactcacagaaagaaaggctatccatagctacatttagtggcccggaatggagtgcaaacataggtccaacaccatctgttgttactccagaaagacctgcattgttcaaaacaattggggtagcagacttctaccagggatacctttcacctcagcatcgtgggaaatcatacataaataatgtcttgaggatccgaaatgagaacatcaaaggctag

SEQ ID NO: 9698 - DNA, 231 bp, Glycine max
  Peptide Sequence Number=SeqID_126476
atgggactattcttaatgctacaacgctttcctgttgaatccaaagggcgatgtaagaagctgcaagaggtatgcaatttgatgatgggatattcctcttcttccctccttcactttgacccagaattaggtagtgatcgcctagcttattctgggctcctctttttaaaaggagaagctgagtcaaacaaatttttaaaaaggagctttaagaaatgtagctttttttaa

SEQ ID NO: 9699 - DNA, 540 bp, Glycine max
  Peptide Sequence Number=SeqID_126477
atggtgaaattaggttggtccttgtgtggcaaaagaaattctttatgggtgcaaatccttaggaaaaaatataagtgtggtgattctattgtgcctaatgttaatgtccttcagcctgggtcaaatacttggaggggaatttgtcacaattgggaaaatgttactgcaaacctggagtggcgaattggtgatgggaattctgtcaacttttggaaccaactttgggttccttctcaagatcctttggcgcacaaatcgacatgtgttgttcttagtgaccttgaagctgaatcaaattctaatgcctcgattcaggcacaatctggttcagcttttgtgggagtcattctgcgtgatcattgtggatttgttgtggtttcatgtgtagttgatattggtatttgtccagttgttagtgcagaatcatgggttgtgtgtattaattggtgttcttattgcttgacaaagaggattcaagaggttcactatggagtcggattcttagcttgctatcaatctcctgaagcatgggtgtcttga

SEQ ID NO: 9700 - DNA, 1155 bp, Glycine max
  Peptide Sequence Number=SeqID_126478
atgaggctatggattaaggcctcgggtgcattgaaagatacgtatagcatttggattgcgaagctctcaccgagtggtccatgtaggaatcctgatctcgaaaccgtgatcatcaaggccacaagccacgatgaacaatgcatggattacaagaacgttcaaagggttttcaaatggctacgtatctcacctttgtaccttaaacctcttctctacattgtctccatgagaatggagaagactcgttcatgggtggtggcactcaaagggctaatgctcactcatgcgttgttttgttttgacctacccgcggtgcaaaaaatgggaaggttaccatttgatttgtcacatttcagcgacggacacgtaaaccctaataaggcgtgggttttcaatgcatttgttcgttcttattttgcgtatttggaccaaaaatccgcatttgtgcggttggaggcaatgaaagggaccaagcgtgggagcaaggagaaggaagagaccgtgatggaagagttgcaaggcttggagaagttgcttggtttgattgatttgcttctacaaatcaaacctaggaaccctaacatgaacgtggtgcttgttcttgaggccatggattgtattatggacgaggttttggaagtgtatgataagttttccgtgagggttcatcgagtggtgtcgatgataattgatataggtgggaaagaggaagcaagagttggtcttgatgttgtgagaaaagctgaattgcaaggtggtaagatctctatgtactttgatttttgtagggacattggggtcattaatgtctccgagtgtcccgaaattgtgaggattgatgagaaagacattcatgaactactcaaaattgtaagagatggtggtgtctccaagaaggaaaatttggagggtgataataataatgctattgtggtgtatgagggcaataattgtagagccattaccaccattttggagcagaagcaattagatttcaagacggtgatcactgaccattgggaggtgtttgatgatgttatggatacaagcctgcctatagccacaagtgctaacccttttgttgattctttgagcatcgtaccttatatccccgtttgcaataatcatgttcttccagatttaattgttttgtag

SEQ ID NO: 9701 - DNA, 618 bp, Glycine max
  Peptide Sequence Number=SeqID_126479
atggagatgatgaagctttcatgtttcttgcacaaaaaacaaacaatttccaaccaaatgtcctgctacagcatgatgtggaagtttacaagtcctcaagaatcagaagttccaagaacaagcctgaagacacagcatcttatcgagctattatgctgcctgtcttccatcttatgcaattttataagacatcccttcgtgactaaagagttcaacaaacttgtcaagttcttcaaatacatcaggttccctgctatactgcctgtgccacagcaacaagatgacgtaggacttactggttctgcttattatgccatgcagacattgcaccgcagaattgtttatgtggaagaaattacgctactttcaaaaggaatgacattttcgcactggaagaagcagccaaaggttttcagggaaaagaatgtgttgacacattctctctgtcaagtatattctcctataacagaaatgaatgcatcaaagatctcaaggcattttgatggtaaaccatggacacttcagaaccctctcactgaaatgagaatatttaccttctttgcttgcatcacaaatatattgcattacttattcatcgggtttcttatatgtatctaa

SEQ ID NO: 9702 - DNA, 1830 bp, Glycine max
  Peptide Sequence Number=SeqID_126480
atgaatactcaattttgcagaacaccaccaccccatcacgtgcatgcacccatcatccccacgtgccacttcccttctttgcacactgtctcaccctcccaccaccaccgacgtttcttcttcttccatgccaatttctcagcttctcccacacccatcttggaagaagaaccttcttcttccaacacccccaccatcatccatgttgtagatgttaacttcgctgctgatgttcagaaacaatattccaagccagaacctgagaacttgaacgagttcttatgtgggttgtttgaggatccaaagactaaagaacttgcttttgactactaccaaaggttgaaagagagaccagagtttagacccgagaagccaacactgaagcacgtgatcaggtacttggtgagtttgaagagttggggttccattttgtctgtttcagaagactttaaggtttaccatgtgttgcctgatagggctacttgctctaggttggttaagttttgcattgagcataggaaattcagggttgctgagtctctgctttatgtttttaaagatgatagtaaggttgctttcttggcttttagttctgccatgagaagttacaacaagctgcatatgtttaggaacactgttttggtgtttgaaagaatgaaatcgagtaatgttgttctcgattcgagaggttatttacacattatggaagcttactctaagctcaatgagtgtgagaaggtggttcagttgtttcgtgaatttgagagtaggaagttaagaggttcaagttatttggctcagatatatgtgattctatgtgagtcattagcgaggcatggaagagctttcgaagcgcttgatttctttacagagatggctaagaaaggaatttctgaatactcaatttactctaaattgatatactcgtttgcgagtttgcgtgaggttgtcgtggctgaggaacttctaagagaagctaaaggaaaaatgacgataaaggatcctgaggtctatttgaagcttgtgcatatgtatattgaagaaggtttgttggagaagactttggaagttgtcaaggaaatggaggatgcagatgtcaaggtttctgattgtatactatgtactgttgtcaatggcttcagcaagaaaagagggtttttggctgcggttaaggtttttgaggagctgatttccaagggctatgaatcgggtcaagtcacctatgcttcggttataaatgcatattggcgtctcgggcaatatagcaaagcagaagaggtgtttttagagatggagcaaaaggggtttgataaatgtgtttatgcttactctaccatgattgtgatgtatggaagaacggggagggtgagaagcgcgatgaagttggtggccaagatgaaagaaagagggtgcaaaccaaatgtgtggatctataactccttgatagacatgcatgggagggacaagaatttgaagcagcttgagaagctgtggaaagaaatgaagagaagaagggtagcaccggataaggtgagttatactagcatcattggtgcttatagtaaagcaggtgagtttgaaacctgtgtgaagtttttcaatgagtataggatgaatggagggcttattgatagggccatggcaggtataatggttggtgtgttctctaaagttggtctggttgatgaattggtgaaacttttacaagacatgaaagcagaaggaacaagactagatcagaggttgtaccaatctgcttggaatgcttttaaagatgccgggttgcaaattcaggcaaggtggatgaaagagagcttccttgtgacatag

SEQ ID NO: 9703 - DNA, 1320 bp, Glycine max
  Peptide Sequence Number=SeqID_126481
ggtgtaaattctcttggtataggccaaataggacagctaaaagctggttggataggattcttatatctgctgaatggttctctaaatggagtggaaactgctggtttcaagataaatcctttaggaagacagttcgggattgctggagagagtgccagtactagggtggggaggctatgtattaaaagaaaaattgaagttgttgaaacagagattaaaggaaatcaggttgaggaaggagctgcaggaagaagtttgggtgactacgcactcaaaagaatccattatgaggcaaaaagcaagaataaagtgatgttgggtggaggagccaaacagagtaagggaggaagtcaaacaattctttatggaaaggatgaggtaagggcagcggtgtgcgaatgtggaagtttcaagagtccaggacctaatggactaaattttaaattcattaaggaattttgggacgtttgggatccccaaaatctaaatgattacatacctatctctctgataggctatatttacaagattgtcgccaaaatcctagctagaagacttaagaaggttatggccactatcattgatgaacgtcagagcgcctttatagaggggagacatcttttgcacaacgatcttgtgtcttttaaccgagcactacttggtaaatggcgttggaacttatttcagcatactggcgctttatgggcaaaggttttggagtcgaagtatgggggatggagaaatttagatgaggctaggaggaatcataaggagatgtgggttgcggataaagttttggaaagattggtagagggaggacaggctgcttttgatggaaaagtaccagaaatgatgctggaagggaaaatggaattagcagccagctttatggaggatattgaggatggatatcatttgcttaatgaagtggtggcggatgagaattgcatattgcaacagcaacaccacactattcagcagatgggcgttgagcctaacctacaagacagatggatttggaaaggggatgtgagtgggctgtatttagagggaagcagacttcatttgcttaatgaagtggtggcggatgagaacgatgatggggcattcacaatcatctggaaaatgaaaatcccaagcaaggttgcacactttgttcgggggttggtgagggacagattgccaaaaagagcaaacctaagaagaagaaatgtgatccttgcatggacagaaactgtaaccatgttccctgcatcacctaaggaacactttcttcaacattcttattgtaaggcaccagaaataatccaaaacagatag

SEQ ID NO: 9704 - DNA, 501 bp, Glycine max
  Peptide Sequence Number=SeqID_126482
atgaggggaggggataaaacccctaaaccaacaagcagtcatgccaaaagatccttacaagatcactccaaagaagagataaacacccttgagctagctagcattaggttagcatataacactgatcatggattacagaacgctagaactgaacatgacatccgcaaaggaactcagagatgccaactccaagaagatggctgtatacgccatcgtctcactctctggcaaacaaaagatcaggactttcgtggacagaaatgttcactttggaagttgttctttgctgaatgtgaacgagccattgccggagcggaagaggaaatcggcaaggcccacgtcccgctccggcaaagaaagattttcaaatgggactcagaacggggtgggaaaaaggaaggagatagtcttgatgttgtgaaaaaagctgaattgcaaggtggtaaaatctctatgtactttgatttttgtaaggacattgaagtcattaatgtctcttga

SEQ ID NO: 9705 - DNA, 165 bp, Glycine max
  Peptide Sequence Number=SeqID_126483
atgggtcctgcggcaaagacgaggaagaagtgttttatcatactaggtgaggttgactatatagatcatatgacccaatcgactctcttaaagatcaaggtgtatggttatgcacggaaacttgcgaagattggaattgaagaagcccttgtggacctgacttga

SEQ ID NO: 9706 - DNA, 792 bp, Glycine max
  Peptide Sequence Number=SeqID_126484
atggaagtggtggtggcagtgcctcctcctccaccaccttcttcttccatggactttaacttcgatagcaactgttcctccccttacatcactgcaccttccagcccccaacgctttggcaacttcttcttcagtgcccccaccagccccactcgcagacactcctctgcttccactcccaacaccacccaagacgagttcgaattcgacttcagtggtcatctccagaggccttccctttccgccgaggaactattcctgggcggaaagattagacctctcaaacctctttccccttcgtctagtagaagaagagagaaaagggttatccaagaatcaccaccatcacaacaacgtaagttaggcaaggaaagagcttcatcattttccgtttcctctacgaccttctctttgggagacaaaagtaacagcagcaaaacctcggagagtatttctaactcctcatttttgtcgtcgatttcgttcgggaaagggtaccgaaagtggaggctgaaggattttcttctgttccgaagcgcctctgagggaagagcttcggacaaggatccttttcggaagtacgcggttctgtccaaaacgaccgcgcacgaggatgtccggaacgtcagttccggttcggtttcgagacggagagggccggtttcggctcacgagttgcattacaccgtgaaccgggctgcttcagtggagttgaagaagaaaacgttgttgccttataagcagggcttcttgggctgcttggccttcaaccctgccatgcatgggtcttag

SEQ ID NO: 9707 - DNA, 2565 bp, Glycine max
  Peptide Sequence Number=SeqID_126485
atggctttcccttcatcttcttcttcttcaaaccactctctcatagccgacaaagcaatcgcttttctaaaacgccaccctcaaagactcgcatctctctctcctcacttcactccccaagcagcttcttacgttctcctcaattcccaatccgaccaacgcaccctcctcaacttcctcacctgggcccaagcccaagcccaggcccacaacttcttcttcacgcctcactgcaagtgcctcgccctccacatcctcgtccgcttcaagctctaccgcaccgcccactccctcgccgcggacctcgccgccaccctccccgaccccaccggcgcctccctcttccgccacctccacgacaccttccacctatgctcctcccccttctcctcctccgccgtcttcgacctcgtcgtcaaatccctctcccgcctcggcttcgtccccaaagccctcaccctcctccacctcgccaaccgccacggcttcgcccccaccgtcctctcctacaacgccgtcctcgacgctctcctccggcggagctcgtcgaatcatcgcgactacgacgacgcggaacgagtgttccgcgacatggtccggaacggcgtgtcgccgaatgtgtacacttacaacgtcatcatccgcggcgtggtttctcaaggggacttggagaaagggttagggtttatgcgtaaaatggaaaaggaaggaatttcacccaatgtggttacttataataccctaatcgatgcttcttgcaagaagaagaaggtgaaggaggcgatggcgctgctgagagcgatggcggttgggggcgtcgccgcaaatttgatttcgtacaattcagtgattaatggattgtgtggtaaagggagaatgagtgaggttggggaattggttgaggagatgagggggaaagggttggttcctgatgaggttacttacaatactctcgttaatgggttttgcaaagaagggaatttgcatcaggggttggtgctgctttcggaaatggttggtaaagggttgtctcccaatgttgttacatatactactttgattaattgtatgtgtaaggccgggaatttgagtcgcgccgtggagattttcgatcagatgcgtgtcagggggctgaggccgaatgagaggacttacactactttgattgatgggttctgccagaaagggttgatgaatgaggcttataaggtcttgagtgagatgattgttagtggattttcgccatcggttgtgacttacaacgcccttgtccatggatattgcttcttggggagggtgcaggaggctgtgggaattttgagggggatggttgagagaggtttgcctcctgatgttgttagttatagcactgttatagctggtttttgccgggagcgtgagctgggaaaagcgtttcaaatgaaggaggagatggttgagaagggtgtcttgcctgacacggtcacctattcgtcgctcatacaaggtctttgtctgcagcagaaactggtggaagcttttgatttgttccgagagatgatgcgcaggggtctcccgcctgatgaggttacttatactagtttgattaatgcttattgcgttgatggggagttgagtaaggctcttcgtttgcatgatgaaatggtgcagaggggttttttgcctgataatgttacctatagtgtgcttattaatggacttaataagaaagctaggacaaaagtagcaaagaggcttcttctgaagttgttttatgaggagtctgtaccagatgacgtaacatacaatacgctgatagaaaactgcagtaataatgaatttaagagtgtggaaggtcttgttaaaggattctgcatgaagggtttgatgaatgaagcagatcgagtttttaagacaatgcttcagaggaatcataagcccaatgcagcaatttataatttaatgatacatggacattctagagggggaaatgttcacaaggcatataatctgtatatggagttggagcattctagttttgcttgtcatacagtggctgtaattgctctcgttaaagcactagctagggaagggatgaatgatgagctgagtcggttattgcaaaacatattgaggagctgtaggctcaacgatgccaaggtagctaaagtacttgttgaggttaactttaaagaaggtaacatggatgctgttttgaatgtgctaactgaaatggccaaggatggcctactacctgatggtggaattcattcatctgctccagcaactccacaattatctaaagcctccttcttggccagaacggaactcgagttgattggtgatattcttaaaactgttatcacaaaacgagacaaggcaccacttatttgctgcatatcacctagtgggagtgaaatcttgtgtgctcgaatgaggtttcatggaagggttgttgcttactctggaagacctccacctgctcttgaaggttttggctcttactggtttgaaaaggctattgctgagtgggaaaatgctggaggcaaggttgcatacaggttggaattgcctgaagacagttag

SEQ ID NO: 9708 - DNA, 1332 bp, Glycine max
  Peptide Sequence Number=SeqID_126486
atgggtttggtggttcctgaagaagaactaagcttagatttgagaccctcttttgttccaaaaaccatcactgattttctctgccacctttccaccaccccaaatgcatcccacaaggtgtccttgctcgatgactttgtccacagattggaactcgaattggccaagatccaagcattcaaacgcgaacttcctctctgcatgttcctcttaaatgatgcaatttcagctttgaaggtggaatcagaaaaatgcagggcttgcaagtctgagccagtgtttgaggagttcattcctctgaagaaagagtgtgatcagaggaaggaaattgagaaggagaaggaatgcagggacaagaagaattggatgagttcttttcagctttggaacaatgatgataaagctgataataataacaatgcatatgaatgtgacaaaaaacacaactatagagttgaaaacaagaataatggagaaaaaagaaaatctgtgaccaaggacttgttccaatatggtagaattagaaatggagagaaggggtttgttattcctttttcctcttaccctgcaacaaaggaagaaaaggaagattgtgttgccaatggactttctcttcagacacctggaactgcagtgaaaagcactagggagggatctggttgtagaaccagctcttgcagggtgggttcctccgctccttcaccgctgcatcagccacaaagcagccggaaacaaaggcggtgctggtcaccggagttgcatagccggtttattaaggctttagaggtgcttggaggttctcaagcagctactccaaagcaaattagggaactcatgagggtagatggcctgaccaatgatgaagtaaagagtcatttacaaaaataccggcttcatacacagcgagttccagttgctacagctgcaaattttagtcggtctgctgtagatcttggaggcttgtggatgcacaatgaatccttgaagggtggcagttctggttctcctcaaggccctctccaattagccacacaatcgggggaagcaacatcccaaacagaaggtgacaacatgatagatgatgatgatgagaaattactccaacatcttagatggattttggagtttcatgatttggtggttgacttagttaatagtagtttagatgatttatatttgatatcttgcacttgttgcataccgttgtgccaaaataggaaaggaaagctatcaagtaactcccagttttgctccccagtgttttctaatagttgtgaaggaggttgtgaaattcgtcatccgggtcaggtgcaaatttaccatgctagctag

SEQ ID NO: 9709 - DNA, 516 bp, Glycine max
  Peptide Sequence Number=SeqID_126487
atggctgttaagagcttttatgagctgcctctcccattgacgcatcaaggtggacatgttagtggaaataaaaacttagggctaatggatgaaatatgtaaatccattgctgagaaaggtggtattgatgcaatactcagacgtatagatgacagtggtgaacaaggcaacaaagctgtggccaaagtttgttgctcattactttcaaagttgaatgactcttttagttgtttaattgataagttagcaggaagtgacgcaaacaagagtacaattgttgggaaaggaggattgcaatttagttatagaaattcaaagaatggatggacattagatattatgatagttgttgaaatgtggaaaggctgtaatcagggtttacaagattatgtctattattttggtgacctcgctattcaagcaatggagaaatccagagaacaggcaaattttaatcgtctcgtctctattggatttgtggacttcaatgtacaaactgaggctgaacgaacctaa

SEQ ID NO: 9710 - DNA, 207 bp, Glycine max
  Peptide Sequence Number=SeqID_126488
atgttggtctctgcgcgtcaacgggcttgtttgcccccggttgacgaaaggacgacaaaaggtgcaggagacgatgttagtctctgcgtgtcaacgggctcatttgcccccggtcgacgaaaggtgcgagtaaccataaggacgacaaaaggtgcaggagacgatgttagtctctgcccgtcaacgggctcgtttgtccccggttga

SEQ ID NO: 9711 - DNA, 549 bp, Glycine max
  Peptide Sequence Number=SeqID_126489
atgggatcgagtcaggcgccttggcttaaaaagaggttctatcaggtcatgatcaagagcctaggagttgccagtctgaaagagttaggacagttgatgggtcaactccagcgacaagcctttcgcaaagcctatggtaagatctgggacctaactatggtggaggtctccacggaggccattgcctcccttgcccaatattatgaccagcctttgaggtgcttcacctttggggacttccagttattacccacggtggaagagtttgaagagatcctgggatgccctctgggaggaaggaaatcgaaatgtttggaagcaaaggcaagaaccttggcaagtcaagacgaatgggccccgttcatggatgtcctggcgctcttgatatttggagtggtcctctttccaaatgtggataggttggtggacctggcaatgattgatgcttttctcgcctttcacgaccgcaaggaaagcccggttgtcgctatcttagctgacctatatgacacattcgaccgaagatgtgagaagaacagtgcaaggatt

SEQ ID NO: 9712 - DNA, 237 bp, Glycine max
  Peptide Sequence Number=SeqID_126490
atgacatacgtaaggatcgcacccgcaagacacctagtggacccgaacaagtccaacagggtcctagggtttccagctctgattattggcctctgtcagttccacggagtgcccgtcacccccagcaaggtaatcaggccccctactaatcgagctttcatcaagaagtactgtgcccccaggcaggcgcagggcgaaacacacaacaacctggggatggctagcagcgggcaataa

SEQ ID NO: 9713 - DNA, 414 bp, Glycine max
  Peptide Sequence Number=SeqID_126491
atgcgctccaccttcaccctcttccgatctctcgcgctctctcttccccacctcccatggccgcgcccctttctcttcccgcgcccccgccagttccctcgcctcgccgtgacggcgccggagagtgaggttctccggtcggcggaggcggaggcgagggggccggaggtggagatggaggtgttggagctgagcgcggtgccggaggagtggcggagggcgagggtggcgtggctctgcaaggagctgccagcgcacaaggcggggactctggtgaggatactgaacgcgcagaagaagtggatgaggcaggaagacgccacatatgtcctcgtccactgcctccgcgttcgcgagaacgaaaccgcattcaagggagaagggaagaacttgcgtttatactctggtctctga

SEQ ID NO: 9714 - DNA, 1077 bp, Glycine max
  Peptide Sequence Number=SeqID_126492
atgatgcaacgaaattggtatcgatttgattttgctcttgctaccaagctagcagattacatgggtaaagagcgaaagttttcaaagtgccgtgaggtatttgatgatattatcaatcaaggccgtgttcctagtgagtcaacattccatatattagttgttgcttatcttagtgctcctgttcaaggttgtttggatgaagcatgcagcatttacaatcgtatgattcagttgggtggttaccaaccccgtcttagcttacatagttccctcttcaaagctcttgtaagcaatccggggatcttgtcaaagaattaccttaagcaagctgagtttatatatcatcatttggttacaactggccttgatgtgcataaagaaatttatgggggcctaatttggctgcatagctatcaggattccatagataaagaaaggatagcagaattgagggaagcaatgctacgtgctggatttgaggaggacagagaggtactattatctatcttgagggcttgtgcaagggagggggaggtggatgaagctgaaaaaacttgggtcaaacttctcaagtttgaaagtgaacccccagctctggcttttgtgtataaaatggaagtctactcaaaggttggcatgccgatgaagtcattggatatatttagggaaatgcagtcaaaactaggtagaacagatgttgccgcatataatcaaataatagagatactatgcaaagcacaagaatcagaattggcagaatcaatcatggaagattttgtcaggagtggtctgaagcctgttacgccatcatatgtttatttactaagcatgtacttcactttggaattacatgataaattggaagaggcattctaccagtgcttggagaaatgtcgtccaaattgtactttatacagtatatatctgaattctttggtgaaaataggtaatattgacaaggccgaggatatatttaaccaaatgaatcgtgatgcgactatcggtgttaatgctcgatcatgtaacatcatcttaagtggatacctctcttcgggaaaccacttaaaggcagagaag

SEQ ID NO: 9715 - DNA, 570 bp, Glycine max
  Peptide Sequence Number=SeqID_126493
ggctacacgccctcaccttgggtactagttaccctcaccgttgagaggactacacgtcctcgccttgagaggactacacgtcctcaccatcagagggctgcacgccctcaccatcagaggactgcatgtcctcgccttgagagggctacacgccctcaccttggaggactacacgtcctcaccatcagagggctgcacgccctcacctctagaggactacatgtcctcgccttgagagggctacacaccctcaccttgggtactagttaccctcgccttgggaggactacacgtcctcgccaacagagggctgcacgccctcacctccagaggactacatgtcctcgccttgagagggctacacgccctcaccttggagggctgcacgccctcaccttcagaggactacatgtcctcgccttgagagggctacacgccctcaccttggagggctgcacgccctcacctccagaggactacatgtcctcgcccttgagagggctacacgccctcaccttgggtactagttaccctcgccttgggaggactacacgtcctcgccaacagtag

SEQ ID NO: 9716 - DNA, 741 bp, Glycine max
  Peptide Sequence Number=SeqID_126494
aagctttatcttggcagatattctgatgatgttggtgctcccaaaattgacgatggagatcattggctgtctaatctcatttctttaacccatctttccttgtacaacatatctaatctcaacacttctcatagcttcctccaaatgattgccaagctaccaaaacttagagaactgagattatttgattgtagcctttccgatcattttatcctttcactaaggccctcgaaattcaatttttctagttccctttccatccttgatctttccgtgaacagcttcacgtcatcaatgatactccagaggctgtccaacgtcacttccaaccttgttgagcttgaccttagtgataacctcttggagggttccacatcaaaccattttggccatgtaatgaattctcttgagcacctcgacctctcaagtaatatattcaagggtgaggatttgaaatccttcgcgaatatatgcaccttacattctttgtacatgcgagaaaaccatttgagtgaagaccttccatcaatccttcataatttgtctagtggttgtgttaaacactcattacaagaattggatttgtcagataatcaaatcaccggctctttaactgacctttcagtattctcatctctaaaatcattgtttcttgatggaaatcaattaagtggaaacatacctgaaggcatcagcttaccgtttcatttgaaatttctgtcaatcagatcaaactcatag

SEQ ID NO: 9717 - DNA, 336 bp, Glycine max
  Peptide Sequence Number=SeqID_126495
atggagaagatgaatgtgcacataataacaaaggggacccctaaagaacaagaaaatgacgtagggaatgatcgcgatcacgatttggcaaaaggccaccttggggcagttgcagcttgcccaagtgagctgaaacttaaccctaaagcagcaagccaaatgctggcatgggagagctgggacctagaaaaaacaaggaaaagacccttttgccttcctttcttggtatcttttgtcttcctgatcgaaacaccgaatggttccttgctttgcactataactggcgctcaacactgtaagtcgactagcaaggatcaaaagatcaatgaacaatag

SEQ ID NO: 9718 - DNA, 171 bp, Glycine max
  Peptide Sequence Number=SeqID_126496
atggtggatgtggatgtagttaaagaacaagttccacaaaatcttgaacctaccaagtgtgatggttgggattggtacgagtgggatcatttgtcacaccctctgtttgggcctcttgagaaaatggatgcacgtaaatttgtaaaacgtctaattcagaagcaacattga

SEQ ID NO: 9719 - DNA, 342 bp, Glycine max
  Peptide Sequence Number=SeqID_126497
atgaaggcccaagtggagaaggatgaaggcccagaggcagagacactatcaagactattaattgttgctgaaggcccaagtaatccttgtggcgtctaccctgacttatcttccttcactggaagtggcgtctaccttgacttatcttccttcattggaagtggcgtctacccagacttatcttccttcaccggaagtggcgtctaccctgacttatcttccttcaccggaagtggcgtcatccaaatatccgtagcctgtatcaaacgatacgctcctcgagaggttcacatcacgaaattgaacaacggaagctctcaagaaatttgtgggatcctctag

SEQ ID NO: 9720 - DNA, 1266 bp, Glycine max
  Peptide Sequence Number=SeqID_126498
atggcgtcacgggtgtctgactggtacttcaccaacggcaacacgccacagggcgtacgccagcaggtagacgatatccgcgccaaagccgccgtcaatcagcacgccgttaaaatcggcctgaatggttttgtcatcgcccgcgagagcgaacaggaagcccaggcggtgctgcaggagatcatcgccaaagccaatccggatgcagtgaaaggctttcagcatgaggtgaaaaatgccggcagcgcgtcgccggaaggcgagggcaactgggccaaatcctccttcgaggatctggtgcaatacaacgacggtttcaaaaccaatctgattggcacgccgcagcaaattgctgagcgcatcatggagcagaaacgcgctggcgtggatttactgctgctggcgtttctgcatttccatgaagaggtggagttctttgggcgtgaagttatcccacgcatagcgcggtcgcgtccggccagcagcgccatcgccatttgcagcgcgcttaccgccaacagcatcagcagcgggagctgccagctgccgctgacatcatgcagcatgccgaagcacagcggccccagcgctgccagcccgtaccccacgcactgcgccatgccggaaagtttcgaggcctggcgatggtcccggcagcaggccggtcaccgcgatgaagatcgacagcgaagccagcagcccgatcagacgctgatcgcgcagctgcttcagcgcccgcatacaggccagattggaggcgatcgccacgatttgatagacgaacaacatgccgcccgcctggagctgactaatgccattatcctgtgcgaacggggtaaaccagccaatcagggtataaaacagcagcgactggctggccatgaacagcgaaacctgccagccgatcgcggaacgccacggcgaacgcgttacggtgacctctgtcgcgcgctgctcaagcgtcgcgggatttttcagctgtggcagccacgccagcagcgcgatcagcgccggaatcagccagaccgccagcgacagacgccagccggcgctgctcagttcggccagcggcacggccacgccggaggcgatgctggcggtgatgcccatggtcatggcatacagcccgatataacgcgcggtgtgcgcggtgtaatcccgcttaatcagcggcggcagcaggacgttggccgccgcgatcccgctgctgagaatcagcgtacccagccacagtgccgtttcgctgccgctgattcgcagcagtga

SEQ ID NO: 9721 - DNA, 1227 bp, Glycine max
  Peptide Sequence Number=SeqID_126499
atgttgtgccgcgaactgcccgcggtgctgaaacgcctgcaggtcgatggtgtgattgccgaccaaatggaagcggctggcggtctggtggcagaggcgttacggctaccgttcgtgtcggtggcctgcgcgctgccggtcaatcgcgaagcggccattccgctggcggtaatgccctttcgctttgctcaggatgagaaagcgctgcagcgctatcaggccagcagtgacatctacgaccgcatcatgcgtcgtcatggcgctgtcatcgctcgtcatgcgcgcaccttcggcctgcccgaacgccatggcttacatcagtgtctgtcgccgctggcgcaaatcagtcagctggtgcccgcttttgattttccacgtcagcaactgccagcctgctatcacagcgtcggcccgctgcggactccagtcgctagcggcgcgctcgccgctccctggccagcgctgcgccagccagtggtgtatgcctcacttggcacgctacagggacatcgctttcgcctgtttctgcatctggcccaggcctgccgcaatcagcagctgtcgctggtggtggcacactgtggcgggttgactgccaaccaggcacatcagctcagactggccggtgctgcgtgggtaaccgattttgtggatcagcgggcggcgctgcagcatgcgcaactgtttatcactcacgccggtctgaacagtgcgctggaagcgctggaatgcggcacgccgatgctggcgctgccgatcgccttcgatcagcccggcgtggcggcacgtattgagtggcacggcgtcggccggcgcgcctcacgtttcagccgcgtcgcgcaactggagcaacacctgcaacagttactgagtgacgatcgctatcgtctgcgcatctgcagcccgcacttaaggttttgctactggagagtcaggcgcagccggctggcaatcatacctggtcgttccatcgcgaagacgtcagcgaagcgcagttccgctggctcgaaccgctgctttcggcgcgctggcccggttatcaggtacgcttccccaccctgcgtcgccagctggatggtgaatattgctcgattgcctcggaggattttgcccggcacttgcagcaggtgctcggtgccgcgctacgcaccgcagcgccggtcagcgaggtctcacccaccggggtcagactggcggatggcgggatgttacaggcgcaggcggtga

SEQ ID NO: 9722 - DNA, 237 bp, Glycine max
  Peptide Sequence Number=SeqID_126500
atgacgatgttagtctctgcatgctatcagactctaagtctgacggatagcaaaagagtgtttgtacggataaccgcttggaaatcgttttgtatggataaccacttgggtatctccgcctaccacctgacttctcgggtcaggatagcgaaaggtggggcggtcgacaaaagcgaggcttttgctcctacgtatcctcaatttctgatgaggaactcagacctacgtagttcttga

SEQ ID NO: 9723 - DNA, 831 bp, Glycine max
  Peptide Sequence Number=SeqID_126501
atggcatttctaggagaaactagcagtcagacgattgtcaactcaaggttggctttcatttatccaaatggatcgattattcacaatgatactggggtttacttccaaacttcaactccggtgcccattcgagtaccaaataggtgtgattttgcaagcctaaaaaccagaatacacaatacccttcagctatccgacaaacaatttttggatgaaattcactaccggaagccattcaccgatacaggtaaccaaattcgctttgagtgtatcaaattgataaatgatgacgatgtcaacacaatgttaatgtgtaatgatcaattttcttgtgttggtccgattgagttattatgcaccgttggaagaacacccgatggaataataaacttacttgaacgcactatgcctcgtattcatgacgcgatcctgtattacaatgggaaatggaacatgccaccgcagaacaaatttgttagatgcgcgttcacaggaaaaaatcctaagaaatttcaaattccttcaacatgtaccatcgatgaactgaagaatttaataaagcaagttgcacctaaagggattccccctcttggaattcacgaatcacaaacggtaagacgattgtttttccgccaaccagctcaccttgagtattcagatacgcttataaaatatgatataaatgagctgaggaccaacgaagaactgctgaaggtgttagtacaatctaactactggaaaaaatatggaccaatagaaattttagctgtctttgctaaatatgttgtgacaattgaagatgaggtcactgggacatcgctaaacaactga

SEQ ID NO: 9724 - DNA, 852 bp, Glycine max
  Peptide Sequence Number=SeqID_126502
atgtttgtatcatatgagtggacaaataataaattgtccaaggagaaagccaaagggaaggaagcaacaaaaactatacttatgccagctttatggaataatgtgctctatatacttaaggtgatggctccatttgtgaaggtgttgcgccttgttgacagtgagaaaaaaccagccatgggttatatttatgaggcaaaggagaaaactaaagaagctataattaagtcatttgaatataatgaaagaagtataaggaagtctttgaaattattaacaatgggtggacttgccaacttcatcacaccttgcatgcagctggtggtaaatggattgtgtgtatgcattaaaaaatttgtgcttgatgaagaggtgagacaaaagattcttacaaagctacaagctcataaaatgggtggtgcacaatggtggcgatcatatggattgtcaactccaaatttgcaacagttggcaataaagatttttagattgacatgtagtgcgttgggatgtgaatgcaattggagtgtatttgagcaaaaaaggaatagtcttgaacacaaaagactacacaagttggtgtatgccaagtataatcaagccttggttaaaaaatacaattatagagatgaaattgatccaatttcactcaatgacattgatgaatgcaacgagtggcttgtgggacaaatggatggtgatgatgaaaatgatgatggccttccttgggatgtagttttagaggcttcgggaattggacaaccaatgacatacactaggcaaaggactaaaaagagaaatgaaccccttggtgttgaagatgctgcacctaagacaaaagaggtcaaatga

SEQ ID NO: 9725 - DNA, 1068 bp, Glycine max
  Peptide Sequence Number=SeqID_126503
atgccaatcgaaagatcaatagagtttgctaacaaattccccaaccaaatcttagacaaaacccagttacaaagatttctaggttgtctaaattacgtaggagaatttgtcccctatttaaacaatattgtcaagccattgcatgataggctgaagaaaaatccgcctccttggtctgacctccatacacaaacagttaaagaaatcaaagtcaaagtccaatccattaaatgtatgtatcttcctattccacaggcatttaaaatcgtcgaaactgatgcttcagacataggcatcaggaatctccctaaggggaggaaggagtacaggcaaaggagccagactggctcttccagagccaaccatcaagaaatcatcacctcttctgggtcaccaacccaggctgggtcatctacccaaaaaaccaatttagaagggtcatcaacccagatttcctcaatcaaacctgagccatccactcaggaatctcccaaaccggcaaccgccaaacaaacatcggccgactatgcatggccaactgaaacccttcaggcccttcaagacatgggtctaaccaaatttccaaaaataatcaaaaaatcttgggcagacattgcctcagaatctgatgatgaatctgaatcaaatttacaaacaatgatccaaaatgcgtcaatgatcaaaacagtcaccaatactaaaggaaaactacctttagccaaagctcaaacaccacctaccaaacaaactaacaattatatttataaaaataaatttacaactgttttgcagatggaacctgaattttgggacaaaaatcccttcaaggcaacggccaaggctttcccaccaggatttcactacaaaccaaccaccgtcctaaagacaagaaccttttatgaattgattttggtagattcaaactcagtatctatcaaacatttcaaagacccaaaagaccaaacattaaacacccactcgacaatccaaatactaaaagttcttcaaccaagacactttggttcggacttgaacaaaggaaaaagattctcagttccatttgatccg

SEQ ID NO: 9726 - DNA, 302 bp, Glycine max
  Peptide Sequence Number=SeqID_126504
atgcttagaacagcccccttcagcctttttataggaaaaagggggaggaggttgccgcccagctcgcctgggcgagctgggcggcaacctcctccccctttttcctataaaaaggctgaagggggctgttctaaggatccctcagccccctggctatgtatttcagctgttttgggtgaaaaaaattgtttccgtgaagaaaatccaagtcgaggtgcttccgtaacgcttccgagatgtttccgtaagcaaatccgtgaaggttttcgtccgttcttcatccgttcttcgttcttcaaccg

SEQ ID NO: 9727 - DNA, 123 bp, Glycine max
  Peptide Sequence Number=SeqID_126505
atgaagcactgcatctgcaactacggccacaatccaaggagaaagggtagaaaaagctacagcttttctatgccactctctaagttgtctactgttgccggtcctcacgttttcggagtgtga

SEQ ID NO: 9728 - DNA, 297 bp, Glycine max
  Peptide Sequence Number=SeqID_126506
atgactttttttcccttatcacagcggtttactcatcttggtggtaagcttccaaaaggagttttgcttgctggtccacctggcactggaaacactatggtgaggaatcttttttctgctgcaaggaagcgagcacctgctataatattcattgatgagatagatgttattggaggaaaacgaaatgcaaaggaccaaatgtacatgaagatgacgttaagtcagttacaggttgagctagatggattcatgcaaaatgagggcataattgtgattggcgctactaactttccataa

SEQ ID NO: 9729 - DNA, 714 bp, Glycine max
  Peptide Sequence Number=SeqID_126507
atggctctattagttcttacatctctagcaaacacaaacaacagagacatgagctgcccaatccctcaacaaaatttcaaaggaggggaaagtgaaggttcatttcagtatggtaactactacagagaggctgaagatctgcgagctgtagttcaacacttctgtgagcagaaatatgcaattaaagcaattgttggtcacagtaaagggggtaatgtggtgctcttatatgcctcaaaatataaggatattcatattgtagtcaatatatctggccggttcaatctagcgagaggcatggaaggtcgtttgggcaaaaaatttatacaaaggatcaaacaagatggatatatagatgttaagaataaaagagggaagattatgtaccgtgttactgaagaaagtttgatggaccgcctatctactataacccatcttgcctgcttattgattccccaagattgcagtgtgttgacaattcatggatccatggatgaaattgtacctgcagaagatgctttagagttcgctaagttcatatctaatcatgaattgtgcttcatagaaggagctgatcatgaatatacttatcatcaagatgagttgaccagcttagttttggaattcatcaagattcatattgacaaagacaaagatacatcgaagcaggcacgatttggaagagtacataaacctattcattcccggttgtag

SEQ ID NO: 9730 - DNA, 729 bp, Glycine max
  Peptide Sequence Number=SeqID_126508
atggcatatgacgcctttttcagagttacatgcttctttctttgggctatgattggcaatccattggatacttttgtgtatgagctcacccccatttattttgaagtttacgttctgaaggttgatgatgttgatctaatgatcattgcccgagtaacacctgggttctctggtgctgaccttgcaaacttgattaacattgctgctatcaaggcggcaatggatggtgctaaagctgtgagcatggctgatttagagcatgcaagagacaagatccggatgggaagtgaacgcaagtcagctgtcatatctgaggagtcacggaagttgacagctttccacgagggtggccatgcccttgtggccatacatactgatggggccttccctgttcacaaggcaactgtagttcccagtggaatggctcttggcatggttactcaattgcctgacaaggaccagaccagcatttcccgtaaacagatgcttgctgatcttgatgtttgcatgggagagaacgaagtcacttctggtgcatcctcagatctcagggaagcaactagtctggcaagggagatggttaccgaatatggcatgggcaatgaagttggactagtcactcacgattacgaagatgatggtaggagcatgagctcagagactaggcttcttgttgagaaagaggttttctcagttggaggaactcaactcatgcacctcggagtctag

SEQ ID NO: 9731 - DNA, 270 bp, Glycine max
  Peptide Sequence Number=SeqID_126509
atgaggttcagtctttctaaactcaagttttcaatagcatcagaaagcaatcgtttttcaagaagtccaattgatggatggacatctaataaatttgtgcatcctgaaagatctagcagctcaagttttgggaccctagaaaaatctggagtgtctataagatatttggagttgcccatatccatcattttcagacacgagaacttctgtggagaaaaatggtggccgataattgccgatacagtacacgaaggtcttttagttgcataa

SEQ ID NO: 9732 - DNA, 222 bp, Glycine max
  Peptide Sequence Number=SeqID_126510
atggttgaagatgagattgaaggagacgcaacaaagcagtatagcttgttgtggaggtacaatcagaaccctaatttccaacattatccaactgcctttgttgtggttgagactgagaccaaggactcttggagatggtttcttacatgcatgttggaggacattggtatagaaaaaaagggcctagccaatgtgtgtcaagagatgtttgacaatgtctaa

SEQ ID NO: 9733 - DNA, 571 bp, Glycine max
  Peptide Sequence Number=SeqID_126511
gcatgctcgtccagttatatttggtgactatcctgagagtatgaaatcttcagtgggttctagactacctaaattcacaaaagctcaatctgaaggtctcaaaagttccattgattttcttggtgtaaattattacaccacatattatgcagaaaatgctgcacctactgatttggattggctctatatctatccgaagggaattcatcttcttatggtacacataaaggataaatacaagaatccaaatatttacgtcaatgaaaatggcattgctgaagcaaggaatgactcaataccagtcgatgaagcccttaatgatggtatcaggattagataccttaagagccaccttagactccttcttcaagcgatcaaggaaggtgttaatgtgaagggctactatgcatggtcattttcggacagctttgaatgggatgctggttacacagttcgatttggtcacgtatatgttgattacaacaacaatttgaaaagatacctcaagtcctctgcgttttggctgaaaaagttccttctcaacgacaataataaagtcttatcctattag

SEQ ID NO: 9734 - DNA, 522 bp, Glycine max
  Peptide Sequence Number=SeqID_126512
atgttgcagagtgacataaaattggtgaaagacattgggttggactccttcagattctccatctcttggacaagaatatttcccaaggggaaaggagccgttaatggcttgggggttgaattctacaacaatctcatcgatgaggttctatcaaatgatttaaaaccttttgttactcttttccactgggacttcccacaagctcttgaagatgagtatggaggatttcgtagttctaatgtagtggaggattttcgtaaatatgctgacttttgctacaagacctttggagacagagtgaaacattgggtcactataaatgaacccttatcatatagcatcaatggctataatggtggcacctttgcaccaagtagatgttctaagtacgttgccaattgcagtgctggtgactcatccattgaaccctacattgttggtcactacttattacttgctcacgaggctgctgccacattgtacaagaaaaaatatcaggtttacttcaaacacattttctag

SEQ ID NO: 9735 - DNA, 270 bp, Glycine max
  Peptide Sequence Number=SeqID_126513
atggaccctcttgaaagggaagctcttgaggcggtcatgcttcagtcagtcattgaagcatctcttgtggaagtaaatgatgatatcattgagatagatttgtgcgccgctctcgttcctcttaagccgatatttgataaggaaaatgttgatattgggacttacattcttcatccagagatgcaacaattagagctagaaaagctcaacctcaccaacattgcgaagtatgcgtctaatgttccaaacgatagcaagatagaatcatga

SEQ ID NO: 9736 - DNA, 795 bp, Glycine max
  Peptide Sequence Number=SeqID_126514
atggcgcaatcttcctcaaatggcaccgtggcagccggggaaacagatggtgctccacctgaaactgcaagccgccgtgaaaccagtccatccaaggagagcagtccacaccaagagtccctttggtctgcttctcgaaccaatcgccgccgctcggtggccctagaatctggaagtgagggagttgaaaaagctagaggagacgacgaagaagggcaaatgctggagatcggggtcgaagtcgaggctgttgcatgcaatgtggtgggcgttgtggttccacttccaccagccgatgctgattccggagaggacattgccggagagaatctggattgctctgttgaggcgggggttgagcatgacattcacgtgcacgcacgtgctgtcagagagcaggactccacagagggagagagggaaaaggacgagtataagggagaggaggatggaagtggtgtggcccttgcggttgaagaggttgagagaggagaggtcggagaagagcttgcggtagtcggaggaggcgggggagacggagtggtccgagaggaggtggggggtggcgaaggcggggaggaggagggaggcggagttcggggggtgcaaggcgaggaaggcgtcagtggcgtcggtgccggcgaggctgaggagggggagggggccgccggggtggcggtggagccaggaggagacgtcgtagaccttgccgtggatggagatccaggcgtcgtggcgcgtgttgtgcttgcggagctcatcggaggaaatgtaggatgtgggagggtccattga

SEQ ID NO: 9737 - DNA, 474 bp, Glycine max
  Peptide Sequence Number=SeqID_126515
atggttccaagccggttcccaagaacttggtttgggaggctgttaacactcatggatgaaggggatttgagtggagcttcctgtggttttgctgtcattgatggtttgatggaggtgcattggggattggctaatctccttttggaaatgggtaagaaagaaactactgacacttgtcatatgtggtttagtaatgctcagcacttcatgcttgagaatgaaataccaatgaaaaaactaggaaacaaacttgtgctgagacatggcaacaagcttgtggagtgggacctactggcttgtttgtcttatataagagatgtttacaatggtattagagcctctatgaccaagtgtctagagttcaattcttgctgctcccattattctaacgagaaggaaggtagcctaatgtgtttgctggtatccatgatttatagatcaactagaagttctatgatgtttgttatcagctag

SEQ ID NO: 9738 - DNA, 255 bp, Glycine max
  Peptide Sequence Number=SeqID_126516
atggcaaaggttgcagttgcctttttgttgacaaaggataaagcagattcaggttcagacatagagtctggagcctccctctttagggtggctctaaggtttgaaggtttaatatctaagggtggttgtcttttaggctttttggttaagacaaaagggttaggtttagatgaaggtggattgtcttttcttttggtatattctgggaatttttcaacaatgctcatattcacaaaggtcactcattttaactag

SEQ ID NO: 9739 - DNA, 759 bp, Glycine max
  Peptide Sequence Number=SeqID_126517
atgaatcataaaatcttacatagtgctcgtcaaaaaggacaaattgggatcactaatccaacacactactttttgccaaaatctcaaagtgctgcagattacaaggcagcaagtagagctctggacttcttctttggttggtattctgatccggttttctatggtgactatccggagagtatgaaatcttcagtaggttctaggctcccaaaattcacaaaagctgaatctgaaggtctaaaaaattccatagattttcttggtgtgaattactacaccacttattatgcggaacatgctgaacctgtcagtgccaaccgaaccttctacacagacatactagccagtctcagtagtaagtacttatggcaaaaccaaactgatttgaattggctctttatctttccaaagggaattcatcttcttatggcacacataaaggataaatacaagaatcttcctatttacatcactgaaaatggcatggctgaatcaaggaatgactcaataccagtcaatgaagcccgcaaggatagtataaggattagataccatgatggccatcttaaattccttcttcaagcgatcaaggaaggtgttaatttgaagggctattatgcatggtcattttcggacagttttgaatgggatgctggttacacagttcgattcgggctcatatatgtggattacaagaacaacttgaaaagataccccaagttctctgctttttggttgcaaaagttccttctcaagtga

SEQ ID NO: 9740 - DNA, 273 bp, Glycine max
  Peptide Sequence Number=SeqID_126518
atggagaatgcagacatccctgagaatgccaacgagcattgcccaggtcctcagtctgaatctgctggaaaatccgatgcatgtgaagggtgcccgaatcagcaaatttgtgccactgcccccaaaggccctgaccctgccagggaagtgagcaaatcatttcctccacagtcaagatgtttgcagcactgcattgaagagcattctgcaactgctctgcatccaagtgttttctgccatagctctttatatgtttttctgatttctgtttga

SEQ ID NO: 9741 - DNA, 210 bp, Glycine max
  Peptide Sequence Number=SeqID_126519
atggcgttgcattgcggactctgcaaaaatcgcaatcgcggtgccttacgcgtcacggaatcatattgtgtcgcggatgttgcgtcgttggtttacgacaagcttgaatctaaagagaaattgtgtcgacggcatttacggttctttggtgatgtttatgaaaaatctgaggaatttaaaatactatggaactcaattgttaacaattga

SEQ ID NO: 9742 - DNA, 210 bp, Glycine max
  Peptide Sequence Number=SeqID_126520
atgcacaagggtgaaaagatgaagaataagaaggttgctatggctggtgtctcgctaagcgaggcttgtgcgcttagtgagaatcattcgctaagcaaggcactcagcccgcttagcgagttgggagaatctggaggagaatctgccaagcattctctcacgctaagcgctcctagctcgctcagtggaaaatcacttactcgcgcttag

SEQ ID NO: 9743 - DNA, 195 bp, Glycine max
  Peptide Sequence Number=SeqID_126521
atgtggcaaagaaacctcataggagagtgtctccaaccaaatgaagctgtgcatcaaactgtcagtgtgatatttgaagatcctggtgtccaggagttactggtgaagctatatcagaaagaatggagtgagggacaggttactgagtacttggttgcaacatttggtgactattttggtgatgtaaaaatgtga

SEQ ID NO: 9744 - DNA, 147 bp, Glycine max
  Peptide Sequence Number=SeqID_126522
atgagagagagttgggaggattctcctgacagatcagcttggtatgggcaagttagtatcactgctgtcaacggcaaatggagccccacggcagaggccaaacagccaccatcgtgtaatggtggattgtgcagcggtcaagattga

SEQ ID NO: 9745 - DNA, 183 bp, Glycine max
  Peptide Sequence Number=SeqID_126523
atgatagatggaggtgttgacgccaaaagggtggtggcagcagaggaggtggagacggcggaagggtttgaactttggatattgcttacacagagaaaaggagtggtgcagcagatcaagaatcagaagtgtcaaatgcttacgaagggagaagagcctgttgaattgaggagaccacggtaa

SEQ ID NO: 9746 - DNA, 216 bp, Glycine max
  Peptide Sequence Number=SeqID_126524
atggtgcgaaacagtggaaggaaaacttggtggtcgattcatatgctcgttcggtgcaactcgcaacacagttacaaggtccgtgtagggttaaaggttcttactgatttaagtggtcaatgtaggctttcaaggaattttattgagatcaaacgagcttgtggcaaaagaacttcggggatgtggattcatgcatatctggctccagcagcatga

SEQ ID NO: 9747 - DNA, 177 bp, Glycine max
  Peptide Sequence Number=SeqID_126525
atggagctaagtaatagcaccatagaagcccttccacagaactacgctgagcagtataaacgagagatttttattgatgaaagaaaggatgatgagcctaagctctatagccgccccaccattcagccatggcaactctatagcagacatttgccaacactactaatagctgcctaa

SEQ ID NO: 9748 - DNA, 210 bp, Glycine max
  Peptide Sequence Number=SeqID_126526
aaggtgtcgtcatctgaagaagaccctgaggaggacccaaaggagatacctcctgagcctgctgtggatgctcttgactttccaaaaggtgatgaggacccactccctgaggtagattctccagaggacgtcatgtcggcatctgaggcagactctacggaggagagcggccctggagggatagcgactagtggaggctcttcatcatag

SEQ ID NO: 9749 - DNA, 846 bp, Glycine max
  Peptide Sequence Number=SeqID_126527
atgtcatctgaagggtattttgtgcaacctactattccacgctttgatgatcactatgaccattggagcatgttgatggagaatttcctgcagtctaaagagtattggcatatttttgaaagtggtgttgaaacatctaatgctgatgtagcactcacagaaacacaacaaaaggagttggagggactgaagttgaaagatttaaaggtaaaaaattacttgttccaggtcattgatcgctctatcttggaaacaattctttgcaaagaaacttccaaagatatttgggattcaatcaagaaaaaatatgaaggctctaatagaataaagcgtgcacagcttcaagccttgagaaaggaatttgaaatgctacacatgaagaatgatgaatcgagttctttgctggctcatgagcagaagatgaatcaagatacaattatagaagagcaagctttgaaggcatctacctcttcaagaggcagaggtaaaggcatagagagaagtggtagaggcagaggacggggaaatcaaaacaacaatagtggaaggggagatcaaaacaacaacggtggcagaggtcaccgggtttccacaaaactgcccaagtttggtcagggcatcccaggtcaagtgcatgagcagccaaatagtgaaaccggcccggttatgccatcggatctcggttggatctatccgactggccgagccaaaccggacggtgacaagacaccaaaaacccagcaagaaaaaccaccacagggagcatgcatccaccacacttggaacgtctatcatggggacctcgaaaatgagagtcccacaaccatggtggaccttctgcgttag

SEQ ID NO: 9750 - DNA, 384 bp, Glycine max
  Peptide Sequence Number=SeqID_126528
atgtttctcaaagacaaagaccatgagcgtaaccatgaacggagagagaaagaagtggagaatgcagcaatccccgagaagccactgaagcatgtgaaggaaacatttcattcgaaactcgactccaagttatacaagagaaaggcagaaaaaagatacaacaacagagtcaaaccaagaagcttcctaacaagtgacttagtgttaagaaaatatggaggatctgaaaaagatcccagcgaaggcaaactagcagcaacctgggaaggaccctttagagataccaaagtactcgaaaatgaggcatatcaactagagcacttatctgacaaagcaattccaagaacttggaacatcactcatctcaagttttattatagttaa

SEQ ID NO: 9751 - DNA, 363 bp, Glycine max
  Peptide Sequence Number=SeqID_126529
atgacccatgcagcatgcatccaggttgcactgattctgccaatgggcctggcgtttttgctcattgataccaccagtaggactggcgtgttccaaattgtagaggaaatagggattcagcgcagtgtagcaggggttcatgcatgctgtatgctttgtagtttttgtagggtttcagtattaatggtttcttcttcgtcatgttcgtcaaatatgtcaattaattctggctgcgttgatggtgacctgttgtggatgcaagataagcatgtttcacaacatatttggaatgaggaagaagataaaaaactgcatattagaagagttgtccccacatatcaaggtcaagaagaaataccataa

SEQ ID NO: 9752 - DNA, 366 bp, Glycine max
  Peptide Sequence Number=SeqID_126530
atgccgcggttcaggggaatcgcgatcccactggttggaaaatcgcggcggtttctgctgtcggacgccgacgttttcgcggcggcgaaggcgttcgcggcgggggtgattttggcgacggggttcgtgcacatgctgagggactcgtgggatgcgcttaaggatccgtgcttggggacagactcgcgcgcgtgggcgaagtttcccttcaccggtttcttcgccatggtgtcgacgttgttcactcttttcgttgactttgtggcgacggaatattacgagtacagagaggcgcgtggacgcgtggagcatgggaaggttgttgattatgagggtagtgacgaggcgacgttgttggaaacgtga

SEQ ID NO: 9753 - DNA, 747 bp, Glycine max
  Peptide Sequence Number=SeqID_126531
atgatattgcatgatggatcatcaagcaactgcaactcgtccttcaatatttcacctgagacagtagttatggttgatccattaagcagcgcatgtgatcggcgtaatttaccatctgaggaagagagcaaaaataacgatcacgggtctgggaacaaatggatgtcttcaaagatgaggttaatgaaaaaaatgatgagaccgagtatcagtccaaccactgacaaagcaatcaattcaagcccaagattccaaaatcatcaagggctcgaaagcagaaggtacagccaaagaagccctcgtaacaacaacggcagtagcacccctagggtttgttcggattgcaatacaagcactaccccactttggaggactggccctaagggtcccaagtctctttgcaatgcctgtggcattagacagaggaaggcaagaagggcaatggcggaagctgcaaatggtttggtcactcccatagcatgtgaaaagaccagactacacaacaaggaaaagaagtctcgtatgaaccattttgcacagttcaagaacaagtacaagtccactactactactactactactactgtaggctcatctgagggagtgaggaagcttgaatatttcaacaacttcgccataagtttgaggagtaacaactctgattttgaacaaatgtttccacgggatgaagtagctgaggcggcattgcttctgatggacttatcttgtggttttgtccacttataa

SEQ ID NO: 9754 - DNA, 2424 bp, Glycine max
  Peptide Sequence Number=SeqID_126532
atgagggaagaaaacccatcagaaaacaggtccaaagcttcaaaattttctgaccaaaaccaagccccaaagcctcaaaacaccaaaggagccaaccccaacaacaactccagaacgaggttgtggggtgctcacattgtgaaaggcttttccgctgacaaaaaaaccaaaccacttgccagcaaaaaactaacatcttcaacaacaacaacaatctcggagaatgttgttacaaaccagaacaacaacaaaccttttgtgccttcttccaactcccgagtgaaaaggtccctcataggcgacttatcatgttctatcaaccctgctcaggttcatccacacgctttcccaactcatagaagacaatcttccactgatttgttcactgagttggatcacatgagagggttgctgcaagagtcaaaggagagggaaagcaagctgaatgctgagcttgcagagtgtaggaagaaagtgagtgaggtggatgaggttatgaagagggttgatttgttggagcaagagaaggccattctcactgagcaattgggtgcattgacttgtgaggaagtgaaaggggaagaagaacaacacaaggaggtgaaagtgcagaatcttgagctggaggttgtggagttgaggaggttgaataaggagctgcagatgcagaagaggaacctctcttgcaggctctcttctcttgatgctcagctggcttgtcctaacaaatcttctgagattttaaattttagaaacagtcccaatgtgtggggttcagagtttggtgcagctgtggtttttgtgttggtagctgattcgtgtggactgagtgacgttgttgccaaaattaaagccgaggcatcattgctgaggctcactaatgaagacctgtgcaaacaagtagaaggtttgcagataagcagattgaatgaggttgaggagcttgcctacttgaggtgggtgaattcatgtttaagaaacgagttgaagaacacatgctcagcattgaattcagataagccatctagccctcattcagtagtgagcagtagtggagattgtgttagttctttctctgatcaagccactaggtattcaaattgtggaagtgaaaataggttcaatatggtgaagaagccaaaaaagtggcctataactagtgatcatttatcacaagtagagttccaaggtagtctcataaggaagaattggattgaatcagatgtagggggaagccccagaagaagacactctatcagtggatcaaactactcagaggaagaggttgttttgagtaagagaagacagtctgattgttttgtgtgttcaaaagaaatggaaaaggaatcagtgccattgtctgttcaacaatctggtttggagattgtccaaagaccacaacattttggcaatttccaagaagctaacaagcttttggtttcttcagatgtggagaaaagagccctacgcattcctaatccccctccaaggccttcatgttctatatctagcaagacaaaacaagaaacttcagctcaagttccacctcctccacctccacctcccccaccacctcctatgaattctgcatcaagaagtaacacgacaatggtgaaacgagagccacaagtggtggaattgtaccattcacttatgaagagagactcaaggaaggattcttcaaatggaggactctctgatgcaccagatgttgctgatgttcgtagcagcatgattggagaaattgaaaaccgttcatcacatttgcttgccataaaggcagatattgagactcagggagaatttgtgaattcattgattagagaggtgaacaatgcagtttatcagaacatagatgatgtagtggcatttgtgaagtggctggatgatgaactttgcttccttgtggatgagagggctgtccttaagcattttgattggccagagaagaaagctgacacattaagagaagcagcatttggctatcaagatttgaaaaaattagaatctgaagtttcctcctacaaggatgatcccaggctaccttgtgacattgttctaaagaaaatggttgcattgtcagaaaagatggagcgtacagtatataaccttcttcgcacaagagatttattaatgcgtcactgcaaggagtttaaaattccaatagaatggatgcttgataatggaattattggcaagataaagctaagctcagttaaattggctaaaaagtatatgaaaagggttgctgtggaacttcaagcaaagtcagcattagaaaaagatcctgcaatggattacatgcttctccaaggagtgagatttgcttttagaatccatcagtttgcaggaggatttgatgcagaaacaatgcatgcatttgaggagcttcgcaatctagcttctctacttaacaaaacatga

SEQ ID NO: 9755 - DNA, 492 bp, Glycine max
  Peptide Sequence Number=SeqID_126533
atggcatctagcagaggtatgttcacctctacttttctgaaggtcttcaagatctccttttccgcttcttccatcttcttgtttggaattgctctaggtgggaaaggaagagggataagaggctattactctgaatggaggctcttgtctcttgctgaaattgcatattctggatggtcatttgtctcactaactcttctaaggaaggtagaagaggagcctcagttgcttgttgtctttgttgtgactgatgctattgttgttgctgtattggaggaggaacatatggcttgcttggaccagcagcattctggaaaggaggaacagactgttgttgttgtggaggacttgtccatctcaaatttggatgattcctccaacctggattgtatctattgcttgaaaggtcataattattctgctattgttggttttgctgctgaggaggtctattataaatgtttgcagcataagcttcatgttgctcattga

SEQ ID NO: 9756 - DNA, 1119 bp, Glycine max
  Peptide Sequence Number=SeqID_126534
atgaagcacctgctgagaaagcttcacatcggtggtggcgctgccaccatcaaccccagtcccaatcacaacgcattgtcgtcgcacgctcacaatcacactccccctccctccacttccacgctcccttctccctccgtcgtttcggatcggagccccgtcgtcgtcgaggcgcaaaacgaggtcgccgatttcaatttgttgcaggaggaggagtttcagatgcaactcgcgctcgcaatcagcgcctccgattccgatcgccgcgacaccgccgaatcggcccagatcgacgccgccaaacagatcagcctcggttactctgcttccctcactgacactcatgccctcgttcagtttcaatcccttcgatattggaactacaatgtgattggctatgatgagaaagtgatggatgggttttatgatgtttatggagttacctcgaatttggttgagcgggggaagatgccgttgttggtggatctgcagacggcttctgtctcgggagatgttgattgtgaggtgattttggtgaaccatgtggttgatcttgagctcaatcatcttgagaggaaggcgtgtagtttggttgaggagtgttgtgtttctgaactgggactggttttgagtggcttgcttcagaagcttgcagatgttgttgttaatagaatgggtggaccggttgttaatgctgagaaacttacaaagatgtgggctatgaggggtcgtgagttacgggattctatgcagaccattgtccttccccttggctgtcttgatgtcggactttcacgtcaccgagccctactttttaaggtacttgctgataggattaacattccctgcatgctggtaaaagggagctattatactggaactgacgatggtgctgtgaatttgattaaagcagatgatggaagttggtatatatgttctattgagttagaaactctgcattgcacgtttacacttcatcatcatggtgatccagacttcagaggcagggtttccaaaatcaattttacttcactctttccattttttttacttctgctgctttgtaaaactctgcgtctcctatgtgatgaggaagctggtccacctttgtgtaattaa

SEQ ID NO: 9757 - DNA, 426 bp, Glycine max
  misc_feature (382)..(382): n is a, c, g, or t
  Peptide Sequence Number=SeqID_126535
atgacctgccctcttgatgagtcgatctcttgctttcacataaaggtggacccttgggtactagtacctatcacctttagaggactatatgtcctcgccatcagaggactacacatcctcgcctgcagagggttgcacgccctcgcctttagaggactacgcgtcctcattttcagtgtgctctatatccacaccttaggagaatataagcaatattctgcccagcgaccacaatgccaatctccccctgcaaatgtatcagttggtctgtgccgtcatgacataggtaaggatcacgcccacaagacgcccagtggaccaaaagaagtccaacagggccctggggtttccagctttggttacgggcctctgtcaatcctancagggtgcccgtccccccagcgagttcatgccatcgtgacatag

SEQ ID NO: 9758 - DNA, 216 bp, Glycine max
  Peptide Sequence Number=SeqID_126536
atgtcgaactgtgaaatctggctgactcgtcagggtatcctggatttgccgcaagaagtcatggaacttgtggttatcatggaaggaataacaaagatgttccaaaaagcccagaagcttcaagagatagtgttgttgttctggtgtttggatgacctaagacatgaggtctttaaggctcttgtgatcagtaagaatgataaaaggatagcctag

SEQ ID NO: 9759 - DNA, 525 bp, Glycine max
  Peptide Sequence Number=SeqID_126537
atggtggtcaatcgcttcactaaaggtgctcacttcggtgctttaccgtcaacatacacaacccacaaagtagccttgcttttcatggatattgtctgcaagtttcatggattccctcgaagcttagtctcagatcacgacctgtggttcaccttcctctccctcgttgaatggtcctacaacactgttgtccacttcgccactggtatgtccctattcgaagccacatatggcgaaacccctccttcgatacctaagtatttggatggttcttcccaagtcaaggccgtggatgttataatgtcgacaagagcccaacttcatttcgacctccaacgtcatttatctaaggcccaagatgcaatgaaaaggcttgcagattcgcatcatcatgaagttgtttatgttgtcggcaccctgggtgtttgtgcggcttcgcccatattgccaaatcctctcttagacccttttacactaaactctccaaacctttttatggccattttcgcatttaggagcgtgtag

SEQ ID NO: 9760 - DNA, 321 bp, Glycine max
  Peptide Sequence Number=SeqID_126538
atggtagctagcgatggcacgagcagtggctggtggcagcgtgactggaggtgccaacgatggtcagtggctgggttggtggtgacagaaaggagaacaagaggagtcaaccatagaagcaagggtttacagaaagagttcgcgactacgaaacgtcaacgacaagtcccaacaccgctacctccactcagtttttcgtgctctatgcaatggagcgagtggaatcgcattttggggagtgaggaagtcatagtgatagatccacaaggaatgtatagaagaaactatagtgggttgtgtgaaaacgcagagggatgttga

SEQ ID NO: 9761 - DNA, 663 bp, Glycine max
  Peptide Sequence Number=SeqID_126539
atgtcatcaaagaagactaccacaaatttactaagatacaactttagcaaatcgttcatggtggctcagaagccatgcggatttggtggaacccttgttggaagtccagttttgagaaacaagaagcgttacccaattcatccaagagtttatcgatggcttgagtggggaaaatgtggatgtggtgggatatgggacacgagggaggtagttcagtcgattcttgaaaaaggtggtcataacgagagagaatatggagagtcaaaactccttgagtttgcgctagacgctgaacttggtgggctgaagctaggggcaaacacgacggtagataagagtaccaccatcgccaaccatgacctgaaggggattaatggcagtggtcgaaagagccaggaaattcgcagcccaagcttgcaccaaattgtgggtactcccaccatttaccagtatcataacttggtgatgattaatgttcccataaatgcgaaaaggtgtcgaggcaagcatgttaaacatcgtgttaaggctgagttgaggggcgatgaaaagatggaggcgaggtttacatctatggccaattacccatttatcatcgcagtgataacagaggcctctgtctctacgattggccaattcttcggctcaaagactttagactga

SEQ ID NO: 9762 - DNA, 339 bp, Glycine max
  Peptide Sequence Number=SeqID_126540
atggggggtcacggttcaagagaaggaaaaagaagaaaatgggttaatgttaatagttgtgttgctgccatggagtttcaagggaggaataagatccaaattggtcttatttcatggttgtggagaagcagtgacgacgagggagggggtgacaacactggcagtgtggagatgatgcaggagttgatcagggacttgtggggatggtttgaagggttttggagaagcaacaatggcagtgtgaagttggtggaggagttggtcaaggaccggtggggtggtttagggggttttggagaagtagcaatagcgacatcgttttttctttttcttttttaa

SEQ ID NO: 9763 - DNA, 813 bp, Glycine max
  Peptide Sequence Number=SeqID_126541
atgaaaaaggctgccgtttttctgttatccttatcaccctattttttgctatgggcacagagacagaatctggatgatggaaagatgaatgaaatccaggtgatcggctcccataacagctataagaaagcaatccttcctgaggtgtatgattttctggcaaaaaaagattcattacattccctacctaaaattcaatacgagcatatcgcgatcccggaacagttggatttaggattacggaacctagaacttgatgtgtatgcagacagcaaaggcggaaaatatgcccacccgaaaattttagatcttgtcaaaacaaaacaaccttttgatccggaagggaaaatgaaaaagccgggatacaaaatgatccatattacggatattgattatcagacctggtattacacacttgaagagtgtttaaaggatcttaaaaaatggtccgacgcacaccctgatcacgaccctatattcattaccctggaacctaaagatggcagagccaacacattcggaaccgaaccggagcactatacaagccaattattcgatgaccttgataacgagctcaaaaagtacctcggtaaaaacaagatcatcaccccggatgatattcgcggatcctataccacactgaacgaagcagtccttcacaagaactggccgaccgtaaaaaatgccaaaggaaagtttctttttgtgctggataacaacggagaaaacagggatctctatatcaagggacacgcttctttatcgggaaggatgatattcactaattcagtacccggaaccccggaagcagca

SEQ ID NO: 9764 - DNA, 426 bp, Glycine max
  Peptide Sequence Number=SeqID_126542
atggatatctctaaagatactgacatccctgtaatcatggggaggccgttcatgttgactgcaagctgcatagttgacatggggaagaggaagttggagttaggttttgaagaccagaaaattgattttgacttgtttgttgaagacaagcttgctccagaacacaatgtttgcttgtgggtaatgggagaaggtcaagaggttctgaaggtgagaaacaaaacgggggccagaagaccaagggcaaggccagttgaggttccttctacatcagcagctcctcatccaacttctacatcggcagttcctcctccagcacgtatgacaacgactccttctaccctacctcttgtagattttcaacgtttcgaggccatgcttcggagcatacatcaggggcagagtattttactgcaaagcctatag

SEQ ID NO: 9765 - DNA, 315 bp, Glycine max
  Peptide Sequence Number=SeqID_126543
atggaagaacaagaaagtgataggtggatcctgtcagtaaaattgattttgataaggggtggttggtttttggaattggtggtatcgaagccaaggaagtcagagaaagggtcaagctcagaccatagttcctgcgcggcgaggttgcggccacgcttcacaccaatgaagtctgagatgatagcacctccacacatagtttttcggttgcttatggcttacactgtcccgggtccacctaagaggctgattgatcagacggtggagagtgaggggcttggtgacgtggcgggttttggttggttgggaggttaa

SEQ ID NO: 9766 - DNA, 2904 bp, Glycine max
  Peptide Sequence Number=SeqID_126544
atggcgacggagcagttaatgtcctccgccggcggcggcagctctcgctacgtccaaatgaaatcgtctccgccgccgtcgccgccggccgcggcggccgaggagatttcctcggtcccgtcgttccggcacagcggcgccgaggccaatcggattttcgaggaattgcccaaagccgccatcgtctccgtctctcggcccgacgccagcgacatcagccctatgcaactctcttacacaattcaggttcagtacaaacagtttccccgaacaaaagtttctgcttttgcgaatttgcttttggccttcaccagctttttagttgttagagttgaaagtgtgtccttccttcctacaggagggtacttatatgtctcctttgcattccagttcaagtgggagctaacaaagaaagcccatcaagtatttattttgcatttcgcgctaaagaaacgtgcttttattgaggaaatccacgagaaacaagagcaggttaaagaatggcttcaaaatctaggaattggagaacacactgctatggcgcaagatgacgacgaaggtgatgatgagactgtcccgttgcatactgaagaaactcatgaaagtgccaaggacagagatgttccatctagtgctgctctgccaattatacggccagccttgggaagacagcattctattgcagacagggcaaagagagcaatgcaaggatatctgaatcactttttgggaaatatcagtattgtgaactctcgtgaggtttgcaagttcttggaggtatcgaagttatctttttcacctgaatatggtcctaagctgaaggaagaatacgtgatggtgaagcatctacccaaaatccagaaggatgatgattccaggaagtgttgtttgtctgactgttttagttgctgtaatgacaactggcaaaaggtatgggctgtactgaaacctggattcttggcattgctggcagatcctttcgatacacagcctctagacatcattgtttttgatgtactgcctgcctcagatgggaatggggatggtcgactatcgctggcgagtgaaatgaaggaacgaaatcctttacgtcattcattcaaggtgacttgtggaatccggagcatcagaattagagtgaaaagtagtagtaaagttaaagattgggttgctgcaattaacgatgctggactcaggcctcctgaaggctggtgtcatcctcaccgttatggttcatttgctcctccaagaggcctagttgaagacggaagtcaagcccagtggttcattgatgggcgagcagcatttgaggccattgctttttcaattgaggctgcaaaatcagagatatttatctgtgggtggtggctgtgcccagaactgtatctacggcgacctttccacactcatgcttcgtcaaggcttgataatttgctggaagcaaaagctaagcaaggggttcagtacagtccttacaataatcaagtagttacaaagatttacattcttctctacaaagaggtggctcttgctttgaaaatcaacagtgtttatagcaagaaaaagcttcttagcattcatgagaatgtgagggtattacgctatcctgaccacttttctactggtgtttacctgtggtcgcatcatgaaaaactagtcattattgataaccatatttgctttattggaggacttgatttgtgctttggtcgttatgacacatctgagcataaagtgggagatttccctcctctaacctggcctggaaaagactattataacccaagagaatctgaaccaaattcatgggaagatacaatgaaagatgaattagaacgtgaaaaatatcctcgtatgccttggcatgatgttcattgtgccctttggggaccaccttgccgtgacattgctaggcactttgttcagcgatggaattatgccaagaggaacaaagctccatatgagcaagcaattccattacttatgcctcagcatcatatggttattccacattacttgggaagaagcagagagatacagattgaaagtaggaacactgacaatcatagagttctcaagagagaagattcattttcctcatcttcccaagaccaagatattcctctacttttgcctcaggagcctgatgggttggatactcatgaaggagaccaaaaattgaatggggtaatctccttttcacatcaccttgacaagccaagaaggatcagcagtggtcttccgttctcgttccggaaggccaaaattgtagcagttggtccagatacaccaatgaagggctttgtagatgatctagattctgagcatggtcttgagaaaatgtctctggatagagtggctcattttgatttacaaagtacaaagccacaatggtgggaaacgcaagaacggggtgaccaaggaggttttgctgaagaatcaggacaagttggtcctcttgcttcctgccgttgccaagttattaggagtgtgagtcaatggtctgctggaacaagtcaaaccgaagagagcatccacaatgcttattgctctcttattgagaaagctgaatacttcatctacattgagggtggtcttgatgatagcggtgcagcatccgtgagggccataatgcattggcagtatcgaaccatttgccgggggcagaattctatcttgcataatctttatgaacttcttggttctaaaatacatgactacatctctttttatggcctaaggtcttacggtagactctctaatggtggccctgtggcaaccagccaggtgtatgttcacagtaaaatcatgattgttgatgattgtattactttgattggatctgctaatattaatgataggagcttacttggctccagagattctgagaaacaagttagttga

SEQ ID NO: 9767 - DNA, 765 bp, Glycine max
  Peptide Sequence Number=SeqID_126545
atggttctttttccatctcttgtcaatggattggcaagaactgtgtccttgaagaaagacaagaattgtagaaaggatggtggaaggaaagttttggaagcattggcaaaggaagcaaggaaaaatgaactattactgacttcatctggaattgttaagtcttccaaggccaacaatgttgcctctgtgttcactaagaagggccacaaaagattcaatcaagatggctttattgtttgggagaaagaaattttttctagacttttagaaaatgttgtgaaaatagacaatccaaatgcatttcctattgatgttgatagaagaattggtagtatgaaagttcttattgttctcgatgatgttaatgattcagatcacctacaaaaattactgagaactccttataagtttggattaggtagtagaataattgtaacaaccagatacgtgcaagtgcttaacgctaacaaagctaacgagacaaaccagcttggagagttcagtttagataaagcccttgaacttttcaatttgaatgcctttaagcaaagtgatcatcaatgggagtacgatgaactatcaaaaagggtggtcaattatgccaaaggcaatccattagttcttaaagtcttggctcaacttctttgtggaaaaaataaggaagaatgggaaggtatgctagacacgcttaaaagaatgcctcctgcagatgtttataaagtaatgaaactgagttacgatgaactagatcgcaaaaagcaatag

SEQ ID NO: 9768 - DNA, 702 bp, Glycine max
  Peptide Sequence Number=SeqID_126546
atgaaagaacatggatacttattacctgagttaccatgtctttctggagatgagatgatacggaatcgtgtgttagaagctttatatcgacggattatgcgagcttacaatgacaaaaaatctttcagggttatagttgtcatacctctcctgcctggcttccagggcggtcttgatgatagtggtgcagcatctgtgagagccataatgcattggcagtatcgaaccatttgccgagggcagaattctatcatgcataatctttatgaacttcttggttctaaaatacatgactacatctctttttatggcctaaggtcttatggtagactctctaatggtggccctgtggcaaccagccaggtgtatgttcacagtaaaatcatgattgttgatgattgtattactttgattggatctgctaatattaatgataggagcttacttggctccagagattctgagattggtatagttttagaagacagagagtttattggttcttatatggatggaaagccttggaaagcaggaaagttttccttgaccctccgattgtcattatggtctgaacacttgggtctccctataggagaggtcaatcaaataatggacccagtcgttgaatctacttacagggatatttggatggcaacagcaaaggcttcttttcttttcatttttgttattttggccaagtaa

SEQ ID NO: 9769 - DNA, 510 bp, Glycine max
  Peptide Sequence Number=SeqID_126547
atggtgttacgatcttcatccaaagaaatttctacactgccgcagcagatgtttaaaggatttgggatcagcctaatgaacaccttgagatgtagcagttgcaaacaacaaatggaattgcatgactccatgtcaaaaggtccttttcagggagttctaaaacataataaagattgtgcaccagattttggttgtcagagtccagagccattccgaaagatcaataaaagaaacaataaatttagaatatgggatgaacatctcactaaagcaaatattgacgactctagggctgttttgccaacaacttcagaagatggcaccttgactcctcttcagcttaccactgacttgaagccatatttaccaagtctacgttctctcttacacactcacaacataagaagtgtatgggatgctatttccaaccaagaagcagtgaaaattgtaggtttgacgccacataaggaaaaaagcaactcaaaggatggtgaaatgcgccatgggtga

SEQ ID NO: 9770 - DNA, 2142 bp, Glycine max
  Peptide Sequence Number=SeqID_126548
atggcgacggcggccggcgcggcggtgatgctctactacgtgttgagccggcggctggcgcggaaggaggaggacgaaggcgaggatcacggcggcgaggctccggcgacgctgctggaatcaatcgtgacgctgtcagagactttaaggttcacttattccgagactctcgggaagtggcccatcggcgatttggccttcggcatcaactacttcatgcgcaagcagggtaatttagctgttgcaagtgtgtatgctgggagtgattgtgtgcagctcaaaggggatgagataattgtggagctctatgagttgttgaggcttttaactttgtgtatgcttttctccaagaagccatttcctgtgtttttagattctgctgggttttcccttgatgatgtgctcattcagaagccaaaagctgggcttctgaagcctgcatttaccattatacgtgatacacaatcaaaatgtttacttctattgatccggggtactcatagcataaaagacacactgacagctgcaactggtgctgttgtccccttccaccattcagtgttaaatgatggtgggataagcaacttggttttaggatatgcacactgcggtatggttgctgcagctcgttggattgcaaagctctgcactcctaccctacttaaggctcttggtgaatgtccacacttcaaagtcaagattgttgggcactcacttggtggtggtactgctgcactgttaacatatattcttagagagcagaaagagttctcttcaagcacgtgcgtcacatttgccccaggcatttcactgaactttcttggtggtgatatgagatttccaattactctacttcagcatattattattgtcaaggatgtactatatcaatgtagcttgtaccttgctgcttgcatgacatgggagttagcagaatcaggaaaacactttatcactaccatcatcaatggttctgacttggtgccaacattctcaacttcatctattgatgatctccgttctgaggtcactgcatcctcttggttgaatgatctacgggatcaggttgaacatacaaaggtcctgaatgttgtttaccgctctgcaactgcacttgggtctcgcttaccatctatatctagtgcaaaagctagggtagctggtgctggtgctattctgtggccagtaaccagtggcactcaggttgtgatgaagcgtgcacaaagtgttgctgaagctgttgtcagaactcgctcatcattgtcatcatggtcttgcatgagtgcccggcgtcgaaatgtgggtccatcagtaaactctaaaactgaggacttaactgaaacctctctaatatccgagagaagcactgattctcacatgactgaagaggtagtaagagaacctatgcttaaggacgaaagtacttcctcaagtggaggatctggccatgatgacactgatgaagaggaacaactcattcctgctaatgaagacattactgcgtctgccgttgacgacttcacagaaggccagttatggtatgaactggagaaggagcttcagagacaggataatactatgaacattgatgctcaagaagaggctgcagcagcaaaagagatcacagaagaagagaatcaactggttgatgctgctgcagaatgcagttgcagttcaatcacaacatcagacaacttggacagccatcgattttatccccctggcaggatcatgcacattgtctccgtacctttgtcggatgagtcaaattcaaatcctgatgaccctttagaagaacatgtcggcttatatgaaacacctagagagctgtacagcaaactcagactttcaagaaccatgatcaatgatcattacatgccaatgtataagaagatgatggaactattaatccgagaactagagaaagaaggcagctccgaagccgcagatggagatgtggccgtcgtgagagaagagagatttgcgttggactcatcgctgagttcggtgaccggagtgggtggtgatgatcggagagcggcggaggacatggcgggggatgcttatggaggtagtgttggtggctgctgctcattgcggattcgagacgcagcgataagtattactactccaaggagttag

SEQ ID NO: 9771 - DNA, 309 bp, Glycine max
  Peptide Sequence Number=SeqID_126549
atggccaaagatggaacttacttttcaatattcatccgcattatactgaagccattgccaccgcccaatcacacccctcaaacaacagtgtatagtttggcaagtgggcaattgttattggaaatctatgaaaagtatgaagctctgttgtcatcatgctgccacgtggcttgcaaatcaacgactggggtctccatagtccataagcaagtgtccgcgaaatctttctgcaacgtgtcaactgctgatacaatccaactatccaagtcaagaccctcaattattgatgcatcgttacacaaatactag

SEQ ID NO: 9772 - DNA, 372 bp, Glycine max
  Peptide Sequence Number=SeqID_126550
atggagatggctagatcaatgctaaaggaaaaaggtttgcctaatacgttttgggcagaagcaatatacactaattgggaagcaaaaaatgttgcaaaaagcaatattcatgttttagtgcaacaatatcaagaagaggttcaagaagtagcaaaagaagcaagtatgcttttgtcacctctacaacaacaagattcttcatcagagtctactccaagtcgagtaagatctttggtggatatttatgaatcttgcaacacaactatgattgatcctaaatgctatgaagaatcctcaaagaagcaaaggcaactaagaaaatcaaactcgagtactacaagagagaagcccaagatgcaaacacttttatga

SEQ ID NO: 9773 - DNA, 781 bp, Glycine max
  Peptide Sequence Number=SeqID_126551
atgtcgtcgtcgaattcgccgtgtgcggcgtgcaagattcagcgtcggaagtgcacgcaggagtgtgttttcgcgccgtattttccgccggacaatccgcagcggttcgcgtacgtgcacaaggtgttcggggcgagcaacgtggccaagctactcaacgagcttaacgcggcgcagcgcgaagacgcgattaagtccttagcatacgaggcagaagcgcgtttgcgggacccggtgtatggctgcgtgggtctgatctccatcctccagcacagactcaaacagctgcagagcgaactccaccgcgccaaaaaggaactcgcttcctacgtcggaccccaggccatgcttcctcctccgcctcctccccctctgctgccaccacagtcaccccgcactttctcgcttttccctttcaaaaccgcacccaccaatcagcaggatcttttcggcttccacgacgatggcggtgcttcggcttcccacggtgtattgaaccaccacctcgccttattctcgccttcccccgcagttgatcacgcgttttctcacccgccgatgcactctcttgcacttccgcatcactcacaccttacgcgttcccctatgcaacccaggcaccaaactgatccggaaatctttattgataacttgaaacagcacttccaagaatttcatggtcagccatgttgccatggtggttgcatggatgttgctgctgcggaagagggtaaaaagggcgatattcggggacttgttgaggttgtgagggttatgaagg

SEQ ID NO: 9774 - DNA, 522 bp, Glycine max
  Peptide Sequence Number=SeqID_126552
atgatgttggaatctgatgtaaatggcaacatagatagatcaatgtttgggtctgttgattttgatgaaaatgtagatgatcacgaagatataacattggagggtgaagatggcgaatataatgaagatgttgatgactgtggtgaccaagaagaacaatatgaagaatatgaaaatgatgacgtggtggaatatgaaaacatgggtgttgaaacattggtggggaagttgtccagcaaacgtatgtttgctcacgagctggttagacctaaaagagggcccaggttggagaagcgaaaacgactatccaagaatgtaacacgatgtggttgtgaggcaacgtgtcatgtgcacgtggatgtccagacttcgagatggtatgtgtcagtttggcattttgatcataatcattattttttggaaacgatacattcattgttgttaccactaaatagaaaaattggagagagtgatatgatgcagatttgtaattttacaaaggttggtattcaaccaccttag

SEQ ID NO: 9775 - DNA, 933 bp, Glycine max
  Peptide Sequence Number=SeqID_126553
atggcttccaacaatgttccattactagcacctcctgtattcacaggaaagaacgacgaaatgtgggttgtgaagatgagaaggcagttgaaagcttttgatctttggaaagtaatggaaacaactgaaccaccagctttggaagagaatccaactgttgctcagatcagatttcacagtaagcaagttgccaaaagagcaaaggctcttaccatcttgcactcagttgtggatgatgatgttctcaaccttaagagggagtttgaagccttaaagatgaatgaggctaaaaacataaaagatttcatgaccagactgatgaagccgaaagatttgaacctaatgtctaatgaaaaagctagtaagtttgaacaatggaaccattctatgaaggagatgaccaccattgaagacaacaatacatggcagctggttgacaaactggaagacaaaaattctattggagttaaatgggtttatacggtaaagctgaatcttaatgggtccattaacaaatacaagaccaaactagttgttaaaggttatgctcagcaacctggaattgattatgtagagacgttttctccggttacaaaaatgaacactattcgcattcttgtagctttggcagctgaaatgaagtgcaaaatttggcatttagatgtcaaatctgcattcttgaataggaacttgactgaagaaatttataaacaagctcctagagcttggtacaacaacattgatgcttactttagcagtcaaggttttaggagtgaaaatgatgcaactctttatgtgaaaaggttgttggatggtggctctttaattgtctctgtgtatgttgatgattttctaatgactagcaataatcaacaagaagtgcaacaactgatagtggagatgcaaaatcagtttcagatatccaacttatga

SEQ ID NO: 9776 - DNA, 910 bp, Glycine max
  Peptide Sequence Number=SeqID_126554
atggcaccagaagtcttgagaaatgagccagccaatgagaagtgtgatgtgtatagttttggtgtgatcttgtgggagttgactaccacaagaattccctggcaaggtttgaacccaatgcaggttgttggagctgttggattccaaaataaacggcttgaaattccagaagatgtcaatccagtagtggcacaaataatacgtgattgctggcaaacttgggatggttttgatttgatgcagggagccacacttgcggccatcattctcacaactgatgtctcgtctttaccgacttcaacatttgattgtcccaaaaacaagctcaacacattaaacgaagttgtctataacatagctattgtaataatacttaaagctgttccttggttcaaagaaccagaacagctaaattgggactggacacaacccattcagaaaagagcagggtccctccccaatatctgcataagtgcagtggagggcgaggcagaggaagcgataatggcaataagaggcataggaatgtcgttctctgctccatcaacaacaagacccatactttccctcaacccacgattcctttcagcgcccgaaacagagtgccctgttccgcacgagcagcagcccatcaacgagtaccagtccctctcgacttcgttcccgttctcgtgggccgccggcgacgtggtggagtacgcctcgcgcctcttcgtgacgggggcgtccttcgcgctgctgctgggcctccccgtggcctggttcgggtccgccggggcccaggccgagcccgccaagcgcctcctctgcgccgcctccagcggcctctttgctgtcacgctcgctgtcgttaggatgtatcttggctgggcttatgtcgggaatcgcttgctcagtgccaccgttgaat

SEQ ID NO: 9777 - DNA, 306 bp, Glycine max
  Peptide Sequence Number=SeqID_126555
atgcctctgcatgagttctctttgttttgtttttgggtgatttgggtgaagactgctgaagttttggcccgcgatagactccttggatcattttttgtcaagcctgtactgggcagattgaaaattactctagtgagtcttgcaacttcattacttgtatgtgcacttatcctcattaacattgatggggaccaaaacctgacatcaaaagaacctagagttcgagttgtacctggagtttacaatgatgattctgcaagattatttgaaccagatgcctttcgtgatgaacttgatcttcaataa

SEQ ID NO: 9778 - DNA, 428 bp, Glycine max
  Peptide Sequence Number=SeqID_126556
atggagttaaatgcaagttatgacgtcgagcattcacattctacacaaagaatacagcatgagctgtggcctctagatccaattgatccaaagaaggcaaaggaggatggagttgttttagatttttcaggatcatatcttgtgaatgttgatgattttgcatttggtccagtggcaagatacttgcaacttgatcgtagacagcacggttacctgcatgccgagtatggtactgcaatcgcatgggacgatgcgttacagacaagtttgcggtattttgagaacaaaactcacaaccttttcacttgcaactgccactcgtttgttgccaactgtctgaatcggctgtgttatggtggatcaatgaattggaacatggtgaatgtaggagctttggtaatatttaaggggcactgggttgatttcag

SEQ ID NO: 9779 - DNA, 714 bp, Glycine max
  Peptide Sequence Number=SeqID_126557
atgtgtgggacagagggtgttacacagtacatagaatcaaatgccttcttgatatcaattttcaaagcaaggtttccaccgaagacttgcttgttcagcatattaatcgcttcaaaggtagtgcaaacacaatcaagcatgtgcatttccctaaagaatccacgctgccaaggcaatgggcttgaagtgctctatttgatcgtcattaggggtcttaggaatcaaaaccaccagattagagttcaagttaggaaggagccaaccttgtttgaaaaattgaagtgttgctataaaaacattttgccccacaatgtcccagaatttcttgataaaattgagaaagctgagagatccttcatatggggaaatcaagagggcgggaagaaaatgcatgttgtgagctggaacactataataaggccaaaggtttatggaggaataactatgtgtaatcttaagcacatgaatttagcttgtaatatgaaattggggtggatgcttagaaatgatgggaatagtttatggtgccaagtcctaaaagggaagtatgctagacagggtctcatttctagttccttgattgccaaacctcaagattctcttatttggaaatttgtggttgagatttggccgcagttagtgatgggtcttgggctattggagatgggagaatggtcaatgtttgggaagttagatgggtcaacaatgagttga

SEQ ID NO: 9780 - DNA, 1178 bp, Glycine max
  Peptide Sequence Number=SeqID_126558
gactacacgtcatcgccttcagagggctacacgccctcaccttcagatggctacacaccctcaccttcagatggctacatgccctctccttcagagggctacacgccctcgccttcagagggctatacgccttcaccttcagaggactacacgtcttcaccttcagagggctacatgcccccaccttcgaagggctacacgccctcaccttgagaggactacaggtcctcgccttcagaggaccacgactgcacgtcctcgccttcagagggctacacgccctcgccatcagaagactgcacgtcctcgccttcagagggctacatgccctcgccatcagaggactgcacgtcctcgccttcatagggctacacgccctcacctttagaggactacatgtcctcgccatcaaaggactgcatgtcttcacctttagaggactgcacgtcctcgggtttagagggctacatgccctcgccatcagaggaatgcacgtcctcgccttcgtagggctacacgcccttgaaggacaacacgtcctcgcctccaaagggactacacatcctcgccttcagaggactacacgtcctcgccttagaggactacaagccctcgccttcagaggactacacgtcctcgccatcagaggactacacgtcctcgccatcagagggctgcacaccctcaccttcagaggactacacatcctcaccttcagaggactgcacgtcctcaccttcagaggactgcatgtcctcatcttcagaggactgcacgtcctcaccttcagagggctgcacgccctcacctttagggtgctacacgccctcgccattagaggaatgcacgtcctcgccttcgtagggctacacgcccttgaaggacaacacgtcctcgcctccaaagggcgacacgtcctcgccatcaaagggctacacgtcctcacctttagaggactacacgtcctcaccttcagaggactacacatcctcgccttcagagggctacacgtcctcgccttcaaaggacgacacgccctcgccttcagaggactacacatcctccacttcaaaggactacacgtcctccccttcagaggactacacgtccttgccttcagagggctacacactctcgctttaagtgggctccatatccacaccttaagagaatttaag

SEQ ID NO: 9781 - DNA, 813 bp, Glycine max
  Peptide Sequence Number=SeqID_126559
atggggagaagaatgggacaagatcaatcagattacaagacccagttggtgttggaggtttgctccatttccacacgttcagttgtgtgtgttcatagacatgtctcaaaccatgctaagccatctttcatagattggtattgcattcttggagtggaagaaaatgcagggatgaacaccattcgcaagcaataccataaacttgccttgcaacttcatccggacaagaatacacacccaaaggctgaaattgcattcaagcttgtctctgaggcacatatatgtctgtctgatgctgcaaaaaggaaagcttttgacttaaagagacataagaatttctgctttgagtgcaatagaatcccttatagtacatccaaacatgtccctggcaattccaattgttcaactttcaagacatggaatatcattagggactcaagatcttacaaagttttgagaaatattagagacatgagagaaagactgaaggaggagaccaaggtgatagagaactgtctgcgaaaaaattcaatgtcaaagaaagaatctcccctctacaatccagatgactatagacatggaagcagcttcaagcataaagttgagaaagaaatccctattttcaatccattgaaatacttgtacaaaggataccctcatctgaggtgcaatgtttacaagaattctgaggcgtgttggtacttgcacactcaaaatcttgtggacactgacaagggggaagccaagtatgcatccccggtttttgaggtcagatcacaaaggagcatgctcacaagaagtaaatttgcttaa

SEQ ID NO: 9782 - DNA, 201 bp, Glycine max
  Peptide Sequence Number=SeqID_126560
atgtgtcttagggtattgggcatcctaaaggctatgaacaatttgataatgttgttatgggcattctatgaagatttttggatgataataagctggtccaagatttttggaactctagcggaagatgttggaggagagttgaatcaagtgtttatgttgacattgtcatgccaccaaattgagaagttacatgaactttga

SEQ ID NO: 9783 - DNA, 201 bp, Glycine max
  Peptide Sequence Number=SeqID_126561
atgatagggttcgaccaggttgttgtagcaggggtgccacgtggagaaaaatgggagggtgtggagagggagaggaggctcccctgggtgacacgtggagggtggggtttgccaaacttacaatggcgaatgacattccctaaagcctttatggaggtactttgtcactttcatttagaccataacccagtttccttctaa

SEQ ID NO: 9784 - DNA, 1176 bp, Glycine max
  Peptide Sequence Number=SeqID_126562
atgaccaatcaggttctcctgcaggcgggtaaaatcgtcctcgctccacacctgcagcagcgtcagcggctgctgcgcaaactgcgcgtgcatgtcgccggcaaattgcgtggtatagaacgtggtaaggtccggctgcagctgaatatccagcgcgcgctcaacggctgccagcgaggctggcaggctaaagtcctgcggctgccacaggacacgctcatccagttcactgatgatgcagggcgatggcacgccgtacagctctgcgctggcgggaaaatggccgtgctgctgctgccagtgcgctacataacgggcgtggtaaccgttatgtcttctgaaaaccgggatacggcgctgagcggcctgactttgggtaagcccaccgcgtatgttgatcgctacgataacacgctgctgcaggcggtgccgcgcagcctgaatcgcgagccgctcgggctttatcccgataacctgccgttccacggcgcagatatctggacgctgtatgaactctcctggcttaacagcaaaggcgtgccgcaggtcgcggtcggcgaagtggtgctaagcgccgacagcgtgaatctgatcgagtccaaaagcttcaaactctatcttaacagctttaaccagacgattttcgccgactggggcgccgtacggcaaacgctggagcgcgatctcagcgcctgcgctaacggccaggtcagcgtggcgctgtttcgtctgagcgaagtggaaggtcagccgatcgggcacttcgctggcgatgtcatcgacgagcaggatatcaccatcagcgattacggttttaacgctgattacctcgccagcgcaacgggcagcgaagtggttgaagagacgctggtcagccatctgctgaaatcgaactgtctgatcaccaatcagccggactggggctcggtgatgattcgctatcagggcccgcgtatcgatcgcgaagcgctgctacgctatctgatttcgttccgccagcacaatgagtttcatgagcagtgcgtcgagcgtatttttaacgatattcagcgcttttgtcagccagcagcattaaccgtctacgcgcgctacacgcggcgcggcgggctggatatcaatccttggcgcagcaatgtccccttcacgccgggctactcccgcctggtgcgccagtaa

SEQ ID NO: 9785 - DNA, 432 bp, Glycine max
  Peptide Sequence Number=SeqID_126563
atgtttacttttgatgaaactaatattacctcctcaagaaaggagtttgttgatgatattgcagatactttggaagatactcaaaatgaagaaaaaaatctgaaaagaaagagagatgatgaagacaaggatgatcaagatgacacagcacaagaaaatgataatcttcctaaagaatggaaaacttcaagaaatcatcctcttgacaactgtcataccctaatttcgtccggggacctttgcttgatgatatgcgacctttctttggtccttgtgaggtgcttggcacccatcattaggcaatttgtgaaattccaggacatgccggaaaaccaaaaaatattgatgcacaatccgcccttccagaacattttggaagttgggttgcttaaggaggaagccactgggcggcaagctcctccacgtttttga

SEQ ID NO: 9786 - DNA, 426 bp, Glycine max
  Peptide Sequence Number=SeqID_126564
atgaacaagggtctctcctttgtgctgctgattcttctgatccactacaacaacgttgtcaacgccaacaacaaaaactgtgtcacagaggattgcctcatcggcaacaatgatttggaatcagaattctacttcggttcccatgtggccagaatgctctacgatgtgagccaatctgtgtctggccaaacaggcaattcaaacaacaaagctgttaattgtccacaaagcaatggctaccgaacctgcttgccttccaaaaacggtggtggccctaaccaaagttgtggcgattacaccaggtggaccatggttctggaaaaattgaaattgaggggaagacaggaagaagaaactgtcatgtataagttgaagaacattggaatctcgatgggcatcttaaatgatcttatcccctgtacttga

SEQ ID NO: 9787 - DNA, 1005 bp, Glycine max
  Peptide Sequence Number=SeqID_126565
atggacgtggaatttggaaatacactagatggtgttaaatttgacacaacaattgaaatagtgataaaaagaagaggtgacgtctacaatcttgatgtaggaaatctttattgtgaagattttgcaagtggtttgacattgaaaactaggaagcgtgaggaaaaaatgatacaaggtggttgcaatgctaggtttcatgttcacgttaactttagtaacgatcattggtttttggtgatgtggtggcttttgatgctacatataggaagaataaatatgtgttcatttgtgattttctttggagttaatcatcacaatcaaaccatagtctttgctattggtcttattactaatgaaactgaagagacatatgtttggttgttagagcaatttgtggatgccatgaaaggaaatactccttcttgtgtaattactgatggtgatattgccatgaagaatgcaataaggaaagtttttcccaatgctcatcacaggtgtttgacatattttatatttatggagcttcagtctaattactattcaaacgatgcaaattatgcctttcattcaagctttcaattccttgaaagttggtcaaagacaacaaaggactccatttgtgggttgtatgttgtttcatcaatctattgggattccactctaatttctagatatgcaacattagttcatatctctagagaggcttgtgagtatgcccatagggagaaagaggattttgacaatttaatggagttacttactggtgagatttcaaggttgaagttaaagtacaaatcagttgaagaagaaaaggttgaagatgcaacaccccgatcgaaagtgcgagtcactgagaatttgaaaatcaggaatgttacaaatggtatcagagatgacctctctcctagtagagtacggttcaaggatgaactaggtggaagttggtgggcatgcagcacctcgatcgtatcacaccagaatgaaagggatctagaggttgtatag

SEQ ID NO: 9788 - DNA, 393 bp, Glycine max
  Peptide Sequence Number=SeqID_126566
atgaatatatgtctttacaagttaaaagcatcattacattttagttttattcctcaacagggaaatgtagagcacatttctatatcgagtgatgccaaaaatttagttacatcagattttaaggatcaacatgaggctgctgaaggagtccttcttgatgatgatttgaatgagccaacaatgagagagaaacttgctagtctaagtgttctggatgggaacaaatcaaggagtgatatagagcaagaatcttctgtcccagcaaagcctccaagtgcagactctgtacatgttttgcttaagcaagcattaaatgttgatgatcgcacccttctgctagattgcttgtttacacaaaatgagaaggttctctttctctcctatttctattga

SEQ ID NO: 9789 - DNA, 867 bp, Glycine max
  Peptide Sequence Number=SeqID_126567
atggatatttctaatcaagttaaagaacaaggtgaagacaccaaacctttatggaattatgtttcaaagattaaaggtctaagtggaggctgtggaaattttgaaaagataactccttcaaaccctacggaacttacaaagatggataatgagactacattaagaatagagaggtcaaagaaaaaacatgtctctttacctccgatgtctaaccaagagacaaccaatgttgatccaaaaaagataaagactcttgaagcaaggaatcctcactataggaaggcattctcttttgctgccaacaataattgtatacctgggtatcaacctccagagaagacctcttatcaatttcatggctgtgagtctatgaccaagagtggaccgatgttttcaaaggccttagattgttcttatgaggtaaaagatagggatttcatagctgaacaaatgagggatgtaattatagaggcagatgatattaacaaggcaaaatttgtgaaagagacagcattggatgacatttggtgggacaaggttgattatatactttctttcactactcctatctatgatattcttagaaaaacagatacggatgtagtttgtcttcatttggtgtatgaaatgtggaactcaatgattgaaaatgtgaaggtcatatatcgacatgaaagaaagggagaaggtgaagaatctaccttttataagggtaaggctgcgtacaatatccctcccccataccttcgcatagcgaagagcctctgggtaatggggtacgaagagaagagaaggtctaatggaggcaaagtcttggtgactaattcatggtgctcatgcacctacacttcaaaagattgctcttaa

SEQ ID NO: 9790 - DNA, 465 bp, Glycine max
  Peptide Sequence Number=SeqID_126568
atggctactaaaattacaagtcgtattgtgatgggtctttttggaaaggctgttccaaaaactgcaggggaaaagggaactggtaaaagtggcaagcctctccattacaaaggtagctcattccatagaattattcctagctttatgctccaaggaggtgattttacacatggcaatggtatgggtggagaatcaatttatggagagaagtttgctgatgagaacttcaagttaaagcatactggaccaggacttctatcaatggcaaatgctggtcctgacaccaatggctcacaatttttcattacaaccgtgacaactagctggttggacggaaggcatgttgtttttggtagagttctttctggattggatgttgtttacaatattgaagctgaaggaacacaaagtggcactcccaagagcaaggttgtgattgttgacagtggtgaactccctctataa

SEQ ID NO: 9791 - DNA, 273 bp, Glycine max
  Peptide Sequence Number=SeqID_126569
atgatgcggcattcgaattccaatgaaccggcaagaagccttccaccgcttggttggtgcaaaccatccggcggacatcagacacagaaaaatcaaactttcactcatcatcaagtgaaccctcaaatgcaatcaaacacttcatcatcaaagaaagctaagtctacaaacttagggttgataatggaacgagaagagaaaagagaattgtaccagatacgttgttcttctgaggaaaacaatgtaggagatgatatggagggagaaatttga

SEQ ID NO: 9792 - DNA, 301 bp, Glycine max
  Peptide Sequence Number=SeqID_126570
atggttggacctaacttcatggatgagatagactgtggcagcttctttgaccacatcgacgaccttctcgattttcccgtcaaggacgtcgacggcggcgccgccaccttgccttccgtcgccgctaatattgtcaaggagctctcagatttcatccttaaacgcctcgaccataaaagtcccatcgtcaaacacaagactttacgattgatcaaatatgcggttggaaagtgtggtgtggagtttagaagggaaatgcagagacattcggtggcaattcgtcagttgttacactacaagg

SEQ ID NO: 9793 - DNA, 276 bp, Glycine max
  Peptide Sequence Number=SeqID_126571
atggtggctttgctattcttacttgccctgaaaatcttcaaaatgttcctaactaatggtgaagtaagggaaggattccaacaagttcaagtgattttagaacaagctccactactgcctaataaagatgattttctttctagttggggtttatcttatgaatcactctctaatgaagaagaggatctcacaatgtggcttgcagggatttcttctatggaaggtaagtcatcaagggaagggaaaactaggaatgaactccagcatttgctttga

SEQ ID NO: 9794 - DNA, 262 bp, Glycine max
  Peptide Sequence Number=SeqID_126572
cttcataccagatcaagttgttacggatcaacttgatccgtatgaggcttacagatcaacttcatctgtaagactcatactgatcaagggaaatgaagcttacctcgatggtggaaaagtcccttcactgcacgtccacaatgccgacggaggagaagaaggatcaaagcccaacgaaaatgacacaacggtacaaacagaggggagaagaatagcggaggcgcaaatggaagctcagcttgctggtgtacgaaatgcataa

SEQ ID NO: 9795 - DNA, 342 bp, Glycine max
  Peptide Sequence Number=SeqID_126573
atgcttgggctgaggaagaaggaagaagaagcatggcaacgcggtccacagtgttgtgtttcccaatggacacggacgcccgcgagggctccaacctgctctgaggtgtcactgtcatgccgttcgccgccaccaacgagaacacccgtgctttgtcgtacaactctgacgatgacctcttgccccagtgagagaactgttgggcctacttcaacacctactgcaagctcgagcagtgatcctggtcctggtcatggtcctgctccctctgcgacaacctcaatggactctcctacgacaccatcgaccactactctcgccctcaatcctgtgccgagatga

SEQ ID NO: 9796 - DNA, 2493 bp, Glycine max
  Peptide Sequence Number=SeqID_126574
atgacaccaccctttactctctccctctccctcttctccatcctcgccgtcaccgccgtccacggcctgggctccgctgccaccaccgccgtcacctacggcaccgccaccgtgtgcggcatcgtcgctggggagccccagcaccgcatccagtgctcccgcaacggcagccgcgtcgttcctctcaccctccccaacgcctccttcgacgccatctccggcggccggagcttcttctgcggcctccgctccggtggccgcagcctccactgctgggacaccgccgccacaactgcctccttccgcccaaagagagtcttccacagcgacgtggtgcagttggctgacgtggcagttggcgactcccaggtctgcgcgagagaggtgcaatccggtgtggtacggtgctggagaggaagcggtggggcccagttcagttccccttcggagagtttaaggtttcggagcatcacatgtggctgtggtttttcatgtgggatagtaaaagagagtggaagagttgtgtgttggggtgatgataacgagggtgcaaatagaaaaggtagtattagtgatgagattcacagagagtttaagaatttcaccatgtcaagtttggttgctggggtgtctcatgtgtgtggtttgactcttcacggggctttggtttgtaaagggaacaatgattctggtcaactaggatacaacaacaacaacaatggtggtgtttttttaacaacttctttggatcatttttcaggtcttgctttgggagaagatttcacgtgtggaattaggactaggaacggtgttgttgtgtgttggggtggtggttttgatagtaatgtggtgaaaggtgtttcttttgagtcacttgttgctggtttggattacgtgtgtgggttaacaactaggaatttgacagtggtgtgttggggtaaaggtaggttttttcatcatgtgcctagtgaggttccattgggtgtgattcttccaggtccatgtgttgaaggtgcttgtagtggttcttgtggtacatatcctgattctggtgctctttgtcatggctctgggagtatttgttactcttgtcaaactgagatcccactagctgttccattgcttccaccatcatcatcaacaacaacacaagctgttccaaatcaagaacaaccttcttcacgtggagggaaaaacaaaaacttgaaggagtttttggttttttttattgttggatcagttggtgcttttgtggggttatgcactattctctatttcatttggatttgtgcaaggaggtttttgttgaggagaaaagaagtagtagtaggaggaggtaataataattctgtgaagcctactagctcagagagtgatgcatatgtggatataatccccatgcctaattttggttccaatggaacaacattcagaacattttctagcaaaagtcggggatcaagaagattggggaggcataggagtggttcatcgtcgaagcgtgtggacagaaccgagagtttctcattgtctgaacttgcaacagccactgaaaacttctcattgtgtaataaaataggtgctggtagctttggaagtgtttacaaaggcatgctacgagatggtcgtgaagttgcaattaagagaggagatagtactagtaccatgaagaagaaatttcaggagaaagagattgcttttgattcagaattgaccatgctgtcacggcttcaccacaagcacttggtgaggctaattgggttctgtgaggagaatgatgagaggctcttggtctatgagtacatgagcaatggttcactttatgaccacttgcatgacaagaacaatgttgacaagagtagcagcattttgaattcttggaggatgaggatcaagattgcattggatgctgctaggggaattgaatacattcacaactatgcagttccacccattatccacagggacatcaagtcctcaaatatactcttggattcaaactggaatgctagagtttctgactttggattgtcaaaaatttggcatgagactgaacaagaattgatgtccaccaccaaagcagttggaactgttggatacatagaccctgagtactatgtgttgaatgtgttaaccacaaagagtgatgtgtatggtttaggagtggtgatgttggagcttctcacagggaaaagagcagtgttcaaacctgaagatggatcaggccctatgggggtggtggaatacacagggccaaagattgcatcaggagagctttggagtgtgttggattatagagttggtcatccagaagtgaatgaggttgagtccattcaaatcatggcttacactgctatgcattgtgtgaacttggagggaaaagagaggcctgaaatgactgacattgttgctaacttggagagagcattggctttcattgagggcacccctactagcctctcctttgcttcattctctgcccctcttgaataa

SEQ ID NO: 9797 - DNA, 396 bp, Glycine max
  Peptide Sequence Number=SeqID_126575
atgaaagcaagaaaagcaaaattgattctgtttggtggacttcactcgggtggactcgatgcagtggccgcgagtgaggatgaaggaggcaatggaggaggcagcgatggtgaagacaacaacgcaacgcttctggcaacacaatgggttctgtcgccttggaacacgagggatatgggagacgacacgatcgattccccagaactcgacagaggtctggtcgtcgatgcggtggttgacgacatagggttgtcaactattcttgtagatgttggagtgtacgaagttgatgatgaggtgttggtagccatgtcactgtcgaaggtttgcgcggtgacgagagaacgtgttgttgcggccattgcgaatgagagtgaggaagagctctctacctag

SEQ ID NO: 9798 - DNA, 108 bp, Glycine max
  Peptide Sequence Number=SeqID_126576
atgattccaaatgtgggagggtttgcactggggctagttcagatggtgctatatgacatttataggaagggcactgagagtgagaaggagcaaggtttaggtatttga

SEQ ID NO: 9799 - DNA, 537 bp, Glycine max
  Peptide Sequence Number=SeqID_126577
atggtgtggatgaataacatgttgattgttcggatgcattcaatacttctcaggtgtttggtacccgagatgatgttttgtagtgggctcgatccgttgttcatgaaaatggatttgtggcgatcattgagtggtcagtatagatctaggaagaaagattttgttagaaaagatactaggagtaggaaatatgggtgtcccttcaagcttagtgggaaaccagtggttggagggaaaggttggatggtgaagttgatgtacgggattcataatcatgaattggccaagtcattagttggacatccatacgctgagcgattgactaaggatgaaaagacaattattgttgatataaccaagtcaatggtgaaaccaagaaacattctgctaacgttgaaggagcacaatgccaatagttgtacaacaatcaaacaaatatacaatgcaagaagtgcataccgttcttccattaaaggaagtgatactgaaatgcaacatctaatgaagcttcttgaacgggatcaatatattcattga

SEQ ID NO: 9800 - DNA, 225 bp, Glycine max
  Peptide Sequence Number=SeqID_126578
atggatgatggagttcctaaagggcttggtgaagtcagtggctgccattgcagtggtgtgttcggctgtggccttgtccttctactagaagttggggctggagctagagatggggtagttgttgtctctttggtctggtttttgcttttgaagattttgttccatcaggaaggcagtgttgtggtcaatggtaaattgtctgaggaggataaatctactcttcag

SEQ ID NO: 9801 - DNA, 375 bp, Glycine max
  Peptide Sequence Number=SeqID_126579
atggccgtgggaaacatcttaggccatgccacaggctcctacagcggcctccataacatctctcccttcaccaaaacaaaagcctgtgatgtctactgcgcaaatttgaagagttgtttcttcctctccatcgcgcttcttctcactctctccacacttacattgagctacgtgaaggagaaaacggtgatgacttccgtggatgtggatgatggtgggggtactgtgccgaagacgatgagagagggattcaaaggcttttgggatgggttaaaaaatgcaattcaaggtgcctctcagacgttgacatgtggcagtcaacgtcactgcttaacggtcaacatccaattgaggtgtccgggaccaacattgtag

SEQ ID NO: 9802 - DNA, 967 bp, Glycine max
  Peptide Sequence Number=SeqID_126580
atggtggtcctcactttcacagatgagttcactagcagtgtccagccaagaagattgttcaaggctttgatccttgatgctcctaacctcatccccaagctgatgcctgaggccattaagaatgttcaactggctgaagggaatggaggccctggaagcattcaggagataactattgctgaaggcaagttgcaccatttcacactaattttcactttaccatttttgttgttgtttgtgactacgaatatggatccaagtggtaacatcaaacagttgaagcatagaattgatgcaatagaccttgagaaattgacttacagctacgcagtgattgatggggatgctgcactggaaaaagtggattcaatttcacatgagattaagttcgaggccactgaagagggaggttgcaagaccaagaatgttagcaagtatcatcccaaagaaggagttgatgttaaagaggaggatttcaaggctgcaagagaggaaggtttggctctcctcaaggtagtggatgcctatcttgtggcaaaccctgaggcctatgctgaaggaactataaatagcggttttttcactttcacagatgagtttactagcactgtccagccaggaaggttgttcaaggctttggtccttgatgctccaaacctcattcccaagctgatgcccgaggccattaagaatattcaactggttgaagggaatggaggccctggaagcattcaggagataacaattgttgaaggccagttgtttcaaactgaaatgactaacaaagagatcattattggtaatgccttcaatgcaggtgataagatcaaacacttgaagcatagaattgatgtaatagaccaagagaagttgacatacagctatgcagtgatcgagggggatggtgcactggaaaaagtggattcaattgcacatgaggttaagttcgaggccaccgaagagggag

SEQ ID NO: 9803 - DNA, 801 bp, Glycine max
  Peptide Sequence Number=SeqID_126581
atggcaaatgctgcagaagatttctcccaattcgggatttcaaaagaggaaaaagataagcttgttggggaattgattaggtacatgcttttcaaaacccatcaaaattctgggtgccccattaagagagaggaactcactcaactcgttacgaagaactatcatcagcgtaaccttcctacctttgtgatcaatgaggctaaggagaagctttcctttgtatttggctatgaaatgagggagcttcaaaggacccaaccttcttccaaagcccggacacagtcctcccaacaaagtgttgcagattcgaaatcatatattctcataagtcaacttcctcctaatgtatatgaaaaatatgttgtggatgttaatactgcgcatctatccggattcacttttgtcataattagtattgtatatcttgccggtggtaaaattccagaagaaaatctatggagccaaatgaggaggatgggtttgggtgaaactgaatcaagtcatccagtccttggaaatgttaagcaagcatttgaacttcttgttcagcaaaggtatttacagaaagacaaagttaatggtcctgaaggcaatactgtatattatgagcttgctgagagagctttagatggacccatgaatgacaggattaaagaatatatctctcagctgaagcaaatagagcagattgtgttgaggattgttcagatatgtttcactgcagaccaaggaggtctaaaattttgtggcctgtctctgtgtagcaccagtgttacctataagcaaacagagaacaagtga

SEQ ID NO: 9804 - DNA, 219 bp, Glycine max
  Peptide Sequence Number=SeqID_126582
atgggaattgtcactactgaacgcaagcaggtttgtgccgtggctcctgcaaggctatacaaagccatggccttcgattttgacaagtctacagtcaaatactacactaaagacaatgcacaactcacagaagagtttttgaaggataacaaggaaaaatctgaggcgttcacccatgctcttgtggattatattgtagctaatcctgattacaactaa

SEQ ID NO: 9805 - DNA, 453 bp, Glycine max
  Peptide Sequence Number=SeqID_126583
atgaagattatctttaaggacaagttagtgaagttgtatgttgctcgaaaagctgaagaaaatcattcattgaagtttttggtagaaagggtgaagatacagatgtcaacatcatgggcaattggtttgaataagttgtacacgtgtacgaatcatgttttctacatcgctcaattaacatcggttattgcaaaaaccgatgttaatgaaagcgcggtggcatttttaaaaccctacactgctcttggaacagtcgtgggtgctcaaaggtcaaagctttctacgctgccagttaacaaggtcgttttcaagcttgacgagagttacacgccaagcaaagtttccatccgtgccagtgatggttttcacaacttgaaggagattaagaccgtggaactcgtgaagccaactgggtgggtttatctatccttgtctggagctgatcctaggtaa

SEQ ID NO: 9806 - DNA, 771 bp, Glycine max
  Peptide Sequence Number=SeqID_126584
atgaaaaagctgagtgctaaggccaaggtgttgggaacttttgtgtgtattggtggagctttgatgttgatcctttataaaggagtgcccttaatcaaccaacaaccagagcacatagcagacaaaggcacaataagatcatcagcctccaagttaaagaaatggatcataggttcactgcttctaactgcaggatgcttcttgtggtcttcatggtttcttatacaagcaagcattagcaaaaagtatccatgtcaatactctagcactgccattttgtccttttttgcttccattcaatcagcaatattgactttggtcatcgatagaagtaacgccaaatggattctcaaaggaaagttagagataatgactgttgtatatgctgggctggtaggatcaggcttgtgctatgtggcaatgtcatggtgtgtgaaacaaaggggtccagtttttacttcagcatttacccctcttctacagatgttcgtggctgtgcttgatttctctatattacatgaggaaatttatcttggaagtgttgcaggatcagtcttggttatatctggcacgtatattctactttggggtaaaagtaaagaggaagaacaatgtgccgtgaagggtactcaagaaagtcaagaagatgaagaatgtaagaataatttggaggccagttcaaatgtaccttctaagctaagtcctaatgaggaacaaggattctctgaattacaagtgaagcagctagctattacagtaactagaagttga

SEQ ID NO: 9807 - DNA, 153 bp, Glycine max
  Peptide Sequence Number=SeqID_126585
atgggtttaacaacaataaacgtgagaagccagagaaggatcatggcttctccacctgcctcccctcctcctcctcctcctccttctactccttcggacgcatcggcttcgccatttgccgtgaagcggacacgcaaagcctcacgtctatga

SEQ ID NO: 9808 - DNA, 951 bp, Glycine max
  Peptide Sequence Number=SeqID_126586
atgaagctgtatggaattattgttcttattaagttgggtttgggtgggaatgaacagagaattaagagatggaaaacgatggagggagagttgcatgcgtactttgtgcttggggacttatgggaatctttcaaggaatggagtgcatatggggccggtgttccgttggtgttggatggaagtgaatgcgtcacacagtattacaatgtctccttgtctgccattcagctttatgttcatccatcaaaaccttccccacggttaaggagacccagtcagagagactctgaatctgctacagagacaagcagtgacagcagcagtggctattgtcatgaaaaaggggcaaagagtgtgcatggcacttggaaccaggataactcgtcagatgcaagatatcaatgttcaaaaagagtttcactaagtaaacctttaacaagttcatcaagtgatgagaatgagagctgcaacccacccaattcatatttcttgcccccagatttccgaccttacacgtcaatttcccgagttgaagacataccggagctgcgatctttcctcagcaagttgggtttctttggcttggtatccaatatacagaatacccactggtccaacactagagagcatgagtgcctgcttcctgactttccattccctatcaacagcagctttgcaaagtatgtattgatgtctttgtttagtttctgtttaagtaatgatggattccatctttgttcaagaggtatgaacttgtcatccaagctatcattaccaatatttgggcttgcctttcacaagttgaaagcttctgtctgggatcctgatgaggtttctgaaggtcagaaagccaattctttgttgcgagccgctgataactggattaggctattgcaagttaaccatcctgattacaattacttcatgtcacattatccatattggagatga

SEQ ID NO: 9809 - DNA, 597 bp, Glycine max
  Peptide Sequence Number=SeqID_126587
atggattccgattcttggatttccacgcgcatgtcgtcctcttcacgccgctatcattcgcgatctgatctgtacgtggaggagagtgaagggagcgatgatttcagggcggagtttctgtgccctttctgcgccgaggattacgacgtcgtttccctctgttgccacattgacgaccaccaccctatccaagccaaaaacgggcgtaaaaggagggtcaggaaagtaggctctggttcaacaatgtctatattgagaaaagagttacgagaaggagccttgcactcccttcttggaggttcttcatacttagcttcctgcaattctgagcctgatcctctgttatcatcttttatgtttaacccagctgtaactgatgattctgcgagtgcaaaacctccttctgttgaagatgctctagtaaaagaaagttcaaaagacgatttcttggaaagaacttctggtttgactattgtgtatggatacagaaaacctcaacagttacagctgtcagaagaagatcaagtagagaaggctcggaggtttgaattcgtgcaaggacttctgatgtccaccattcttgatgatatgttatga

SEQ ID NO: 9810 - DNA, 2022 bp, Glycine max
  Peptide Sequence Number=SeqID_126588
atgaatctcagccacggcaagggatccacttcgagttctcctctgaaagccggagacaccgtctccgaccagttcccggcgggtctccgggtactggttgtggatgatgaccccacttgccttatgatccttgagaggatgctgcgtgcttgtctctatgaagtgacgaaatgcaagcgagcggaggttgcattgtcgcttctgagagagaacaaaaatgggtttgatatcgttttaagtgatgtgcatatgccagatatggatggatttaagcttttggagcatattgggttggagatggaccttccagttattatgatgtcagctgatgatggaaaacaagttgtgatgaaaggggtgacacatggtgcctgtgattacctgattaaacctgttcggattgaggctttgaagaatatatggcagcatgtggttcggatgagaaagaatggtttgagagatgtggagcaatctggtagcatggaagaaggagatcggcctccaaagggatcagatgacggaaattactcgtcttcggtgaatgaagccaaaagctcaaagaagaggagggatgaggacgaggaaggagatgagagggatgattcctccacgttgaagaagccgcgagttgtttggtctgttgagcttcatcaacagtttatggctgttgtgaatcaacttggaattgataaggctgttcctaaaaagattttggaattgatgaatgttcctgggcttactagagaaaatgttgctagccatcttcagaaataccgtttgtatcttagaaggctgagtggagtttcacagcagcagggtaacttgagcaactccttcatgagctcacaagaagcaacatttgggggaacctcaatcaatggaattgatcttcaaaccctttcagctgctggccagttcccatcacaaagtctagccaagtttcaagctgctggacttggcaggacaactgccaaagcaggtatgcctatgtctctatccgatcaaaagaaccttttcagttttgagaacccaagattaagatttggagaagggtcactacaacatttaagcaacagtaagccaataaacttgcttcatggaattcttaccaacatggagccaaagcaacttgccaatttgcaccaatctacccaaccccttggtagcttgaatatgcgagtcaattctcctgccacgcagaacaaacccttgctgatgcagatgactcagtctcaaccaagaggtcagttgctaagtgaaaatgccagttctcatgtaaccaggtatccgtcatctttggtgcagcctacagtaccaaatggtatttctagtggtgttttgggaaatgcaattgctggaaccagcaacataactactacttataaccctgttcaacaaaactcttcattgttgagttttcccatgaaccaaaccaatgaaatgtctgccagtaatttccatcttagaagcactccaggtataactagtatcccaaataaaggtatgtttcatgaagaaggtacctctggtgttaaaggatctggtggatttgttcaaggttatgacatgtttaatgaccttcaccatcagaagtcccatgattgggacttaacaaacacaggcatgacatatgatgcttctcagcatgcaaatcctttacaaggtaacattgatgtctcaccatcagttttggttcatcagagttttccctctatgcaacagactgtacaaaatagagatactacttcaattggaaaagctatgttctccacaggtgaaggcatgcatcagagtagtctccaaaatattggtcaacaccacaataaccttcttcttgacaattcagtaagggttaaggctgaaagaattcctgatcctagctgtcagattaataacctcttctctgaccaatatggtcaggaggatcttgtcagtgcatttctgaaacagcaagaaggcgttggaacagctgaaaatgagtttgactttgatggatattccttagacaacattccagtttag

SEQ ID NO: 9811 - DNA, 1854 bp, Glycine max
  Peptide Sequence Number=SeqID_126589
atgtcgctgaggccgaatgctagaaccgaggttcgccgcaaccgctacaaggtggcggtggacgccgacgagggtcgccggaggagggaggacaacatggtggagatccgcaagagcaagcgcgaagagagcctccagaagaagcgccgcgaaggcctccaagctcagcagcagttccccactcctctccaagccgcctccattgtcgagaaaaagttagagagtcttcctgcgatggttgctggagtgtggtccgatgataacagccagcaactggaagcgaccacgcagtttcggaaactgctttcgattgagcgcagtcctccaattgaggaagttattcaagctggggttgtgcctcgatttgtggagtttcttgttagggaggatttccctcaacttcagtttgaggctgcgtgggctctcacaaacatagcatctggaacttctgagaataccaaggtggtgattgatcatggggcagttccgatatttgtcaagctacttagttcgcccagtgatgatgttcgggagcagaatactaaaactctgaaattccaggcagtgtgggcattggggaatgttgctggtgactctcctaagtgtcgtgatcttgttctcagccatggtgccctgatcccactgttggcccagttgaatgaacatgcaaaactttcaatgttgagaaacgcgacatggaccctgtcaaacttctgcaggggcaagccacagcctccatttgagcaggtgagggcagcgcttcctgctctagaacgattggttttttccaatgatgaagaagtcttgacagacgcatgttgggcactatcatatctttccgatggaacaaatgacaaaatccaagccgttattgaggctggtgtgtgtcccagactggtgcagctccttctgcacccatccccttcagtgctgattcctgctcttcgcacagtgggaaatattgtgacaggagatgatatgcagactcagactatcatcaatcatggtgcgctcccatgcctcttgagcctgttgacacataatcataaaaaaagtatcaagaaagaagcttgctggaccatttcaaacattacagctggaaacagagatcagatacaggctgttgttgaagctggtttgattgccccccttgtcaatcttcttcaaaatgctgagtttgacattaaaaaagaagctgcttgggcaatctcaaatgctacatctggtggtacccatgagcagatcaagtatctggtgagccagggttgcattaagcctctctgtgatctgcttgtttgcccggacccaagaatcgtcactgtctgtttagaaggacttgagaatattctgaaggttggggaagctgagaagagcatgggtaacagtggagatgtcaacttgtatgcacagatgatagacgaagcagagggattggagaaaattgaaaacctgcagagtcatgacaacaatgaaatatatgaaaaggctgttaaaattcttgagacatattggttggaagacgatgatgagacactacctacaggcgatggtgctcaacctggaacctggttggatggagcagggttgatgctagggttactgtcggagtcgagtctgggtggggtggggagttgggggtttgggtgggtgaggacgggtcagtttaactaccatgtccaaataagaagggtggtggtgggtgggttcaacagcagcataatgaccttgttagaagtttatgttgtgtttaaagtatatatatttgctgggcataactatggggaggttctatgttgcagtagcagagaccatattatgtggcagtggatgggttttcttgaatgcggcttttga

SEQ ID NO: 9812 - DNA, 2079 bp, Glycine max
  Peptide Sequence Number=SeqID_126590
gttgttgttactgacgacagaatgtcggaaggaaccagtctggtgctggaatcatctgaaaatggcacagatttgtcacaggatgacattggcaccattgaggaaataccagaggaaacaattctgtctagacaaacttctgtcaaccttgttccttttattggccaaagatttgtatctcaagaagcagcttatgaattttattgcagttttgctaaacaatgtggcttttcaattagacggcaccggactcgagggaaagatggggttggcaggggagtcacgaggagggattttacttgccatcgtggtggatatccccagattaaaccttctgatgatgggaaggtgcaaaggaatcgcaaatcgtctcgctgtggttgtcaagcatacatgcgtatcgtcaaaagatcagattttgatgtccctgaatggcgtgttactggttttaggaacattcacaatcacgagttgttaaaatccaatgaggtgcatcttcttccagcatattgtcctatatctcctgatgacaagggtcggatatgtatgtttgctaaagctggaatgtcagtaaggcaaatgctaagattgatggagctagagaaaggcatcaaacttggttgtcttccttttacagagatagatgttagaaacctgttgcagtctttcagaaatgtggatagagataatgatgccattgatttgattgctatgtgcaagaggttaaaggatgaaaaccacaacttcaagtatgaattcaagatagatagtaataacaggcttgagcatattgcatggtcctacagttcatctattcaatcatatgaggcatttggtgatgctgtggtttttgatacaacctatcgagtagaagcttatgacatggctttcttgggcttcatgaaaggaaaagctccacaaacaatattgacagatcataacatgtggctgaaagaagctattgcagttgaattgcctgaaactaagcatggcttttgtatatggcatattctttctaagttctctgactggttttctttatttcttgggtcacaatatgatgagtggaaagctgagttccaccggctatacaatttggaactggtggaagattttgaagagggattgaccagtacatgtcagtctgaatccattaatgctttcatccaacagttcttgagtgcccagtctcaattagatcgctttgtggagcaagtggttgaaatagtggattttaatgaccgagctggagcgaagcaaaagatgcaaaggaaactgcagaaagtgtgcctcaaaacaggttcacctattgaatcccatgctgccactgcacttactccttatgccttaagtaaactccaggaagagctagttttggcgccacaatatgcatcctttctggttgatgaaggttgtttccaggtcagacaccactctcagtcagatggagggtgcaaagtattttgggttccttgtcaagagcacatcagctgcagttgccatctgtttgagttttcaggcatcttatgtagacacgtgctacgtgtcatgtcaactaacaactgttttcacatcccggatcaatatttaccagcccgttggcgaggcaacaattcatcttctgttaaccactaccggggtacaaccagtagggatcagcctgaaaggatacagtttttagaatccatggtttcaacgtttttagtggaatccattgaaactgaggaacgcctggatgttgcttgtgatcaaatttctatggtgctatcacgcatcaaaacctttcctaggtccccacacggggtgaatgacattgcatatagttatccatcagattcattaatcctgccagaggtagaagatactgatggaatgattcccggctttacaatcacaaatccccatgattctatcactacaggaaagctaaaggagagaagagcgagagatgtagtggatctcactaggaaacgcaggcagttctccatgccattgtgtgctcaatatggacatgatgcgtctgattgctcaataatggcgagtgacaatatgagtggagatgcattagggtacttgtag

SEQ ID NO: 9813 - DNA, 801 bp, Glycine max
  Peptide Sequence Number=SeqID_126591
atgccacagagaatggcagttacacatgcagaccttgaaccaagcagaagtaaaacagatttgagcagcaaaactggtgcctttcttatggttctcacaatcctaataggcctcttctgcttcatcctatgtctcatagcagaagccacacgttccgaggtgacatggatggacacaggtgggaaagaaaatggagcaaaatcagaatgtgtttatagtggaagtgggaaagtgccattgctatgtgctgcttctgcttttgttggacttgcatttgccatggtaatggaacatgcttacatgctgatagcagtgagtaaatcatcaccttctttgcttacctgggaccctgattctccttctgccaagtccctaacatggcaggcagggtttttcttcattacaacttggatttgtttcggaattgcggagattttgttgctggcagcacttagtgtagaatcaggccatctaaagaactggtccaagccaagaacaggttgctacagcatcagagaagggttgttctctgctgctggtgtgtttgcattagccacagttttcttggctgctggtttgtacctaacagcactacgtgcacaaagaatgtcagaggaacacgcaaatgttcgaagagaggttctagaagcctctgccttgtatgcttctccaccaagatcacctcaaccacaatacatgtcaactgttgcaagggaaaaccccacaacaagagagactcagaatgagcttctcttatctgtgtttccaactccattcatcaaaagtcatggctttgtttaa

SEQ ID NO: 9814 - DNA, 186 bp, Glycine max
  Peptide Sequence Number=SeqID_126592
atgctggtgctgaagaagtgcattattattactgatggtgaggccaagcctatggaaggtgaactttcaaaatcactactggagaactacaaatgctatctattggactgtggggctgaggtatttgtccgggttggccgggtaacacaagttaaagaacgaaaagcagaatgtgaagcagctgag

SEQ ID NO: 9815 - DNA, 333 bp, Glycine max
  Peptide Sequence Number=SeqID_126593
atgggacggcacatcttgttagagttgtggaagaagtgcttagtcttgcgactacgtgcaaattctgaaagcgagactgaaagcattggtggtgtctcagacgaagccaatgaggagatgtatggtgaccatgggaccagaggagtgagtcatcgaggtggacgaagagaagatcggtcaacaatgatgtcgaaaaattcaaaatgtcctgaaggtgttgcgacccatgggataaatgtcttacacactagtaccttcaaagacgatatgttgtacaaagaagttgaatgtcacgaaggcatgtctaacatgcttgcatgttccaagaaatag

SEQ ID NO: 9816 - DNA, 374 bp, Glycine max
  Peptide Sequence Number=SeqID_126594
acatacttgagagagcgtttcagccccttatgatggtggcctcgatggagaaagggcttggctgtggcaacgaagggaggccgatgagaagcaaagcaggggaaaaaatattcggagctttacgtgagatgtcttccttgttctctgtgctgctggtgctatcattatcccaccctgggaaaatcaccttgtcctcaaggaatccaggcgggagtcaagaatggttaaaggtttcattatcagttgattatagaatgcgtctggtgggagagaagaggttgtggaacatagtgagggtgtattttggatgtggtggcttcggtggtggtggtggatgtggtggcgggtgtggcggcggacgtcgtcgtcgatga

SEQ ID NO: 9817 - DNA, 552 bp, Glycine max
  Peptide Sequence Number=SeqID_126595
atgttacggaaccttgcggattacataatcatcccctttttgacttacggaatgttacggaacctcactaattatgcaatgatgcttccatttgatttccggtgtgtcacggaacctttacggattgtgcatcaatattttcttttgtttttcggcatgtcccggaatttcacaaattgcctaatgatgggtgccaagcaccttacaaggaccaaacaaaggtcgcatgtcatcaagcaaaggtccccggacgaaattaggggtccttatcattcctctttcttcttcacttcgtccaagtggtgtgatcagaagggggagtacctgcaaaagggactccaatgctcaataactgtgattattgcctcacgttggtctgaatgggtacatttggatcttgagggcgagatgaaggtgttggagaaaaggacattggatgttgaggcttcgaacaagcttaataaggaggaagtggagaagttggaagctactttggccatcgcaaagagggagaggaatgctgaaaaggaggagaggattggggttgagtag

SEQ ID NO: 9818 - DNA, 168 bp, Glycine max
  Peptide Sequence Number=SeqID_126596
atggaccgtctttggttgcttctttacaaatggtctgatatgcaataccacatgccaccttattgtacatgcactaatgtggcaggagaaatagttgagatcggacaagtcaaagatttcaaagttggcgacaaagttcttgctaaactcaaccatcaagtattctaa

SEQ ID NO: 9819 - DNA, 332 bp, Glycine max
  Peptide Sequence Number=SeqID_126597
tcaaagtacagcaccggaggcacgaccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcaggctccctctccggaatcgaaccctaa

SEQ ID NO: 9820 - DNA, 305 bp, Glycine max
  Peptide Sequence Number=SeqID_126598
gcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggtgaacgtgggtggtctagtgcccccacattgttccttaaaatcggttgtctcggatgacgcttgccctggcgcttgctttgttcaacgcgatgctactactcttagttag

SEQ ID NO: 9821 - DNA, 390 bp, Glycine max
  Peptide Sequence Number=SeqID_126599
atgaggcaccatccactagggaataagccatggaaggaggagcttcaccaccaagagagtgccttggataagaagcttagagaggaagctttaacggaggaaatgaatgagagagagtggcatctccagtcacctttcctccttctccattccactgccattgattttcaagaagcaaaggacttcattgatgaagaagatccaaggcctacaagctctacatggagctacattaaaacccaagaaaagatccagggtttgggaaatggatggtgtaggctaaggagatgttgtggtataaagggggctaatgaggggaagggcgaaatctgggaacaaagggcggagagagcagttgtaagagataagagacgagagtccttaatttga

SEQ ID NO: 9822 - DNA, 564 bp, Glycine max
  Peptide Sequence Number=SeqID_126600
atggaggagtttgacgcacaggtggcctggccaagagaccagccttattcctctagagggggtggggtctccacagcccaggagcctgttgtaggagagcatcatccacagaagatggttcaaggcaaatttgtcccaaatttcggggagccactgggtatggaagctaagtgcctgaaaaaaaagggcaagtatggggaaggaacaaatgcaaaagtgaaggttattctatggatgaatgctctcctagaacctaagcttttgaatcctagaaaaaccatgaattgttggcagcctaaccccattacaagcctagaaagtccttcggattcatttttgtgtgttcattgctgtatgataggagatgaaatgcaaagcagttgggctaagctcaacagttgggctaagcacatattcaccactaagcatagctttagcgcgcttagcacaaaggagaatttggctgagcgtcagcatcaaagtcgcacgctaattgtagtaggtgccttcagccaggctaagcttgagactggtgctaagcccaatttcacttactcgcgctaa

SEQ ID NO: 9823 - DNA, 801 bp, Glycine max
  Peptide Sequence Number=SeqID_126601
atgatgagcatgattttagctttgtggcatgtacttaaaagtaggacattacctggtaaatgttctctaaaatgcagtgctggtatgaaaaagttcttcccgaattccaaaaggcgaaaatgttacagaatactagcaaacaattcaacaactttggttctagttagagcaaaatttgtgtacaagaactatgatggacttgggaaatcccctaagttctttgtttgtattgggatagctatcgctgcaagcataaatcttgttgaatcagatccatggagtgaagagtttctatggactttccacaaggatacactgtcattttgcttaaatgcaattccaaaaggaggttcacttgtaatttcttcccctgaaattagaccacttcctcaaggagcctacacgaatggcatggaagattttcctattaagttgataaggaagagttatagaattaattgtggacactccaatgattctataaggtatccattggatccatttgatagaatatgggatgctgatagaagtttcacactatttcatgttgcaactgggtttaagattcaacttagcttcaaacagtctagtcttgtcaaaaaaccaccaccagttgttcttcaaacagggagagttttggctcgaagaaatacactgacatacagtgatgcaatccttccaaggaggggatccatcactagagccatggctaggagactccaagaatattgggccagagatgcaggagaaggtcacaggattctcataagctttagggtagattttggacgcatggactaa

SEQ ID NO: 9824 - DNA, 1212 bp, Glycine max
  Peptide Sequence Number=SeqID_126602
atggatgaaattgaaatccctgctcatttcctctgccccatttccctccaactcatgagggaccctgtcacggtttgcacaggaatcacttatgatagagagaacatagagagatggttattttcatgcaagaacaacacatgccccgttactaagcagtgtctattaaaccatgatctcaccccaaaccacactctacggaggttgatccaatcttggtgcaccctcaacgcctctctaggagttgaacgcattccaactccaaagtcaccaatagacagaactcagattgtgaaactcctcacagaagcaaaaaggttccctgagaagcaactcaagtgcctcacaaggcttcgatccattgcctttgaaggccaaaggaacaaaacatgtttagagtctgcaggagtaatagaattcttggtctcaacaatgaagaacaacaacacacaagaagactcaactgttctcagtgaagcagctattgaagtcttgttccacctcaatctttccgaggctcgggttaaagctctgattaacaacgaggaatttcattttattgagtcattgtttcatgttttaagacttggaaactaccaatctagagcctttgctacaatgctgcttagatcagcatttgaggtagctgatccaatccaattgatcagtgtcaaaactgcactgttcgtggaaatcatgcgcgttctgcgcgatcagatttcgcagcaggcttcaaaggctgcattgaagctcattgtggagctctttccgtggggaagaaacaggatcaaaggggttgagggtggtgctgttttggtcctcgttgagttacttcttggtgcctcggaaagaagaacgtgtgaactcattttgatagctttggatcagctttgtgggtgtgcagaagggcgtgcagagttgttgaaccatggagcaggagtggccattgtgtccaagaaaattctaagggtctctcatgtggcaagtgacagaggggttagaattttagcctctatttgtaggtattccgccaatgctagagtgcttcatgaaatgttgcaggttggggcagtgtccaagttgtgcttggtgcttcaagtgaattgcagtttaaagactaaggagagggcaaaggaaatactccaattgcattctgtggtttggaagaattctccatgtattcctgtacctttgttatcttcctatccatga

SEQ ID NO: 9825 - DNA, 1248 bp, Glycine max
  Peptide Sequence Number=SeqID_126603
atgacagaaattgaaactcctcaattttttctttgtcctatttcgcttcagatcatgaaggaccctgtgacaaccgttacagggataacatacgacagagaaagcatcgaacaatggttgctaaaagcgaaagattgcacgtgtccaatcacaaagcaacgattgccacgaagcacagagttcttaaccccaaaccacacgcttcggaggctaatccaagcgtggtgctcagcaaacgaagccaatggcgtagaccaaattccaaccccaaaatcccctcttagcatcgccaacgttgagaaactcgtgaaggatctcgaagtatcttcccgttttcaaagggcattggagaagttgcacgatcttgcaatagagaacgggaggaacagaaggtgcatggcttctgcgggtgtagcagaagctatggtgcacgtgatcacaaagagttttatccaaggtaacaaaacgacctcgtgcgttgaagaggctctgagaattcttggtttgctttggagtagtgctaataatatggtcgacaacgacaacatgaagcgcatggtgggtgagaactttgactttctcaactctttgacttgggttttgcagcttcaaaccaagaacaacgttaaggtaataaacgaagcaatgccaatattgaaattgacaattgaagccaaagattcaacccctttagggaacttgaagcttgaattctttaaagttgttgtgagtgtgatgaaaaatagagaactcactcagcaagctgttaaatctgcattgcacgtgcttatagaaacctgtcctttggggagaaacagaatgaagatagttgaagcaggtgcagtggtggaactcattgaacttgcacttgaaaaaccagaaaagaatatgacagaactcatatttattctcttggctcatctttgttcttgtgctgatgggagagaacagtttctgcaacatgctgcaggcattgctgtggtttcaaagaggatccttagggtttcaccaaccactgatgatcgagctcttcatatattttccttggtttcgaagttctcggcctccaatgaggtcgtgcaagagatgctgagggttggtgctgtgtcaaagctttgcatggtgttgcaagcagattgtgcttcctatttgaaggaaaaagcaagaggggtacttaggttgcactcaaaaacatggaacaattctccatgtattcaagtgtatttgttaaccagattccataggtga

SEQ ID NO: 9826 - DNA, 297 bp, Glycine max
  Peptide Sequence Number=SeqID_126604
atggaaacagatgccgagagagaggattcacaattcacatcaatatgtgcagaaattaacgagttggagggagctataaacttgaggaagctgagaaggaaggtagaaaggtgctgtctagatagacaaagtgtccatcatcgcggggcaggggatgcaagtaaattaaagcttctctcccttttgctttcagatggatttatattgggttgggacttcacttgggagagtttcatgagtagtactctctgcaactttgttgtcttctccaaacgaaaattctatataaatttataa

SEQ ID NO: 9827 - DNA, 495 bp, Glycine max
  Peptide Sequence Number=SeqID_126605
atggtggttcccattgcagttgttgtcacgaacgccaatgaaaaccaccatcaccgacacattgaattcgttctccaagctgacttgatacaaagcacattgtccatttctagattgatcttcaccaattcatcagtggcacaagagaatgtttttgtggctgagttggtggtgcaaaagccacttgttgagaaagtggcattcacatctgataaggacattgaagctcaaggaccaacacaaggactaggaggacctataaccaaagctagagccaaaaagacaaaggagaccttacaacaactggtagcaataattcttgaagttgtacttgcggcatacagctcgcttagcgggttgggaaaccctagaagaggattagtcagagatgtgctcacccaacacgtcgccagcttgcccagcgagtatactgtttcttctcgcgcccagcttgctaagccaaaattcacttactctcgcttagcgagcctttag

SEQ ID NO: 9828 - DNA, 1452 bp, Glycine max
  Peptide Sequence Number=SeqID_126606
atggagcagtttcctgaaaccgctgcttccatagtctccttcaagatcgattccgacgtcgtttcgctcgacggtagggattttctggaaacagacgccgaagtcggcgatgatgggaagcttcacgtaacggttaggaagtcgaacgcttccagaaggtcctttatgatgactccgcggccctctaacctcaccggcgcggagatttacagcctcagctcgtcgcgtaaccccacgccacgtggctccaacttcaaccacgcggatttctactccatgatggggtacgcgccgaggcattctaattttggtgcagcggatatgtactccgtgcagtccacgtcacgcggggtcacccctcgtccctcgaacttcgaggagaattgtgggtctgctggtgcaatgcagcagcagaccatcagctccccgaggttcgggttctatcccgcagtgcagacgttgcccgcggcgtacccggctccgaacccggaattctcctccgggttaacgaagagtgtgagcaagaattctcagacgcagcctcagcttcagactcagacgcagccacaggttcaagctcaagttgctcctcctgctcctcctcctcaagtagctcaacctgccaacagtgggaataaaaccagccacgatgctaaggagctccatatgtttgtatggagctccagtgcgtcgccagtttctgaagccggcggcctccacgtgtttagtggggctgattttggagcatcggatcagtcaggtcgctccgatcaaggtgccaaggagattaggatgttggttgctgatgaccaccctcaaaatggagaaaccaacaaagctgctgcagaaggagaatttggtggggaagagttgaagtttcctgcgaaagaaggagaacaagcagaggaagagggagggaaagctggaccagctgggcttaacaagttaggatctagttcaacggcggagctacacccgaaagccgctgtcgccggtgctggaaaacacatgcctccggcgagtgtgatgacccgtctcatactgattatggtgtggaggaagcttattcgcaaccccaacacttactccagtctcattggtgtcatttggtccctcgtggcgtttaggtggcatgtgcacatgcccaaaataattgagaaatcaatctccatactgtctgatgctggtcttggaatggctatgttcagcttgggtctgttcatggctcttcaacctaagataattgcatgtgggaactctgttgcaacatttgccatggctgttcggttcctcacaggtcccgccgtcatggcagcagcttccatcgctgttggcctacgtggcaccctcttgcgtatagctattgttcaggctgcactaccacaagggattgttccatttgtgtttgccaaggagtacaacgtccatccagccattcttagtacagcgtga

SEQ ID NO: 9829 - DNA, 654 bp, Glycine max
  Peptide Sequence Number=SeqID_126607
atgacgattgttcccaaaaatcgtcttaaatcgtcttggtggtggcaattttgtaatatagaggacttcaatgacgacaattttacaaaaacggtcttagaaatcgctaaccctcatggcctcactcagctcgtgccctccctccctcactcactcatgtcatgccctcactttgttcctcactcatcagtcgtcgaaggtgcctccattgttatagaggattttgttggaataaggattccactgatgccaagtccaactccaagtcaaaagaaagtgaattttcttgtgacttatcactttgttaatgctttaaagcctcattcttcatcatccagagccaaattatccatgagaaacatcttaccaaaattcggctttaagaaccgtgcaccatcgatattgcttgatgttgaaaagggtgttactattgctactcaagaaggttccttttctgttcatcaagagaagtcttcaatcccaagatcagtgtctttcacaaagatgtttactcctaagattaagagaacgtcttcattaccaatagaagaacttgggcttagggcgatgtctcgctcagcgcacaagtccggcttagcgcaagaaggcccacgaggagaagcccaatgcatgctcagcgcgaggtcagcgtga

SEQ ID NO: 9830 - DNA, 249 bp, Glycine max
  Peptide Sequence Number=SeqID_126608
atggatgaaaaggatgaggagggggagaaagtggaaaaaatccacaatattgtaattggaaaaaggcttgcaacaacaacaaatgcaacctcaactgctaccaagaaagggaaaaatgttaaagtcagttatccatttgattctatgtttgtcaagagtgttgatgcatcctcttacatgaagattaatgaaaaagtgttttacttgttggatagttttgttgaagagattggagagatgttcaagtga

SEQ ID NO: 9831 - DNA, 225 bp, Glycine max
  Peptide Sequence Number=SeqID_126609
atgagaaagaagaaagaaacatggaagccaactgtggtttgtgtgggcccgtggtccccacaaaacatgaagaaaggtgtgcgactttcttgtccattggcacgtctcttggggcccaattttgaattgtgtaagaggaaagaaccagcaccgacaagttcaattttgtcgccactctacaagccaactatgcatattatgatcatcatcactcgtttaaggtga

SEQ ID NO: 9832 - DNA, 396 bp, Glycine max
  Peptide Sequence Number=SeqID_126610
atgacaagagcaagagctaaaaaggcccaagaagctttggaacatatggtgactattctgagggcagttcaaatgcaaggagaggcccaacacttagaggcccacaagggaaagttgctagtcctatggttcttccttgaaccaactgatcttatcaggaattcacccaattcttgtggtgatcctttaggcttatcaaacctcgatgtttgtggcgcctatttgattttctatctttcacgttttctgttcgtgtttggactttcgacgttcttcagattgtgccttcggcccgaattttctcaagttcattctgcacgtttcttgaccctaaatggcagttcagagcgtcatgtttctcctcattttggaatcactcaaatccgagttctgtag

SEQ ID NO: 9833 - DNA, 273 bp, Glycine max
  Peptide Sequence Number=SeqID_126611
atgggagctctgaatcgccaaggatttcaaggctacaaccaaggaggaccgttgggattcaaccaagggaggaactttacacaaggctcaagctggaggaatcatccggggaaccagttcaacaaggagcaaagaagtcaacctggccagaattccaaccaagggattgatctttatgagaagactaatatccatgtccaactacaagatcacggaatcatccatcaagaacttggagatacaagtgggaaaattagccaaacaaatggttga

SEQ ID NO: 9834 - DNA, 258 bp, Glycine max
  Peptide Sequence Number=SeqID_126612
atggcttcctatggtagtgagcttgttctgactcatcttctctccttgaagtggcgtctccaatcatctttcttccttctccattctactgcaattgatcttcaagaagcaaaagactccattgatgaagaagatccaaggcctacaagctccatatggagctacatcatgtggtatcaagaacatcttcgtctagttccctacatgatgcctatgaagaagttaagttgtggtgctgagttgtggctggatttgtga

SEQ ID NO: 9835 - DNA, 712 bp, Glycine max
  Peptide Sequence Number=SeqID_126613
atggggcaaagcctggctgaacactttcattgttcactgacggctgaaccggcccttaaagagcaggcctttggtcagtttgaaggtatgccgttagaactactcagacaaaaacatccaaactatgcaaatgcattattcaggcttgatgcagagtattgtccaccagggggggagtcactggcgcatgcttctcagcgaggcactctggcaattcttaaagaagggactgtcgatagtttccctcgctatgctcatcccaatgcaagcattgaaaacccatcctgccagagtcatcattatttaagcacaatgttcactcctcgcttgcgcatcgcaaactcatgctcttctgatgacgctggcgaaagtgagggtgaaatggataaaacagagaaaaatcagatagtagatagcgacattgcacagttattactaaagcacaggaaagctcgtaactggacggtaacggaacttgctcaacgctcaggcgtcagccaggcgatgattagtaagattgaacgaggcgtctccagtcccagtgcgactatcctaagtcgtttagcgaatgccatgaacattacgctatcaaaacttttcgccgagcttgagcaacatcagaactcgctggttcgtttcgctcaccagcagcagcattggacagatgaacaatcaggcattattcgttggacattgtccccggcgggcgcca

SEQ ID NO: 9836 - DNA, 306 bp, Glycine max
  Peptide Sequence Number=SeqID_126614
atgtcattgcctggcgctgttcatgcatcctccacctacgagtctggagccccgcgaagttattgcgtagcgcttttcaccaattctccattctccacttttttacggagccccatgaatgtcattgcctggcactgttcatgcatcctccacctacgagtctggaaccccgcgaagttattgcgtagcgctcttcgccaatactccgttctccactttttaacggagccccatgaatgtcattgcctggcgctgttcatgcatcctccaccaacgagtctggagccccgcgaagttatggcgtag

SEQ ID NO: 9837 - DNA, 1011 bp, Glycine max
  Peptide Sequence Number=SeqID_126615
atgattggacttccggagccggagaatgagttccggcgagatttccgtcggccggtaagtgtaaggatggccgttgacggtgccggtccagttaacactcgtgagcgtgtatttggtgcatccatcaggatccgccatggacaacagggtaggaaaataatgctcctcggggtaacactcatcgtcacggtaacacgggatcttgaatttcctccaaagtgtcctgtccttaacgacgacgagcgcgtggcggcgcgtgagcgtgaagaactgagagcccacgcggaaatcttcgaaggggatctccggcatcatggcgtagcgtccgcgggaggagtagcgcctccagagcttgggcgcgtgggagaggatctcgacgaaggatttgtatttgaggcggaggccgaagcgggacgaggattcggggttttcggaatcgaaggttggggagaggaagagggagttgtaggtgtatttgaaggagtggagagggatgcagtgctgggagaggagggcgaagtaggcgttggaagggtcgtcgaggagagcggaggcgaggaggcggcgagtggcggagataagggtaggggaggagcggaaggtgggtttggaggagatgaatttgttacggaaaagaggggaaagagggagagtgagaggtgggaaggggaggaagagaagaagaggtcccataagggggagaagtggagatcggtgttggtgaggaagaggaaggcgattttgagagaggggtttttggaggagaggtggaagaatttggaagggttggaatgggaattgctggaatgggaaatggcgcggttgaagaggttgatgtcatcgagctcgtcggagggggagatgggggggaaggaatggggctttggagggaggatccgtggggcaaggaagaagaggattgggagggagagaaggagagagaaggttaacacgaatgggcttgagaacattgagtttcctggggaatggaaagcctacaggagaaattaa

SEQ ID NO: 9838 - DNA, 102 bp, Glycine max
  Peptide Sequence Number=SeqID_126616
atgactactattctgcacctggtgatggacaacaagaaaatgaggcccattatctgtaaaaccaaggcagacctcaacaaaactttcaaggaagctaccaag

SEQ ID NO: 9839 - DNA, 1740 bp, Glycine max
  Peptide Sequence Number=SeqID_126617
atggtgtgtgcctccgaagattgctccgataactctcagcgaccggactcacacaaggaccagcgagtctatttcgttcctcacaggtggtggaaggatgctcaggattcaatgccggcggattcggataagaagaagggaattgcgttcgcctcttttcccggttcgtcctatgctggtcctatgaagattatcaataacatctttaactcagatcttgtgttcagtcttcggagggaggacgatttgcagcacattcgtgaaaatggcgaagttggtgtgtctggccgggactttgctttggtatctggggatatgtggttgcaggcactcaagtggcatagtgattcgaaaaatgtaatgaaggatgacaaaggcttttcagcaactgacagtgatatggcagatgtatatcctttacaactcaggctttctgttcagagggaaacaaattcatttggagtaagaataagcaaaaaggacaatgcagttgaactctttaaaagagcctgcaaaatgttcagtgtggattcagagacgctatgcatgtgggactattctgatcagataacatttttaatgaatgacaaaaatcagattcttttggagttgcaagtttatggattgtcagactcaattagatgtagggaaggaaagaaagatgagatggcaaatttttctggcagtgcttcactgaagatgaatgacacttatgacggtgcaaattctgattgtatgaattccaattctttgaccttctcttcaggccctggtgaagcaggttccttgggattaactgggttacaaaacctaggaaacacttgcttcatgaacagttccctccagtgtttagcacatacaccaaagctcgttgattattttctggaagattatattagagaaatcaatcatgataacccattgggaatgaatggtgagatagctttggcatttggagatctgctcaggaagttatgggcgcctggagcaagtcctgtggcaccaagaacattcaaatcaaaacttgctagatttgcacctcagttcagtggatttaatcagcatgattcccaagaacttcttgcttttttgttggatggtctccatgaagatctgaatcgtgttaaatgtaagccttatattgaagtcaaggatggagatgatcgaccagatgaagaggttgctgatgaatattggcataatcatttggctcgcaatgattctgtgattgttgatgtgtgccaagtagattatattgccattggattgctatggaaaaaattaattagcttctttgtggggaggggggtgacatttctgctgaagggtcaatataaatcaacattagtttgccctgtttgtaggaaggtctctgtgacatttgatccattcatgtacctatcattacctctaccttcaacaacaatgcggacaatgactataactgttagtggcaatggtggtgaaatgcctcaattatcaccatatactattactgttccaaaaaatggaagatttgaagatctgacccgtgctcttagcattgcatgtgctttgggggctgatgagaccttattagtagctgaggtatacaacaattgcatcatacgtttccttgaagatccaactgattcattatccttaatcagagatgctgacaaactagttgcttaccgatttttgaaatataatgcggatgcccctttggttgtcttcataaaccagcggatggaggagtaa

SEQ ID NO: 9840 - DNA, 261 bp, Glycine max
  Peptide Sequence Number=SeqID_126618
atgatgatttgggaacaacgtgcaaaattagtcatggctacagctaggtgggtactcaagcatccagtttatggcattgtgatactaaggcttgggatttacacaaaatacgaatctggggatcccacggtcatgtggctccgcatgccactggacttatgggtcatggtaacaaaaggtggggtggtcgacaaaagctggacttttgctcctacgtatcctcaatttgtgatgaggaactcagacctacgtagttcttga

SEQ ID NO: 9841 - DNA, 856 bp, Glycine max
  Peptide Sequence Number=SeqID_126619
gcagtatgtctatgggaagctgactctgaattggaaagcctttggaattcctgttgtagatatgctttatagtgttacaaatggatctgatctccgcaatttgtatctaaagtggttctatccatttcaaaatccaattgaagaggccttagaaaattgtctcgtgtttaaggaaactgaagaagacacagaaacagaggccacgactcctagtttaggttcaaatgtgaatgggttagacactccttcagatggaggaatggagttttatgttacagatgaaaagggaactatcaagaattccaagatattaatgaatgagcctctagtaataaatggagagttaaggctgctgcacgtgcttgtgtgttggtcagaagaacagcttaagaaatataacacacagctttgtagttcattgcctgaggttttcaagtctggctttttagcaaagagacctcaagaatcagtttctctttacaagtgccttgaagcattcttacaagaagaacctcttggaccagaagacatgtggtactgtcctggctgtaaagaacatcgtcaagctagtaagaagttagatctttggagacttcctgaaattttggtcattcatcttaagaggtttcaatacagtcgttacttgaaaaacaagctggagacatatgttgatttccctgtagataatctcgatttgtcagcttatattacccatgggaatggtgagtcatacaattacacactttatgctgtcagtaaccattatggaagcatgggaggtggtcattacactgcatttgtccatcttatggtttgggatatgagaaacggttttgaaacaattgaaatggtttga

SEQ ID NO: 9842 - DNA, 1506 bp, Glycine max
  Peptide Sequence Number=SeqID_126620
atggagattctttctttcatgattatatttgcatgcatatttgttccctctctcaaaatatcattagcgattgattctatcaatctgctccagtctgtgagagatggcgagaccttggtatcaaaaggtggaaagtttgaacttgggtttttcagcccaggtagttcccagaaacgttatctgggcatttggtacaagaatatcccaaacaaaaccgtggtttgggtagctaatggggccaaccccatcaatgattcttcaggcatcataacactaaacaacacaggcaatcttgttctcacacaaaagacatctcttgtttggtacaccaacaactctcacaaacaagcacagaatcctgtgctagcgctcttggacagtggcaatcttgtgataaaaaacgaggaagaaacagacccagaagcttatttgtggcaaagttttgactatccatctgatacactcttgccagggatgaagttgggatgggaccttcgaactggtctcgatcggagatatacttcttggaagagtccagatgacccatccccaggtgatgtttatcgtgctttagtactccataactatcctgagctttatatgatgaagggaacacaaaagttgtaccgttatggaccttggaatggcctatactttagtggacaaccagatctatcaaataacaccctttttaacttgcactttgttagcaataaagatgagatctactacacctataccctcctaaatgattctgacatcaccagaactataacaaaccaaacaggtcagattgatcgctatgtatgggatgaaaatggtcaaacatggagactatatagatactacccgaaagaattttgcgacagttatggcctctgtggacccaacgggaactgcgtaattactcagacacaagcatgccaatgtttaaaaggtttcagtccaaagtcaccacaagcatggttctcatcgtcggattggactggagggtgtgtccgcaataaagggttaagctgcaacggtacagacaaagataagtttttcaaatttaaatctctcaaagttccagatactacgtacacttttgtggatgagagtattggtctagaggaatgcagagtcaagtgcttgaataattgttcttgtatggcctttactaattcagacataaatggtgaaggtagtggttgtgtcatgtggtttcatgatctctttgacatgagacagtttgaaagtgttggccaagatctatatatcagaatggctgcttcagagtcagactctcaagaaccagtatcaaggcacaagaacaacacgccaaagatagttgcttcgtccattgctgcaatttgtggggttctttttctaagtacttattttatttgcagaatccgaaggaacagaagcccaaggaacagcgctgatgatgtgatagtcaccctggaagccacatgcatgacttatcctgccatactaattgatggcatgtggttgtcaaagtaa

SEQ ID NO: 9843 - DNA, 222 bp, Glycine max
  Peptide Sequence Number=SeqID_126621
atgccatgccaagtagggcattgcaagccaaaaagaaagtaccggggttgtttggtccagaaaggaatctcttgctccatggatgatggtcctactgggtactggccactggcaaattggcaacggccaaccctaggccaagataaagtcaagtcacccatctatctagctatctttctttcagacaagatccatgccacacacacacatgcatccaattaa

SEQ ID NO: 9844 - DNA, 130 bp, Glycine max
  Peptide Sequence Number=SeqID_126622
atgatggataaaagattgtccctctggatgaagcacaccatgtacccaaagaagggtcaaatggtaaccctctcaaagatgaaaagcactgttcaagtggtcctcttcgaggatgagagagtgacacatg

SEQ ID NO: 9845 - DNA, 588 bp, Glycine max
  Peptide Sequence Number=SeqID_126623
atgtatattcatcaagattcccgattgagaattatccatagagatctcaagccaagtaacatcctacttgacgaaaatttgagtccaaaaatatcagattttggagtggccagaacttttggaggagacgaatctgaaggaatgacaagaagagtagtaggaacctatgggtatatggcaccggagtatgctgttgatgggtcattttcggtgaaatccgatgtctttagctttggcattttagcgttggagattgtatctgggacgagaaacaaaggactttatcaaacggataagagtcataaccttgttggtcatgcatggacattatggaaagcgggcagggaattagatttgattgactcaaacatgaagttgtcgtcatgcgttatatcagaacagttcccagatgatagacctccaatgaagtctgtgattccaatgttggagggtcacatggaaatggttgagcctaaagaacatggttttatttcggtaaatgttttaggtgaattagatttacactcgaatccgcaaaacacgagttcatcaaattatgtgacgattaccatgttagaaggtcgatga

SEQ ID NO: 9846 - DNA, 198 bp, Glycine max
  Peptide Sequence Number=SeqID_126624
atggcagaagatgaagatttagagccgtacatatctgttggggtagcaacatccccatacccaagcactctggtgttaagtaatagtaacagcttgcaaacgattgaagaaagagagaaaaaattacctccgtcaggtatatcgagtggcagttcgcgagttgccgaaaggaattgcagtggtggtgctaagtggtga

SEQ ID NO: 9847 - DNA, 1119 bp, Glycine max
  Peptide Sequence Number=SeqID_126625
atgtattttgacgagtacacttacaattttgttcttggagcctgtgctcgctctccttcagcttcaacgttatgggttggtagacaactacatgctcggattgtaaaacatgggtttgagtcaaatattttggttccgactaccaaaatatacttttatgcgagcaacaaagacattatctcagcccgaagagtgtttgatgaaatgccgagaagaagcactgttacctggaatgctatgataacaggttattcttcccaaaaagaaggaaacaagaaatatgctctcaatgcgttgtctttgtttattgacatgctggttgatgtaagtgtaattaaaccaacgggtacaactatagtttctgtgctttcagcagtttctcaaattggtatgctggaaactggtgcctgcatacatggttttgcagagaagacagtgtgtactcctgaagatgatgtgtttataggcactgggcttgttgatatgtactcaaaatgtggatgtcttgatagtgccttgtctgttttctggcgaatgaaccagaagaatatcttgacttggacggcaatgactactagcctagccatccacgggaaaggaaaacaagccttggaggttttatataaaatgggagcttatggtgtgaagccaaatgaagcaacttttactagcttcttgtcagcttgttgtcatggtgggcttgttgaagaaggcctaatattgttccatgaaatgaagagaacatttggcatgatgcctcagataaaacattatggttgcattgttgaccttcttggccgtgctggaaatttagaagaagcctatgattttatcatgcggatgccaattaatcctgatgctgtaatatggaggagtttgctgggtgcatgcaagattcatggggatgtagtgatgggagagaaggtggggaagtttcttctccagttagaagagtggagttctgcagagtctccaaagagtgaggactacatagctctgtccaatgtttatgctttagcagaaaagtgggatgacgttgaaattgtaaggaaaacaatgaaatctaagggtattttgagtaaagctggttctagcgctgttcaaactgttagcatggct

SEQ ID NO: 9848 - DNA, 180 bp, Glycine max
  Peptide Sequence Number=SeqID_126626
atggaggccataaggagaggaatatcagattcttcaaaagagtaccttaatccatgtataggtgatagatttgttacaaataaagctttcatacacaacaaaggttatttagaccaatcaaaagaagagaaagaaaatcccttcgccttagcacttaaccaaggtcaagatctaagctaa

SEQ ID NO: 9849 - DNA, 345 bp, Glycine max
  Peptide Sequence Number=SeqID_126627
aaggagctgctgacgtggatgctggagtaggagccgcagaagttgaagggagctcagctggcctagccctcgccctcctaacccctcggatagaaattgttagatcttcgggagtagggaacccaagtctagaagtgttagattgggctatagaggtcatctggccagagatcagcactcctatgtccatatccatgcgagagactaagccaaagatcaacctagctctatccactgtcaaaatcttcccaggatggccctcaaagttcaagatgaaccctcagccaggcaacctgcagtatctggagtatgcgcgtaaggtctccctctctgctaatactacag

SEQ ID NO: 9850 - DNA, 801 bp, Glycine max
  Peptide Sequence Number=SeqID_126628
atgcccgcatggtctgaggttcctacggaccgagacaaagacaactcgttgcagaaatcggaggtcttgattgtgaaccaagtgcaaggaccagagagcattgcctttgatcctcttggtcgtggcccttacactggtgtagcagatggaaggattttgttttggaatggacagtcagaactatgtaatcctaaggaatctgcatctccgatgagttatgtcgaaactgagcacatctgtggaaggcctttgggactcagatttgacaaaaacactggtgatttatacattgcagatgcatattatggactgatgaaggtggggcctcagggtggtttagcaacatctcttgcaactgaggctgaaggggtgccgctgagatttactaatgatgtagacattgatacagaggggaacctttattttacagatagcagcactaactttcagaggagggttttaaaatacaaccttgccactaaggaaaccactgttctcatgaggaacgttcaatttccaaacggcatctccttgagcaaggatgcttccctctttgtcttttctgaagggatgaatggaaggttacgtaagtactggctaaaaggagttaaagctggtacttcagagatcttggcaatcctccctggttttccagacaatgttagagtaaatggaaatggtgacttttgggtggctatccactgtagaaggttccatgcagtagttgtcaagtatagccctgaaggtaaacttctgcggatattggaggacagtgagggtaaagttgttagaactgtgtga

SEQ ID NO: 9851 - DNA, 1602 bp, Glycine max
  Peptide Sequence Number=SeqID_126629
atggatcgccacagcatccccggcgtctccaatctctgcatcttcctcttccttgtttctcttttcccacaagcattaacgctgcgggtctcttctccgtcgtcaccgacgggtcagattaactcaaattcaatcctcgtggctcttctggactcgcattacacggaactcgcggagctcgttgaaaaagccatgctgttacagaaactagaagacactgtcgccactcacaacataacaatcttcgctccgaccaacgaagccttataccgcaacctcgaccccgatttcaagcgcttcctcctccaacccgccaatcttcactccctccagacgctcctcctctctcacatcacccccgccctaatcggatcccaaaccctaacacgccacgtcaccactctctccgaccacaacctcaaactctccgaaaacctcaccaccgtcgaccaagccagagtcacccacccgaatgttgtgacccgacccgacggcgtcatccacggcatcgaccgcctcctcctcccccgttccgtcgaggacgacttcaaccgccgccgcagcctccgctccatctccgccgtcaaacccgaacctgccccggaggtcgacccgagaacccaccgtctcaaaaaaccccccccaccggcgaaacctggttctcttccagaacttccgatctacgacgcgatggctccgggaccctccctggccccggcgccggcgccggggccaggcggcccgcaccaccacttcaacggcgaaagacaagtgaaggacttcatccacacgctcctccactacggcgggtacaacgagatggcagacattctcgtaaacctaacgtcgttggacgttgaaatgggtcgtttagtctcagagggttacgtgctcaccgttttggcaccaaacgacgaagcgatggcgaagttgacgacggagcagttaagcgaaccgggggcaccggagcagataatgtactatcacataatcccggagtaccagaccgaagagagtatgtacaatgccgttagaaggttcgggaaggttcgttacgataccctacggttgccgcataaggtggttgctcaagaagctgatgggtccgttaaattcgggcacggggacgggtcggcttatttgttcgacccggatatttacacagacgggcggatctcggttcaggggattgatggggttttgtttccggcggcggaggaggatgcggagcgggttagacccgttacccaaacgggtcagaacgctacgaagcttgttgtcaagcacaggagagtgggactggaagacttgaattgtgatcaatatgaggttgaaaacaaaaagaagtttctgaaaggcgaaacagaagtttttgaaaagaaattaagggttctttgttgtcttgaattaaaacaagacaaaagggttgagaaacccagtggcggggaaaattgctggaaacagcatgctggatgcttggaacctttggacagcattctagattcgcctcttgtcaatgaagaagcccacgtttttgttgctagcaagatttctcaaaacaatgaagtgagattgcaacttgttgtttcatttactagataa

SEQ ID NO: 9852 - DNA, 237 bp, Glycine max
  Peptide Sequence Number=SeqID_126630
atgtatccagtttcagcgtgggtttttaaatgtgttgtttgggatgcttggaccttggagggtagacagatgggtgtggaaaagaggttcgtcgtcatattgagttttggtgggcatatcaggcatgaaagttcagaatttggacttggtccatgctattattacgtgttgtgtgttttctcaaaagagagattgatatcttggtgcaatcctgttcggggtattttaataggctga

SEQ ID NO: 9853 - DNA, 1236 bp, Glycine max
  Peptide Sequence Number=SeqID_126631
atgttggtatcaagggaaaaagcattggctaaatctgtactcgtcgccacaatccaattgttgtctgaatcacttaacaatatttggaggatagactttgtattcaattctaactcttatgttgtaggtgtcaaagaagctcccagtgccccatgtgttggcaacctatcagtctcaaagatccaacaagccaagaattacttgaggcagtggaaagagagcggaactttaggttcaatccatctagaaatgccaccatatttcatcatccaacactgggggattttgagttacaacatgtatgtgttgccagttggagctagtgatgctgatcttgaagagcgcattatccaacacttagctgctgcagcagcgatgggaagagcacggcacgttgctagaagagaaggccagagaaacagatcatcagctcaaggtcgccaacattttttggttttttcaactcatcctaattcaccacccatggctcctgcttcttcctctccatctcagaggggggatgatgaaccaactcctacaattgatgttgccaatctgtctccaactcctgcaactggagaagaatcatcgcagccgactttagtttcgcctgttcaagcagaacaggtgtctgcttcaggatctggaactactgctcttgctacagatcatcagggatcatcctacaacaataggagatctcctaatcagtcatctccaagtagtcaagacagagcaggaccatcagaattacagtcattttcagaatctctgaaatctaaactgaatgctgtgtcaacaagatacaaggaatcaatttccaagagcacaagagggtggaaggagagatggttctcccgtaacaacactatgtctgaccttggatctgaagttaggcgagaagttaatgcagggattgcaactgtgtcacgcatgatggaacgcctggagaccagagacaataatagaagcaatagcaattctgctccaagtaatatagaggatggttcagtgcagggatctaatgatcagactttaacagcaggcaatgaagggggctctcttgtgagagacaataacacaaaagcttcttgtgctgcaggaagaaatagaattgcccattggggatgtgaaattccatggatggcattgcctattggctggcgcagaccaggcaactggttaggtgggtcgggttttgagtaccccgcaaaaaacccacaaatcctcacctaa

SEQ ID NO: 9854 - DNA, 378 bp, Glycine max
  Peptide Sequence Number=SeqID_126632
atggagaaacttaactccaaagaacaacaccatgataataatgagaagaagaactatgaaggggaggattctttgggctggaaatcacttaataaagggaacaatacttctgaaaggttctattctcaaagcacaggaaagggtagggacaagaacaagaatatagtggaaacaagtgtgaacaatgtgattgaagagacaagtaagaagccaaggctgaattggggtgaaggacttgctatgtttgagaaaaagaaaactaagggtgatggtgtaagtgctgctactgttgctactccagcttttggtgcattcagttccttctcagatatcttgttagattctatcaactactcttttttatggccgttcaattaa

SEQ ID NO: 9855 - DNA, 462 bp, Glycine max
  Peptide Sequence Number=SeqID_126633
atgggtaaagctaaaaagggaccaaagtttgctgttatgaagaagattgtcacttccaaagcaatcaaaagctacaaagaagaggttttgaacccagaaaagaagaatcttatgaaggaaaagttacccagaaatgttccaactcattcttcagcgcttttctttcaatacaacactgcactgggacccccttatcgtgttttggtggacaccaacttcatcaatttctcgatccaaaataaattctggttctacatatatacgtttacatggaatgctccgttcaaagttgcagtatgtgatatggaattgataatgtttgactttggatctggagaaagggatgatggactgcttatatgcaaaatgcaccccttgtattacggactgtgtgatggcagaactcgagaagttaggccaaaaatatcgtgtagctctaaggtagatgttatgtcttcttga

SEQ ID NO: 9856 - DNA, 582 bp, Glycine max
  Peptide Sequence Number=SeqID_126634
gagacaggaaaggcttcagaagttgaagtaaaagatgtgaaattgaatcatccagaggaaggtagcaacgcagccaagactaagaacaaatcaatgctacctacttctaaggcatccccaatttcaacaccaaaaagttcaaagcctgcatcaaaaactcctaacaaaacagtgacacctgcttcttcaactagaaagggaagctctccatctttgactatgaggcaaattacttctgttgaagacaaatctatgataaagaagcagggacttagtgtatctttctgtaatcaaacaatgacaatggcagtgagatctaaaacaatggcagtgagatctaaaacaatggcgcggagacttgaagctttcctcgtacctcgatcagaaacaaagaagaagaagaagaagaagaagaagaagaagaagacaacaaagactaaggtccttgtggttacaaagaaaaagaagaagaagaagacaacaaagactaaggtccttgcggttacaaagaagaagaataagaagaagttgtacctaggtaacgtggctacgtgtcacggtcgcaaagaagctgtacaatga

SEQ ID NO: 9857 - DNA, 549 bp, Glycine max
  Peptide Sequence Number=SeqID_126635
atggcggacgtcacggccaacttgcaagcagcaaccaccgcatccaccccttacgcgcttcccaccaatctccctctcctctccgcttttctctccttcgctctcgctcagttcctcaagatcttcacctcctggtataaggagaagagatgggattctaaaaggttgcttgattcgggtggaatgccttcgtcacattctgcaacggtctcggctctggctgttgctatatgtctccaagaaggggcagggtcacccgcctttgctattgcagtggtcttggcatgtattgtgatgtatgatgccacgggagttagacttcatgcaggtagacaagcagaattgcttaatcaaattgtgtgcgaacttcctccagaacatccttgttccaatgttagacctctgcgtgattcacttggtcatactccacttcagagattctacagaagctcttggaatagcatattccatgtttggctgatcctcataatagctgcccctacttttcatagtccaatcgccatcatatttatgttacgtagttgctaa

SEQ ID NO: 9858 - DNA, 369 bp, Glycine max
  Peptide Sequence Number=SeqID_126636
atggcagaactcgagaagtcaggccaaaaatatcatgtagctctaaggattgccaaggatcctcgatttgagagaatactatgtactcataaagggacctatgctgatgactgccttgttgagagagttactcagcacaagtgctacattgttgcaacatgtgatcgggacttgaagaggagaattcggaagattcccggtgttccaataatgtacatcaccaaacgcaagtactcgattgagcgattgcctgaagcaacaattggtggaggtagatactcttatttagtgaaatttatagtgactaacatgaatttgaacttggtttgttggacaacgcaacattgcatagctctttttagaaactag

SEQ ID NO: 9859 - DNA, 279 bp, Glycine max
  Peptide Sequence Number=SeqID_126637
atggacttgcaagtaattttggccttccaccatctgcaattgataacactggcaagctgtacacttgaagctggagtcacaatatactccttaagggtggattcggtgcattctgaagcatataaagtccttgctagaatgaatagagcatgccaagatactgagcaagacactactttagggaatgttaatgctgaaagtggacaagcaagcaggaaggaagttggcaaaaaggttgattctctgggtatttggattgaaatcatacattttgtttag

SEQ ID NO: 9860 - DNA, 345 bp, Glycine max
  Peptide Sequence Number=SeqID_126638
atggcaaaagctcatctgacacggcattcctcacaatttgtcgcatctcaccaaatcgatcaagatgtgacagggaagagaatggggtggttgagggtggaagttggcggcgagggacttgcggcggatggcggaggcgcgggctgcacgggcttgggcccgttcaagctgatcatcgttggagcccatgaagaaagggctcgtgggagattggatacgagcggacatcggaaccctgttttgtggcccgtcgttggattagagcttaaggttttcgccattgaaatgtccttctctgagttcatgcagttgtttggtaacagaaacagaaatggcctgatttaa

SEQ ID NO: 9861 - DNA, 2139 bp, Glycine max
  Peptide Sequence Number=SeqID_126639
atggccaaccaaggacatgacctccctctctatgaaaaaatatgggtcaagcgaaaatttcaaagagtgatagacacattgatcttagtcctccttctcctgcttcttagttaccgacttttctcatccaacaactttactttcccgtggttccttgctttcatatgtgaatcttggtttacattcacttggattgtgattctcaacaccaagtggagtcctgcagtaaccataacccacccaaatcgtctcctgctacgggtacctgagtctgagtttccaccagttgacttgctcgtgacaacagcagaccatgtacttgaaccaccaatcatcacagtcaacactgtcttatctcttctagcacttgattatcctactaacaagctagcttgctatgtttctgatgatggttgttcccctcttactttctatgcccttgtggaagcttccaaattcgctaagttttgggtacctttctgtaagaagaactgtgtacaagtgagagcacccttcagatacttctctgacattgccactaacaaaagtgaagactcacttgaattcaaacaagaatggttacaaatgaaggatatgtatgacaatctttgccaaaaaattgaagaggtgacgggcaaaacaattccattccaacttgatggagaatttgctgttttctcaaatacagaccaaagaaatcatccaaccataattaaggttatattggagaacatgggtgatcttttagatgggttgcctcacttaatctatatatccagagagaagaggccacagtatcatcacaattacaaagctggagctatgaatgtcttgacaagagtctctgggttgatgaccaatgctccctttatattgaacgtagactgtgacatgtttgtgaacaatccaaagattgttctacacgctttgtgcattttgatggattcacaaagaggaaaagaagttgcttttgttcagtgtttccaacaattctacgatggaataaaagatgacccttttgggaatcagtggatgattacatttaagaacattataatgggaatggcaggacttcaaggacctttctatgggggaacaaatgctttccatagaagaaatgctatttatggcctttatcctgatgaaattgaaagcgagagaaaaggaaaattagaaggaaagatattaatagagaaatttggaagttcaaaggagtttatcaaatcatcagctcaagctttgggagggagtgcattttctgctaatgatattactactttcaactttattgaggcagcaacacaagtttccaattgtgaatatgaatatgacacttgctggggtaaacagatggggtggttgtatggctcaatctcagaagatgtgccaactgggttgaatattcaaagaaaaggttggagatcagagtgttgtacaccagatccaattgccttcacaggatgtgctcccggaggaatactctctacaatgttacaacaaaagagatgggcttcaggcctcactgtagtcttctttggaaagcattctccaattacgggcatgctctttggtaagacccagttcagggcaggcttgtcttttttttggcttaccaactggggcttgcgtggcctatttctagtttgctatattgctctactagcattttgcattattaccaacaccaatatctttcctaagagaatgtgcataattagaaccacgactgcatcgtttcttggatttttgagtgctatgcttaagctatcggggatatcggattctgtctttgaaataacagacaagaaaccctcaacttctggtgctgatggaaacaatgcagatgctggaaggttcacattcgaggagtccccagtttttgtgataggcacgaccattttgttggtgcatatgacagcaatgttgatcaagtttttggggttgcaacctactcatagtgggaatgggtgtggacttggggagtccatctctagtatgtatgtgatagtgtgttactggccatatttgaaagggctgtttgctagaggaaaatatgggattcccctatccactatttgcaaatcagcagtgttagcattagtgtttgtgcacttttgtagaagtaacgttatcagttga

SEQ ID NO: 9862 - DNA, 1008 bp, Glycine max
  Peptide Sequence Number=SeqID_126640
atggcaagagggggtggactctccattgattcagatccaattgggagcttcctcccccacgagccaatagtcttaaactccttccctgaagacaacaaagacaacaacaacagtcgccaacaacacaagtggaaacttggtacaaacatggatgccactgttagcagaaagagttctccatcatccacttctaacactaacaccaccatccccttccaagaccaccttacctctgatgacaagatgcctcacctcgacgagatgaacttcttccccaacaaaagcaacaaggatgatgacgatgacaacaaccttgcctctgcctccacctctgcacctccctcccttgaccaccttcatcacacacatgatcattcctccgctatcttgggattgaaagtaaacactggtttgaatcttcttactaccaatgcaagcagtgatcaatctatggtggtggacgatgacatatcccctaattcaggagacaaacgagctaagagtgagatggttgttcttcaagttgagcttgagagaatgaagacgcatttggtgagtttgatgaaggaccagatggacaaggaggatgataaacaacaaccgcatcaagtgtttgatggaaaactagaagagaagcaagctgggaatggtggtggagccttggtgccaagacagtttatggatcttggattggccactaatgctgacaccaatgaaacttcgcattcccattcttcgtccgtgataagaagtcaggattcaccaccaacaaataatacagaggtggcatccaagaagaatgggggtgctagtgatgaaggactagtgtttgatcaagacaagaaggaatttggtaggggaattgagagagaggatagtccctcggatcaaggggtagctgctaataacaatgttccaaagtttagtcctccaagaaatgttgatcaagctgaggccaccatgaggaaggctagagtttctgttagagctcgatcagaggcacctatg

SEQ ID NO: 9863 - DNA, 366 bp, Glycine max
  Peptide Sequence Number=SeqID_126641
atggctagtgaaatagcgaatctgaaaatagttggcgctgctatagcattctatgcagttcctgcttctcaacttgcagaccctgcccaagccaaggctcctgttcaggctcactttggagagctggacaattatgttggcttttcatatgtaacagcagccaaggcattggaagagaagctgaaggcatccggagttccgcacgaagtacatatctatcctggcaatgcacatgcattcatgaacaggtcaactgaagtaatccagaggatgaagaacatgggaatgcttgatgaagatgaagcttcagttcagcttgcttggtctcgcttcgagacatggatgacccattatctgtcttgttag

SEQ ID NO: 9864 - DNA, 507 bp, Glycine max
  Peptide Sequence Number=SeqID_126642
atggggacaaggggttgcatcagttacaatctcgttcttgctataaggcaacttggctaccctatgagagggacaccactagaggaagagctcgtgcctgtcatttcacgaggtttcaataagaccaacatggatgtacttcagaaggtccgcaaggcatgggaggtggtgcaaaagaaggacaaagaactcaggggcagtaacaatgggcccattggtggctactgtaagtggttgaaagcccacgtgcaaggtttggattggctcccgagtttaagaaccgctaaaagggaggaagttgaggcaccagaggaagatgaagaggtgcaggcccttagggcaacactcgagcaagctcaaacagtcaaagaaaggttcaaatcagtagctctgaagatccgaaaggagaatgccgaactgagagatataaatatagctaccaccaaagccttggaacaagaaaccaagagggctcgtagggaagagcacgaccggaacaagttctga

SEQ ID NO: 9865 - DNA, 243 bp, Glycine max
  Peptide Sequence Number=SeqID_126643
atgaattttgatgatgccaaagaaggatcaaacaaggccgcttcaaaggataagcatttgcttcaagattcattgaagattgcttcaacaaacaaaacattgtttaaagattcactaaagatcaagccctgcctcaaaacaatgggtttcaaagtcatgcaaggctctggtaatcgattaccagaagggaagaatgaaaaagagctattgaaaagggttttaaatttgaatttgaacatgtaa

SEQ ID NO: 9866 - DNA, 667 bp, Glycine max
  Peptide Sequence Number=SeqID_126644
atgttccgcaagaaggatcccggcaacagtcccaaggtcgagcagtcggtcgccaaggcggtcagctacgagatcaccgtggccgatatggcgcgtcgcagcgagcggcgcgcgtggtgggtcgccacaggctcgttgctgatgtcgctcgcactggcgggcggctactactacatgctgccgctgaaggagaaggtgccgttcctggtgatggccgacgcctacacgggtaccgcgaccgtcgcgcgcctgagtggcaccttccagggcgagacgatcaccagcaacgaagcgatcaatcgcagcaacgtggcccagtacgtgctggcacgtgaatcgtacgactcggcggtaatgggcctgcgcgactgggagctggtgttcgtgatgtccaccgatccggtggcgcagtccatgcgcgtgcgatatgccggcaacaacccgcagaacccgttcgtgatgtatggccgcgagcgcgccatccgggtcaagatcctcagcatcacgccgctgggcgccgaaccgaacggcagcttccgcggtgcgtcggtgcgcatccagcgcagcctgctggacaagcgcactggcgttgccacctacctggacaatcagctggtgacgatgcgcttcggctacaaccagaacctcgcgctgtccgagcaggatc

SEQ ID NO: 9867 - DNA, 447 bp, Glycine max
  Peptide Sequence Number=SeqID_126645
atgaacgtattttctggttgtgtgaatgtatgttacgtgctattctttccacattactctgtttactctcgtcgctgtgacactgttcagctcaggttgcttgctatttgcactcaagatacaagtcaagccaatctagcactcagaataaaaatggcacaattcctcattcttgggtcatcagctgaaatccgttatggaactgggcaaatttcaggtttctttagccaggactatgtcaaggttggagacttgattgtcttgaccaggattttattgaagcaactagagagcatatctgttgggaaggtttctcctatctggtataatatgctcaatcaacatcttcttgcacaaccggtattttcattctggttaaaccgcaatactgacgagaagcaaggcggacaaattgtatttggcggagttgattcagatcattactag

SEQ ID NO: 9868 - DNA, 1197 bp, Glycine max
  Peptide Sequence Number=SeqID_126646
atggagtggactagaggcttcattataggacgtggctcatcggccaccgtttacaccgtcacctcctctcactcctccaccgtcgcggccgtcaagtcggcagagctaacactatcaaattcagagcagctgcagagagaacagaggattctgtcttgtctgttttctcctcacatagttacctacaaaggctgtaacattacagaggacaagaacaacaccctttggttcaacctcttcatggagtacatgccctttggcactctctcacaggaaattcaccggcgcggtggtggccgcctcagcgagccagccaccgtgcactacacgcgacaagtcctgcagggcttagagtacttgcacaataatggtgttgtgcattgcgatattaaaggtggcaacattttgattggtgaagatggggccaagattggggactttggatgtgccaagtttgcgaatgattcctcggcggtgatcggtggcacgcctatgttcatggctccggaggtggcgcgtggggaggagcagggttaccctgctgatgtgtgggcacttgggtgcactgtgcttgaaatggccactgggtttgcaccatggcctaatgtggaagaccctgtgacagtgttgtaccatgttgcatattccgatgatgttcctgagattccttgttttctgtctgaggaagcaaaggatttcttggggaagtgttttaggaggaatcctaaggagaggtggagttgcagtcagcttctgaagcatccatttcttggggaattcagttccaatgataaggaaattcaagaatctaattcatgttctccaacaagtattcttgagcagcgcttttggaattctgtggaagaggcagaggcagagtgtgtctctgtctctggcaatgtggttcagattaaaagttttgaggattctcccatggacagggtcagaagtcttgctttgagctcaggggatccattttgggaactggatgatgaaaattggatcacaacaagaggcagtgaagcaggggcttcgagttgtgatgggttgaatttggatgttaatagtagaattagtggttatttatgtgatgattattataaatgtagggatgttagtgttgtagttgataatttcaattttgagagaggcaattctgagatgcttctccctttaaaattggaattttttttataa

SEQ ID NO: 9869 - DNA, 464 bp, Glycine max
  Peptide Sequence Number=SeqID_126647
aattttgtgcttccaagtgctccgcgattgatgattctggaacctctttgttagctggcccaacgggtgccattgctcaaatcaatcatgcaattggagctgttggtgtagtgaaccaagaatgcaaagcagtggttgctcaatatggaaaaaccatattggataagctgataaatgaggctttgccacaacagagtgtggttgataaaaccatagagaagacatcttatagttggaatgatgccggatgcacagcttgtgagatggctgtggtatggataaaaaatcctctacgattaaatgagacagaagatcaaatcttagactatgccaatgcgctctgtgatatgcttcccagtccaaatggagaatcagttgttgaatgcagtactttatctgaaatgcctaatgtttcattcaccatagggggaaaagtgtttgagctttccccagagcaggaataa

SEQ ID NO: 9870 - DNA, 183 bp, Glycine max
  Peptide Sequence Number=SeqID_126648
atggattttgtgcctgggttcggttttgtgactgaaacggcgggaagtgagtgcccttttgtacacagtggaagcgccacgcacgaagttcaacgtcaggggcttctaatcctctacggtgctgatcatcatacactagaaaataaatattttatgaatacagtagtaaagattgttatgtaa

SEQ ID NO: 9871 - DNA, 410 bp, Glycine max
  Peptide Sequence Number=SeqID_126649
atgacttcacaaattgatacaaagatgaggtggcacaaagatagaaaatatgaagatgggcaattgagacatctagctgattcgattacttggaaaactcttgactcaaaatatccatcttttgcggtagatccacgtaatgtaaggcttggattgactagtgatggttttaatccatttggaattataagcccttcaaacaatatttggccagtagttttagttccttttaacttaccaccttggatgtgcatgaaagatacttttttcattatgtcactacttattccaggtcctacggctctaggaaatgatattgatgtgtatttacaacctttacttgaaaagctgaaggaattatgggagaaagatgtagtgtcatatgatacatcaaccgaagaaacattcag

SEQ ID NO: 9872 - DNA, 441 bp, Glycine max
  Peptide Sequence Number=SeqID_126650
atggctcgtacagttaggcttcaaaattctgcaccaattatcaatggcaagcagaaatatgctgtcaatggtgtttccttcatccccgctgatacaccccttaagttcaaccttggaagcatccccgacaaccctactggcagtggcggttacctccagacttctgtcttggcggagaatcctcaagacactgtccagtcatggcaagttgatggccaccacttctatgttgttggaatggatggaggccaatggtcagctgcaagcagaggtgtatcccaagtgatggactgcagtgtacatggctttggacaatttaggaatgtggattgtgagatcagagaactgggttcgtcagtatttagggcaacaattcatggagagatgagtacccaaaaccaagtaatgctttgttttgtggccggggctataggccattga

SEQ ID NO: 9873 - DNA, 294 bp, Glycine max
  Peptide Sequence Number=SeqID_126651
atgaatcttgaagggaagacaaaagactgtctaaagtcttgttttgatctagagtatatgggtattcgacttgagcttcatgctaccatggttgaagaaggaacactaatgaatcttcaagggaagacaaaagactgtctaaagtcttgttttgatctagagtgtatgggtattcgacctgagcttcatgctaccatggttgaagaaggaaaaacacgccttttgccaatcatccaatatctcttgattcatagatgtccaagatggaaaaatatctgggatgaaatgtcatga

SEQ ID NO: 9874 - DNA, 456 bp, Glycine max
  Peptide Sequence Number=SeqID_126652
atgccgtttctcaagaatttgagtagcaaaaatgttacaattgaatgctgtcctaatactagacatttcagacgacttaaagatccacaaagcaccaagtatttcaatgatgaggacctgccactcacaaaggccatattaagctgcattgaagatgcatcttgttcatgctcaaaactatggagctgcatgctgagggcactgtcttatgctgaacaagttgtgaagctgatggatagtttggtcatggcagggaaagccacagttgaaatgaataaggagctgaacaccagaaaatgggagcacccttgttgcacaaaactgttattttcacagatatgttactttgacacagcacagacctcattgatgcatggctttaagctcctcaaagatgatgcttatgtctctttattgcattccatcaatgtactaatgccgatcgatgagttttag

SEQ ID NO: 9875 - DNA, 126 bp, Glycine max
  Peptide Sequence Number=SeqID_126653
atgaggctcatcttcctcggcctccgaagcagagacaagaccaaggccaaagctcaagatccctcgccttcgcaatttgatgctcccgactccaacgccatctcatgcactgctctgtttttctag

SEQ ID NO: 9876 - DNA, 666 bp, Glycine max
  Peptide Sequence Number=SeqID_126654
atgacgaaaagatttgatttcgcgttggagtatctaactccgataatcgctggatccatacctaacaacaagcaattcgtaaacatttatggttgcggtttatggtcgcgaacgttaatgatggataaggtagttggtggtcgcggtatggtgatatggtcggtggttgtggcggttgacagtgggagggtacacattgcaagaactggatggtttgcagcagccttggtgccaacaccaattgcattcattttgctggccatatctggcagtggagcagcattacacataggcactgccttgatagggctaagttcaggctttgtgttttctgcagcagtatctattacttcagagctttttggcccaaacagtgttggtgtgaaccacaacatcctcatcactaacattcccttaggttcatgcctctacggccttcttgcagccttagtttatgattccaatgcaaggaaaccaaggcatacaatttggctgcacaaaatgtccatgtgcatggggaggaagtgttaccttcaaactttcgtatggtggagttgcatttcaatggtaggattgggttcaagcttcttcctttacataaggactaagcaagcttatgagaattttgaaagaaataacaacagaaacagtgtagctccagaataa

SEQ ID NO: 9877 - DNA, 927 bp, Glycine max
  Peptide Sequence Number=SeqID_126655
atgcataacaaatcctctttaaacagggtctttcttctatgcctgattgctggctgcagcatctgctggttcaacaccatctgctatgtcttatgcatcaaacattttcctgcaaaccgttcccttgcattatccttgagcattagtttcaacggtgtgagtgcagctttgtacactctcattgccaatgcaataaactcaaatgatgctaccctctatctattactcaatgccattgttcctgtgctaatttctggactagtactcatcccaattctcaatcaaccacagcctcaaccacattctgttgacaccattcagcgtgacacctcggtgtttctctgcctcaacatccttgcctttgtcacaggcctctacctcctcttcttatattccttctcttacaccacggccattgctcgcgttatccttataggtgcaatttttctccttgtgctgctctttttcttgcctggcattgtgtattctagagaatggtcttgctttactgtccccacaagcttttccttctacagttcaagattcactcgtgccgtccccgatgatgatgagctttacaaagagctcattagtatcaaggaggacagcacgaggaatagaagtgcacaaagcacaagagagaagaaatgttgtattgtgaatatgttggagagagagaagttttcaatgctaggggaagagcattcagctaagttgctagtgcgtagatgggacttctggctgtactacttagcatatttctgtggaggaacaattgggttggtttacagcaacaacttggggcaaatttcgcaatcactaggacactcttctcagactagttctcttgtcacactctactcggcatgttccttctttggtcgtcttcttgcagcctcacctgacttcttaagcaggtacttttaa

SEQ ID NO: 9878 - DNA, 648 bp, Glycine max
  Peptide Sequence Number=SeqID_126656
atggttgggtacatactagttcttgaacttgatgtaattgtggctaataatgctattttgttatcggtactgggccaggagccattatccatatctgatattgtggctgctttggatgatggtgctaaagtacagatatcatataaggggataccaggatcatacagcgaggatgctgcactcaaagcttaccctaattgtgaaacagtttcatgcaatgactttgaagaagcttttaaggcagttgagatatggtgggctgacaaagttatccttccaatagaaaatacatctgggggaagcattcaacggaactatgatttacttctttgccataggcttcacattgttggtgaggtgcagttggctactaacctctcccttctagctctgcctggcatcagaactgagtacctaaaacgggttctaagtcattctcaggcaaagcttcatgttgctggcacttttttagacgtggcatttgaattgagtgatgatttcctgactaaattaggtgttgccagagaaaacgttgatgacacagctggtgctgctcagattatagcttcaaatggtctgtatgatgccggtgcgattgccagcattcgagctgcggaaatctgcgggcttaatgtacttgcagaatga

SEQ ID NO: 9879 - DNA, 363 bp, Glycine max
  Peptide Sequence Number=SeqID_126657
atgttgctaagtagcactgtcatccatatctgtgtaagagtggtcatgttggtgcgcatgatccgcactcatctctttgcagcgacacgggtgaaatcttgccccgataagcatagtagttgcacgatagcctccctctctagttgtgctcgcacagttggtcgccctccaatatcagggggtggcccaggaactgataaaagcaaactactagcccctcacccgggagcatgttgccccagtatgcatagtagctgcacgatagcctccctctctggttgtgctcgcacagttggtcgccctccaatatcaaggggtggcccaggaactgataaaagaaaacaattggcccctcacatgtag

SEQ ID NO: 9880 - DNA, 306 bp, Glycine max
  Peptide Sequence Number=SeqID_126658
atggctgttcatgtgcctttatctttagaagctcaagcagaagctcgtttacttatgttttctcatacgaacctcctgtctccggctattggggatcctatttccgtaccaactcaagatatgcttattggactttacatattaacgagcgggaatcgtcgagcttatcaacaaaaaagaataaacttcgatagtcctttgtggctccggtggcgactagatcaacgcattatttcgtcaagagaagttcctatcgaagttcactatgaatctttagatcatatagatggttggtatctaagataa

SEQ ID NO: 9881 - DNA, 376 bp, Glycine max
  Peptide Sequence Number=SeqID_126659
atggttaacatggagtttatctctaatgcaatgatactttcattctcaatactattgttgctaccaagtacatcatattcactatatcaaaagcctgaaaatcatatcaagacagctatttttgtaactgggagttttgaaatgggaccaggatcaattgcaacaaaaacatttgagaatataaagtttccaaaaggtcatgttggaattaagagttttgatgcggaactagttgaccaagaagggaactctataccttcgtatgaaacttaccttcatcattggtttgcacatgcagagtataccattccagcaactggtggtggtggtgattctcctcatgtccaaaaagaaaacatcccaatggaaaaaggag

SEQ ID NO: 9882 - DNA, 390 bp, Glycine max
  Peptide Sequence Number=SeqID_126660
atgcataaggcattacgggccaatgcacctcttccttatcctcaattggtcaccctatttctccgtcattttcaaattcctcttgatggtgaaccttttgttcaagtcaagcgatcctttgctattggtgctggtgctgtaacttcatttcgtgaccgtaaagatcgtgatggtcaatggctgaagaaggacacgctacctcaacaagacgagcgtactccttctcctcctcctctacgagatgattccacagcccttatgaatgaagttctttcagagttacggggcctctacacatatgttggcatggatacccgcatcacccaacttgaagaagatgtgacttatcttcgtcggtgctttgatcttccaccgccttctaagtcttag

SEQ ID NO: 9883 - DNA, 633 bp, Glycine max
  Peptide Sequence Number=SeqID_126661
atgttagccgacctatatgacaccttcgaccgaagatgtgagaagagcagtacgaggatttgttgtactccagctctttatgtatgtttggtttcgcacctttttctccaagaggtgaggcatgcttgcccgctagaaggtcgtcgttcatgcacagagaaaggaggtgcaaattgggaccaactcttagcaaacaaagaaggagcgtctatcaactggttccctcgatggaaggaaggaagaaccggagttcttatttcatgcggaggatttccaaatgttcccttgatggggacgaggggttgcatcagctacaatcccgttcttgctataagacaacttggctaccctatgagaggggcaccactagaggatgagctcacgcctatcatttcacgaggcttcaataagaccaacgtggagacacttcagaaggtccgcaaggcatgggagatgttgcaaaagaaggacaaagaactcaggggcagtaacaatgggcccattggtggctaccgtaagtggttgagagcccacgtccaaggtttggattggctcccaagttttagaaccgctaaaaaggaggaagttgaggcaccgcaaggcattctcctttcggatcatcagcagctctga

SEQ ID NO: 9884 - DNA, 210 bp, Glycine max
  Peptide Sequence Number=SeqID_126662
gattcctttgaggatcaggcgacacagggatccttcgtcccccatggatgtcaggatgttctcgccgctgctattggacgtccagagcaccttggacgtgtccgtgctgctggagccggtgtcaccatcaagcaatactttggatcggctccatggacgtcccgtagctcttcctccctgcctcctgaagaattgcagcaactgacctag

SEQ ID NO: 9885 - DNA, 450 bp, Glycine max
  Peptide Sequence Number=SeqID_126663
atggacattagtctcggaagaaagagtttctgggcacgttcccttctcatgtctgcggcaataggcgctgcaattgaaaaagagaagtcacaaggatcagtggtgggatgtgcagtaattagtggagttactgtgatgataatcatatgctccataggccacatctccggagctcatctcaaccccgctgtcaccatctcctttgctgtaataaagcacatgccgtggaagaatgtgcctgtgtatattggtgcacaagttttggcatcagtgagtgctgcatttgctctgaagttaatttttcatccattcatgagcggtggagtgacggtcccttctgtgggatatgggcaagctttcgctgcagagttcatggtcagctttactcttatgttcgttgtcactgcagtggccgacggcacaagagttgtgagtattttactctactaa

SEQ ID NO: 9886 - DNA, 348 bp, Glycine max
  Peptide Sequence Number=SeqID_126664
atgggaaagctggatcatctagaggaaaggcttagggccattgaaggaggtgaagattatgcctttgctaacctagaagagttgttcctagtacccaatatcatcacccctcccaagttcaaggtgctggactttgacaagtacaaggggattacttgccccaagaaccatctaaagatgtattgtcggaagatgggggcatacgcaaacttgatacattccttccaagaaagtcttattggggtagtggttacctggtacactaacttggaaccttcccgagtccattcttgggaagacctagtggttgtcttcgttaggcagtgtcagtataatgtcttcggatag

SEQ ID NO: 9887 - DNA, 263 bp, Glycine max
  Peptide Sequence Number=SeqID_126665
aatgtggtgttgagtggaaaaagagtgaggctttgagagttgaaaggctaaatctggattctgtggtaaatggagagttttctgcctttgccctgttttacttggctgtgatagcttatgctgtgggatggtgggtttatgcgcgcattgtggatgtggaaaacttgttgtgcaccatcgcccgaccgccacctagtaccacatgtgatggagtggtacctggagatatgtcgcggggggtcaggagaccttggggacgtcag

SEQ ID NO: 9888 - DNA, 384 bp, Glycine max
  Peptide Sequence Number=SeqID_126666
atgaagctcaccattatccgtttacagcacttcagcgatcaggatcgcattgatttaggcaaaatctggccgtcgcaggatcctgcggcgctgatgctggatgaaaaccatcgtatttacgccgcccgctttaacgaacgcctgctcggcgccgtacgcgttaccctgcgcggcgtcgaaggcgagctcagcgatctgtgcgtgcgtgaagtcacccgccgccgcggcgtggggcaatatttagtggaagagacgttaagcgataacccgaatatcaatagctggcgcgttgccgatagcggggtggaagaccgcggcgtgatggcggcatttatgcaggcgctgggtatcagcgcccagcagaatggtcgggagaagcattaa

SEQ ID NO: 9889 - DNA, 465 bp, Glycine max
  Peptide Sequence Number=SeqID_126667
atggcatttgataaaggatggcaaaggatatggttagaatgtgattccactagcgaggttgctcccttctcttctgttgtcagtgtcccttggcggatttggaatcgttggaagaggtgtattgatctcaggaaatctatgaactttgtagtctctcttatttttcgtgagggaaatgatagtgctgacaagcttgctatctatgggttagataatatgggttttattagggaggcgcaattcgagtcacgtagggaggttgcgacagagacaaaagcagggcaaaggcaacaatcttcttgggttggcagcaagagccagagcgacagaagaacaagaagagatgatgatgataataacaataacaacaataataataacaacaacaacaataataataacagcaacaacaacaacaatgatgatgatgatgagactaaaggttgttgttgtttgtggttttaa

SEQ ID NO: 9890 - DNA, 573 bp, Glycine max
  Peptide Sequence Number=SeqID_126668
atggctaaagtagacgaggtgcaagaatggatgaaggccgacatggaggccatgaaagaacaaatggccacaatgatggaggccatgatgagcatgaagaagataatggaggtcaatgcggctgcaattgccaccgtgagcgttgtttctggggtggacccgactcccccatctggcctcaagctaataaatcatccaaccgcagttttcccgccatatggtttgccttcgaactatactccacccaatgagaatgtcaataactccactcctatactcattgagagccaacaaactcaatctgatcatgcacatgtctctcaacccatgggggacacacatgaaatgccccaccacaatctagctgacttcaagccttgcctcggatatgccactgaaggacaaacagttggtggtatacccctacaaaacactttagagggccttcagtatcacccacaaccacaccccttgcattccacagtgggtaaaaaccctcatgctatggcggaaatgggaaagttggatcatttagaggaaaggctcatggccattgaaagaggcggagattaa

SEQ ID NO: 9891 - DNA, 212 bp, Glycine max
  Peptide Sequence Number=SeqID_126669
atgtcattgcctagcgctcttcatgtgtcctccattatcaagcgcggagcctctggtgactgggaaatatgttcttctgtttttttccggatcggttccttcgccaaacatgtcaaaaaagaaggagtagagacgaaaatcgtcatcacggaaagggcaggatggacgaaatcagtgtcttatctttgctttcctcttatctccgttgagag

SEQ ID NO: 9892 - DNA, 1503 bp, Glycine max
  Peptide Sequence Number=SeqID_126670
atggcggtggtgatgcacgcctttcgggtggagaaacagcacatcgtcgagagcgaaagccgctttcgcagcgcgctggagtattccgccatcggcatggcgctggtgtcgccgcaggggaaatggctgcaggtcaatcaggcgctgtgcgcgctgctcggctatacgcccgaggcgctgcataagctaacctttcaagaaattacgcatcccgacgatctcaccgccgatctcagccagttgcacgacctgctcgatggccatatcagcagctacaccatggagaaacgctacatccgcagcgacggccagaccgtctgggcgctgctggcggtctcgctggtacgcgacgccgaagggctgccgctgtacttcatctcacaggtggaggacatcagcgatttgaagcgcagccaggcggaaaacaaccggctggtggagcgcattacgctggccaatcaggtgggcggcgtcggcatctgggaatgggtgatgagccaggaaaacttcacctgggatcagcgtatgttcgaactctacgatctcaatcccgaccaaacgccgacgctggcgctgtggcgcaccctgttggtgccggaagatcgcgaccgcaccgatcgcgagctggccgcgctgttggccgaccccaagcctttcgtcatggaataccgcatcgtgacccgccatggcagcgtgcgccatattcgcggccagggcaacgtgatcctcgacgatcagggccggccgctgcgcatgatcggcaccaatatcgacatgaccgagctcaagagcctcgccgaagcgctgcacgaggagaaagagcgtttgcacatcaccctcgacgccatcggcgaaggggtgatctccaccgacagccacctgcgcattacctttatgaatccggtggccgagcagatgtgcggctggccgctcgatctggcgatcggtatgcccgtcgccggcgtggtgcgcctgaccaacggcaaagacggcccggaaatcgaaaacctcacgcaatatccacggcagtggccggcggattacgcattggtgctgcacagccgcgacgggcgctatttcgacgtgcagcagtctgtctcaccgctgaaaaccctcgacggtgaaaccatgggcgcggtgatggtgctgcaggatgtcaccgcctcgcgcgaactgatgaaaaagctcagctacagcgcctcgcacgacgcgctgaccggcctgccgaaccgcgccagcttcgagaagcagctgaaagcggcaatcgtcgccggcggggaaccgtcaccgccgcattcgctggtgttcctcgatctggatcggttcaaggcggtgaacgacaccgccggccacgcggcgggcgacgccttgctgcgggacatcgcccagctgatgcggcaccagctgcgcaacagcgactgcctggcccggctgggcggcgacgaattcggcctgatcctgttcgactgccggccggagcaggccaaatcgctgatgcaacag

SEQ ID NO: 9893 - DNA, 130 bp, Glycine max
  Peptide Sequence Number=SeqID_126671
ggccttgagcctttgattgtgcttacagattctgtttttgctttacagatgttgaagttcatcctgagattagtaaacaattctgggattctcagcattggccaaagcatatactcgtccgatatacatg

SEQ ID NO: 9894 - DNA, 201 bp, Glycine max
  Peptide Sequence Number=SeqID_126672
atgacgttagtctctgcatgctatcatgcattgagtcttagagatagcaaaagaaagtttgcgggttaccgtcaggtgtctccgcatgccaccggacacttgggtcacggtaacaaaggtggggtggtagacaaaagtaggtcttttgctcctacgtatcctcaatttgtgatgaggaactcagacttacgtagttcttga

SEQ ID NO: 9895 - DNA, 213 bp, Glycine max
  Peptide Sequence Number=SeqID_126673
atgaagaccattttgcaacgacgacaccaccatggacaccaacgatgccgtgatggccaaaacccgaatttctcgaagaggattaaaggttgggtgtcaaaggttatggtaatggttttgatctccaccatggagggggagaccaagaggaggatgacgacaacggttaagacacggataatgaagaccattttgctcatcatatcttccacg

SEQ ID NO: 9896 - DNA, 274 bp, Glycine max
  Peptide Sequence Number=SeqID_126674
atgctggaaagttttaaacaacaagaccaaatgtcagttctggaattgtacataaaaaaggatgtggctggtggttcaatgtttcattatgcaaattcgcttacatcatgtggaaattatttatctaatgatgagacacaaccgacaacaaatttgagcaatttacatattgacgaagacgatgatgatgatgacgatgatgatgatgacgatgattatcttgtgtctaactcatacgttgaaaagtctttagacgaagatgacagtcttgacg

SEQ ID NO: 9897 - DNA, 168 bp, Glycine max
  Peptide Sequence Number=SeqID_126675
atgggaaaggtcgaaggtctgcatattttgaaaatgagggttcaggacggggaaggtgttgaacccttcatactcaacctccctcccctatttataacaaaaatagaggaggtgcttgccgccgagctcgcccaggcgagctggttgcttattggtgaagctttctaa

SEQ ID NO: 9898 - DNA, 543 bp, Glycine max
  Peptide Sequence Number=SeqID_126676
atgtcaagggaacttcttacttcccaaacagatcttcctacatctatatataaacactggtttatcaagaatacgcaagaaaagcattttgaattgttgattcattgccagagatggcttagaatcaatagttcattatctaatggatttttccgttctaatactctatctgagagttatcaatatttatcaaatctgttcctatctaacgaagcgctattggatcaaatgacaaagacattgttgagaaaaagatggcttttcccagatgagatggttgttgctatctgctccaataacgaatcattgatcccctatatcgataatacacattccagtttgggaacgtccggtgccaaagtcattgaatggcatatactcctcggggagggtgcagggcggacgatttcaaaacagattacccattcattcgatagagaagatcaccaagatttcgtgattcgctgccgaacttattccaattccaataagagatctcaatattatgccttgaagaggactcgaacctccacgctcttttag

SEQ ID NO: 9899 - DNA, 447 bp, Glycine max
  Peptide Sequence Number=SeqID_126677
atgtgtgccgacaagcggtctcctcattacgtcacatgtgcgcgatttgttgttgtggatgattgtggcgaccatgtggtactgatcaacacaagggagattgcgctacccggtgatgagtgggtcaagcgtgtctacttccatcacactggatatcctggtggtgcttcgtggactctggcctgggagctgcactcgaaggatcccacattggtcatgaagaaggccgtttacaactcgatgaaaggcaatctgcagcgccgtcacacaatgcagcgcctgcatctatatgcggatgatcaagttccaaaggatatactagcgaatgttacgaaccaaatacgcacgccgcgtactgtgcctcagcgtctcgatcatattgataaagagacactggagaacttccccacgattatggattatccaaaggactacatcttgcgttaa

SEQ ID NO: 9900 - DNA, 1011 bp, Glycine max
  Peptide Sequence Number=SeqID_126678
atgggaaaacgtatcgatgattatggtggcagtgctaccaatttagatgttttcccaccactttgggattttaaaacgccgattccggctggagatgccattccaaatggccttgcctgcaagcccagttacactgcaagaagtggtacagcagataaaaaatctaaaggtcaaaaaagcgcctggagaagaccttttagacaacaggacgctgaaactgctccccacaagggctctgctccagagaaacagcatactgaagtagatggatataggccgattagtctgctacctgccctcgggaagatgatggaacgcgtgattctggaccggattctccagctcgaagccgtgacgcgcagaattccaaaatggcaatttggatttcgaagaagtcacggaacaccggaacagctccaccgtgtggtcaacttcgccctggaagccatggagcaaaagatgtactcagtggctgtgtttatggatattaaacaagcttttgatagagtgtggcatgatggtctcctctgcaaattgaaaggcatgctaactcctcaattgtttcaactcatcgaaagctttctaagggacagaagcttcagagttgctgttgatggagtgaaatccacgaggcgctcaatttgtgcaggagtgccccaaggcagtgttctcggtcctaccctgtatacattatttactgctgatatgcctgcaccgcaagagatccttggagtagacgaggatgacgcactaatagctacttacgcagacgacactgtggtgcttaccagatgcagagatatcgatgtagcttcggaagccttacagcagtatgtaagtagtttcgagaagtgggctctgaattggaacattggtatcaacgccagcaagtgtgcgaataagactcaacttcagcaagcatacaacaatggtcaagcgatcggtcatggcaaaagccggaaagatggcatggctgcttgcaccctgcaacaagctgtctctgcacagtaa

SEQ ID NO: 9901 - DNA, 777 bp, Glycine max
  Peptide Sequence Number=SeqID_126679
atgggtcgtctgggtacagtggatccgagctcctattctgagccagacctgattaccaccgagcacagtgcgctgaactggacagtggactttgcggcaacaaagttgcgtggcagcgtcttgcaccgcttcaatgtgctgtccaccaatctggacaagattgtaagtgacaaagatatgtctttctaccatttctgttttaaatatattttccctttccagctgctcgatgtacgcgacatcaatgtgacgaacgccacgttgctagccgatggctccgagttgcctatcaattacttcatcagcgatccggtgtctgatattggacaaaagctgacgctggagttgccagccggcactgctaagggcaacttgaacgttcgcatcgattacgagactgccaacaatgcgagtggcctgcagtggttgacgcccgagcagacgctgggaaagcaacatccgtacatgttttcacaatgccaagccattcacgcacgctctgtggtgccctgccaagacacgccatccgtaaagttcacctatgacgccgtgattcagcatccgaaggagctgacggctctgatgagcgccattatcgacaaaaaacaggagggccagactagcttcaagcaggaggtgcccataccagcttatctattggccattgccattggaaaacttgtgtcacgccccttgggccccaattcaaatgtttgggctgaagaggctattgttgatgcctgcgccgaagattttccgagacaaccacaatgctaa

SEQ ID NO: 9902 - DNA, 459 bp, Glycine max
  Peptide Sequence Number=SeqID_126680
atggcggtgtggatccagaattccaaccacaggagtgtcgaagctccaccaagagaaagtggtggggacaccacgccaacaacgatgatgaggatgtcagagttggcataccccaacatagatgctaacgacaagcacatgccaatgacaatcgccaccatcgtcaagaatgtctgtcaacttcatctttcacccaaatgtaaaggcaaaactccaactaagtctatactacagatagaaagtgaaatgaacactcacaagtacaccatcgatgataatatattcaggcttagctggggtataagcatgaccaaaagattgagtgagcttaaaaggaagctacttggccttcttgagaagattagaggttcgaaactctgcatcatctctgatgaaactccaccaaatgagcattgcaaggccaccagaaataacaacgagccagagcttccaacgtga

SEQ ID NO: 9903 - DNA, 2592 bp, Glycine max
  Peptide Sequence Number=SeqID_126681
atgacaaagaagtcccaaagacgcccggtgcagtatgagaaagataaatcaggctgcatgtggggttttattaatatgtttgattttcgccatggtcactctacaaggaagatgattgcagataagaggcaaagcagcaagcatgctgttggtgttgtgcattctaagaacaagtttgagatgttgggcaatttggatgaagtttgtcacggcagttctggcaatggagagagtagaagaccaacagtagcaactgctgctaataagcctagtgtgaagaaactcatagaagaagagatgttcattgaccagaatacaatgaaggatacatatagtgcccaaatagaatcaaaggaatccagattaaggcgtgaagtccttttgaagttagataccaaaaggaagaagaaatcttacaggaaaaaccgtgataaggaggacaccaatgatttaaatttggatagtaccttgaaatctaaattcacacataatcagcactcaaggaagcaattgaaagataatcttgatctggataagatgattgaagacttttgtcatctaaaagatgcttattccatgatgcatggcaatgatggagaagtagaagttaatgcacaatcaaaccacaggcaagctatttctgaaaatgcaagagatgcaatttgtgaatttgtggatcagatgatattaaatggcaaagatccagccgaagcgagaaaattcctttgctcccatcaacttatggaagttctccagcttataagttcggataaggaattgtttctttcacttctacaaaacccgaattcacttttgttgaaatgtgttcaagagtttaggaattctcagggaacaaatgaaaaagaatatggttgtgtcactggttccaacttctcagaacaagatcatggcaacctggaacagaatagggagatagtcaaccataaaaagcataagtttttcagaaaaaaggagaagtctcaatcaaaaacatcaataaatgaaaatgagaatactaattcgtcaagtagaattgttattctgaagcctgggcagataggcttgcaaaattttgaaactagaaacaaccttgcctcataccaagatactcatgattctgtcaaatataatggtccttctgtgagaggtagttcacatttttctcttgcagagataaaaaagaagttaaagcatgctatgggaaaggagagacatgcaaaccctggacaccctgctgctgaaattcaaaataagtggcctatcagcaaagccattggtaaagacaatgttggaatgagatctcctaataaagaccacttcttcattgaaaaaattgcaagacctaccactggtggtctgaaaggagacaagactggtacagctaaagattctgaattgattgtggaacatgaaaatggtacttatccaaaacaaagggtttctaacttgtacattgaggctaagaaacatttgtctgagattgtaggtaatggagatgagaaaatagacttgtcaagtaggaatatttccagaacccttgggaaaatactatctcttcctgagtacaacttttccccccttagcagtcctggaagggattgggagcaccattttgtgactgcacagacaagattttcttcctcagataaaatttgggaggctaataaggataatgtgtcttccaaacaaggaacctttgttggtgatttggatcaggaaatggacaattcagggaagcagtcaagcatttgtgatgaaagatctgataataaagtacaagaaattaagtcagaagacattagtcatgttgataaagcaaaaaaatttagtcctgttagagatgagatagttactgaaggtgatgtagaatctgcaaaagaggtgagtgttttggaatcttcctcagaaccagttgacctcagtgcaggaaaggaggaccaaaactatggtatctcagaaacttctgattgtgcaagatgttcccaaagttcaaagcaggatgtaacagaagtaaacaaaccaacaacatctccactgtcatcccccccacactcttccaccactaaaaaaattgaagagctagaaagtgttacagaggaacctggtcgaccaagtcctgtatctgttcttgacacaccgttctcagaggatgatatcaatcctggctactccagatttcaacctgttgaactttgccatgatctgaagctcatcaatgactgcatcaatgacgttctcatggaggtttgtcggaattacttcggggtctcaccttgcgtgtcattcaaaaatcctagcataaggcttagtccaaatatgaagaaggttgttctcatggtctgggaaggagtgtgctggcatttccttcccttgcccccaccacgtaccttggacaaaattattaaaaaagacatggataaaaatggggcatggttggaccatagtcttgaagctgaaacaattggttttgaaatgggagaagcgatcctcacagaactgatggaagatacaatacttagctgtgtaagcaacagtccagaaagtgaatgttctcagcttcaatttgaatataaggccaatgacaacagctaa

SEQ ID NO: 9904 - DNA, 1746 bp, Glycine max
  Peptide Sequence Number=SeqID_126682
atggatgcagtgcgacaactaccattaaacccatacaagttgaagtgtgataaagaacccttgaactctaggcttggggcaccagattttcatccccaaacgccaaattgtcctgaagagactctgaccagagaatatttgcaatctggatacagggatacagttgaggggctcgaggaagcaagagaaatttcactaactcaggttccgcattttaacaagaacattgttcttaaatgcaaagaggctattagaaaacgtctgagggccatcaatgaatctcgtgctcagaagaggaaggctggtcaagtatatggtgtggctctttcaggatcacaacttggcaggtctggcattttccctgaactaagaccctgtggtgaggacttccagaagaaatggattgagggtttatctcagcagcacaagcgattacgctctttggctgatcatgttcctcatggttataaaagggcatcacttttagaggttcttatcaagaataatgttccattgcttagggccacctggtttatcaaggttacttacctcaatcaggttcgacctggttctgttggtatttcttctggggcagctgacaagattcagctgtctcgctctgatgtttggaccaaagatgttatcaattacttacaaacacttgtggatgaatttttgtcaaagaatgctttgcattctgcttctcatggtcgagagcgatcaccacaaatcccttatactggctcactgcagaataaaaatgatccattattatctgtttctgatggtgaaggaccatccttacattttagatggtggtatattgtgaggcttctgcaatggcatcatgctgaagggttgcttcattcttctcttgtcattgattgggtgtttaatcaactacaggaaaaagaactgcttgaggtttggcagctgttattgcctattatatacggttttttagaaactattgtcctgtctcaatcttatgtacgcactcttgctggattagctcttcgtgtcattcgtgatcctgctccaggtggttctgacttagtagataattccaggagggcatatacagcttatgctgtggttgagatgctccggtatttaatacttgtggtgccagatacttttgctgctctggattgctttcctttaccatcctctgtaatttcacatacaatgaatgatgggagttttgtactaaaatcaactgaagctgcagggaagataaaaaatagttcagatgattttggtcacattatttcatgtattcagaaacatacagaagatttggcgaagtctgcaagcccaggctatccaggtcattgtctagctaaagttgcaaaagctttggataaatctcttgtgctgggtgatttgcgtgtagcatataaatttctttttgaagaactttgtggtggaactgtatctgaaggctgggtttccaaagtcagcccttgcttaagggattttcgcagtactcctcctcgtgacataaagtttacaggtaggaaagatctttcccaagtgcatatagcagttagacttttactgatgaagattagggatgtgaagatttcacaaaaacaaacaaatgaaaatcacagagccagtcatcttgcaaagaattcgagtcagtgccagaattggaattatgtgggtaatgtatccagatcgaaatctagttcaaagagtatgggttcttctgtatttgaaagcccagcatgtggtgcataa

SEQ ID NO: 9905 - DNA, 828 bp, Glycine max
  Peptide Sequence Number=SeqID_126683
atgttgaagatgctagatggttgggtgtgtgctttccttttggtgctttattgttctgtggaggtaattgatgcaagtgctggtgatgctgatccgcgctatagggtttgtataacacagtgtcaggaaactggatgcgttgcgcaaagatgctttccaaactgtaaattttcttctgatggagaatttattgatcgcccatggtatatgcaacaagaaccactctatttacaatggaaaaaatgggattgtcaaagtgactgccggtactactgcatgcttgatagagagaaagaaagggagtcacataaccttggacctgtcaaatatcatggaaaatggccattcaggcgtatatatgggatgcaggagcccgcttctgtggctttctcagctctcaatctcgcaatgcattttcatggttgggtctcctttttcattcttatatactataaattgcctctaaaagatggaaagaaggcatattatgagtatgctggtttgtggcatatgtatgggcttttatcactgaactcctggttctggagtgctgttttccacagtcgagatgttgatataacagagaaactagactattcatctgcagtcgttctccttgggtactccctcattttagccatcttacgaacattcagtattagggatgaggctaccagagtcatggttgctgctccattgattgcttttgtgaccacccacgtaatgtacatcaacttctatttactagattatggtatgtcctgtcatgtaatctttatattattattgccaagactgagagttgattgtaggaacaactctgcttga

SEQ ID NO: 9906 - DNA, 744 bp, Glycine max
  Peptide Sequence Number=SeqID_126684
atgcaaaggtatcatgctggcagctgcactagtgcagttaacaacagtacaataggtggaccatctgctagggacccaggaagatctgattcaccttctttgccagctaactttgcttggagtctgctatcaaaccaaaagaaaggaaggaacaaagcagcggtgctgagacagaacagagaacagaggataaaacaccaggcaagggccatcgaggtctacaggctttctggaaactgtcacaacctggccagaaaaagccggagatactgctggagaagggaggtggtcgtggttcatccagattcaggattaaccactgaaaaagttgaaattgaagattaccctccacaaaaccccctgatcgcctttgttacagggaacaagagaggcaccacatcacaccaacaaaacagagcaagaacagaacagaaccctgacagagacacatgttatgaacaatatgcaacaacccagtggacgcaaggcagagacagagcagaaaatgtggttgcagtgaaacggagagcagagggaggagtagtgaggattgaagtcatcgtcgcgatagatggttttgcaaaatgggtgaaatcaagaattttagggcacttgcaaacgaatcggctgggacagcaaaggggttttgtatcaaaacctgacctgcgggagattggcatggagtggatcatgcgatcttggatgaggaagatcgcaatcctctgcaatcttcacgaaacctga

SEQ ID NO: 9907 - DNA, 4575 bp, Glycine max
  Peptide Sequence Number=SeqID_126685
atgatgttctggaagaatcagggattgttgaagaggccgcagctcaaagaagccttgcaaatttacttgaatgaacgccgcctcatacttcggggtcctctgagcatgtcccatgatgatgccaatggttccaatttatctgctctgaagaaaaaaaaatatccagcttctacaaaggatgaagtttctgcagtgccaattgatcagagaaatgttatttctaccacaatatcttctaaaagtgcaaaggataatgctaacattgaagaactaagaacagcaatctcggtactgttacagctacctaattgttcatctaatttgagcactacaggtgatgaatctgagggcagtgttagaagacctattgggtctccctacagcaagattgatccagtggagggtacacctgggtgtgaagaatgtagcagagcaaagagacaaaagttaagtgaggaaagaagctcatttgttcaagggcattctccagttcaatctgatgatgacgatgcatggtgggtgaaaaagggaatgaaatccccagagcctctcaaagttgatcaatctcagaagtcaaccaagcaggtcaccaagattcggcaaaagaatgtgcgtaaaactcagagtctagctcaactggcagcttctagaattgagagtagccaaggggcatcaactagtcatgtgtgtggtaacaaggtaagctgccctcaccataaaactgctatggatggagaggggcagaggtctgtcgattgcatccaaacaagtcattttggggatatagtttccattggaaaagcattaaagcagctacgttttgttgagaaaagggcactagcagtttggctgttgactgttgttaggcaggtaattgaagaggtggagaaaaatattggtaaagttggtcagttcggcaggccttttcctgttgcggatgatagaggctcaatacggtggaaacttggtgaagacgaactttctgtgattctttatttgatggatatctctgatgatttggtatcagctgtcaagttcctcctttggttgctgccaaaggttcttaatagccccaattctacaattcattctgggaggaatgtgctgatgctaccaaggaatgtggaaaaccaagtttgtgatgtgggagaggcttttctgctatcatcactcagaagagtacctggtagtaagctgttatatctgtttcttcttatgctccatttcttgtcatctttaatcaggtatgagaacattcttgttgcagcagaccttattcccgaagctttgtcatctgcaatgcatcgtgctgccactgttattgcatctattggaagggtttcagggtcaggggccctagcttttgctcggtatttgttgagaaaatacagcaatgtggctagtgtcatcgagtgggagaaaacttttaagactacatctgatgctagactttcctctgaacttgagtctggtgggtcagtggatggagagttaggtttacccctaggagttccagctggagtcaaggaccatgatgattttttccgtcagaagataagtggtggtcggttaccgtccagagtaggtgcaggcatgagggatatagtgcagcgtaatgttgaagaagcgttccactatctttttggaaaagatagaaagctatttgctgctggtacaccaaaaggtcctgctttagaaaaatgggataatggatatcaaattgctcaccaaatagttatgggtttgattgattgcataaggcagactggtggtgctgctcaagaaggagatccctctttggtctcttctgctgtttctgcgattgttggcagtgttggtccaactttagcaaaaatgcctgatttttcatctggcaataatcattcaaatataatgtcagctacaaattcattgaactatgccagatgcattctgcgaatgcatataacctgtctatgcctgcttaaggaagctctgggagaacgccaaagccgtgtatttgatattgctctagctactgaagcttctaatgctcttgcaggtgtttttactcctagtaaagcatctcgttctcagtttcaaatgtctcctgaagcccatgattctagtaacactatttcaaatgatatgggaagcaactctattaaggttgtggcaaaaacaacaaaaattgctgctgctgtttctgcacttcttgttggtgcaattgtatatggtgttaccagcctggaaaggatggtggcagttctcagattaaaggaggggctggatgtggcacaatttgtaagaaacgctagatccaattcaaatggaaatgctcgttcagttatggcttttaaggtggatagttcaattgaaggtcatgtccattggtttagattgcttgttggaaactgcagaacaatctgtgaagggttagtggtggaactcttgggtgaaccatctattatggctctttcaaggatgcaacttatgcttcctctaaatttggtctttccacctgcctattcaatatttgcctttgttaggtggcgacctttcatgctgaatgctacagttcgggaagacatgaatcaaatttatcagtctctttcaatggccataactgatgcaataaaacatttgccatttcgagatgtatgttttagagactgtcagggtctttatgatcttatggctgcagatgcaagtgattctgaacttgcaaccttgctagagtttaatgggtctgatatgcatttaaaatccacagcatttgttcccctacgctctaggcttttcctgaacgccatgattgattgtaagatgccaccatctatttatacaaaggatgatgggagccgaatgtctggacttggtgagtctaaaattaaattcacagatagtgagtctaagcttcaggatttgcttgtgcatgttttggataccttgcaacctgccaaatttcactggcagtgggttgtactcaggttgctcttaaatgaacaagccctcgttgaaagactagagaatcgtgatgtgtccttggttgatgctataaagttgtcctcacctagtacagagaaggcttctgctgcttctgagaatgagaacaattttattcaaatacttctcacaaggttactggttagacctgatgctgcaccccttttttcggagttgattcatctctttggcaggtcactagaggattcaatgttgttgcaaggtaaatggttccttgcaggccaggatgtcctctttggtcggaagaccattaggcaaaggctacataacattgctatgaaaaaaaatctttctgttaagacccaattttgggagccatggggttggtgtagcccgtctactgatccattaactatcaaaggggataacaagaagtttgatagcacatcccttgaagaaggagaagttgttgaagagggaatggatttgaaaaggtgccagcagcaagtgactgagagggctcttattgagttgcttcttccttgcatagatcaaagttctgatgaatcccgcaattcctttgcaagtgatatgatgaaacagttaagttatattgagcaacaaataactgctgttacaggtggaagtaaaccagtaggaagtgctcctcctggagttgaaggtcagccgaataaagtaaataaccgcaaaaatatgagaggtggaggccctgcattagctagacgacaaacagttgcagcagattcttctccaccatctcctgcagctctacgagcttctatgtcattacggttgcagttgctcctgagatttcttcctattctttgcactgacagggagccatctgtgcggagcatgagacaatttcttgccactgtaatttttcgtctccttggtagccgggttgtgcatgaggatgcagacatttcggtgaatgctgtgccatttctgcctataagggaggcagagtcatcttctgaagttgcttctgctgcttttgtggattcttcttctgggagtttgtttgatcgtttgttgttggttttgcatggattattaagtagttatccaccaagttggcttagggcaaagcctgtttcaaagacaatcagtgaacctacgagggaaatttctggaattgaccgagaattgttggaggctttgcagaatgacttggatcgtatgcaactgccagacactattcggtggcgtatccaagctgcaatgcccatgctcattccctctatgcggtgctctttatcctgccagccaccatctgtttcaaattctgctcttgtttgccttcaacccagcattacaaatcctgggtctaactccagtagttcaactatccctcagaggaattcagttctatcaagggttgcatctaatgcatcagggaagtcaaaattacaggacaatgatttggaaatagatccttggacgctcttagaagatggcgctggatcttacccttcagcaggtaatactgcaagtatagtaagtggtgaccacgctaatattcgtgccaccagctggcttaaaggggctgtaagggtgagacggacggacctcacatatgttggtgctgtggatgacgatagttga

SEQ ID NO: 9908 - DNA, 219 bp, Glycine max
  Peptide Sequence Number=SeqID_126686
atgcatcatatagcaaatgcagaaccaattgacaatatagaagctttggaagaacaggtctggagggcaacaatgttggaagaactaaaagccattgagaagaatcatacatggaagttggtggaattgccagcaaagaagaaaccaatagatgttaaatgggtgttcaagctaaaattgaaccccaatggcactattgcaaaacataggccaaactaa

SEQ ID NO: 9909 - DNA, 369 bp, Glycine max
  Peptide Sequence Number=SeqID_126687
atggggttaggtgctacggccatagatttagaagaaccaagctctaatacaaaaggaaaaagacaaggttcgacttcttctggcacacatcctcacaagagaaagatgggagaaaaagaaggaatagtagcttctttggataaaatggcgaactcttttaaccgaatggtggaaaaaatggatggtaaagttgatgatgaagatattcaagaagtattacgtgaggcagctttgataccagattttaatagacaacaatgggctaaagctattaaatggttagctgacgatccaaagcagttagctattgtgaaaacccttccaattcaccaaaagacagattatgttttaacacatcttggagaatga

SEQ ID NO: 9910 - DNA, 186 bp, Glycine max
  Peptide Sequence Number=SeqID_126688
atgagcagtgcgtgcccttcaagcacaaggttcaaaagcttgtttgatgggggatggctgacgtttcaagaggacagtctgaatgtgaagactaatccactcgccaatcatggaggctcagtggttaatgcagtggaagagtgggagccagaggctgaagtagatgggagacgtgttaacctctag

SEQ ID NO: 9911 - DNA, 300 bp, Glycine max
  Peptide Sequence Number=SeqID_126689
atgggcagagaccagaagatgagcatgcgaagtcgtaggcaaaaagtaaacacaataaccaaaaagaacaaacacgctttacgacacccctatcaaacacgtgccaaaaccaaaatcataagtgaaatagaggaagtgcaagagcagatgaaagctgacatggaggccatgaaggatcaaatgacctccatgatggagcccaaaatgagtatgagaaggattatggaggacaacatggccacagttgccaccaccagcactgccactgaggcggatctaactcacccaggcataaactaa

SEQ ID NO: 9912 - DNA, 405 bp, Glycine max
  Peptide Sequence Number=SeqID_126690
cacccatttcaaacgcatatccaatttttgcacagcagggttatgaaaatccccgagaagcaaccggtcgtattgtctgtgccaattgccatttagctaataagcccgtggatattgaggttccacaagcggtacttcctgatactgtatttgaagcagttgttcgaattccttatgatatgcaagtgaaacaagttcttgctaatggtaaaaagggagctttgaatgtgggggctgttcttattttaccggaagtgattgatattatacctccaggaccagaacttcttgtttcagaaggtgaatctatcaaacttgatcagccattaacaagtaatccaaatgtgggtggatttggtcagggggatgcggaaatagtacttcaagatccgttacgtgtccaag

SEQ ID NO: 9913 - DNA, 381 bp, Glycine max
  Peptide Sequence Number=SeqID_126691
atggatagattcactctcactctgaatgggagtcaagagcttccaaggctgttagccagagccaaggcaatggcggatgtatactcagctcccgaggaagttcatgggctcttcaattattgtcaacacatggtcgagttgatcagtcgtagtaaaaaagtaaacacaataaccaaaaagaatgaatgcgctttacggaacccctaccaaacacgtgccaaaaccaaaatcatgagtgaaataggggaagtgcaagagcaaatgaaggctgacatgaaggccataaaggatgatgcaatcctaccccccaaggggcatttgatagaagactccaagaagattgggccagagatgcaagagaaggccctagggttctcatga

SEQ ID NO: 9914 - DNA, 186 bp, Glycine max
  Peptide Sequence Number=SeqID_126692
atggcacttccatactctattccttcaggctacttcagagccttctgcaccagtgacccctccactccttttctacagatgccagaggacccaactacaccagtcctagctgtggacacttctcctccaactactccagtgcttcagctgacggatgaggaggatggtcagacacaggacacctag

SEQ ID NO: 9915 - DNA, 759 bp, Glycine max
  Peptide Sequence Number=SeqID_126693
atgcccgggtgtcatcaaaacttaactgaaatgtgcgaaaacggcgcggtgaaagtttggtcgccgtttttgccaatgataagcaatagtcgtttgcctactgaacgtcgccaccggggagttccgcttgttgccagggaaccgacccacggatgggcgtttactgttttcacctctttcagggaaatggttatgacggtacatcactccgttacgcaacaaggttcacccgcttccgccgccgatgcgcggctggaaaccacctccgggcgcaaagatttctggcgcgccaccttctcctgctggctgggcaccgcgatggaatacgcggatttcgccctgtatggcctcgctgccggcatcatttttggcgatgtgttcttccccgaagccaccccggcgatggcgctgctctccagctttgccacctggtcggtcggctttattgcgcgcccgatcggggcgctgctgtttggctggattggcgatcgcaagggccgcaaggtcgtgatgatcagcaccatcattctgatgggtgcttcaaccacgctgatcggcctgattccttcctatgcaacgattggcctgtgggcgccggcctgcctggtgctgctgcgtttcacgcaggggctgggcgccggcgcagagctctcgggcggcacggtgatgctgggtgaatacgcgccggttgagcgccgtggcctggtgtcgtcggtgattgcgcttggttccaacagcggcacgctgattgcgtcgctg

SEQ ID NO: 9916 - DNA, 1068 bp, Glycine max
  Peptide Sequence Number=SeqID_126694
atgctgacgctggccgtacgaccggtaggcgcattgatctttggccggctggcggaaaaatatggccgccggccgatcctgatgctcaacatcgtgctgttttcgctgtttgaattgctgtcggcatggtcacccaactttgctgccttcctgaccttccgcgtgatttacggcgtggcgatgggtggcatctggggcgtggcctcttcgctggcgatggaaaccattcccgaccgttcgcgtggcctgatgtccggcatcttccaggccggttatccgtgcggctatctgctggcgtcgatagtgtttggcctgttcttcgaacaggtgggctggcgcggcatgttcctgattggcgcgctgccgattctgctgctgccgtttatctattttaaagtgccggaatcgccggtatggctggcggcgcgcgagcgtaaagagaatcacgcgctgctgcccatcatccgccagcactggaaaatctgtatttacatggtgctgctgatggcctgttttaacttcttcagccatggcacgcaggatctctacccgacgttcctgaaagtgcagcaccagtttgacgcccacacggtgagcattatcgccatcggttataacatcgcggcgatgctcggcggcattacgttcggctcgctgtccgagcgtatcgggcgtaaaaaagccatcatgctggcgtcgtttctggcgctgccggtgctgccgctgtgggcgttctccagcggttcctgggcgattggtatcggcgcgttcctgatgcagtttatggtgcagggcgcatggggcgtggtgccgacctacctgaccgagctggtgccggccaatgcgcgtgcggtactgccgggcttcgtttaccagctggggaatttaattgcttcggtcaacgccacgctgcagtcccgcatcgccgaagcccacggcggtaactacgggctgggcatggcgattgtcgccggcacggtggcggtgctgatttgcgtgttcgtggcgtttggccgcgagacgcgcggcatcgaaatatccggggcggtggcgaaagagacgcgttaa

SEQ ID NO: 9917 - DNA, 417 bp, Glycine max
  Peptide Sequence Number=SeqID_126695
atggccggtccagttcaccacttcatccacgctcagcatgcgcgcttttgccccgagcgctgccttcagcttgcggttatccagccgggcgtcgccgcgtgtgacaatcagcaccacgctctctttcactttcagcgacagggttttggcgatttgccccggcgccacgccatgtacgcgtgcggccagttctacggtggcagtgctttccggcatctcgatgatgtcgatatccggtgcgtgttcggcaaagaagtgccgtaccgactccaggctcatttttttctccgttaccgcagcgttcgacgtccggaatgcgatagcgctggcagcagctgcggcgctccatcgcgccgttacgcgggatcatggtgcgatacagcggattatcactgccgtcggacagggatttgctga

SEQ ID NO: 9918 - DNA, 223 bp, Glycine max
  Peptide Sequence Number=SeqID_126696
atggccacagctgaagcctgggaacgagaaaccaagaaggcccgaaaggaagaacacgaccaaagcaaagttgattcatggcaccaagaggcaacaatgtggacggaccgatttgctcttactttgaacaggagtcaagaacttccccgattgctagccaaggccaaagcaatggcggacacctactccgccctcgaggagatccacgaacttctcagctatt

SEQ ID NO: 9919 - DNA, 375 bp, Glycine max
  Peptide Sequence Number=SeqID_126697
atggatctttgcggtctcgtacattttatcaaggttaagggtctagatgtcaccagcctcaaggaattgggacgattgatgggacctctccaaaggcaagccttccacaaagtgtacgagaagattctagatttgaccgcagcggaagtatttacggaagctgtcgtatccctcacccagtactatgatcagccgttgaggtgcttcacgtttggggatttccaaatggtaccgactgttgaagagtttgaggagatattaggatgccctcttgggggaagaaaaccgtacctgttctctgggtttcttccctccttgagtaagattgcagctgtggttggagattcgataaaagagttggatcacatgaagtaa

SEQ ID NO: 9920 - DNA, 414 bp, Glycine max
  Peptide Sequence Number=SeqID_126698
gtttcattgaagctaatgcgaagatacttcagagaatccgtaaagcatggaatacaatggaaagaaaagataaggagcttaggggaagtagcaatggcgtcataggcgactatcacaaatggttgaagtctagaatgcaagggataacttggctcccaaagctaacaggtctaagtgggaaagaggctgaaattcctgaagagagtgaagaagtgcaagctttgaaagcggagctcgaaaagacaagactggtgaaggagaagctgaaggtggtagtcactagggtcaggaaagaatgtgataagctaaaagatatcaacatgaccacggttgaagcattagagcaggaaacgaaaaaagcccgaaaggaagaatggagcaggaacacattccggggggctttgtggggcagca

SEQ ID NO: 9921 - DNA, 333 bp, Glycine max
  Peptide Sequence Number=SeqID_126699
atgctagacttgtcttataatcatttgaagggaaatattccaacaggaactcaattgcaaacctttgatgcctccagcttcatcggcaacaatctatgtggtccaccactgcccatatactgcagctccaatgggaaaacccatagttatgaaggaagtgatgagcatggagtgaattggttttttgtcagtatgacaattggatttattgtgggattctggatagtgattgctcctttgctgatttgtagatcatggcgagggagagtagctgaacgtaaagaggggaaggataggaggtgtggggaaatggaactaaggataaccaagtaa

SEQ ID NO: 9922 - DNA, 204 bp, Glycine max
  Peptide Sequence Number=SeqID_126700
atggaatccgccttccctgattccgatgctgttgagcggcggctggtagtgaaaggaactgacgatcttggcttagatggctttgctcctggggaacatcatttatcgatagtcaagccattcatatcgtgtggccccttcggagaggtcatagagatcaaggaaaacctcccccacaaactttgctacgcccttaactcttga

SEQ ID NO: 9923 - DNA, 526 bp, Glycine max
  Peptide Sequence Number=SeqID_126701
caaaggaagtgcatgtgatgtaggtagcaaatacaccttggaaggacatatatgtgatctaggtaacgaaggtgccttgattgtgcctcggttgtatgccatcttcgttttaagaatagcatttcttggtaaaactaactctccaaatgtttgccttcgcaggaaatggccccgtggaagcttgcctcaaagaggtccaggaaggataaagcggccgaaggaaccagttccgctcccgaatatgacagccaccgctttaggagtgctgaacaccagcagcgcttcgaggccatcagggggggagatagttcgccggcggtgggcatcactggttacccccatggctaaatttgacccagacatagtcctcgaattttatgccaatgcttggcctacggaggagggcggccaggagtgcgagtatggccagaggaggaaccggtccgatggttttgatgaagaggacatcgcccagttgctgtgtataccggggcaggattttgcccggactgctgcagggaagcga

SEQ ID NO: 9924 - DNA, 474 bp, Glycine max
  Peptide Sequence Number=SeqID_126702
atgtcgttggttgttgttgtgtcattttcgtttgtttcccagtttggtttagctctgttgttcggttggttctgtgattttacatttttttctttggttgagaagtttcttttgcagtttagttttgctgaggttgattgggagaagctaagtttttctttggttgacaattttattttgcagtttagttttgctgagtttgattgggagaagctaagggtttgtgattataaagttatggcatgtgttgctgataaaataaaattgatagatggatcaagggaagctcttaagctttttgtaaggatcacttatctttggttcattgggattcccggaaagactgaacaagccgaaatggtggttgttgattctgatggatatgaaatccatgttgtttgcaagcaggatcagctgaagtctcgcaaggctaatttgaaagaaaatttgacttatgtgatccataattttaaa

SEQ ID NO: 9925 - DNA, 240 bp, Glycine max
  Peptide Sequence Number=SeqID_126703
atgtacaaagataattggactcaaccttggcccatgggatcagaaatctaccctgaggttcatgagaaccatagggccttcttcagcagctctagcccaatcctcttggagcttcttgctcatggctctagtgactggtcccttcctaggaaggattgcatccacaacattgataatatctttcccactgaatgcgaattgccttcattctctctggttccagcggtctttgataagtaa

SEQ ID NO: 9926 - DNA, 138 bp, Glycine max
  Peptide Sequence Number=SeqID_126704
atggccaggaaaggggttttcagtccttaccgtgttgaggaaagaattaatgagtttcaacaacctcgtgatttgaggtcaaatccttttcaagggggagggaacgatgcaatcctatgccgcaaggttattggatag

SEQ ID NO: 9927 - DNA, 123 bp, Glycine max
  Peptide Sequence Number=SeqID_126705
atggcctccatcattgcggccatttgctctttcatggcctccatgtcggcctccatctgctcttgcacctcctttacttcacccattactctagctctagcacaggttcggatacggggttga

SEQ ID NO: 9928 - DNA, 459 bp, Glycine max
  Peptide Sequence Number=SeqID_126706
atggcaagacacaaggtcacacgcacacacacacacacacactcacgcaggcacaagggggaggaggggcttggtcgggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaaacggttcctctcgtactaggttga

SEQ ID NO: 9929 - DNA, 382 bp, Glycine max
  Peptide Sequence Number=SeqID_126707
ccagcccgcatcaattagaccttgcaccttacgcttcagagccctacaatgctcaatggaacgccccggggcttctccgtgacaagcacacgttgcgttcgaatcgtattctcggaaaaatggaggtcgatgaaccttggctggggttatggctaccattggattatcgagtggatatgggagcaagtcagcataggacaccggaatttcggtgggttttgtggtttgatttagggatggcctttatggataactgggtggtgggtaaggagatgggttgttattggttgagtaatgacattgttgggatgatcaaatttgcctcttttcagacccacttcgatccttttgccggcgaagaccatatccgcaaagctggaag

SEQ ID NO: 9930 - DNA, 750 bp, Glycine max
  Peptide Sequence Number=SeqID_126708
gcaggatggagcaaggaaggcattgtcactctggcgcagcttatcgcgtttgtcagcttccagagccgactgatcgccggactgcgtctgctgaatgacaggcccgttgccacaagcgatgcatcggtggctgcgggtatctggcatacaacgccaaccacggtcaccgggaaggcggcacccgtcgccttcacccagcaggagctgggctgggagccatggttagccgccaaaccgctggcggaattccgtgacgatgaggtggcgatcctggcgaaatttggccacacggactccgactatttccgcctgatggggcgcaacctgccggtgcttgatcagcgcacgctgacggataaagggattttttatacgccgggaggattgccgcgcgccgagcgtgagctggctgcaacggtcgccagtaaaatcatcggctgcatctactgcgcatctgtccatgcgcgtaaagccagccagctgtctaaggatgacgacgcggtggaagcactgctggcggtacgtcccgggcaatccctcactgagggacagtctgcacgctggcaggcggaaattaacttcgcgtcggcgctgtcggttacaccgcctgccgccacgccgctgcaccttgccgccctggaaaaagaggggctggataccttagcgcagcttgacctggtgcagtccgcggcgttcttcgcctgggccaaccgcctgatgctgaccctcggcgagccctggcttgcctga

SEQ ID NO: 9931 - DNA, 375 bp, Glycine max
  Peptide Sequence Number=SeqID_126709
atggaggccatgaaagagcaaatgaccacaatgatggaatccatgatgagtataagaaaaatgatgcaggtcaacacgactacagtcattgtcataagtaccgccactgaggtggacccgactcacccatttggcctcaatcaagtaaatcgtccagtattgaatatgacaggtcagggaggcgaagcgttgggaagtacgggtgacccacattttgtgcaggtccagagcaagcattccttcccaccatatggcttgcctcccaactatacaccacccaatgttgcacacgctcctgatgagaatgtcgataactccgctcccatatccattgagagccaacatccccaatctggtcatgcacatgtcccttaa

SEQ ID NO: 9932 - DNA, 198 bp, Glycine max
  Peptide Sequence Number=SeqID_126710
atggcacctcagacaccttataaggataagctacttaaccatgagggttccatagagaaggatggggttgtgtcagacgagctggtttctacggaggaggactacaagcatgctatctatgaaggtccatgcatggattgtagcggaccattatatcattgttcagaggtggcgtcccttcttccttataaatgctga

SEQ ID NO: 9933 - DNA, 1113 bp, Glycine max
  Peptide Sequence Number=SeqID_126711
aggatcccacgtccggcagttgcaggatgcgtcggtgaaggccgtgcgcctgcccgaggtgcaaaagcacctgaagctgctgggcgcctcggtcaccgagatggaccagagccgcttccccgcccagatcgccagcgaactgcagcgcaacaaggcgctgctggacaaggcaggagtgaagccggaatgagcgcagtcgagcatctccaggacttcttccagcagcagtccccgcgcatggcggccctggccgacagcatctggtccctggccgagctgcgctatgccgaaacggcttcggcccggctgcacatcgatgcgctggagcaggccgggtttcgcatcacgcgcggcgtggccggtattcccacggccttcctggccgaatggggccacgagggcccggtgctggccttcctgggcgagtacgacgcactgtcgggcctgaaccagcaaagcggcgccctggtctgcacgccgtccaccgacagcccgggcctggccggccacggctgcggccaccacctgctgggcacctcggcgcatttcgcggccatcgcgctgcaggagcacctgcgccgcagcggcgccaaggcgcgcgtgcgctactacggctgcccggccgaagaaggcggatcgggcaagaccttcatggcgcgcgccggggtcttcgacgatgtggacacggcgctgacctggcacccggccagcttctccggcgtgttcagccagagcacgctggccaatatccaggcgaagttcgtcttccacggcaaggcctcgcatgccgcgcactccccccacctgggccgcagcgcgctcgacgccgtggagctgatgaacgtgggcgtgaactacctgcgcgaacacatgcccaccgatgcgcgcgtgcactacgccatcaccgactcgggcggcctgtcgcccaacgtggtgcaggcgcgcgccgaggtgctgtacctggtgcgggccgcacgcaaccacgaggcggccgcactctacgagcgcgtgcagaacgtggcgcgcggcgccgcgctgatgacggattgccggctggagatcgtcttcgacaaggcctgctccaacctgctgcagaaccgcacgctgaaccag

SEQ ID NO: 9934 - DNA, 346 bp, Glycine max
  Peptide Sequence Number=SeqID_126712
ggctattgaagaaggcgtagattatgcctttgcagacatggcaaagtggcgcctagtgcccgatgtggtcattcctccaaaattcaaggtgccagactttgataagtacaaggggactacttgccctaagaatcacttgaagatgtactgtagaaaaatgggggcatacgtaaaagatgaaaaattgttgatgcatttcttccaggaaagtcttattggggtagctgtcacctggtacaccaatctagagtcttcccggggatctggtagctcaagtagcaccaccaatgatggagaaggagatgataacaatgatagtggacacattaccgttgttctactatga

SEQ ID NO: 9935 - DNA, 192 bp, Glycine max
  Peptide Sequence Number=SeqID_126713
atggcagtgaaacactcttatctttttgtgaaaaatgggtcttttgatctagataatttaattttcatggaacctaatgatgatgcacaatctgaggaagaccttgatgatgatgatggagatggagatggtgatgaaagtgatgatattcatggagatgatcctattagaggattggacatgcttctttga

SEQ ID NO: 9936 - DNA, 252 bp, Glycine max
  Peptide Sequence Number=SeqID_126714
atgtcaggatttacacgcaattctcctcaaatttcagccagcccgcatcaattagaccttgcaccttacgcttcagagccctacaatgctcaatggaacgccccgaggcttctccgtgacaagcacacattgcgttcgagtcgtattctcggagaaatggaggttgatgaaccttggctagggttatggctacccttgaattatcaagtggtcttagtcattggaagtgcggtagacaagctttgtggttga

SEQ ID NO: 9937 - DNA, 270 bp, Glycine max
  Peptide Sequence Number=SeqID_126715
atggcagagttatgcctagtgcctaatgtcgtcatctcaccgaagttcaaggtgccagatttcgataagtacaaggggactacttgccccaagaataacataaagatatactacaggaaaatgggtgcatatgcgaaagatgaaaaattgctaatgcatttcttccaggaaagtcttactggggcagccgtcacctggtatactaatttggagcctttccaagtccattcttggaaggacctattgtttgccttcattaggaagtattaa

SEQ ID NO: 9938 - DNA, 102 bp, Glycine max
  Peptide Sequence Number=SeqID_126716
atgggtgtagtatggatgctgatttccccagttgtgagacataacagagtcatggataatgatggaactgggcaggcgacagctgactcggttatggcatga

SEQ ID NO: 9939 - DNA, 120 bp, Glycine max
  Peptide Sequence Number=SeqID_126717
atgggtccaggacatatcccatttcttttgcttgcaccacatcgcacaaaactttgttcgcggttacgcatacacgaagaagatgcactagcgacatcttggggatatccgtgcgaataa

SEQ ID NO: 9940 - DNA, 354 bp, Glycine max
  Peptide Sequence Number=SeqID_126718
atggctataaagtggggttatagtatggatgggttggaagggagaaacaatagacacacaaaaatatggaaaaacttagaggatttgaatgtgaaggttccaagtttccaaggaagttgtgatccggaggcttacttaaagtgggggatgaaaatagaaaaagaaataaaggaagagattcaatggaacgccggtggcaacatggttggagatgaagaccttgatgagaaagaggtatgttccaagagaatatcaaaggaaacatatagaagaagagaagtagggaacttgaatgtctcgtgtgttctggaagagggcatatggcctctcaatgctgaaggtggaaaagattga

SEQ ID NO: 9941 - DNA, 852 bp, Glycine max
  Peptide Sequence Number=SeqID_126719
atgatggaggccatgatgagcatgaagaagataatagaggtcaatgcgactgcagttgccgcaaccagcgctattgttgaggtagacccgactcccccatctggcctcaaccaaataaatcatccaacctcagatatagtgggtcagggaggcaaagagttgggaagtacgggcggcccctattgtctgcaaattcaaaacaagcacgctttcctaccatatggcttgcctcccaactatacaccacccaatgtggcacacactcccgatgagaatgtcaataactccactcccataatcattgagagccaacaacctcaatctgatcatgcacatgtctctcaacccctgggggagacgcatgagatacaacaccacaatctagctaactttaagcctcaccttggatacgccactgaggggcaagcagttggtggtgtacccctgccaaccactttggatagccctcagtttcgcccacaaccacaacccttgcattttgcggtgggaagagtccctcctgccatggtggaaaggaagaaattggatcaaatagaggaaaggctaagggccattgaaggaggcagagattatgcctttgctgacatggaagagctgtgcctagtacccgacgtcgttatccctctgaagttcaaggtgccggatttcgataaatacaaggagactacttgccccaagaatcacatgaaattgtattgtcgaaaaataggggcatactcgaaagatgaaaaattgttgatgcatttcttccaagaaagtcttactggggcagccgtcacctggcagtatcagtacaattctgatatggcttcagataggatgcaactatag

SEQ ID NO: 9942 - DNA, 189 bp, Glycine max
  Peptide Sequence Number=SeqID_126720
atgtctcctccacctctagaacctcacaatcactcacagactcatctcatgctcttaggacgacttcctcttcaagctccattctctgcagctcatccttcttccagattcttcctcgcgcttagccgaggagtgttgcgctcaacggatggctcactaagccagaagattggcttagcaagcggatga

SEQ ID NO: 9943 - DNA, 381 bp, Glycine max
  Peptide Sequence Number=SeqID_126721
atggcatgcagagaccatcatggtcatccgcttttgttgttttctagactattacagtctcctttgccatccagagacaatcaagtccgatggcatgtggtgaccatcatggtttctctgttaggactttcgctagtggtcggtcggatgggttttgtgacgtttcagaaggaaatgtgcaaaatattcaaaataggggcaaaagggtcaattttaaggcattttttagcccctgggcccactagaaagcttagggatgaagtaaccagctcgcctgggcgagctaagctcgcttgggcgagcaagttacttcaggaggaatcaagcagctcgcctaggcgagctgctatgcaacctccaccccttatttcctataaatag

SEQ ID NO: 9944 - DNA, 798 bp, Glycine max
  Peptide Sequence Number=SeqID_126722
atgggagacacaaaccacgcgtccaccgtcgatgacgatttgctcctcaaaaacttcttcgccgaagttagcgaagttgaaagggataacgaagtgcttaggattctctcttgttttaagttgaatccttttgagtatctaaacttatcatttgattcatcaattgatgatgtgaaaaagcagtaccgcaagttatcattgatggttcaccctgacaaatgtaagcatccgcaagcaaaggaggcttttggagcattagcgaaagctcaacagttattactggatcaaaatgaaagagattatattcttagccaagttaattcagctaaagaagaacttagagcaaagaggaagaagcagctgaagaaagatacagcttcaaaaatgaagtctttggttgaagagggaaaatatgacaaacaatatgaacaatcagaggagttccggcaggagctcaaagtcaaagttcgcgaactattaacagaacaagaatggaggagaagaaaaatgcaaatgaggatatctgaggaggaaggccgattaaaaagggatgaagaggaacagaaagaaatgtggaaaagaaagcgtgaacatgaggaggaatgggaaggaacacgagaaaagaggggtggaaagaagaataagaaaggggaaattcgtccaccgaagcttaagacagaagatcccaacaaatcctacgttcaaaggcctgtaaaaagaggctatcttttgtatcagttagatacttttaaacagatttattactggggtcatttgaggcatgttaatggaatgtag

SEQ ID NO: 9945 - DNA, 1275 bp, Glycine max
  Peptide Sequence Number=SeqID_126723
atgtcaacttgtatgagcaagaaaatacaaggccaaagcctttctatagaagaagagaacatgctggtggtgcagaagcagggaatcgtgaccattttgggctctaaccacgatgctccgacaacttctcttcgacgcactttatccgcagacatgtcttccaagacatggctttctcaaaacggcttctctctcatgaaaaaaacctcttcctctgaagaactctcttactcatcactcacaaaatccactatttctgactcatcctcgtctgatgaagataactgcgaagaagcgaaacaagaccagttccaaatttggaacacaattcaaaaggagcagcagcatgaggacaacaaaccaggacaggttgatgtgtggagttcaattttggtccaaaaagccaacgaggaaaccttaaaactaagcacaactccttatgttcacccacttgtgagaaggtcaaagagttgtttgagtgaaaaaagtttagagatctgcacggagagtcttggatccgaaactggctcagatgggttctcttcttactcaccctctgagacagaagaaaaagaagaagaaaaagaggaagagagtatgcaaattacacacgaggaggattttcaagtgccaaaacaaaactatgctgagaaaaagtccttgcctcgttctttccctcctccacttccttcactccacatgcgttcacaccgtgacaatggaaggttgttcctacaagctgtgtctgttccttcacagaacaacttttgtgctcaacgagaaaacggtcgacttgtcctcacttttgctgacgtggaggtagctgaagaagaagaagagtttgatgaggcagaggaatttgagagtgtgatagaggaagcaaaaacacccatgttaaggttgttatctagtgggtttgggttagcattaatgatgaataagccaattgggttattaggtactgatgctaacgttaagagtccaaaatggtcagagaagttcaacgatgtggtcaattttaaggatgttgatacggtacaacatagtcatccactgccaccgaggccaaggcagcatggtagtattcataaaaaggctttcaatgcttatgaatactattggaggaccaagcctacgacaaaagttgctcctgcttctaacacgtttacctttcaacacaacaacaattactcttccttggagaacaatttgaagagttgcaaggattctaggaggtcttttctgatctgggaaccgtattgcattgccacctga

SEQ ID NO: 9946 - DNA, 204 bp, Glycine max
  Peptide Sequence Number=SeqID_126724
atggagaagaaggcctcaatagagggtcatggtcatgggtttgaggtcgtcaaagccgaagaagttggagacaaggatcatgggattggggataacgttgtcggcaacaaagaagaaggccttagcaaagggaatgtgatggtcgggcacagagacaacttcacatcgaaatcagcattgggggtggacatcaatggaaaatga

SEQ ID NO: 9947 - DNA, 447 bp, Glycine max
  Peptide Sequence Number=SeqID_126725
atggtgccggagaccgatcacgatccggccgcgcagaaccacgccgccgctgctccggctccggacgcggcggagggagagcagctagcggagccgccgtcgtccggagacggatctccggagcaggcggctgcttcagcgccgcagagtccggtggtcggaccgaggctggcgccaacttacacagtggtgaatgcaattttggagaagaaggaggacggaccggggccgaggtgcggccacacgttgacggcggtggcggctgtcggagaggaggggacgccggggtacattggtccgaggctgattttgttcggtggtgccactgctcttgaaggcaattctgcggcgtcaggaactccttcatctgctggaaatgctggcatacgccatccaccaccaccaacctgttacaagtgcatttacgtgatgtggtctgcattttaa

SEQ ID NO: 9948 - DNA, 333 bp, Glycine max
  Peptide Sequence Number=SeqID_126726
atgaagcctcctgatgtccaagaagatcatatctttttaaaggcttttccttattggcataccctaatttcgtctaggtaccattgtttgacggcatgcaacctttggttgaccgcttcgagaaagaaaacaagtgtcgttacgaaattcgtaaagtttcgtaacgttacggaaaaagaatcaccaaaaaaagcaaagagggtgtatttagtaaaaaaaggggaggtgcaaatagcaatcaggcccacttgggccttccagattcttcctccagaaggcggttgcttctggaggaagcaacctggctcgcctgggcgagctgagctcgcctga

SEQ ID NO: 9949 - DNA, 543 bp, Glycine max
  Peptide Sequence Number=SeqID_126727
atgacccaactaaggcccaatagcatagtgattgtcgtgtcacagtggtcgaggagtactggcagtccattttcactggtaattgggagtctttgcatcaaacacccaaatttgtttggtggaagtgagaagcttgatgtttcgtgggacaagggtctgtatgattcaaatgtcttggttgcatatagaaggccacggccagaatggcttgctcagcagtcttttgtattgcagcattctctttcacctgagattggagtccatggtatcccagtgaacaatttctcccgctcaggaagtggaggtataaatttatctcgattgtcagtgggaatggacctgaaggaacctgctagttcaaaatggagcagcactaccagcataaagtttgagcatgttcgtccattgaatgatgatggtcgcgctatatgtagagattatgatggatttcctttgacttccagtggcaatccacatgacagtatggtagtgttaaagcaagagtctcaatttgcaaaggcgaatgataatagcttttttcat

SEQ ID NO: 9950 - DNA, 1110 bp, Glycine max
  Peptide Sequence Number=SeqID_126728
atgacactatgcagcttcatggtcatttctactacactaacttcatccattttaaccaactttgccaaaattgcaaaatgggaatcagaaaaagagcagggcatgatggatcaatgcttggttgtgcacatcccggacaagcagccgcatgaccttcaccaccaacccactgagagtgtttttgcttcagccatcgaccctaagcatgccaaccaaattgtaaggcgtttgaatcagatagcaccacttgaagatctccgtcatgtgaaacgaattcagaagaaagttcttgaaggaggacaaatagagctattggtgatcttgtgtctggcccatgaaggcaacaatcaactggataatatgccacctcttcttcaggagttgatcagttcccatcagttgagtccttttatcacaaaagtctgcaaatacgctgcaacatcaaaagaagagtggcaagagcaatgcaaattttggccaacatcatatcaccccaggacttacaacattgatggcattactggatttagcgaggaggactcccaatcagttttgaagtttatgcaatcagctgttgagatggcaacatctgatggcatggttgttaatgctgcagtgatagtggatccttcagctaagcaaataatttcaagcgcatgtgatcagattttttcttggaacacttgcaaagacaacaactgctatagaaagccagaattatctagttcccatcctataagttccagtagatgtaatccccatgaaccattgcattcaaacagttcctccaatcagcttaaacaatcatatacagacgttgcttgtttatatcctcggcaatggactgagcagcaatctcattcacagagttcatattattggcaccctttgcgacatgctgccattgtagctatagaatcatctgctgccagggatcgataccttttttccagtgagggaaacagtgaagatagatatctggaattggatagtgataattcttcttggactagctctcctgcaaagagacagaaaacagtgtgtgcaaatctgcccatctgtatgaagtgctaccatgccattcctacaaaagtattaagaacaacttaa

SEQ ID NO: 9951 - DNA, 324 bp, Glycine max
  Peptide Sequence Number=SeqID_126729
aaaactgacttgactccttcatgcatgctccactcggctcggggggatatagctcagttggtagagctccgctcttgcaattgggtcgttgcgattacggaggaccgaaacatgccactgaaagactctactgagacaaagacgggctgtcaagaacgtagaggagtcggtggctctcctagggtttcctcatttgggatcctggggaagaggatcaagctggcccttgcgaacagcttgatgcactatctccctttcaaccctttgagcgaaatgtggcaaaaggaaaaagaatccatggaccgaccccatcgtctccacccc

SEQ ID NO: 9952 - DNA, 324 bp, Glycine max
  Peptide Sequence Number=SeqID_126730
atggccggaggtgccgccgggggtttcgtcactcgagcgttcgattctattctcaaggagtgttcttctgtcaagaagtttcccgaacttcagaaagctattcagaattacacagatataacgaaacaggcgagccagaaaaagcagagtgaggtcaatcaagctgcaccttcagctgaatctgggagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaa

SEQ ID NO: 9953 - DNA, 213 bp, Glycine max
  Peptide Sequence Number=SeqID_126731
atggaggagaaagtaaagctgaaaactaatggagctttaaggagcacctacttgaagctcttccatggaattgcagcgaaagataaaggagaagaggttcatgagaaccctatggtcttcttcagcagctctagtccaaccctcttggaacctcttgctcatggctctggtgactggtcccttcccaaggaggattgcatcaaatatgtttag

SEQ ID NO: 9954 - DNA, 309 bp, Glycine max
  Peptide Sequence Number=SeqID_126732
atgcgggaaatcccagggccctgttggacttatccaggtccaaagggtgcctggtcggcaccatacctgcaaatagataaatggcatcagcaatcaactgagccacgtgaatgctcatccgtgtcaggatggcgtaaccaactgacacttcggcagggggaggtcggaattatgatcgctgggctggatgttgctgagcagcaacgtcatccatatctaggtcagggtggtcatgttggtgggcatgatccgcacccgtctcccagcagcagtccgggtgtgacaccctctaccccgacatataaataa

SEQ ID NO: 9955 - DNA, 717 bp, Glycine max
  Peptide Sequence Number=SeqID_126733
atggcgtcaggggacacagattccttcagcgataaggtagaagagaagttccacgaccacaactccgattccgattcctattccgattccgatgacgaccacaacaacaggccgccgcccaagaccaccgtttccaacaacgtttaccgcctcttcggtcgcgatcagcccgtccacaaggtcctcggcggcggaaaacctgctgatattttgctatggaggaacaggagaagcactggagtcgtacttggtgcaggcactgccttctggattttctttgagttgatgcaataccacctcataacttttatttgccatttattgattgtgtctctcgcggcacttttcttgtggtccaatgcatctgtctttatccacaagtcttcactgcacatccctcatgtagcacttcctgaggaatgcgttcatcaggttgcttctgctttaacaattgagattaaccgagccttcgttattgtgcgggaaattggaactgggagagatttaaagaagttccttagctctagtttggtggttatgtttgccttcacagactttgtgcagacagtagcagctgaagtaggactaattaagaaatatgaagaccaagttgatgcattaggagagaaggcaatgattgaaatcaaaaagcagtatgcagtgtttgatgctaaggttttgagccagataccaatagcaggttttaaaaaggattag

SEQ ID NO: 9956 - DNA, 2253 bp, Glycine max
  Peptide Sequence Number=SeqID_126734
atgtttggtggtgcatcttggattctattgaattcaaactccggcttcttgattttaagtcttattggttccaacaattgtaccttacacttgatcaatcaacttgttctggacttttccaagcacttgaggaaccttcatccagcaagtagagctattttgctttctggacctgcagaaccttatcagcaaaatcttgcccgagctttagcacattacttcaaatcaaagttactgttgctagacattactgacttcttgttggagatgcagaggaaatatggatgtcccagaaaagaaccatccttccttcaacaggcagaactagaggtaccggaggaagttgcacttgaactttttggaaaagtacactacatcgacagagtagtgaaattgaaaattccagcaatcctccaaagcttcgcaggaatgcctctactgcatgtgatacgattagcacttcccaatatgttcatgttttcagctcctttgaagtgcacaagcggcttctgttttgatgaaaagctcttcgtgcagtcactttataaggtcttggtttctatctcagaaaccagttctgttattttatatatcaaggatgttgagaagctctttgttcgatcaacaaggctacacaatttgttccaaaagttaataaagaaactttcaggatcagtgttaatactcggttcccagatcattgattctgaagatgattgtacagaaattgatgaaaagcttagtatgttattcccttacaacattgagatcaaaccacctcaagaagacgcccatcttgcaagctggagaacgaaactgataaaggacaaggaaaaaagtctgtttcaagatagcaggaaccatattgctgaagtacttgcagcaaatgatgttgattgtgatgacttggaaaaagtaaaccatgctgatactatgctactcagtaattgcattgaagagattgtagcgtctgcaatttctcaccacctgatggagactaaacatccagaataccgaaatagaaaattagttatatcacacaagagtttgtcccatgtattgaatattttccaggaaagtgaaagtaatctggagaataaagattcaaacaaggaggatgctcttgcaacaaagaaagatggcgacaatgagtttgagaagcgcatgagagcagaggttgtgcctgcaaatgagataggggttacatttgaagatattggtgcattggatgatattaaagaattacttgaagatgtggtcatgcttcccctcagaagaccagacttattcaaaggtgggcttctgaagccttataaaggaatattgctttttgggcctcctggtacaggaaaaacaatgcttgcaaaggcaattgcaaatgaagctggagcaagcttcatcaatgtctcaatctctaacatcacttcaaaatggtttggggaagatgaaaaaaatgtccgtgctctgttttcactagcagcaaaggttgctccaactattatttttattgatgaggttgatagcatgcttggaaagcggactaaatatggagagcatgaggcaatgagaaagattaaaaatgaattcatggcccactgggatggaatattgacaaaacctggtgagcgaattctggttcttgctgcaaccaacaggccatttgaccttgatgaagcaattataagacggtttgagcgcaggatcatggttggtcttccatctgctgagaacagggaaatgatcttgaaaactctcctagctaaggaaaaatatgaacatatagactttaatgagctttcaaccattacagaaggatatactggaagtgatcttaagaatttgtgcactgctgctgcttatcgacctgttagagaggtacttcaacaggagaggttgaaggaaaaggaaaagaagaaaacagaagcagaagttcaaagatcagaagatgcttctgatgctaaaggagataaagaagatggagtgattacttcaaggtgtttaaacattcaggaaaagaagaaaactgaggcagaagttcaaagctcagaaaatgcttctgatgcaaaaggtgataaagatcaccaagtgattactttgaggcctttaaacatggaagacatgagactggcaaagagtcaggtggctgcaagttttgctgcagaaggatcaataatgagtgagctgaaggagtggaatgaattgtttggagaaggaggttcaaggaagaagcagcagcttacttatttcctttag

SEQ ID NO: 9957 - DNA, 4107 bp, Glycine max
  Peptide Sequence Number=SeqID_126735
atggagggacgggcccttgcttggttccaatggatgtcaagcaacggccaattcacctcttggcccgtatttctacaggccttacagaccaggtttgctccgtccaattacgaggatccctcaggatccctattcaagctcattcagaagaccacagttgcagaatacttatctgagttcgaggagctcgcgaacagggtcgtcggcctccctgctccgttccttttaagctgcttcgtttctggccttgcgccggagattcgtcgcgaggtgatgatcaaccaaccgcttacggtggcacaagcggcgggtcttgcgcgtctccacgaggagaagttgcgcgacctccgcttcgatttccgccaacccaaccgacctcgccctcttcagctaccccctgtagccccaccgcagacttcaccgctcccaacctacacacctccgcgcgcctccacccttccccctttgcttcctctgccgccacgtcctaacccgcaaccgccaccgatgtttcgtcgcctgacctcggaggaactggcgtcgcgccgtgagcgcggcctgtgtttctcatgtgatgagaaatttcacaagggccatagatgcgcccctagggttcatctactgatagcagatgatgaagacccccttgaccccgcgggttctaatataaatccaccagaccctcccgacccgctacccggcccattggatggacccgactcaccggcccacctcagcatcaactctttagcgggtcatcttgcacccgagaccttgagactcctcggcaccatctccggcgttcccgtcctggtgctcattgacggtgggagcacccacaatttcatccaggagccactcgttcaccaattgggccttccttgtcaatcaaccagcccattaaaggtcatggtaggaaatgggcaacatctgcaatgccatacgatttgcagttccaccaccctcgtccttcaacatcattcgttcaccatggacttatatgtcctacccattgccggcgctaacattatcttgggtgtccaatggttacagtccttgggcccagttttaactgattatacaaagctcaccatgcaattctttcatgatgacagtctctacttccacatcacagtgcttccggtggattccgcacaaccattgaccaagcccgttgaccctcaggttcaacatcttcttcatcaattcgccattctctttcaagaccccaccactcttccgccggcaagagacacggaccatcaaattcaccttcttccacatgcgacaccagtgaatgtccggccatacaagtatccatattaccagaaacgcgaaatcgaagctcaggtggaaactatgcttcaacggggcttaattcaacccagcaagagccctttctcgtcgccggtattattggtaaagaagtctgataacacatggcgcttctgcgtggactatcgcgcattgaatgccctgaccatcaaagatcgttttccgattccgacgatcgatgagcttctggatgagctcggcggtgcgtcttgcttttccaaattggaattgttgcaggggtatcaccagatacgcatgcaaccggaagacatcccgaaaacagccttcaggacgcatcacggccactttgaattcaaagtgatgcccttcggtttgtgtaatgcgccttcttcattccaggcaaccatgaacactcttttccgaccgtatctccggcgattcatcatcgtgttctttgatgacattctcatctatagcggttccctcagcgatcacttacgtcatcttcaggccacatttcagatactctatgagaatcattttgtgcttaagctctccaaatgcctctttgcgcagtcagaagtcgaatatttgggtcatctggtctcacacagaggtgttcaacctgtcacttcgaagcttgatgccattgctcagtggccaataccacgttcagtccgtgctctacggagttttcttggcctcgccggattctaccgcaggttcattcagggttatgccaccattgccgccccgcttgtaaaggccaccacggttgaacctctccagtggaactcctccactcaggcagcttttgacactttgaaacaggctctaatctccgctccggtcctttctctccctgattttcaattgccttttacaattgaaactgatgcgtctgcaatcggaatgggggctgtattgtcccaacggggccatcccatagcttactttagcaagccttttagtccaaagttgcttcgagcctcgacttatgttagagaactgtttgccatcacggccgccgtgaagaagtggcggcaatacctccttggccatagctttattattttaacagaccatcggagcttaaaagaattgatgagtcaggttgttcaaacacctgaacaacatacttaccttgcaaggttaatgggctacgactaccagatccaatatcgctccggcagtcacaatcaggccgcagacgcactatcccgtttgccggaaaacccctctcaggccctcctcatcctctctgttccatgtctcacctttctggaggagcttcatacccagcttgctgcgaattcttctttccaacatctcttccaagagttgccgtcggacataccaatcatcaagaccttgctcacagagtaccacgccacccctacggggggccacgccggcgtcgcgaaaacggtagctcgtctcaccaccaatttctattggactggtctacgagatgacgtcatgcgcttcattgcaacctgcgttgactgccaggtcaccaaatatgagactaagaaaacagctggacttctctgccctctccctgttcccactcaaccttggtcggacttatccttggatttcatatgtgggttaccaccgtatcggggcaacacgacgattctcgttgtcgtggatcgcttctcgaaaggcatccacttgggcatgctccctcaaagccacaccgctcttgctgtcgctcggctctttttggacttagtggtgaagatacacggccttccccggagcctcgtttcggaccgtgaccctctcttcattagtcagctatggcaagaattatttaaatccagtggtacccagcttcggatgagttctacatatcatccacaaagcgatgggcagacggaggtcttaaatagagtagtagagcagtatctgcgtgcgtttgtccacaggaaaccgacaagctggggaaaattattaccatgggttgagtggtcgcacaatacctcttggatggccagcacgggcaccaccccttatgagattactttcggccggaagcccttcaattttcccgattatcttgcggggtcttctaaaattgaggcagtggaggaaatcttaactgatagagacactaccttccagttggttcgcaaaaagttgctgaaagctcaaagcaagatgaaactttatgctgatcaacatcgtcgggatgtacagttcaccgttggtgattgggtcttggtccgccttcgtccttaccgtcaattttctgcaaaagataagcaccacacgaatgagaaactagcccgtcgctattatggtccctttcaagttgttgctaagctccgacccgtggcatatcgtctagcgctaccagagggggtccggctccaccccgtgtttcattgctcgaagcttaagccctttcgcggggatccagattcctcatcccctctgcctttaccagccactttccatgaaaatcaaccactcgtctctcccctctctatcctggattttcgtcgggaaacctctgatccccagagtccgtggcaagtcttggtccagtggcagggtcttccaccggaggaaacgtcatgggaagattggcatcagctttgccaggattatcaccttgaggacaaggtgatcctgcaagggccgagggatgatacgagtacagaggacacagagcttgggaaggaagacgctgaggaagaagatgatctgagtaagagggaagaagaggatagaggggtgcaaagagaaggaaagcccaaaaggaaggttatcaagcccaattatctaaaggattatgtttaa

SEQ ID NO: 9958 - DNA, 826 bp, Glycine max
  Peptide Sequence Number=SeqID_126736
cctcccacggcactctcctcctcaactccgctcctctcgtcccctccaccttccgcaaactctcctcctacgtcccccaacacgaccactgcctccctctcctcaccgtctccgaaaccttcctcttcgccgcaaagctcctaaaacccaaaacctcaaacctcgccgccatcgtctcctccctcctctccgaactccgactcacgcacctatccaacacgcgcctcgcgcgtggcctctccggcggagaacgcagaagggtctccattggcctctgtctcctccacgatcccgctgtattactcctcgacgaacctacttcggggctcgacagtacttcggccttcaaagtcatgcgaattctaaagcaaacgtgcgtctctcgcaacagaaccattattctctccatccaccaacccagcttcaagattctcgcttgcattgataggatcttgttgctctcaaaaggacaagttgttcatcatggaagtgttgccacgttgcaagcgttcttgcactccaatggcttcactgtccctcatcaactcaacgcgttggaatatgctatggagattttgagccagttgaatgaggctaagcctgttactccaccgagtattcctgaatcgcctgagagatcaagttcagtgatttcggtttctgatggtggagttaggagtagtagagagatcataaggttttggaagattatctacagaactagacaacttcttttgaccaacaccgcagaagcacttctcgtgggtcttgtgttgggaactatttatatcaatatagggtttgataaggaagggattgagaaaag

SEQ ID NO: 9959 - DNA, 1981 bp, Glycine max
  Peptide Sequence Number=SeqID_126737
atggttgcctttgggaaaaagttgaaagaaagacaaattcaagaatggcaaggatattacataaactacaaactaatgaagaaacgagtaaaacagtatgctcaacaaattcaacttggaacactagatcggcgccatgtacttaaggatttctcaagaatgctggataatcagattgagaagactgtgcttttcctgttggaacaacaagggcttttggcaagtaggatagcgaagctcggagaggagcatgaagttattcagcaggagcctcatataagtagaatagctgaactacgagaagcttatagagcagtgggacaagagctattgaagcttctcttctttgtagaagtcaatgctgttggtttgcgcaagatattgaagaagtttgacaaacgctttggctataaatttactgattactatgtcaaaactcgcgcaaatcatccttactcccagctgcaacaagtgttcaagcatgtgggatttggagctgttgtgggagctttatctcgcaaccttcacgaacttcaggagaatcaggagagtcagggaagcttcttatcaatttatgatcagcctacacttcccctccaggatcctgttattgattcaataagagcagctattgataggttaagtaactcaaccaacttcctaaactttttggggcaacatgcacttattatgcatgaggagttgcctgcacctgttgatgagcgtgttgacgagcaaagttaccattttatgtctcttttcctgaacttggcaaacacatttttgtacatggtcaacacatatattatagtccctacagcagatgattattctatgagccttggggctgcaccaacggtttgcggtattgtgatcggggcaatggcagttgcacaggtgttttcttcggtgtattttagtgcgtggtcaaatagatcatacttgaggcctcttatattcagtagcatagttctttttctcggcaatgtcttgtatgccttggcatacgatcttaattcgatatggattctcataattggtcgtcttttatgtggagcggttaaccggcgttatattagtgattgtgtgcctttaaagatccgcatgcaagcatcggcaggtttcgttagtgccagcgctcttggaatggcctgtggtcctgcattagccggcttacttcagaccaattttaagattttcaacattacatttaaccaagataccttaccagggtggcttatgactattgcttggctgatatacctagtgtggttgtggatcacttttaaggaaccttatcgtgaaattgaagagaaacatgtaccacatcaatccaatgctgaaaacaatgcacttgaaaaaggcataaaacaaccactgctgactagtttaaaagataaggtagatgaagatgatgatcaggattacgaagatagtgaagaagctccagaggattctcatcagccagccaattcaattggagcagcatatagactccttacaccttctgtaaaggttcagttattgatatacttcatgcttaaatatgcaatggagattttactatcagaatctagtgtcatcacaacatactacttcaattggacaacaagcactgtttccatttttcttgcttgccttggtttgacagttcttcctgtcaacattattgttggaagttatataagcaatatgtttgaggacaggcaaattttgttggcatcagaaattatggttttcttaggcatacttttcagcttcaatgtaatttttccatacactgaaccacagtacatctgttcggggctccttatgtttgtttctgctgaagtacttgaaggtgtcaacttgtcacttctttcacgagtaatgtcatcaaggctttctcgtggaacctacaatggagggctcttgtctacagaggcagggacacttgcacgagtcattgcagatgcaaccattactcttgctggctatgggg

SEQ ID NO: 9960 - DNA, 1344 bp, Glycine max
  Peptide Sequence Number=SeqID_126738
atggctgttgggaatgctcttgtagatgcttatgctggaggggggatggcagatgaagcatggtctgttattggcatgatgaaccatagagatatcatcacatacacaactttagcagcaagattaaaccaacagggagatcacgaaatggcattaagagtcatcactcacatgtgcaatgatgaggttaagatggatgaatttagcttggcaagttttatatcagctgcagctggcttaggcattatggaaactggaaagcaactccattgttattctttcaaatcaggtttcgagagatgtaactcagtctcaaatagcctagttcactcgtacagcaagtgtggtagcatgcgcgatgcatacagagttttcaaagatataactgagccagatagagtgtcatggaatggtttgatctctggattggcatcaaatggacttatatccgatgctctttctgcctttgatgacatgaggttagcaggagttaaacccgattctgtcacattcttatcactgatttttgcttgcagccaaggtagtttattgaatcagggtcttgattatttctattccatggaaaaaacatatcatataacaccaaagttggatcactatgtgtgtttagttgatctcctcggtagaggtggtcgcctagaggaagctatgggagttattgaaacaatgcctttcaagccagattctgtaatttataaaaccttattaaacgcttgcaacttacatggaaatgtgccactgggagaagatatggcaaggagatgtctcgagcttgatccatgtgaccctgcaatatacttgctgcttgcaagcttgtatgacaatgctggactccctgattttggtgacaagactcgcaagctgatgagagaaagaggcttaagaagaagtccaaggcagtgttggatggaggtaaaaagtaagatttatctcttctctgcaagagagaagataggtaatgatgagatcaatgaaaagctagagtctcttataactgaaataaagaatagagggtatccataccaagagagtgaagacaagttataccactcagagcaattggcccttgcatttggtgttcttagcgtgccaactttggctccaatacgcataaataaaaactcacttatctgcactcactgtcattcttttataatgcttctgacacaatttgttgatagagagataattgtgagggataggaaacgattccatgtctttaaggacggccagtgttcatgtagagcaatgtcgatgaaacccgaaaggggtccaagattggtcaggccagggttgaaggctgttgccaaaattggagtatga

SEQ ID NO: 9961 - DNA, 882 bp, Glycine max
  Peptide Sequence Number=SeqID_126739
atggctgaggactgggatctctttgccatcgtgagaagctgccaatcagccaccacaacaattccacaaaccaccaccaataatacttcctcttccttagttacttccactatcaaggaagaaatatatgatgcattttcctctcccaatatagtgccacccaataccaatgagtttcaagagctacaccaattgttcacaccctttaaccccaccaacaacactagtgctccgggcatcaatcccaattccccttattttgcagaacaagaaagccagcaaatcagtgaacaccttcatatttggcctcattttgtgccagaacagtcttccactcccagtttcaatagattccatgaccaacaacaacagcaacagatcaatcaactacaggcacttcagaaacacgaatttcgactaccccagaacatttctcccacagtttcaccaaacgcacaacctcaaacacccaaatcaagaaaaagaaaaagccaacagaagaagatggtgtgccatgtaaccgcagataacctctcagcagatttgtgggcatggcgaaaatacggacaaaaaccaattaagggttctccatatccaaggtgcagcagttccaaaggttgtatggctcgaaaacaagtcgaacggagtaacactgaacccgacatgttcgtcgttacgtacaccggagaccactcgcatccccggccaactcaccggaactcgctcgccggaagtacccggagtaagactctggtaaccaatccgccaccgtcacctgggtcactctcctgcttccaagccacccctttttcttcttcttcttcatcgccaccacactctccaacgtcgccggaggaagatccacggaaaccgccgatttag

SEQ ID NO: 9962 - DNA, 744 bp, Glycine max
  Peptide Sequence Number=SeqID_126740
atgggaaactgcttctttggggccatgtcagatcctgatgcagcagcaatcaaagtgataacatcaaacggtggtatcatggaattcagtgctccagtgaccgtgagtttcatcaccaacgagttcccggggcacgccattttcagaagccacgacctcttttggaaaccactaagccaattcgaagaactggagccaggccaatcctactatctgctaccattcagcaacagaaacaacaacaacaacaacaacaacagcaacaataatatagacactctaccatgtgatggtgaaaatgttaacgttgttgtgagacaagggcatgttagatctcaaagtgttcctacaatctcaaaccctgccttgtatagaatgtccttggactaccaccaccacaaccagggaatggggttgctcaagaggtcctcgaataataacattgatgccttctctagcaggagcagtggtgttgttaatagcagcaacagtattggtggtggtggtagcagtaggttttggaaagtgaagcttgtgatcaccccagaacagttgctggacattttggcacaagaggctcgaaccaaggagttgatagagagtgtaaggatggtagcaaaatgtggaattaatgctggtggtgctatttcaaattcagctgcaggtatgatttctgatcagtggagcctttccagctccagttggagtatttcctccaagattgatgccttagtaggcatttaa

SEQ ID NO: 9963 - DNA, 348 bp, Glycine max
  Peptide Sequence Number=SeqID_126741
atgaaggtagtctccaatctttcaggggttgaatcagtctcagtggatatgaaagagcaaaaattgaccttaattggagacatcgaccctgtggttgcagtggggaagctgaggaagctgtgtcacactgacatagtctctgttggaccagccaaggaggagaataagggaaagaataataaggaggagaaaaagaagccagcagtagcagagaatcaaaatcatcagaacttggatgatatggtgaaggcatacgaagcctaccaccacatgcataatcagatgaggcaaccggcttattattacataagtgtggaagagaatcctaatgcatgtgtcatttgctaa

SEQ ID NO: 9964 - DNA, 1185 bp, Glycine max
  Peptide Sequence Number=SeqID_126742
atggcttccgatcttgagcttaaggccaaagaggctttcgaagatgataactatgatctcgcctacgacctcttaactcaggccattggtctcagccccaacaacgcagacctatatgctgaccgtgcgcaagtcaacatcaaagtcaacaacctcaccgaggctgtttctgatgcaaacaaggcgattgagttgaatccttctcactcaaaagcatatttgcgaaaaggtaccgcatgcatcaagcttgaggaatatcagactgctaaggcagctctagagatgggtgcttcattggctcctggagattctaaatttactgatttgatcaaagactgcgatgaactgattgcagaagaatctggtgtcatacccatacaagaagagagcacaacacagggtgctgctacaaaagctgttgaggcagagaatgatcttccagagccacctacagtaaccgtggttaaacctaaatacaggcatgaattctaccagaaacctgatgaaatggttattaccatatttgcaaagggcattccacgagacagcattactgttgactttggtgaacaaatattaagtgttacaattaatatcccttgcaaagatgcttatgtcttccaacctcgcttatttggaaagaaactaaggatcattgattttcctctatcagatcataccctccaaatgccgttaattagtgaatataaaccacattactactactcacctttggcctttggttggatgctcctcaaggcatatggattgaaattagcgtccttggatcctttttatcacggttttcatgtaacatgcattatttcataccccatgaatttggcagttgcaagaggtgaaaaacctacttatccatcctcaaaaccgaaaataacagattgggataagcttgaagctcaagttaagaaagaggtttgttggtacacttccttcccctatcctaacacttcatttcaggagaaagaagaaaaacttgatggtgatgctgcgttgaacaaatttttccgtgatatatatcaagatgcagatgaggacacaagaagagcaatgagcaaatcatttgtggagtctaatggaacagtactgtctacaaactggaaagaagtgggatcaatgaaggtacaggaaagtcctcctgatggcatggagttaaagaaatggtaa

SEQ ID NO: 9965 - DNA, 873 bp, Glycine max
  Peptide Sequence Number=SeqID_126743
atggccgctaccaccaacaaagacgaagccattagcaccagtgcatcttcttcttcttctccagtcttcatatccacagagaccctattcaccatccttacccatcacactctgatgaaccacctccaatccactctccccaaagcatcaaccattctccaaaccccaattcgccaacaccactctctctttccttcctcctccctcctcctcatgccttcatggtcctcttccccttctctcccttacatcggcgtcaaactcgttacccatttccctcaaaactcttctatcaacttacccggcgtgcagggaagctatgtcctcttcagttccaccaccggccaaaccctagcttccatgaactccaccgaactcaccctttacagaacctcatcgagacatgacagcgaggttcttgttatgaacagtgggaaaggcgacaaatttggtcaaagtggggaatttggtggagtgagcttcgagggttgtggctgtttggacgaggttgtcggatttggggacattgtgagttgcgccacgaattccgagacaccccttgtgaagggtgtgaggttgaagggtggggcgcatttggatttggtgggttccttcaagccttcgatgatggagtgtgatgatgaggccataaggaggggaaaggtttttgtggacaatgaggctgcattagttgaagcaggggagctggtgggtgcttttgagagaggggtcatcaagagagatgaaattggagggagtttggtggagcttgtgagaggtgacaaagttgggagaagcagttctgagcagattactgtgttcatgtctgttggttctgctgttgtagatatgcttgcggcagtttgtttatga

SEQ ID NO: 9966 - DNA, 381 bp, Glycine max
  Peptide Sequence Number=SeqID_126744
atggaagaaagttcagggtttcctgtgttatttggtggtgaaaattcaaaccctcctgatgatggtggcaaagacaagattctggggctgcaacttagtgcaagacttcaaaacaatggtctcaaagataagatatttctagggttggaacttattgcaagacttcaacaccgcaccagaggtttaagacatttaactaggatacatggtgtggatttgacgaacgaaactcaggatacatacctatatttgtttcattcccctctatgttttcttttaaatgaatattgctcaactcgaacatatgtgaaaaattatgaacatattttcgagttgatagacataaaagacactatgaagtttcgaaagtgtcaagaataa

SEQ ID NO: 9967 - DNA, 745 bp, Glycine max
  Peptide Sequence Number=SeqID_126745
atggcaagagtatcgaaagtggtcaaaatcgcggcccaagaattggaccgagtgaagcaaaacataaatgggttggtagagataccaatgaagcacttagaggggaaggcgaaagctttggcagatcaaggagaatggacttcatttgttgatgttttagcactgtcggtatttgggatcgtgctctttcagaatgttgatgagctagtggatttagcagtgaccggcgcttttcttgcttatcaccacaacaaggaaagcctggtcattgctgttttggatgatgcttatgacactttcgacctaagatgcgaaaagagtagtgctagaatcgtctgttgtacacccgctctttatgtatggctggtctcccacatttttcgtcatgaaagtagacctgtctgtcccctacaaggtcatcgcatgtgtgccgagaaagggaaaacaaattgggaggaacttttggcagggttcccaaacgtccccttgatgggaacaaggggttttagtgaaggcaatgcaaaaatacttcagagagtccaaaaagcatggaatgccgtggaaagaaaagataaggagcttagaggaagcaacaacgctgaagtccctgcggagagagaggaagtgcaagccttgaaagcgaaactggaaaggacgagagtggtcaaagaaaagttcaagatggcagccactagggtcaggggtaccgagctcgaattcgtaatcatggtcatagctgtttcct

SEQ ID NO: 9968 - DNA, 318 bp, Glycine max
  Peptide Sequence Number=SeqID_126746
gctctgctaccatcatgcacagaaacaaggaacaagaaacatgagactgttaaggtcttttgcaagccttgtaaacctggtcaaggacacgagtatgcacaagaacttgccagattgagtggtggtattccacttcaaataattggagatgacactataatatttgattgcggaaagaactatgaacagcctgaggttatgtcaccaattgataccctgtccaagaataaggcaagaatacgcaggggtgacttctttgtccatgaaacttacggtgcctacaaatctgttgaggaactttgggatggtgaaatctga

SEQ ID NO: 9969 - DNA, 420 bp, Glycine max
  Peptide Sequence Number=SeqID_126747
atgtttggaaagaggaaaaccccaaagattagcaatgctaatatgtccacaacctaccctttggcgggagggcgacgcgagactcacgggtgcgtcttccaagaaaggaaaatgcgcggagtcgccatcaacgttttttcgaggaaaacgtcgaaaaaaccggaaagatgtggtctacgaactttaatcgtgaaaggttcgggagttgtttttacacacgggaaaggtgtttcccttgctcctacgtattcctcgattgtgataaggaaatcagacctacgtaattcttcgagaactgaacgttggttaagttgttttaatcctttttttgcaagatatattttgaccaaacaaaagttgtttaaggcgttggaccatttgaacgaccttttgattcttttgaagggagagaaacattaa

SEQ ID NO: 9970 - DNA, 255 bp, Glycine max
  Peptide Sequence Number=SeqID_126748
atgaagccaaagaaaattctagatgaggcttcactgtcatcaagcgagtcgaaaacccagcatgaccacagatcgacctctactccttatggctcacataggcccgggtataggagtttaatagatagacagacacataccaaacacaacatcatagcaaaggttatatacaaatatggacaaaacaatggacaaaagggaaaaaggaacataaataaagaagaagacacgataaaaacattgcacactgactaa

SEQ ID NO: 9971 - DNA, 345 bp, Glycine max
  Peptide Sequence Number=SeqID_126749
atggcaaaagcagaacatcctcggagaaaactcgttataaagatcttccctccaggttctaaagtttcttattcttgtggtgccaacactccaaaagattcaatagtgtccaaagtgtgtgagctgaagaataagaagggttattatgctatgacaatgtgggttaacaccgaaaacccatcagaatcttgtgtcactgattcaagaatttcaagaaccgaaatggcaacacggttaacactaaaaaccagtccaaagtatgattttagtccaaatgcctatggagctttttgggccgaccaacatccccatgctgataaggatgggagtcgcttgacaatgtag

SEQ ID NO: 9972 - DNA, 1035 bp, Glycine max
  Peptide Sequence Number=SeqID_126750
atggtgtcaaaaaatccgaacccctctgaggctttaaacttggacccctccggcatgtcgctccccggaatcctccccttcgccgccgccgccgccgccgcagtttcctttgaggatcctgctaagaagactcgcaagccttacactatcaccaagtctagggagagttggaccgaacctgagcacgacaagttccttgaagctcttcaattcttcccttctgatcaccagtaccttccctaccacccaaattcagacaccgggacaattggactaatcacctttgattcgtcagagctcaagttaatatttgaccgtgactggaaaaagattgaagcatttgttggatcaaagacagttatccagatacgtagccatgctcaaaaatactttctaaaagttcagaagagtgggacaagtgaacatcttcctccacccagaccaaaaagaaaagctgttcatccatatcctcagaaagcttcaaaaaatgttccagtactgtcacaggtatcaggatcctttcaatcttcatcagctttgcttgaacctggatacatattaaagcatgactcttcagcaatgcctaaaacttctattattgacactacagtgtcttcctggtcaaacaactatctgcagaaaaccaccaacgtattgcatgggcaaaaacaaaaagtgaataattgttgcagtagcagtgaaagtccaagagcacagttggttggtgaatctaatggtcgagggaataatagccatccattgagagttcttccggattttgctgaagtatacaacttcattggcagtgtatttgatccaaatataactggacatgtacagaaactaaaaaggatggaccctatagatgttgagacggtgctattgttgatgagaaacctgtctatcaatttagcaagcccagattttgaggaccatagaaggctgctcgcatcatatgaggtggaacctgaggtcgataaatacatcaatgcagatcgaaccatgcttgatgtgcggttaaagagtgctacttag

SEQ ID NO: 9973 - DNA, 360 bp, Glycine max
  Peptide Sequence Number=SeqID_126751
atgtacaattatcatgtgaaaggaagagctcctgatcttgaaagtgtattggcagacttcatgacatatcaagctagttctaaagattatcaatgggagtcagaatggcaaccttattttcacaatgaagcagtggggttgtctaatctggatgacctgttaatgcaattcaagggtacaatagattcaatgcaacaagcatttaaaagagctgagactcagattggtaagttggtggacgacatgattaatgttgtggttagaagagaaaaagagtatgcagagattgaaacacatcaagaaatcattcttcagttaacacaatacatcatcattgatcatcaaagaagaaagagatga

SEQ ID NO: 9974 - DNA, 417 bp, Glycine max
  Peptide Sequence Number=SeqID_126752
atggacaactaccttaaaggaataattaagaggtcaatgttgtttttcaatacatttgcattagcattactcagcaacatctatattttaatgttccttgtaatcaccagtgctttgaaaggacttgaggatactccacaacctaaatccaaggctggtgctaggtggattgttgttaaaaccattggaagcagagagattgaaggcactttgcatccaatggacaactaccttaaaggaataattaagaggtcaatgttgtttttcaatacatttgcattagcattactcagcaacatctatattttaatgttccttgtaatcaccagtgctttgaaaggacttgaggatactccacaacctaaatccaaggctggtgctaggtggattgttgttaaattaacgtttaatatttaa

SEQ ID NO: 9975 - DNA, 303 bp, Glycine max
  Peptide Sequence Number=SeqID_126753
atgtcaccattgctaacggaaaacacttgggcgactacattgagggtgtcacatttagtggtatcagagcaggtcggacctttcggccatgaagtaatggctgtgagaaataagcgggagcgacttcttaccaagtccttaaacaacttggcgctagttatggccaatcagggaggtgatggaggagcagctacttaccaagcagaatggagaaaaagaagagttgagaggagacgccacttcaaggagaagatgagtcaagaagaagctcaccaccataggaagccacggataagagcttga

SEQ ID NO: 9976 - DNA, 393 bp, Glycine max
  Peptide Sequence Number=SeqID_126754
atggcgatgagcaatgtgccaaatgaattgaagtaccgtgatagccacgagtgggtgcgtaaagaagctgacggtacgtttaccgtgggcatcaccgaacacgcgcaggaactgctgggcgacatggtgtttgtcgacctgcctgacgtgggcgccagctttgccgccggtgacgactgtgcggtagccgaatccgtgaaagcggcatcggatatctatgccccgctgagcggtgaaattgtggcggtcaacgaagcgctgggcgatgccccggagctggttaacagcgaaccgtacgccgccggctggctgttccgcatcaaagccagcgacgagtccgagctcgacgcgatgcttgatgctgccgcctacaaagcgtccatcgacgagtaa

SEQ ID NO: 9977 - DNA, 315 bp, Glycine max
  Peptide Sequence Number=SeqID_126755
atgtactatgcgtcctcgtcttcagaggactacacgtcctcgccttcagagggctacacgcccttgccttcagaggactacacatcctcgccttcagaggactacacgtcctcgccttcagtgggctacacgtccttgccttcagagggctacacgtcctcgccttcagagggctacacgccctcaccttcagaggactacacgtcctcatctttagagggctgcacgccatcgccttcagaaggttgcacaccctcggctttaaagggcgacacgtcctcaacttcggagggatgcacgccccctcgcctttaa

SEQ ID NO: 9978 - DNA, 537 bp, Glycine max
  Peptide Sequence Number=SeqID_126756
atgtctataatggtttcttctgaacattcatgggaggattgtcaatctgccaatggagacattccatatgaaaacttaagctatggccaattaatttcctatgtccaaaaggtagccttaaaaatctgccaggatgacaaaattcagaggcaattagccaaagaaaaagctcaaacaaagaaggatttagaaacttcagaggaagaaactgaaactgaaacttcatcctccgtattttccgacgaaaatctaaacttaattcaacaagatgaccaattatcatcaacggatgatgatgataagcaaattaatactctaacaagagaacaagatctcttgtttgaagcaattaattccatccctgacccccaagaaaagaaggtttttctggaaaaactcaagaagaccttagaggtaaaacctagaccaaaagattttattgcaaacaacaagtttgatgtaagtaacatactcaagagattagaaaattcttcaaccaaaccaatgactatccaaggatctccaaacaggagataa

SEQ ID NO: 9979 - DNA, 303 bp, Glycine max
  Peptide Sequence Number=SeqID_126757
atgggggagacacatgaaattccacaccacaatctaactgacttcaagccttgcctcggatatgccactgaagggcaaacagttggtggtatacccttgcaaaacactttggaggggcctcaatttcgcccccaaccacaacccttctatggaaaaatggtgggttacacaccttcaagctttgcgaatttggtcttcactggcgaaaggatcaaagtgggtctggaaagagaggatgagaatgagggagaaacccttgctatgactatcattccaacacagtcaaatttcccatcagcctaa

SEQ ID NO: 9980 - DNA, 429 bp, Glycine max
  Peptide Sequence Number=SeqID_126758
atgacactttctctgaattacgcgtgggtggggaactccgaaaaacagtgccttgaggtttgcgcttatcccttcgccgtccccgggtacataggtagcggtggccccggccacctcatactgtcgaacggagacatcgaggtggacgacatggtgagtgtgatcgggcacaagctggcggagctctcgtcgaacccgctcgtgaacgcgtggtacgccgacgaggaccccaccgcgcccaccgagatcgaagatttgtacgagggcttgtacgaaatgggtggtggcggcggctatattggttccattatgaaagacgacgaagggagaacgtttaatcttaacggtaggaatggacggaagtttttggtgcagtggatttggagccctattttgaaggcctgtgctggtcccaatgctttggattga

SEQ ID NO: 9981 - DNA, 348 bp, Glycine max
  Peptide Sequence Number=SeqID_126759
atgattgaacagatgaacaagatttctccacatatgcaaaccctatcaaggaactattgcaaagacaaaatttaccatgaattggaattggttaactcagaattgaagctcggcattactctttcagctcccttgtcatcctcaacaacaacaatcctcctgttaaatcaattggtgagtgggtcatggcggaaagaatccacgcggtggagaaagaaagtggagagtgggtcacagtggagcagcgaaacagcgactacccacggcggtgcagtagcagtcttgatgatggacagcacgacgaacagcgcgctatactacccagtggtcattcacaaaaaccaatgg

SEQ ID NO: 9982 - DNA, 141 bp, Glycine max
  Peptide Sequence Number=SeqID_126760
atgttgcttgacaattgggaaaatactggtttcctagaagcaagagtcagtcaaacagtggaacatgaatcacaaagagagaaaagccactcagcacctatgatgaattcatcccttgcacccttgttgagccaaaagtaa

SEQ ID NO: 9983 - DNA, 165 bp, Glycine max
  Peptide Sequence Number=SeqID_126761
atggagaaaggtataagtcttcctatggagaaaggtttcaagatcctgttgtttcctataattgatagtctaggaaaccccttaaagttttacagactctactcccaaaagccctgcaacaagctgttcatgcatgtgcaacatgtgcacattgtcattatgtga

SEQ ID NO: 9984 - DNA, 372 bp, Glycine max
  Peptide Sequence Number=SeqID_126762
atgtatgatttgattaggcataaaacatcaaggctagaccattccattcaatgcctgggttttcaagaattcaagaaattaatgtgtccaattatcatgagtcttctaagactaaatgagggaaactggcaacacaagtctatgaccgtcatttaccacatattttatggtagctacttggtgaagaagttatcaagccatgaaaaacttcaatgggtaaaaagacttcacctttctttggacgtccatctttttggaaatatgattgtctatgactccttggacttagattgctgcacttgccctgcacctttggggaccttggagattgtgggagacctaggagttttaggggaccttggagatttttga

SEQ ID NO: 9985 - DNA, 282 bp, Glycine max
  Peptide Sequence Number=SeqID_126763
atgtacatacatccaagtattttgctaccatatccaaagtgtaaattgccaaaggatatatgtggggcaatcattctagccctttcggaaatgaatgcatgtcccaaaaaaatggaaaatatgtgcaaacccaaaatgccccatgggttgtttccttacaaaaatcacgcgctaatgccattgaggcatttcaccgaacacttggtgggtgcacgtttaggcatcaatagcaagagaacggggacaatgtggcatgtcccattgcttcaaaatgcattatag

SEQ ID NO: 9986 - DNA, 229 bp, Glycine max
  Peptide Sequence Number=SeqID_126764
atggcgacgcatcaggcaggggttattacggtttcctgtatccctactgccgccttctatttcctgccttccgtgatacgagattataacaatgactacccaaacatccggatccgcatccttgagcacagtgccagcgattgtctcgaagcggttttaaatggcgacgcagatttcggtatacctatgataaacatcacacatccgaatatcgattttgcccccgctg

SEQ ID NO: 9987 - DNA, 627 bp, Glycine max
  Peptide Sequence Number=SeqID_126765
atggtggggtggcatcgatacggagcgctcgcatctactcgccaacctggcctcgctgttggtgaaatcgacagcgggggaggaggtctacaccgggccattggagtccgcgcagacgctggaaacgctgcgggcacgtatcgaagcgcaaccctggcgctggtggcgcagcggggtggctacgcgccgatgatcggtggcctcggctatgtcgcggcttccggatactcgggttccactctcaacagctttgccgctaaagatctttgggtccagcagccggaccgggatcagaccgagcgtgccctgacggtggcgccgctggacctgcccggtggccgatcggcgggatccgacgcggtcagttcgccgcgcgtgttgtcggacttgttctggctggggcgctacggagagcgcgcggagaatctggtcaggctgctatcggtcactcgcgaacgcttccacgagtatcggtaccggcaattcatggaggccagtgaatgtgttccggtgctgttgaaggcattgggtgacatcaccggtaccgacaccgcggccgaggatctgggaacccagctgtggtctctcacggtggacaaggagcggtcaggttcactggcgcagtcg

SEQ ID NO: 9988 - DNA, 395 bp, Glycine max
  Peptide Sequence Number=SeqID_126766
atgggcgccgatttaccgatgattctgatactttccggcgtcatcggcgggctgatcgccttcggtatgattggactgtttatcggtccggtcgtgctggcggtctcttaccggctggtttcggtgtggatgcatgaagcgccggcaccagatgacgatccggaaacggccatcgaagcactggccgaacacgaagagccgcagcccgataaacagagcggcccggcggcgaacgccgtcagcgctgggtttatggcaatcttatgttttgaaaagtgggatgggataagggacaggtgcccgacggttgccgggcaccaggcaggtgtaacagattacgctttggccgcgtccagctcagccaggctcagccaggtttccaccacggtatccgg

SEQ ID NO: 9989 - DNA, 480 bp, Glycine max
  Peptide Sequence Number=SeqID_126767
atggggaatcagcagaggcaagggtatactcaaggaagattttcaggcttccagcaaggtccttataatcagcaaggacagtgggggacacaccctgacaaccagttcaataaagaccaaggtggatcctcaaacaccctgacacaccctaacatatttcagaggaggactaagttggaagagaccttgactcagtttatgcaggtgggacaactggccaagcagatagctgacaagtcatccaacagttttggagcaaatacggaaaataatcctaagaaggaatgcaaggctgtgatgactaggagtaaaaagtttgtgaaagctgaggatgaagagagtgtggtgtataaggagcaaatgggtgaaaagataggtgctgatgttgaggaaaatgatgtgaagggtaaagagaatcaggaaaaaggaaaaaaaataatggttcagaataaaaagataaaaagggagaaaaagaaatag

SEQ ID NO: 9990 - DNA, 420 bp, Glycine max
  Peptide Sequence Number=SeqID_126768
atgcataacgcattgcgattaaattctcctttaccatatccacatttattcactcttttcctccaacatttcaacatccctcttgattctgaaccttatgttccaatcaagaaatctttcttgatcggtgctgctatggttgcatcctttggttaccgcaaagagcgtgatggctcttgggtaaagaaggatactcaaccaaatgatgatgaaggacaattaccagttgaaggggactcttctctccttcaaagtattttggacaggttcgatgaactccaaacatatgttggtgaaaggtttgatgctttggaacaacaagtggacatgcgattcgatgcaatggactcaaggatcacaaaggttgaagaagatgtcaccatcattggcgactgccttgatttacctccaccaccataa

SEQ ID NO: 9991 - DNA, 463 bp, Glycine max
  Peptide Sequence Number=SeqID_126769
atgaaggaattatatgccaacctttatgaccctgaggacaaatcgccaaagcaagtttgggttcgagggcacctaattaagtttgatgctgactccctcaacaccttcttgcataccctagtgatcttggagcaagtggagagcttgcccgcttactccagattttgtcggttgaggctagatcctcaagagttgatagcccggttatgtatccctgggaggggatttgagcttaatgctgatggcttgcctctgaagatcttgaggaagaatcttaccactatggcccagacctggagtgttttatctttctctaacctagccttgacatcccatacttctgatattactctagatagggctaggttgatctacgagcttatcatgaagatggatatgaacttaggatccctaatctcaggtcagatttctcttattgcccagcatgactcctcaaggctag

SEQ ID NO: 9992 - DNA, 441 bp, Glycine max
  Peptide Sequence Number=SeqID_126770
atggaaggtaactgtagtgttgttattcaacgtattcttccacccaagcacaaagatcctagagttgtcacgataccgtgttctattggtgaggtcgctgtaggcaaagctctcatagacttgggagccagtattaatttaatgtctctctccatgtgccggcgacttggagagctggagataatgcccacacacatgaccctccaattagctgatcgctccatcacaaggccatacggagtgattaaagatgttttggtgaaggttaagcaccttatatttctagctgattttgttgtcgtatatataaaagaggatgttgacattcctctcattcttggtcgcccattcatgtctaccaataaagatctgcctgaccagaatgtctgtttgaaggtgcatgtgatggaggaaaggagacctgaaagaaaaggtccttga

SEQ ID NO: 9993 - DNA, 483 bp, Glycine max
  Peptide Sequence Number=SeqID_126771
atggtgggagcaggtttgaaaaaggatcttagagtgtctagggttgtgccaggaggttatttcacaaagacttgccatggtaaagaagaagggggaacaagcacacttggagagcgcagtacaacggatagttgtgcgatgatttacttcacgggcgaggtctctgctcagttggtagagctccgctcttgcaattgggtcgttgcgattacgggttggatgtctaattgtccaggcggtaatgatagtatcttacgggctgtcaagaacgtagaggagggtttcctcatttgggatcctggggaagaggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccaggggtcgcggaccgaccatag

SEQ ID NO: 9994 - DNA, 384 bp, Glycine max
  Peptide Sequence Number=SeqID_126772
atgggttcatgtggacctgagaaaatcaaagccatccaagagtggcccaccccaaaaagtgtaggagatattaggagcttccatgtgttggaaagtttctatagaaaggtcttggagaggataaaaaataatgcttataagctagacctcccagaggagcatggagttagcaatacctttaacattactgatttggcatttaggaagcatcctcaggccatttttggcatgggtatattttctaaaaggctcctaatgctacctatcctcaaatatgcatatgttgaaaggcattttttgctactcattcacactttgcaaggcatgaatagcaagagagtgggggcaatgtggcatgccccattgcttcaggatgcaacatag

SEQ ID NO: 9995 - DNA, 381 bp, Glycine max
  Peptide Sequence Number=SeqID_126773
atgacaaagttatgcctagtacccgatgtcgtcatctctccgaagttcaaggtgccagactttgataagtacaaggggactacttgccccaagaatcacccgaagttcctcaacctccctttttttaaggatacaactcgaacgcaacatgtgcttatcatggaggagttccagggcattccattgagcattaagtatgtacatggggagagaaatacgcagggtctcattctgatcgttttgatatatatattgcctactttcgaaaacgagccccgacgagtgcagagaaacgcgaggaactggaaccagagaggtggcacgcaaaccgaggaaggatttcagcatccaaaaggtcaaacttttcctccttgtggctga

SEQ ID NO: 9996 - DNA, 447 bp, Glycine max
  Peptide Sequence Number=SeqID_126774
ctggttccctccgaagtttccctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtctcagcggctggaagagcaccgcac

SEQ ID NO: 9997 - DNA, 201 bp, Glycine max
  Peptide Sequence Number=SeqID_126775
atgtgggatactctccaacttacacatgaaggcaccactgatgtgaaaagatctagagtcaacacctttacacatgaatatgaattatttaggatgaacactaatgagaacatccaaaggaatggcagcccaaggaacatgaaatggaacttcaacgtctcaactaaaatgaagagactgacaagagaaaatgaagcatag

SEQ ID NO: 9998 - DNA, 724 bp, Glycine max
  Peptide Sequence Number=SeqID_126776
ccgaacagcttcggtgcgcgggtcacgcgctcgcgcatttcctgcacgaggcgctcgacatcaagggtacggatgcgcaggttggcgatgcccacctggccgatcttcagttcaccggcctgttcgtaatcgaaattcaccgccacgctcaggtccccgtcggccgctgtgcctgcgccggcagctgccgggcgcgtgtccatgccacatccggcagcttgtcgccgtaggtctcctggacccacgggtagctgcacagttccttggccagcatgctggcgcgcacatcgacctgcggcatggtgttctggcccagctcgcggaagccgaagctgccgtggaagagcagggcggcatcggcgccatggtcgaggaagacttcgcaggtcatctgcgggtagcgcagctcggcgaagctctgcgcgtctgcatagaacgcacggccgacgccaccgccacgacggcggctggcgaccacgatgcggtcgatatagaagaacggggtgtccagctgctgcttgaaccaggcgaaattgctgctgtcgtgctggctgtcgctgccgaagccgatcaggaagccggccaggttgccgtcgcgctcggcgacgcggaaatactcagcggtttcatagaacaggcgcaggcgggccgcatccaggggaaggatggccaggccagcgttgttgttcaaagccaggacggaatcgagctcgtgctcgcgcac

SEQ ID NO: 9999 - DNA, 294 bp, Glycine max
  Peptide Sequence Number=SeqID_126777
atgtataaagctaagtggacccaaccttggcccatgggcttagaaatctaccttgaggttcatgagaaccctagggtcttcttaagcagctctagctcaatcctcttggagcctcttgctcatggctcctgtgactggtctcttcctaggaaggattgcatcagcaacttaacatgttcttattatgggggagtttcagggcattccattgagcattgtatgaccctgaaacataaggtgcaaagtctaatcaatgcaggctggctaatattcgaggaggacaattgcttgtga

SEQ ID NO: 10000 - DNA, 572 bp, Glycine max
  Peptide Sequence Number=SeqID_126778
gcgctggtggacagcggctcaccgcaggcatcggtggtgatgcgccacctggtggcctacctccgcggcagcgtgccgcgcctgcagcagcccctggtacggatggaagacgagatcgcgctggtgggtgcctatctggaactgatgcacatgcgcatgccggatcgcctgcgtttccggctggatgttgcagacgaaacgcgtgcgctgggctgcccgggcctgtccgtgctgaccctggtggagaatgcgatccgccatggcatcgatccctgcgaagacggcggcgaagtggtggtgcaggcgctgcgccagcgtctgcagctgctgtatggcgatgcggcctcgctccagctgcaggcgggaccgcaacgcggtgccgtcgcgctgctgcggttaccggcccgggagtgtggtgcatgatcgccaccgcgctgattgccgatgacgagccgctgctgcggcaggcactggcggcgcagctggcgcaggcgtggccgcagctgcaggtggtggcgcaggcacgcaatgggcgcgaggccctgcaggcgttcgagaccctgcagccgcag

SEQ ID NO: 10001 - DNA, 543 bp, Glycine max
  Peptide Sequence Number=SeqID_126779
atgggtgaaatagaggagttgcaagagcggataaaggccgacatggaggccatgaaagagcaaatggccacaatgatggaggccatgatgagcatgaagaagataatggaggtcaatgcggctgcagttgtcgctactagcaccgttgctaaggtggacctggtcagggaggcaaagagttgggaagtatgggcggcccccatttttgtgcaagttcagaacaagcatgccttcttgccatatggcttgcctcccaagtatacaccacccaatgttgcgcacactcctgatgaaaatgtcaataactccactcctatactcattgagagccaacaacctcaatctgatcatgcatatgaagtaccccaccacaatctagccgacttcgagccttacctcgaatatgccactgaagggcaagtagttggtggtgtacccctgccaaacactttgaagggccctttaatttcccccacaaccataacccttgcattttgcagtggggagagtccctcttgctatggtggaaaagggaaaatttga

SEQ ID NO: 10002 - DNA, 402 bp, Glycine max
  Peptide Sequence Number=SeqID_126780
atgaccgtgcctctcaatgagtcaatctcttgctttctcataagggtgaacccttgggtactagtatctattgcctttagagggctacactccctcgccttcagagggttgcacacccctgccttcagagggctggatgccctcgactttagaggacaacacatcctcgactttagagggctatacgccctcgccttcagagggctacaggttctcaccttcagagggctacatgtcctcgccttcagaggactacacgtcctcgtctttagagggctacacgccctcgcctttagaggactacacgtccttaccttcagaggactacacgtcctcaccttcagagggctacacgcccttgcctttaaaggactacacgtcctccccttcaaaggactacat

SEQ ID NO: 10003 - DNA, 267 bp, Glycine max
  Peptide Sequence Number=SeqID_126781
atgattacgggcctctttcagttctatggagtgcctgtgccccccagcaaagtcatcaagcccctactaatcgagttttcatcaagaagtactgtgcccctaggcaggcgcaaggcgagacaccacaacagcctggagatggacgacaacgggcaacaaacacaccaccaccacctccaaagcccctcagctcatccacaaaaagttagatcgttgcctacgacacatggtcgaccaataggcaaccaagtccaaagccaaaggtaa

SEQ ID NO: 10004 - DNA, 444 bp, Glycine max
  Peptide Sequence Number=SeqID_126782
atggaactcgatcttagatgggaggcgttaaatggcaatttctacaacgtgctcttgggcaccacgttcaggctcgagccgttgtcgatgagtactttggccataacatgttccatgcatttgactgacacatgtaaagccctgttatgtcctctcccctcggcagggatttcctcttcagcgaagaggaactcgccggcctcctcgagtgatacctctttcttgccgcagccctctcttccctcggcaaaatccttcatcggaacatcctcgccgggctgtatcagcagactagggggtgcgaacatgcgaacgctacgggttatgccgctcagcccagtgatattggtcactttggccgatagtgaactaatattggtaacttcttccttcctaccgcccggaggggcatacctctacggaactgcgcggctgtcatggtaa

SEQ ID NO: 10005 - DNA, 530 bp, Glycine max
  Peptide Sequence Number=SeqID_126783
aacaatagcttccattctagaggaagaagctcatttttctgattctacatcatctgactcaccatcatcaagggaatccgcgacatatttaccagaagttgttatcatggctgatgaacaccagcaaagggttacccttgaggactactcaagcagagaagccaagaggtggctctattcatttaagggtaccagtctgaagacctggaaagaagttgttgagcaatttctgaagaaatacttccccgagtcaaagactacagaagggaaagctgcaatttcatcatttcatcagttccttgatgattccctaagtgaagcattggagaggtttagagggggaaaaataaaactgaaaacccctgaagaagcaacggatttgattgaaaacatgtctgccaatgatcacgccactcaacgttgtaccatatgtggtggtactcatgaattcggcctttgcattccttttgaagagcaaacgcaagaggttagctacatggggaatcaacaaaggcagggatacaatcaag

SEQ ID NO: 10006 - DNA, 333 bp, Glycine max
  Peptide Sequence Number=SeqID_126784
atggcggcgcagctaatccatgatcgagtggagatggagtgcctagagggagcttgggagaccctcgaaggcaacacgaggtgccgatttcggggcacgattcggtttacggctacttcattggtgcatccagatgaacccgtgcacacgcttcagcgtattgtggagtggatactacccacgcctacaccataccatctagtggagccagtccaagtgattgaggtaacgtcatccgaggaagaccctgaggaggatctcgaggagctgcctcctgagcctgctgtggatgctcttgactttctagagggtgatgaggacccactccctgag

SEQ ID NO: 10007 - DNA, 408 bp, Glycine max
  Peptide Sequence Number=SeqID_126785
atgcagtcccagttgcaatcacagatccaatcacaaggacttgcactacctccggagcctgaggttggtacctcagctgctcatgtcagcacaaaggggagttgtgttgatccctcaccaaccagtccagacacgggtgactcaaacaaatgtgggttgtacatcgaagaaaatccttcccgcctggttaccctaggaagagtttatgagggatccacaacggttcacaacatccctttgttgcatggccaagtgaaggttggtgttgaggaggttaaagatgcagaggctcacattcctgtacccactaacgaggttattttagtggggcagacacttaacaccttccttgcttggcagacacttatcacaacaggcaactgtgtctccagcaaaacctccagatag

SEQ ID NO: 10008 - DNA, 900 bp, Glycine max
  Peptide Sequence Number=SeqID_126786
tctttcgcccctatacccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggtttactcgcccgttgactcgcacacatgtcagactcctttggtccgtgtttcaagacgggccgaatgggggagcccacaggccgacgccagggagcgcgcaggtgccgaggcacgccaagggcgcgcgcatgccatccacaatcgcgatggatgacgtctcccacgagcatatcaacagcccgggcttggggccacccatcgcaatccgcgttcgggtcaatgtccccgagtcgatcggggggaccggctctcaccggttccacatcccgaccgggacacatcgccggcccccatccgcttcccctcccgacaatttcaagcactctttgactctcttttcaaagtccttttcatctttccctcgcggtacttgttcgctatcggtctctcgccagtatttagcccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttgttagtttcttttcctccgcttattga

SEQ ID NO: 10009 - DNA, 1481 bp, Glycine max
  Peptide Sequence Number=SeqID_126787
atgtcttcattcttgtctaaatctaccattggcatgggtggtagtgattctgggggctcgattgagctacccatgatggaccaagaagtcatatctattggcgattggaggatacttgtcggggtgcctgggacaacgagtcatcctcttcggagaggtaaaggtagtggcagtggagatgtcagggagtctccctacgtgcgacgtagccatagccctaggtcgtcgttgtccacacctgccgtcgttggttatgagtgggtgaagctggcaagccttgaggactcctgcatgttagccgttcaggcttgcgggagagataacttccctttcttgagggcggcgtcgggtagttcgcccttcttctatatgtataggtgtctgtttgaggtcttgggtcttattctccccttgactgctttccaatgtgctttgcttgaggactcgaatgtggctccttctcagctccacccaaacagttgggcaatgctaactgaaaagattggttgggtctccttgaacaacatgtccaagaagctatttgagggccctgaggatgactctgttagctgcatgtgcctaaccgttggtctgaggatgttcgacagagtcttcataagtctaagctttgaattgagtgttgttgtccatgacaatggcgtatgggaggctgtacctacaaataaggtgtttctaggtgaatttctccacttcgctggtcgtagtttccggcagtggccttgcttctatccactggggatagggggagctcagactgtggagattgttaagaggggtgcatggaacttctgcaatctcttggcatcgtctgcacctcttggtgaagtcgagggcatctgccctgagtgttggcttgtagtagctggctcccaccactttggtggcaagggagcatcctctagtgtggagatcgcaaatcccttcacgaagttatctcataacatagtctgcctgttgggggtcatccagtctggttcctcctcttctctagccataacttcctcagcatttatggttggagcttggattgtctcctggatgatagtcttgaggtgcccaaccttcttggtgctggccaactttgagagcaggctttctcaaaacctgtttgatgggctagttcattttgactaccacttgataactctagaagtagggcctgagtcatcaggcaaagggggttggtgcttccctttatcttgtataagggctgagctaacggctttgtcagctactaagagatacaggagtaggggtactcctggcttgggtcgacttaaaattggcggtgtggctatggatgctagtgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaag

SEQ ID NO: 10010 - DNA, 828 bp, Glycine max
  Peptide Sequence Number=SeqID_126788
atggccccaaggaagcttgcctcaaagagatccaggaaggataaagcggctgaaggaaccagttccgctcccgaatatgacagccaccgttttaggagcgctgagcaccagcagcgcttcgaggccatcaagggatggtcatttcttcgggagcgacgcgtccagctcagggacgacgagtataccgacttccaggaggagatagttcgccggcggtgggcatcgctggttacccctatggccaagttcgacccagacatagtcctcgagttttatgccaatgcttggcctacagtggagggtgtacgagatatgcgatcctggggccaggagtgcgagtatggccagaggaggaaccgggccgatgggtttgatgaggaggccatcgcccagttgctatgtataccggggcaggattttgcccagactgctgctggaagacggggtatggcacctaccaggcaccctctggacccggataagtccaacagggccctgggatttcccgctttgatcacagggactctgccagtcgccgcagacgcgccgccacctcatcaggctggcccagccgaatcatttgatacagagcagtatttgcggcatttggttcgccagcaggcggccaaccactgggctcatgtacaaactcatgattatcttttaccagatgagcctcagcctgcagagccaggggcagaggtcgcatggcctgaggcccgggcaggagaggcgccagcagaggctcccgacgaggcagatgaggccctcgaggacgaggagatgaccgatttacttgatttcttaggagggagtggggccacctga

SEQ ID NO: 10011 - DNA, 285 bp, Glycine max
  Peptide Sequence Number=SeqID_126789
atgcctgagtgtttgctgatacctatgagtttcctaccaaaatcatttggccttggtttagtagaattttctccaaatttcccacgtctagctattctcaaattctttaacatgctgaaattcgttgtgaaccatatgattaatgatatatgccaattgtttaggcagctgagacatgagatcgtctatcacgatgttgatatgctatttttcaaaggaggtcgtcatggcaacattttgtctattagtggttcatttgccatgacaaaagaaattgccaagtaa

SEQ ID NO: 10012 - DNA, 426 bp, Glycine max
  Peptide Sequence Number=SeqID_126790
atgggactgcaccgcaaagttgaaaaatccttgaccaaactcaccgaagtggtcatcaccaaccacaaaaacactaaagtcgcgatcaaaagcatggagactaaaatagggaaattggctaaacaattgcaaacctcttcaattggcttatccacagccatcgaggagaacccaaaggaagaagaaaatgaggtagaagaaagcaccacgctagaggaagacatcaaagaacaagccaacccttcaacccaaggtatgcaatcctcacttaatcctctgttgtttgattttagcaagctaagcatccataagcaaggagaagatgaaaggatggccaaattcgagaaacacatggagatgctacaagggaagaaggtggaaccacctgttgaaaaactcatatgggacgtgatacgtcaagtatga

SEQ ID NO: 10013 - DNA, 951 bp, Glycine max
  Peptide Sequence Number=SeqID_126791
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccacatgatgtacttgggatcgtccgccggggcgaagcacatgaaggacaccaccacgtcgcccttggggttgtcgttggtcttggtgccagtcttatcggcggtgccggtcttgccgccgatgcggtagcccgccacccggccatttttgccgctgccggaggagaccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 10014 - DNA, 825 bp, Glycine max
  Peptide Sequence Number=SeqID_126792
atggcctccaggaagcgtaagagcattggggcaaggccaactgctcagtatgacactagacgcttccattcgcttgatgcttggaaccgttatacaaataacgtcttacgaatgagcattttgctagagaggaaggtagagatatatcacatagagtttgatgacttcaagacagagttagagaggcgtaatcttcacaaacgcctcaccaacttggttgatgggactattgatgttgctttggcgaaagaattttatgctaatctctacagctctaaggatccttcaccaaagcaagccagagttagaggccacttggtgaagatagacgctgacagcctcaacacatttctagagactcctgtagtcctagaagagggggagacattacccacctgctctaggtactataggttaccatcagaccacagagagattgaggctgctctttgcatacaagggagggggttcattttaaatgctgagggccatccggggaggattctcaggaaggatctgactaccttggcccaggtgtggagtgttatctcttactctaacctggcccctacatctcatacatcagaccttactgtggacagagccaacttgatctttggcctggtctctcatatggacatgaacatcgacgctctcatctcaggacagatgacttccattacccagtctaactcttgcagacttgggtttcctgctttgattatcgccttatgccgagctcgaggggttgtctctgacagcctcacatttgagcgcctaagtccggccattaacttggcctacatcaggaagaactgttggaat

SEQ ID NO: 10015 - DNA, 544 bp, Glycine max
  Peptide Sequence Number=SeqID_126793
atggatgaatttatggctgaattggagaggcgtaacttccataagcgcctcaccagtttagctgacaatagcactgacctagcattggtgatggagttctatgccaacctttacagtcctgaggggccttcaccaaaacaagtcagaatacggggccacttgataaggattgatgcagacaacctcaatgtcttttcagaaacacctgtggtgcttgctgagggtgaatctttacccgcttactcaagatactgcaggatgcctactgacattaaggaaattgaggttgctttgtgcatactcggccgagggtttattttaaatgctgaaggtcaccctgggaagatcctcagaaaatatctaaccactcttgctcaggtctggagtgttctcgcatactccaacctggctctgacttcccacacctcggatttgactgtggatagagctaggttaatttttggcctagttactgagcagatcacatcaatggcccagtctaactcctctaaactcgggttccctgctcttatcacaactttat

SEQ ID NO: 10016 - DNA, 291 bp, Glycine max
  Peptide Sequence Number=SeqID_126794
atggctagcggcacagcgtgccccgcaggtggagcggagtggccagaatggctagcggcacaacgtgccccgcagagactcacacttgagggggagatgtgttgggttacaagtgtgaggttaagttccatatcgggtagaagtggaaaggttgagtaccatataagtgaggagaagacccataaacttaagccttcaggttttgggttagagtgtggtgtcagacttccttatgtagtggctcgtggtccacaggtgtatcccttgaatctccccaacaattggtattag

SEQ ID NO: 10017 - DNA, 339 bp, Glycine max
  Peptide Sequence Number=SeqID_126795
atgcaaggtagagcagtagttgaaataccttttaaggaagaattaactagaaggggcaacgtattacacggaggaataataatgactgcgattgacttcactggaggtcttgcagcgtttactgttaatgatggtgtagatcaagttacacaagaacttaaggttaactttctggagcctatgtataaggggccgtttagagttgagggtaaggttcttaggaaaggcagtacagtaatagttgttgagatagagtttagagatgctgaaggcaatttaggggctaaggcattaggctcatggtatattttaagaaagaaagtccaaggtgctttgtga

SEQ ID NO: 10018 - DNA, 1155 bp, Glycine max
  Peptide Sequence Number=SeqID_126796
gttacaattaggcttaaaaatcacttcaaaattatctactaccctacaagcccagtcctagtttgggataaggaagtagtaaaaaagaaggcaaaggagttggaaagccaaggcataagaattgctgaggagttttataagatattggaagagagggagaagattagtaaaattaagaggtttttattcgctgataaggtagctaaggagttcactaaagattataaggttgacgctgatattttgtatcaaccagaccatacatcgcttgacattttctacttggctaggaatacaaagtacggtataactttccatgaacccccattttataacgactctttaagatacttgagaaggttaatgaaattttatggtgttaatccgtatactggcaaaggttttcacactaggttcttatataacgagtatgtgaaatttctgtataagagattactaaaaaaagaggtaagtaataagccaacttttctggctggtgttagcgaagcccctttgattgagtcaggcttggaaggggaaattataaaacctggtaacgcttttgacccatttctcatgaagtatagaaacaaaggaaaggaggattacgttatattctggagtcggttgaaccaagataagggatttcacgaattgccagacattttacgcataatggaaaagaagagtggtaataggataaggttagttgtaatgggtaagtttttcgataagtatagcgagaggaggttttggtctaaggttagaaaatacgatttgaaggttgagtataagggttttgtgaagagagaggagttagctgaaattgtgtcaagggctaaggttcttatttacccttctcatgttgatggtttttccctagtagtcttagagtccttagctctaggtactccagttgttgcgtatggtattcccgcaattaaaagcgtttatgggggtttagaaagcgttagtatagttaaggagttcgataagggaagcatggcgcaaaatgctttaagattctataaaatgaatgcgagtaaaattgaagaaataatgaatggaaataagttaatggagtttttaaagttacattccagttgggataacgtagctgaggctgggttaaagctcataacaaactacatttaa

SEQ ID NO: 10019 - DNA, 573 bp, Glycine max
  Peptide Sequence Number=SeqID_126797
atggttcggccaagagaaaaaacaggtactggtcaagttcacgtctcaccgtggacccaggataagctcccattttatgtagcagctcaactcactggagccatttctgcttcatacacattgcgagagctgttacggccatcagatgagattgggggaacttcacctgctggatcacacattcaagccctaatcatggaaatggtgagcacatacaccatggtgttcatttccatggccgtggccaccgactcaaacgcgacaggacagctatcaggagttgcagtaggttcttctgtttgcatagcaagcattgtagccggaccaatatcagggggatcaatgaacccagcaaggacattaggtcctgcaattgcaacatcatactacaagggactttgggtatattttgttggaccgattactggggcagttttagcagcatggtcttacaatgtgattagggacactgaacaccctggttttcccatttcactatcctccatttcatccaaggtgcgccaaagcattggtggaaccgaacaaaaaagcgaccaaagatgcttggtgtga

SEQ ID NO: 10020 - DNA, 367 bp, Glycine max
  Peptide Sequence Number=SeqID_126798
atgccacctaccaggcaccctctagacccagataagtctaacagggccctgggttttccagcattgatcacgggtctctgccagtcactcgggggtgatgcaccgcaggtcgcagaggcaccgccaccacctcatcaggctgatccagctgggtcatttggcatggagcggtatttacagcacttgggtttaactccttttgcatgccctactccagatcagttcagggctgaggttgcatggcccggagattggcatgaggcccaggcaggggtggcgcccgcagaggctcccgacgatgcagaggaggcccgcatggatgaggagatgacagatttactcggtttcttgggatggagtggaccac

SEQ ID NO: 10021 - DNA, 375 bp, Glycine max
  Peptide Sequence Number=SeqID_126799
atgaccccagatttcaaccaaccacgagggggggtgctcgcgggaggtcagcatacaccccgcgcagcaacattgttacatgtttgcgttggggaaacgatgtgtgacacccaggggggcgtgcccctcggcctaatgtcttcgggcgcaacttgcgttcaaagactcgatggtcacgggattctgcaatcacaccaagtatcgcatttcgctacgttcttcatcgatgcaagagccgagatatccgttgccgagagtcattgtatatttgagttccttggcgcacgaagcgccggggtttgtgtttgtcgcgaggacgaggaggccgggcgcacggggcgccgtggtcatcccctccctcccgacggtagatga

SEQ ID NO: 10022 - DNA, 379 bp, Glycine max
  Peptide Sequence Number=SeqID_126800
cggctggaagagcaccgcacgtcgcgtggtgtccggtgcgcccccggcggcccttgaaaatccggaggaccgagtgcctcccacgcccggtcgtactcataaccgcatcaggtctccaagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 10023 - DNA, 841 bp, Glycine max
  Peptide Sequence Number=SeqID_126801
tcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaa

SEQ ID NO: 10024 - DNA, 195 bp, Glycine max
  Peptide Sequence Number=SeqID_126802
atggagaaaggtacaagtcttcctatggagaaaggtacaagtcttcctatggagaaagacgggggctacttagtaccaggttgccttcctattctcagcctcatcaactacatgtgttcatctaacaaacatctcaatgtgaccaatacgcgtttcctctgcagcctacacctgtcaccattgccaatgaattaa

SEQ ID NO: 10025 - DNA, 516 bp, Glycine max
  Peptide Sequence Number=SeqID_126803
atgggtcgtcgtcccttgcctagctctggacaaatgaaaagcgccgctgcaaggcaacctaagggcgccaactgtgcgaatacaactagagagggaggctatcacgcagctactatgcatactggggcaagatttcacccgtgccgctgcaaaaagacaagtgcggatcgtgcgcaccaacatgaccactcttacacagatatgggtcatgcccacaagacacccagtggactcggagaagtccaacagggccctggggtttccagttctagttacgggcctttatcagtcctacagggttctcggatcgcgcccgcaggacaccccgtggacccaaagaagtccaacagggtcctggggcttccggctctgattacgggcctttgtcagttctacggagtgcccgtcacccccagcaaggtcatcaggcctcctactaaccgagctttcatcaagaagtattgcgcccccaggcaggcagagggtgagacaccacaacagcctggggatggctag

SEQ ID NO: 10026 - DNA, 2856 bp, Glycine max
  Peptide Sequence Number=SeqID_126804
atgcagattgtggtaggggggaggaacaagtatttgatcaatgggaagcttgcgcagcctagtcaagttcagaacctttttcattcagtgcagctaaatgttaataatccacatttccttattatgcaaggacgcatcactaaggtattaaatatgaaaccaccagagatattgtctatgcttgaggaagctgcagggacgagaatgtatgagacaaagaaagaggctgctcttaaaacacttgagaagaagcagagtaaggttgatgagattaacaagcttcttgaccaggagatactgcctgctctggagaagttaaggaaagaaaagacacagtacatgcaatgggctaatggcaatgcagagttagataggttgagaagattttgtattgcttatgagtatgttcaagcggagaggattaaagacaatgctgcttctgaggtggaagaagtgaaagccaagatagctgagattgatgacattgctaagacaaatcagggggaaattaaggaaatggagaccaaaatagctcagttgactgctgaaaaggaagcaagcatgggtggagaaatgaaatctctgtcagagaaggtagatgcactttcccagaatcttgtgagggaaacgtctgtactaaataataaagaagacactttgaggagtgaagaagccaacaaagcaaatcttgttaaaaatattgaagaattgaagcattctgtagaagagaagtcctctgctgttaaaaaggctgaagagggggcagcagatctgaaaaataaagttgatgagctcacaaagagtctagaggagcatgataaagaataccagggtgttttagctggcaagagcagtggtaatgaggagaaatgcttagaggatcaactaagggatgcaaaggtagcagttgggagtactgaaacagaattgaaacagctgaaagccaaaattagccattgtgaaaaggaactgaaggagaaaacaaatcaattaaggtcaaaacgtgaagaagctaatgctgttgaaaatgagctcaacactagacaaaaagatgttgagaacgttagaatggagttggagtctctttcttataaagagggtgagatggaagatttacaaaaggagcgtatgactgagatggactgtatgcaaaagttgaaggatgaaatacgcaatctttcagcaaacctggcaaatgttgaatttacataccgtgatccttctaagaattttgataggtcaaaggtgaaaggtgttgttgcaaaactcatcaaagtaaaggataggtccacaatgactgccctagaggttacagctgctggaaagttgtataatgttgttgttgacacagaaaatactggaaagcaactactacagaatggcaatcttagaagaagagtgacaattatacctctgaacaagatacaatcctataatgtttcctccagagttcaacaagctgctgttagattggtgggcaaggggaatgctgaaatagctctttctttggttggttatgaagaagaattgcagagtgcaatggaatatgtatttggttcaacctttgtctgcaaaactattgatgctgcaaaggaggtggcatttaatcgggagattcacaccacaagtgtcactcttgaaggagatatatttcagccaagtggtcttctgactggtggaagccgcaagggaggtggtgatcttttggggcaacttcatgctttgtctgaggctgagtcaaaactttcagtgcatcaaagaagattgtcagagattgaggcaaagatctcaaagctcttcccacttcagaaaaaatttatagatctcaaagcacaattagaactgaagttgtacgacctttcattgtttcagagcagagctgagcaaaatgagcatcataagctcggagaattagtgaagaagattgagcaagagcttaatgaagcaaagtctacagtcaaggacaagcaacttctatatgaggactgtgttaaaactgtttcatctcttgagaaatcaatcaaagaacatgacaataacagagagagtaggctaaaaggcttggagaaaaagataaagacaatcaaatctcaaatgcagtcatcattaaaagatctgaagggacatgatagtgaaaaggagagatttgttatggaaatggaagctattatccaggagcaagcatctttggagaaccagttagcatcattgggaacactgatcagtaatcttgcctctgaaatctctttctgtagagcaagattgtgttctcaaccctttgaggtacaggttgctgctgcacgggataatcttgatcaagttcagtcacagctgaaatcagttcgcctaaaaatgaaggaatgtgataaggaaatcagtgctattattaaagaccagcaaaagcttgaacataaaattagtgagagtaatcttgaaaggaagaggatggaaaatgaggtaaaacggatggagttggaacagaaagattgctctgtgagagtagataaattaatagagaagcatgcatggattgcttctgaaaaacagttgtttggtagaagtggaactgattatgatttttcttcccgtgatcctactaaagctagagaagaacttgagaagcttcaggctgaacaatctgggcttgaaaaaagggtaaacaagaaagtgatggcaatgtttgagaaggcagaagatgagtacaatgatttgatgtccaaaaaatacataattgagaatgacaagtctaaaatcaagaaggtgattgaagagctagatgagaagaagaaggagacacttaatgttacctggatcaaagtgaataaagcctttgtgatcaaacagtcaagaggttga

SEQ ID NO: 10027 - DNA, 1335 bp, Glycine max
  Peptide Sequence Number=SeqID_126805
atgagttatgctgatcaagaaaatggttcactgagtgctctttatgaggtttcattgagaggtaatgtatctgagttagacactctaatagggagagaccctcttatcctacacaagctttcattaacaaccttcactgaaactcccttacacatatcagctttacttggccaccttgatttcacaaagtctcttctcagacacaaacctcaacttgcccttgagttggaccattccaaacgcacccctcttcatctagcttcagcacaaggccatgtagagattgtccatgtgttgttgcaaacatatcatgaacatgcttgtttgatgagtgatcaagatggaagaattcctattcactatgcagctatgagaggacgaacagaaatagcaagacaactgattatggcaaagcctgagtcattgatggtgcttgatggatcaggaaaaactgtgttgcacctatgtgttgagcacaatcacttggagaccttgaaaacattggtgcaagtgcgagatcttagtggtaatgattttctaaacaaaacagacttgcatcatgggaataccattttgcactttgctgttaccttgaagcaagttgagactataaggtacttgctttcgatacccaaaataagagaagaagcaagcattgagaataagatgggttgtactgctttggacatgttagtggatgctgtcataatgaacaatggaatgaaccaaacacattcactaccatcacttaatccaaatgaaaagtattggacaaagaatttcaaactgggtaaaaggttcttacaacatcagggtgaaaggctggaagaaatgagagggatgcttagtgtggtagctacaatgatctcagccatgacctttaatgctgtaatgaaccctccaggtggtgttatacaagcaaatggttcagacttacgtagttggaaaaacatgttaagtaataatgtgaaggatgctatggaattacatcctgggagagcagtattcttaactactcaagaatctgactttgaaagttttgtaatgttcaactccatctctctggctgcatcacttagtattactctcttacttgtgagtggagtccccttaaagaatgaagtcaccatggggatcttatcaataggcacgtgtgtcactctcacatttcttatgctttcctattttttcggagggttcatgttgggtttcaagtcagctaatcacgtatttcatttttggatttatctttggcttggacttcttgggctaattgttgtcttcagcatgatccgcgtaatttcttggctagtaaaagttatcaaacatggataa

SEQ ID NO: 10028 - DNA, 318 bp, Glycine max
  Peptide Sequence Number=SeqID_126806
atgttatacttgggaaggaaggtcctcaacctagtgttggaggttctcaaggtggctaacgccgaatgggcctataaaatagataggtgggaaaatccctataaagcttacccttatgttgttgcacgtgtggttcgtacttgtgatgatcctatatctgatgttcaagagaagcaaatggctaggaggtggcttcgtgtcttccagagacttcatggatatgggtacttggacaagaagacatgttatctcttttgtttccttttagcgtcatatatagtgttgactggctcaaagtctaggtgtttatctttataa

SEQ ID NO: 10029 - DNA, 768 bp, Glycine max
  Peptide Sequence Number=SeqID_126807
atggtgaaatctagtcaaattttgttgacaatcaaagatcaagaccagagaaatgtcaccactattgagaaaatatacaatgaacaaaaaaatatcgatgtgaacaaaagggtccaagaatgtagggtggacactcaagatgttgtcaaagatataatgtggtcacatccaaattccatcaagctattaaattcattcccaatacggttgatttttgatactacttataagatgaacaaatatcgtcttctgttgttagagattgttggtgtgaattcaataggcatgactttctttgttgcctttgcttacttacaatctgagagggtggacaattttgaatggcctttaagtaatgtcaaaggattttttatgaatgatggtgtgatgcctcagctggacactcagactactcatggtctaccatgcgcctatgaacttgctaggtattgtcgtatcattggctcaatacccttgaagtgcattcatgtgcactggaagatgttatccattagtattacagatgacacaaactttttatcacttgatgtgggatggaaaatcacattgaagaaaaaggtccgtgaagttgcatttttgaataccacttcaatgtgtccttctccaaaaaaggagagagttgatgaaatgaacacagtggttggtagtttaggaattctaagcgtggctcgcagagatcctggcccaacaacatccattgagaagtggatgaccattcccgacatgggttatgtcattgctagttag

SEQ ID NO: 10030 - DNA, 2862 bp, Glycine max
  Peptide Sequence Number=SeqID_126808
atggagtcctctgttgatgcattagcttcaaaacgctctcgttcaagtggattttcccctgaccctgacagaggcaaaagacagaagttatcaaatgttgtggagcacgggaatccattcgcagttactgatgttctggatcgtatagagcatggaaaatatggaagtgtcacgaaggatatagaggccctttttgcccgaagaatgaaggtacttggaccttacttagcaaagtatcccaaacttaatcaattgatccatgcggtaatcgaccgcgatgaagaaattcttaagtcagaagatcaacaagttactggtttgacacatcaaaatgtcatagatttggaaactcctaagttagaagttcaacagattactggtttgacacttcaaaatgtcatagatttggagggggaaaacactgagaaggatgttcatgcagcacaaattcatggtttgattcacattgattcagatgaggaagatgatggagataaaaaatctattgttccatatgaagcttcagatgaggaagatggtagagataaaaaaattattgttccatatgaagcttcagatgaggaagatggtagagataaaaaaattattgttccatatgaagcttcagatgaggaagatggtagagataaaaaaattattgttccatatgaagcttcaaatgaggaagatgatagagacaaaaaatcttttgttgcttttcatgaagttgtgtcgccaagactagttgcaccatctcctgcgtctaagacggttgagtaccacactcccattccttaccatggagaaactgaagatctaaaaattgagacaagtatatctggaaaagataacactaggggagataaaggtgtttatattggtgtacaggaggtagaggatcatcagggtgatactgcagatgatgatggtctagaagatatttggaaggagatgtcaatggcaatagaatgttccaaagatacttacgtgaatcctctgccagatgaagaagtaaaagaagatgaggactgtgatcattcttttattttaaaagatgatcttggctatgtttgtcgtgtttgtggcattattgaccggggaattgaaaccatatttgagttccagtacaaggctaaacggagcacaaggacttatgcatctgattcacggaataccaaaggaaaagcagatgcatttggaattaatgttgctgaagatgatctcatagtaactgaaatctcagcacatccgagacacatgaaacagatgaaaccccatcaagttgaaggattcaattttcttgctagaaatcttgtgggtgacgatcctggtgggtgcatcttggcccatgctcctggatctgggaaaacattcatgataatcagtttcatgcaaagttttctgggaaagtatcctaatgcaagacccttagtggtgcttcctaagggaatattatcaacatggaaaaaggagtttcaaacatggcaagtggaggacattcctctatatgacttttacacagtgaaggcagatagtagaagtcaacaactggaagtgttgaagcaatgggtggagcataagagtatccttttcttaggatacaaacagttctcttctgttgtctgtgataatggggccagcagtgaatctttatcttgcaaaaagattctactgaatgttccttcaattcttattttagatgaggggcacaatccgaggaatgaaaacacggatatggtacagtcccttgtggaagttcatacccgtctaaaagttgtactgtcgggaacactttaccaaaatcatgtcaaggaggtgtttaacatcttaaatcttgttcggccaaaatttttgaagatggaaacatctaagcctattgtgaggcgcattcgtagtagagttcacacaccgggggtgagaagcttctatgatttagttgaaaacactttggagaaggacacgcattttaaaacgaaagtagctgttattcaagatttgcgagagatgacgagcaaggtacttcactattataaaggagatttccttgatgagcttcctggtcttgttgattttactgtggtgctcaatcttagccctagacagaagcccgaagttgaaaaattaaaaaggttatctggaaattttaagaaatcttctgtaggcagtgctgtctatttgcaccctaaattgaaacctttagctgaaaaaagtgaaaaaggtatatctgataacatgattgatgctctgatagagaaattggatgtgagagatggtgtgaagtccaaattctttctgaacatgctaaatttgtgtgaatcagctggggagaagcttctagttttcagtcagtatctgttacctttgaaatatttagaaaggttaactatgaaatggaaaggctggagtctaaaaagagaaatctttgtaatctctggagaaacaagctctgaggatcgagaatggtcaatggaaagatttaacaactctcctgattccaaagtcttctttggctcgataaaggcttgtggggagggcatatcattggtcggggcatcccgcataattattttggatgttcatctcaatccttctgttactcgccaagctattggtcgagcattcagaccaggccagaagacgaaagtctttgtgtatcgattggtatctgctgattctcctgaagaggaagatcacagtacttgtttcaagaaggaattaatttcaaaaatgtggtttgaatggaacgagtattgtggtgatcaagcttttgaagttgaggaagttggggtgaaagagtgtgatgatctatttcttgaaagtccattgttaggggaggatgtgatcaagagaatcagagtatga

SEQ ID NO: 10031 - DNA, 3180 bp, Glycine max
  Peptide Sequence Number=SeqID_126809
atgttgagagtgacccaacaattaccaccgaccccttcacctacatccaagctcacctatctcaataaaaaaacacacaaaagagagaaacggaagaacaaaaaagcatggagacgtaaaacactactgactcagcttaaaaaggaagaagatacaagaggggcccaaaaactaaaccccgagtctcgagacaccccaacgttctccttgacgcccttctgccctacctcgaccctcattgttctcactgaacctagagtggaaattttggttgagatgggaaagaagaacaaagtgaaggaaaatggaggcaaagagcattgcccctcgactctttttgtctccaacttgccctattccttttccaattctcagttggaggagacgttcagtcaggttgggcctgtcaggcgttgcttcatggtcactcagaaaggatcagctcaacatcgtggtttcggttatgtccaatttgccgttgaggaagacgctaaccgtgctattgagctgaagaatggtacatctgttgaaggccggaaaattgtagtgaagcatgcaatgcctcgtcctccccgtgaagaacgacaatcaaaaccaaatcaagcgggcaagacagatgatctcacaaagccaaaagatgatgatgaagacggcagatcatctggatcagagaagaatgtttcagtttcgaaggaagaagaattgcaagtcagtaaacaaaaaagcacaaggaagcccatggaaattaaaaaatcagctctttgtgatgatgtagcagatgagggtggttgctcagaaaagcagagggttgctagaactgttatatttggtggtcttataaattctgatatggctgaagaagttcacagcaaagccaaagagattggcactgtgtgttcaattaagtaccctctttcagggaaagatcttgagcaacatggtctcctgcaagatggatgtactttagatgcttcggctgtgctttatacaagtgtaaaatcagctcgagcttctgttgcaacattacataaaaaagagataggagggggaaacgtttgggcacgccaacttggtggagagggctccaagactcagaaatggaagcttattatcagaaaccttcctttcaaggcaaaagataatgaaataagagatatgttttcatctgcagggtatgtgtgggatgtatttattccacaaaagccagacacaggtctgtctaagggttttgcatttgtaaaattcacctgcaagcaagatgcagaaaaggccattcaaaagctcaatggatcaaagtttgcaaaacgactcatagctgttgattgggctgtttcaaaaaagatatttagcagtgatacaaataatgctcttgcctcagagaaagtaaatataatgattaagaaatctgtcttaagcggacaaaaaaacttgagcgatgaggatagtactgatgacgattttgagcttgatgataaaagatctggtcaaggagatgatagtgatacagactactctagtgccatggaggaagaaggcactcctgaagataatttcgataaggaagcagacattgcaaaaaaggttcttaacaacttgcttacatcctcgagtaaaggaacatctgcaaacaatgattctatgctgatcaaagaaaacaaggagtcaagatctgatgaaattgttaaggatgcagatgaaaaaaatgagtctggaaaggtttcaggtgtttctaagcctgaaatttccagcagaaacaacttatcaattcctaagagaacagaagaagatgatttgcagggaacagtttttatatgtaatcttccctttgaatgtgataacgaagaagtgaaacagcgtttttctggatttggggaagtagaatactttgttcctgttctccaccaagttaccaagcgaccgagagggactggttttctaaaatttaaaactgtagaagcagctaatactgcaatttcaactgccagtgctgcttctgggatgggtattttattgaaaggtagaccattaaaagttttgaaggctttggataagaaatcagcacatgacaaggaactggagaaagcaaaaaatgaggttcatgaccaccgcaatctttacttggctaaggagggacttattcttgagggaactacagctgctgaaggggtttcagccagtgatatgttaaaacgccaagagttggaaaagaaaaagaagacaaagcttcaatctcccaattttcatgtttcaagaactagactcattatctacaacttacccaagtcaatgaatgagaaagaactcaagaagctttgcattgatgcagttatctctagagctaccaagcaaaaacctgtaattcggcagataaagtttttgaaaaatgaaaagaaaggaaatgttgctcaagaacgctattcacggggagttgcctttgttgaattttcggagcatcagcatgcccttgtggctctgagagttcttaacaataatcctgaaacttttggtcctgagcatcggccgatcgtggagtttgctcttgataatgttcaaacacttaaacttcggaaggcaaagctacaatctcagctgcaggctcctcaagatgacaacaatgccatggataatgacaaacctggcacagtagaaggtcacaagcctgtaaagaacagaaaacgaaaatctcaagagcatgacaaaccagcaatggaatcagcactgaatacaaatggtgaattgggtgttgcagtgtcaaacggaaaatcccctcaaggacacaaatccaaaagacagaaaggcaacaataagagtaaaaaggcactgaaagaaaatccagaagccttgtccatgaagccaaagaataatgaaaatggccagagcaatggtggtgcatcactagaaggtcaaaacactgccacttactcaaatagaagaaaatcagggaacagagaagattgggggtttagaaaaagaaagattcaaaaccaagaacaagaagcaggccaaaaggtttctaagaaacggcctaagaagaataaagattcagtagggaaggacgtgggagacaagcttgacatgcttatagaacaatatagatccaagttctcacacaagggttcccaagagaatgatggagagagaaaaccttctaaacagcttaggaaatggttccaatcatag

SEQ ID NO: 10032 - DNA, 315 bp, Glycine max
  Peptide Sequence Number=SeqID_126810
atgaacaatgagagtgtgaacttggatttcaacttgaatgtagtccgagaaacagagaacaaaaatgaaggtccattattgaatagtgatgccaataacgtgcaatcaaaatcctcaaattctattgatttgaatattgtacccatgagtggtgatggagcaaattctcaacaacccatcaatggtgagggaaatcaatctcagttgtcgaacttgaatgatctcccaagcgttgaaatggactttgatatgagtgttgacaaggaagaagatggtatgcctgacgacactgaagatgcaagcttacacgggtaa

SEQ ID NO: 10033 - DNA, 324 bp, Glycine max
  Peptide Sequence Number=SeqID_126811
atggcctcttctcctccctcttcctccgctattaaggatgccaaggtgcttatggttggcgctggcggaattggctgcgagcttctcaagaccctcgccctctccggtttccctgacattcacatcgggaagaatttcgagtctttggggccaggggtggtggtttttgtggtgaggtggagtgttggtgcttacattcagttggcttcaattgcttttatgctaatcgatgtttgtgatgatggaagtagggaattgattattaaaatggcagatctgctgaatgcttgggcggtattgtacccagaacaagtatcttgctag

SEQ ID NO: 10034 - DNA, 1056 bp, Glycine max
  Peptide Sequence Number=SeqID_126812
atgggccagcgcccgcttaccggagtatctggtcgcgctgctgttcttcgcggcggtgatggtgttgcagctggctcccgccgcagtgaccttttccggtttcgcgtcttccgcattctggctggtgctcagcggtttcgtgctgggcaccgccatccgcagcaccggcttggcggatcgcctggccaaccgactcttgccgcacctggccggctcctggccgcgcctggtgggcggcgtggtggcgataagctacgcgctggcgtttgtcatgccttccaacatggggcgcattacgctgctgatgccgatcgtcatggcgttggccgatcgcgccggtctggcggagggctcgcgcggccgcatcggtttggcgctggcggtggggttcggcaccttccagctttccgccagcatcctgccggccaatgtgcccaacctggtgatgagcggcgcggcggaaagcgcctacggcagccactttgcttatctctcttacctgctgttgcacgccccggtgctcggggttgccaaaggcgcgctgctgacgctgtgcatctgcggcctgttccgtgcgcggccgcagccggtggcggccgaggcggcgcaaaccccgctcagcgccgccgaatggcggctgatcgcgctgttgggcgccacggtgttgctgtggatgaccgacagctggcacggcatcgctcccgcctggatcgggttggcggcggcctgcttgtgcctgttgccgcgtatcggccactcggggcttggcgatcggctgggcggtgcgctgctggcgatgatgccggatctgcacggcaaaccgttcaccgcgttcggttcgttggtggggatcaccgcgttgctgaatttcgtggtgacagccaacggcgtgccggcgctgtttaccccgctggcgcaggcgctgtccgcgggcagcggcttgccgctgctgacggtgctgatgacccaggtgatcggttatgccacgccgctgctgccgtatcaggcctcgccgatcgtggtggcgatggggatgggcaaagtgccggcgcgtga

SEQ ID NO: 10035 - DNA, 393 bp, Glycine max
  Peptide Sequence Number=SeqID_126813
atgactagaggcaatccatctgacttacaaccctttgaccctgagatagataggacatttcatagattagttaggcatccttttataccttttgatcatcctgagcattccattactggtgaatctgtgcattctgttattggtgattttgaacatcctgatttggagcattataattttgagcattctgattatgagcattctgattctgagcattctgattttgcacattctgagaacatggcacaacctccactccgtgagatggtccagccctcagcaacaacaacagcagcctgctccttccttccaaaatgctgctggcccaagaagaccatacattcctccaccaatccaacaacagcaacaaccccagaaacaaccaacagttga

SEQ ID NO: 10036 - DNA, 256 bp, Glycine max
  Peptide Sequence Number=SeqID_126814
atggtgggagcaggtttgaaaaaggatcttagagtgtctagggttgtgccaggagggtctcttaatgccttcctttttcttctcatcggagttatttcacaaagacttgccatggaatctattgattctctcccaattggttggactgtaggtgcgatgatttacttcacgggcgaggtctctgctcagttggtagagctccgctcttgcaattgggtcgttgcgattacgggttggatgtctaattgtccaggcg

SEQ ID NO: 10037 - DNA, 1302 bp, Glycine max
  Peptide Sequence Number=SeqID_126815
atggaagagaaagatttcattgaagagggtaagagtatgagtcgaaaggagaagaggaaggcaatgaagaaaatgaagcggaagcaggcaaggaaggaggaggctgagagggagcggcgggaggaagaggagcgcctgaacaaccccgaggagcagaggcggatgcagttgctggagcagcaggaggctgagaggatgcagagggatatgatcctcttccgagagagagagaaggcgtggatggacactgtcatcactcaaaaacaacaacaacaacagcagcagcaacaagaagacgaggatgatgaatacgaatatgtcgaggaagaaggccctccagagatcatttggcaaggaaatgagatcatcttcaagaagaaacaactcagagttagggttaccgacagggacaaaccaaagcccaacgagactaatcaaaatgaccaccagattcccaaacatgctctagaatcgaatttgacatccaatcccttacccccagaatcaattatgtactatatgcattcatctgactgtatgtgccagccattcataattgactatcatcatttgcagcaggaggaggataataaacctacatccaatcccttacccccggaatcattgacacttgagaatgttgctcaacaaatacccaattttggaactgaacaggataaagctcattgcccttttcatctaaaaacgggagcttgtcgttttggtatacgctgtagcagagtccatttttaccctgataagtcgtccactcttcttatcaaaaacatgtacagtggtcctggccttgcttgcgaccaggaccaggatgagggccttgagttgtcaggcgttatccaagtcttggcttatggagctatgttgcagactaacggtcatgaccttcaaaggtatacagatgaagaggttgaacgctgctttgaagaattttatgaggatgttcacacagagttcctgaagtttggggaaattgtgaacttcaaggtgaaattgcggcaatttgcaggaggtgcaagggcatctgtgatcaggtgcaagagcccttttccagctattgctgactttgtcagtgtggccctgttctctgtattttgtggccattcccattcatactctaactatcagtcggttttgggcctacaaagcctaaacctaagcaacctgaaggctgtaatattgcctgtttctaaccacacagttcatcgggttagctggggttgtgtgcaactcgggctggttcaaacggactggatagattacaggtcagtgttgtattttgcttag

SEQ ID NO: 10038 - DNA, 1005 bp, Glycine max
  Peptide Sequence Number=SeqID_126816
atggcagttcatgtgtgtaaaaatggttcatttcacttgcgaggaaatgtctatgtacagtataaatcgcttgattctgctctgcttgcttataacacggtgaatggtcgctactttgctgggaaacaggtaagttgtcaatttgttaacttgacacgatggaaggttgccatatgtggcgagtatatgaaatcaggtttcaagacttgttctcatggaacaacatgcaattttatccactgttttcgtaatcccggcggagactatgaatgggccgattctgacaaacctcccccgaaattttgggtaaaaaaaatgatcgctttatttggttattctgatgattatgagacttcaatggagcaaggaaatatgagtttgtcaaaaacagattctgacagaacgtgccactctagaagaaggtcaagatctagggagatggatcagttaaattgcggtcattcaggtagaagaaaacagcgagatgaaagaaagcatagaactcctaatgaggattggaatggcagctttaaaaggaaatcgagaggcagaactcctgattccggtgctgtttctgacagggaatggttagaaaaagaggaaaatagggaaacacaccatgaatacactatgaatagcagacgccatgaagaagattctgatgtggaatgggttactagggacaacgaaaaacagcatggtagagaaggaagaaactcaagaaagcaaaacagagatgagaaaaggcaccatattagcaaaagcaattatcagggtggccgcgatgcttctgaatctgagaaagattttcttggtagaggagagatggaaacacaacatgattattactctaggaaaagctcaagatacagaagatcaggtcttgatgatgatgactataaataccatgagaatgaaaatgacaaagttgatggcggttggtctcggaaggacagttacaagcgagaagagcatcatcacaaaaagaagagatcaaaacattag

SEQ ID NO: 10039 - DNA, 312 bp, Glycine max
  Peptide Sequence Number=SeqID_126817
atgaaaattgggggtagccaggttttgaccttggcaatcagaatggtatcaagggttactgttagggctaaggaagcagttgaagcagctggtgggtctgtgagaagggtgtattacaataagttgggcttgaaggcactggtgaagcctgagtggtttgaaaagaaaggaagattgctgcctaaagcagctagacctcctccaaagcaaaaggataaagttgatagcattggtcggttgcctgccccaacaaagccatttccatttttagttgaagcaagcaaggatcttccagttcagcatcttagttga

SEQ ID NO: 10040 - DNA, 273 bp, Glycine max
  Peptide Sequence Number=SeqID_126818
atggcgctgaggatggcgacgataccgatgacaatcatcagctcgatcagggctccttgttgtggagccgcaacggtaagaaagggcgggcaaaagcggaagggggcgcgtttcaatcccggaaaggggcgcgcagaaaatgtagcgcgttacaggcgaagccacatgatgatggaagccggctcgcaatttgccgccagcaccggcggcatagcccttacgtcagacttcgcgaaaacgcatcgacagatcggagcgcctgcacgtgcttag

SEQ ID NO: 10041 - DNA, 690 bp, Glycine max
  misc_feature (634)..(634): n is a, c, g, or t
  Peptide Sequence Number=SeqID_126819
atggataagccggatagcaccctgcaggcactgtgtgcccgctatcaggccgtgatactgcaccatgacgccacgcaattgcgcgtggcggtcgcggacgcgccagacccgctgttgttagaggcgctgcagtttgccagccagtgcgcagtcgaggttgagtgctggcccgccgcacggctggagcagctgctgcaccagccagaaagccgtgcggcaccgcgcgaacaggccagcgccgagtccgctattcacgcgctggatcagattctgcgccaggccatacagcgacgcgcctccgatgtgcactttgaaccgcagcgtcacgggctgcgcgtgcggctgcggattgacggcgtgctgcatccgctgccgcagttaccggatgccccacccgccgccgtgctggcacggttgaaaatcctcggcggtctggatatcgcggagcgtcggctgccgcaggatggccagttcagtctggagatggatgacaaaccggcggcgttccgcctgtcgaccctgccggtcagccagggcgaaaaagcggtggtgcgcctgctgcaaagcgaaaacagcgccattgcgctcgataagctgggcatgccgctaccacagctgcgcctgctgaaaaacngcgctggccaaaccgcaggggctgattctggtcaccggcccaaccggcagcggtaa

SEQ ID NO: 10042 - DNA, 1575 bp, Glycine max
  Peptide Sequence Number=SeqID_126820
atggacaccatagaagtcagtaacctgaacaggcaatttttatttcgacaattccatgttggacaatccaaggctaaagtttcagttttccatcaatctgatgaagtcttcaaccaggttgctagggatgctgtattaaaatttaggccccacataaacattacaccataccatgcaaatgtcaaagatcctgaattcaatgtggacttctttaagcaatttaatgttgttctaaatggactagacaatctagatgcacgccggcatgtgaatcgcttgtgcttggcagctaatgttcctttggttgaaagtggaactactgggttcctcggacaggtaactgtgcatgtcaagggaaaaacagagtgctatgagtgtcaacctaaaccagcccccaagacatatcccgtctgtacaatcacaagtaccccatcaaagtttgttcactgtattgtgtgggcgaaggacctactttttgctaagttatttggggacaagaatcaggacaatgatttaaatgttcgatcaagtgatgctgccagctcatccaaaaatgtagaggatgtatttgaacgtaggaaagatgaagacattgatcaatatggaaggaaaatttttgatcatgtatttgggtataacattgaattagctttgtctaatgaagagacatggaaaaatcgtaacaggccaaagcctatatacagcaaggatgtcttgtctgatgaaccggctcaacaaaatggaaatttggagaaaaaatatgaatctgatgaattaccagtttctgccatggcatctttgggcatgaagaacccacaggatatttggagtctcaaagaaaattcgagaatatttcttgaagcatttagactattttttacaaaaagggaaaaggagattggcaatctaagctttgataaagatgatcagttggctgtagaatttgttactgcagctgcaaacataagggctgcttcatttggcatccctctccaaaacctttttgaagctaaaggtattgctgggaatattgtgcatgccgtggcgactacaaatgctgtgattgctgggttgattgtcattgaagcaatcaaagtgctgaacaatgacattaaaaattatagaatgacatattgtctggagcatccagcaagaaacatgctgcttatgccggtggagccatttgaacctaacaaatcttgttatgtttgttctgagacacctttatcgcttgaaataaacaccaatcgttcaaagttgaaagacttggtcgaaaaaattgtcaaggcaaagcttgggatgaaccttcctcttattatgtgtgcttcaaacctgctttatgaagctggtgatgttgaggatgacatggttgctatttatgaggccaaccttgaaaaggctctggctgagcttccttccccagtaactggtggcacaatgcttacggtagaggatatgcagcaggaattcgtttgcaatattaacatcaagcacaggtttttactcaactctatttttgtattctgtgaaaaatattccttggataaaaaatactactatgctagaggaacttaa

SEQ ID NO: 10043 - DNA, 315 bp, Glycine max
  Peptide Sequence Number=SeqID_126821
atggcggatgcaatactgttgggaagggccggagaggtgttgacggcaaagaggagcaaaaccttgcgtgactttggcgaagatgaacgtgcatttatcttagagaaattccgacaggtgacatcacgatggtaccaggcgactaacggtggagcaccaaatgaggatgagcgatctcatatgataattgtaactgacgcttgccttcctctctttgcttctggagaatttcctttgaacactcatcttctcattaactatgagttatcggcaaagaaggtcttcctcttttctcttttcctttttaaattttaa

SEQ ID NO: 10044 - DNA, 464 bp, Glycine max
  Peptide Sequence Number=SeqID_126822
atgttggataaacaagcagttgtgtctcctgcaaaacctgcagatggaccggatcctcaggttatgtgggatgataccgtgttcggggtgtttaatgaacacttcccgttgtacataaagcacgaagatctgtctgaaattgcacatggtggtcaatgtctccgcatacctgttatacagttgtggattctgcatctgactgagacaagtatgcgagcagggaatttcgatgtgtacggattcctcgagccacagtccattcagagatctgggcaatcacaatttgaatcagaaagttacatgaagagttggatgcaaagttcaaaacgagatgtctaccttggagcctacctgaatggcgcacactggcaaatagtcgtcattttgcctaaggaaaatcttgttgtctggttttgttccttgcatgacagaccagacaactaccttaaaggaataattaacag

SEQ ID NO: 10045 - DNA, 960 bp, Glycine max
  Peptide Sequence Number=SeqID_126823
atgctttcaaagctaaggcacaggcacttggtgtccttgattggatactgtgatgagaatgatgagatgatcttggtttatgagtacatgcctaatggtcacttcagagaccatctttatggaaagaacttgcctgctctctcatggaagcaaaggctagatatctgcattggatcggcccgcggacttcactaccttcacaccggaacagctcaaggcataattcaccgtgatgtcaagaccactaacattttgcttgatgagaatttcacggccaaggtttctgattttggtctttcaaaggacgcgccaatggggcagggtcatgttagcactgctgtcaagggtagctttggttatcttgaccctgagtacttcaggaggcagcaactgactgaaaagtctgatgtgtactcatttggggtggttctgcttgaggcactgtgtgcaagaccagccatcaaccctcagttgccccgtgaacaagttaacttggccgattgggcgatgcaatggaagaggaagggccttcttgacaagatcattgaccctctcttagttggttgcatcaatcctgaatccatgaagaagtttgctgaggctgctgagaagtgtttggctgatcatggtgtggataggccttcaatgggggatgttttgtggaacttggagtatgctttgcagcttcaagaggccttcacacaaggaaagcctgaggatgagtccaagtcagcatcagcagctgttcctacttcaccaacacctcctactccttccgatgatcgcccggcagctccggctgtgcctgcacgtccggaagcagcgaataatgcttcatcagaagtgaattctattgatgaccattctggaactgcaatgtttgctcagtttagcaatctcaatggtagggtgagggtaattgtagaagcaagttcaaagaaactggctaccgacaggtag

SEQ ID NO: 10046 - DNA, 1012 bp, Glycine max
  Peptide Sequence Number=SeqID_126824
atagcaaatcacactttcacagttgttgccatggatgctgcatacactgaccactatgtcaccaacatcattgttattgcccctggccaaaccattgatgcactattcacagcagaccaacccttaggttcatactatatggctgcatctccttacatcgttggtgttcctgtctttgacaacacgacaacacgtggcgtcgtcgtttacgacaatgcaccaccatcatcgtcacaacccttgatgccaaccctaccacccttcggcgacacagaaactgctcacaaattctacagcaacataactggcaaggtgggggcaccacactggattcctgtcccaaccacggtggatgaacacatgttcattactattggattgaatctagcattgtgtgaccctaacaatgccaacaatgccacgtgtcagggtccatttggccataggttttcttctagcatgaacaatgagtcctttgtgctcccaattgggagagggttctctatgttggaagcattctttaagaatgtgagcggagtgtacactgctgatttccctgacaaccctccggttacgtttgacttcgcaaatcccagcattagttttgatcctaaccttttgtttgcgccaaaatcaaccaaggtgaagaaactcaagttcaattcaaccgtggaggttgtgtttcagaatacagcgattcttggtgtgcagaaccatcccatgcacgttcatggttttagtttccatgttttggctcaggggtttgggaatttcaattccaccacggattcaaccaagtttaatttggtgaatcctcagctacgcaacacaattgctgtgcctgtgggaggatgggctgtcatcagattccaggcaaacaatccaggggtatggtttgtgcattgccatatagaagatcatgtgccatggggactaaacatggcttttgaggttgagaatggaccaacttcttcaacttcactccctccaccaccttctgatctgcctaaat

SEQ ID NO: 10047 - DNA, 258 bp, Glycine max
  Peptide Sequence Number=SeqID_126825
atggctcaacccgccattgccagtggcggtaaaggaggagagaagggtgtattgccagtagcagtggcgagatatggccacccgccagtgggaacggcgacacacccgacgtgggactcgcccacacggctggcgagacagcctgggtctcgtccacaggactggcgagacactcccaccccatttcagcttttccttttcgttttggcgggacaaagctgtattttatcagctagggcacagctagggcactgttag

SEQ ID NO: 10048 - DNA, 672 bp, Glycine max
  Peptide Sequence Number=SeqID_126826
atgaagcttttcatgtttttgctagcatgggctttcgctcttctgggttcttccttggcttcagctgctatagtggaatacactttcaaattgtacaagaaggttgttcaaaccacaacagtcaaccgcttgtgcaataagcgagtgattgtgacagttaatggacaattccctggcccaaatataaatgtcagcgaaggtgacactgtggttgtccatctattgaacgagggaccctacaatatcaccattcattggcatggagttcttcagctatttactgcttgggcagatggtcctgaatatgtaactcaatgcccaatcagtccaggaaataattatacctataccttcaatgcgacacgacaagaaggaaccttatggtggcatgctcatgcatctgttttgcgtgccacggttcacggtgccttcatcattcaacctcgttcgggacgatttccgtttcctaaaccctacaagcaagttcctattatattaggtgattggtatgatgctaataatgttgtggatattgagacccaagcacttgccaccggtggttctccaaatatatctagtgccttcacgatcaacggcttgcctggtgatctctttagttgttctcaaaatcgtatgcttcctccttgtatatattattctatgcatatgtag

SEQ ID NO: 10049 - DNA, 233 bp, Glycine max
  Peptide Sequence Number=SeqID_126827
atggcatcttcatcatcatcttcatcacatgttaacattaagtctggccccatcgatgctgatgtattatggatgcaacctaaacatgtttcagaacatgtttggaatggggaagaagataggaaattacatatcagacgagttgtccccacgtatcaaggggaagaacaaattcctgagcaaatttttccttttcttctacaatctggtttcgcttggattatcaagatggg

SEQ ID NO: 10050 - DNA, 396 bp, Glycine max
  Peptide Sequence Number=SeqID_126828
atgacagacaagatcaagggctattcccttgatatccagcttagcaatatccatctcagtaggcacttgcctatacaacttttttttttcaaaagtgatggtccaagcatctacactcgatcactaggccattgtggattgagtttgcagcaacctgttatcccaccactattgggagtaggaagtgtttgctgctttgtaaaaccaaccccacgcattgctctccatttagaaaccaggagacttatgccttcgcttaagtcccatgattcaactcggcgtgcaggtggggccacaactcaacctagcaaagccaaagagttgttccatcatcactttggtgccccacatgagtcacatgctagcgtatctcagctgggcaataaaaatagttaa

SEQ ID NO: 10051 - DNA, 189 bp, Glycine max
  Peptide Sequence Number=SeqID_126829
atgaactacttttatttctcacattctcataatcaaaattggaagaagggaacaccaaggaaaccactgaataaggaagaagtaagaaccatccatgagaggcttcttagggctaacacaaaagattatggacgatatgatccatccccatctctttcaaagcctcctttcaagctcatacccaattaa

SEQ ID NO: 10052 - DNA, 507 bp, Glycine max
  Peptide Sequence Number=SeqID_126830
atgagtcatcattcatctagtattaatggaagccataggtcacatcttagacctcactcccataggagagaaaaggaaagaaagcctcaagaggctaacatttacctcccatacttccatgggaaggacaatgtaaaggctaacttagattgggaaataaggatagagcaacaacttaaaagaaagtctacttcaaaatcttatggctctcactcttatccaaagaaagaccaaattctaggcatcttgggggcggcaccttctaagcccaaagatgataaggggaagacaatagaaaagcaaccccttaaggctagtatgcaagagaagactagctttataaagtgctttgaatgccttggaagaggacagattacttctcaatgccccaccaagaaaatgatgattatgaggggacaagacatttatagtagccaagatgaggctactacttcaccttcctctagtgaccttctaagcccaaagattataaggggaagacaatag

SEQ ID NO: 10053 - DNA, 615 bp, Glycine max
  Peptide Sequence Number=SeqID_126831
atggcccactatggctacgaaaccagtcttcatagtagaaatgaagattgtgcccataccggtgacggggatcaatccataaagtataaggaaaccttagcctcaactaattggcttccaagagcatatgaccaaacaaaagaagagaagtgcgtgagaagcttatccgcagggaggtctgacgttccatggggagttcccggcagtggcgagttgcgtcaccgtcatgtggacgttgatgtgcttgttgggctcggggaggtcgagaagcgcgttgttaaggatgacaaaggcctcctcgagatcgctgaagatggagaagagcgagtggaggccatcagtggtggtgtcctagccaaggccgtggaggaagagcttgcgctgggagacattgtggtccgtgacgatgcgcacaacaacaaggacgtcgaggtggcccaccaccgcgtcctaaaggatgttgaggaattggttaggggtgaagcgcttgatgagcttgcgggcttcgaagggggagagcttgagggggtcagaagagttgttgttgagaataagaaagcttcaataaaaggaaaattaaaacataacattataactcaatatcggtttttgtaa

SEQ ID NO: 10054 - DNA, 354 bp, Glycine max
  Peptide Sequence Number=SeqID_126832
atggaggaggctgaggaaggaggcacagcagaggccagcatagatgaagactatgtggaggacaagagaaagaacatgaaaattaggggcgtgagtgaaaatgtcagcttgtttgataggccaaagaagagaaggcgcaaaaagctgctaatgaactcgcttagcgaggcagattggctaagtgaggcagattggctaagcgagcctcatccccttagcgaggcagacaacttgcttagcggatgggaaacccaagaagaggataagtcagagatctgcacgctcagcatgcaaccagcccgcccagcgaaaacgttgtctcttttcgcgcttagcgcgcccaagctcgcttag

SEQ ID NO: 10055 - DNA, 120 bp, Glycine max
  Peptide Sequence Number=SeqID_126833
atgaccagcaaggtcgtgatttcagatgtaacatcaaggcactgcagctactggatagagacaaaaggttctaacaagaatggcactaccagccttagtggaataacaggaaaggaataa

SEQ ID NO: 10056 - DNA, 363 bp, Glycine max
  Peptide Sequence Number=SeqID_126834
atggatataggtctaacactaggtaccaaatctatagaaaactctatctctcactctggcggtaaatcggatacatcctcaagaaaaagcttttggaaattctctaacaatagggaggtcacccatagaaacattggtctctacttccagtttaacaagaaatggttggaagataaccacttcatacccatattaacatcaatttggctcaaagctccattggagcttgtaggcctaggatcttcttcatcaatggattcctttgcttcttggaagatgaatggcagcagaatggagaaggaagagagagaggagacgccacttcaaggagaagatgagtctagaagaggctcaccactatag

SEQ ID NO: 10057 - DNA, 249 bp, Glycine max
  Peptide Sequence Number=SeqID_126835
atggacttcacaaagcccattgatgaggttaagacgagatctcttaagaatataggactagttgatatagggaatgattggatttacaatgctcctctagtggatgtggatgaggagcaagctactgaaaaagttggaaaagtggaagagaagcctatgactaccttcgagaaatctatgctagccaagatggatgagctaatgcttagtgctctacttcaagcttcctttatgtttagttttgaatga

SEQ ID NO: 10058 - DNA, 177 bp, Glycine max
  Peptide Sequence Number=SeqID_126836
atgaccatcgatggccagcacaagccatcgttgcttgctgtcagaccacagcacagagaggaacactttaatcggagaggaatcttcagaattcaccttaaggattcgatatataatgaagctcccaacactttctttggtagtttctatgaggaattaatgaaacattgggcttaa

SEQ ID NO: 10059 - DNA, 273 bp, Glycine max
  Peptide Sequence Number=SeqID_126837
atgtacacatctttcattctgcgagatgatgctgatgttcgaaaaatgttcaacattttttacaacaacccacaactaccatttgtggagttatttgccataatttgtgacaacaataacccatcaagcaaccaacatgacttaacctccaatcttgaggacatatcagatgaatacgagacttgttgggtcaaaaaccatgatagtgatactgactcctctttcggggccgaaggaagttttcctatggtgtcttatgtcggtgttcaatga

SEQ ID NO: 10060 - DNA, 660 bp, Glycine max
  Peptide Sequence Number=SeqID_126838
atggttctaaattgctgtcttcaatcactaccagagctgcaatgttgcagctttgaagaacccggacaccctcaaagcctgtctgaaacattccagaaccttctccgcttccttgacgcccagcccctcaacctcctcagtggcgtccagccgcaccacggtgttgccccattccctcctgggcaccctccccttggcaaacttgatgagctccgcaacggtgccgcggagggcgtcagggccggcgtcgaagccgggggaggcggcggcggagtgagcggcggcgaggagggcacgggcggggccgaggaagtggaagacagagaggcggagggcgtgggggccggcgcggagggcgagggcgaaggaggcggggcgggagtcggcgaattttggggaggagtggatttggagggcggtggagaagaggtagaagaggaagggggcggtgaagaagaggagggcgaagaaaaacaagaggcatctggtggtgtggggtttgttgttgggatttggatttggggaagaagaagaatagagagagatcatgcgagggtgcagttggtgtggtgtggggaaagtgcaatgcgaatggcgttccgaagagcagagaggggcgagagaagttttgagcttgaagaacaagtgttgcttgattaa

SEQ ID NO: 10061 - DNA, 276 bp, Glycine max
  Peptide Sequence Number=SeqID_126839
atggtgagactgttcattgttgtcaattgggaagaacaaggcatctcttcttgggttgctgtaaattatgctcttggaaacttgggacgagaggctcaagaaacaactggaatagttgaacttggtggggcttctttgcaggttacatcagctaaacttaatgcagatttagctcagtctttgcgaactataagattgtctggggttacgtacaacctttacactcagagttggccccaactgggtcaggtgctctttagcttttctgaagtctga

SEQ ID NO: 10062 - DNA, 504 bp, Glycine max
  Peptide Sequence Number=SeqID_126840
atgcgatatttccttgccctaggtgtgctttcggtgaaggtgaaggggtcggtgttcattgttgcggtggtttgttcgacgtcagcgacaaacgagatggacgaagatccatggatgtatggtaatataatgtctgaagaagttgatatggattatcaaaatgaagaagaatgtggtgtgaatgaaccacatgttgattgttcggatgcgttcaatatttctcaggtgtttgacagtcgagacaatgttttgcagtctgacacaaacactggtagtagaggaaggacttcgtttgtgttaattggttgtgaaaggagtggcgagtataggtgtaggaagaaagaatttgttagaagagatactgggactaggaaatgtgggtgtcccttcaagcttcgtggcaagccaatggttggaggacaaggctggatggtgaagttgatgtgtgggattcataatcatgaattggccaagtcattagttggacatccatatgtttggtga

SEQ ID NO: 10063 - DNA, 489 bp, Glycine max
  Peptide Sequence Number=SeqID_126841
atggctcctaggacttctttgtttcaattggaggcagagggccgacattattgtgaagatcattgggatgctcttaaagatctgcataatgaagttgattatatggatttattgaagtattgtttctcttctgcgtatatgctggcattattgcatgatgttcttgggattgctatggaagagaaaagggttggatttgggaaccggaagattaacagtgatgttgattggacacttggatctttcataactgaaacaatggcagaaccccttgaattggaacatttagatacagggatgattgttgggaatgaatcagtcacatatttttcattatttgcatttcttttcttattcatgcttgctgcattctttgtactgcaatggagaaagccacaattgaagacagtatatgaccttgagaagggacgctatattgttacacgtatacccagatgtgggagagggaaggcgaaagagaagccttaa

SEQ ID NO: 10064 - DNA, 444 bp, Glycine max
  Peptide Sequence Number=SeqID_126842
atgaagtttaagaataatctgaatgatccttcaaataggctttggtcttggaatcataataataccaactgttgccactggtatggagtcctctgccacaaccttacttcccatcttcttcagcttcacctcaacacttcacgttctgctttcgagtatgactactataatggattctaccgtagattcgatgaggaagcttatcggagatggagctttggtggagagataagtccttgtttggctgatttaaagcatttgaattacttggacttgagcggcaatagatttcttggagaaggtatgtcaattccttctttccttgggacaatgacttccttgactcacctcaacctctctcatactggattcatggggaagattcctcctcagatcgggaatctctcaaatttggtaatgggtatcaagtatgtggaagcttga

SEQ ID NO: 10065 - DNA, 777 bp, Glycine max
  Peptide Sequence Number=SeqID_126843
atggtgaccgtaacaaaagcaatgtgctggactgttgtggctaagactcttgattcatctggaattgggcttgttatataccagaagcctacctcatcttcctgttatcaagaacgcaaagggaacactcctcctttatgtgaaaataacgatagaaaaagtatctcatcatggtatgccaaattcagtagctgccttatacctcttccagctgatggtgagggtaatatgcagagctggtcaatgccttggccccaaaggcttaccagtatacctccaagcttatccattgaatccgatgctggtgagatgttcttgaaggacagcaaacactggtccgaattagtttcggacatttatggagatggtctttctataaactggtcaagttcgaactataatggacatgaatgctggttatgcagggtgatgaatgtagtacccattgacatgccaaatactcttacaactatatttgacagagggctaataggaatgtaccatgattggtgtgagtccttaaatacatatccttggacttatgatcttgttcatgctagctttatcttcaaacatcttatgcaaagatgtgacattgttgatgtggttgtggagatagatcgcataatgagaccagatgggtatctcctggttcaggactctatggaaataattcacaagcttggtccggtcttgcgttcacttcattggtctgtaacattgtctcaaaatcagtttcttgttggtaggaagagtttctggcatccaaggccgtag

SEQ ID NO: 10066 - DNA, 1170 bp, Glycine max
  Peptide Sequence Number=SeqID_126844
atggtccctgttggtctcggtgcggctggaagtgatagtgctaaaattaaagaggagtttgcttcagtgatacccttgcttgtcatttccatagtactagatgctgtccaaggtgtcatgcaaggggtggctgaccttaaccccaagagagagatgagagggaaactaaagagggtgatgggggtaccaacatatgcccaaatgattcaacgacctaagcctatagagggaaagaagtggctgatgaaaagaagtttagaaaaacaagaaagacaactcagatggtggtctagggagaattctattattgttgctcctgcacctcaagatgatgcaagtattggcaatggaaacagtggctcgaaggagattcaacaggaacattttagcagcgaaatatcaacatatggcatcaaaaactgcaaccctttggtatgggtcaagaatgacaacaaggttggtgggaaagtttgggagattgagaagaaagtggagcaatccaagctcaggagaagcacaaggaggggtcaagcaagatgcaccaatgaagctagtctctttcaatggagaggatatgtaggactagaagggttgtggaaagataaggagagggatgttgttataatcaatatttacgctcctaatgacattgaggattttaattgtgtgaagagggcttatgagagagtaggggtagcgggggaagatgaaaatgttgctgagagggatcagttcaatgctttcattagagacatggaactagaagatgcaccttgtgtagggaggaaattcacttggtaccgcccaaatggaagggcaaggagcaagcttgatagaatgatgacaacaagagattggttcacaatgtggccgggaagtacacaatacattcttgataggaatataccggatcattgtccaatttttgtcaagaataattgtgttgattggggaccaaaatctttcaaggtccttgattattggttctcggataaaaagttctcaaaatacgtggagtcttggaaggctattagatgtgaaggatggggagcttgtactaaaagaaaagctaaaagagttgaaaaaatatctaagagtgtggaacttggagcattttggaaacttggaaaaaagagaatcacatatttcaaaccaattgaacttgattga

SEQ ID NO: 10067 - DNA, 243 bp, Glycine max
  Peptide Sequence Number=SeqID_126845
atgttcataattaaaaccgggatttggaaacctaccaagtgccctcattgtgttcttcaaccaccacatcgtggaagccagcaaaatgcaagagggatcgccaatgatggatggttcctaggaaatcataacggagatcatcaatgcattggcagtctcacagtgaaaacagcgatggcttcataccaccgcctcgtcacagcctgcaaaatgcaagaattaactaccgtttttaaaaagtga

SEQ ID NO: 10068 - DNA, 826 bp, Glycine max
  Peptide Sequence Number=SeqID_126846
atggaccctacaactgtatttggaatgatttttggaagtgaatattttgaagaatatattggaaaacttgcacttgcttctttatcatctatagaaatcgaggaagactcacaggatcctgaagttctgaggcagagaattcaagaaaagatgaaagcatggcagaaggaaagggagcagaagctttcaacaattctgaaagatcgcctgcaaccatttgttgatgatcgagaagatgaatttacagcatgggcacaatcagaagcacgtagtctttctaaagctgcttttggagaagccatgctacatacaattggttacatctacacgcgaaaatctgcaagagaacttggaaaggatatgcggtatatgaatgttccctttttggcagagtgggtgcgagacaaaggacaccgtataaaatcacaagtaacagcagcctcaggagctgtgtccctcattcaaatacaagaagaactcaagaagctaaaccaaggagaaaacaaagaagaaagcatagtcaaagctattgaagataagaaggatgccatgattaattctctatggcagatcaatgttattgatattgaatcaactctgtcacgtgtttgccaagctgttcttaaagatccaagtgcctccaaagatgttctgaagtctcgagccaaagcattgaaaaagttaggaactatctttcaaggtgctaagtctgcttataacagagaaaacagcctacgcaaggaaatttgtcatgagcggtattcttatggccttctgactcagtggattttgaacattgtttcttacagtgctgttaataggcatg

SEQ ID NO: 10069 - DNA, 309 bp, Glycine max
  Peptide Sequence Number=SeqID_126847
atgacagcagaggaaatttttttatacaaattgttaaaggttgataatattggaacaaatgaagcaagacaaaatgaagaaaatctagcctcgcagtgcaagcatgacactattttaatgaggaaattcgaatatactgcagatagtgtggttggattgccactgaaatcaaatatatcacaccatgatttgaaagcacagtttgaatttgatgaagatttctttactacatggatgtcttggccatttgtaatggccttactagctaagacagctttaatgggtttgtgcctctgtggttctagttga

SEQ ID NO: 10070 - DNA, 1320 bp, Glycine max
  Peptide Sequence Number=SeqID_126848
atggcaatgattacacgttattgctctcttgctctggttttattgtggtgtttatacaacatctcattcttgaaggccaatgatggtggctttagtgtggaaatgatccaccgcgactcgtcaagatcaccattgtatcgtccaacagaaactccgttccaacgagttgcgaatgctgtgcgtcgttcgatcaaccgtgggaatcatttcaagaaagcttttgtgagcacagattcagccgaatcgactgtagtagcaagtcaaggtgaatacctaatgagatattcagttggaagcccaccattccaagtattgggtattgttgacacaggtagtgacattctttggctgcaatgtgaaccctgtgaagactgttacaagcaaaccactccaatattcgatccttcaaaatcgaaaacctacaaaaccctaccttgctcttctaatacgtgtgaatctttgcgtaataccgcttgctcttcggacaatgtgtgtgaatatagtattgactatggtgatggttcacactcagatggagatcttagcgtggaaaccctaactttagggtccactgacggttcttctgtccattttcctaaaaccgtgataggatgcgggcacaacaatggggggacctttcaagaggaaggatctggcatagttggccttggaggaggacccgtgtctcttatatctcagttgagttcttcaattggtggaaaattttcctattgtttggcaccaatattttcagaatctaactcatctagcaaactcaattttggagatgctgctgtggtttctgggcgtggaactgtctcaacccctctagacccattaaatggacaagtattttatttcctaaccttggaagcattcagtgtgggagacaatagaatagagttttcaggctcctcctcttctggatctggtagtggagatggaaacattataattgactctggtacaacactcacgcttttgccacaggaagattacttgaatttggaatcagcagtatcagatgtaattaaattagagcgtgctagggatccaagtaaactcttgagcctatgctacaaaactacatcagatgaactggatttaccagtcatcacagcacattttaaaggtgcagatgttgagttgaatcctatcagcacctttgttccggtggaaaagggagtagtatgttttgctttcatttcaagtaaaattggtgccatctttgggaacttggcacaacaaaacctcttggttggctatgacctcgtaaagaaaactgtctcctttaagcccacagattgtaccaaggggtga

SEQ ID NO: 10071 - DNA, 416 bp, Glycine max
  Peptide Sequence Number=SeqID_126849
gtgtgccaaagctaaagagatcagagcttgaagcagcatgtgaagattttagtaatgtaattggtacttcatccattggtacagtgtacaaagggactttatctagtggtgttgaaatagctgtggcatctgttgcagcgacatcatccaaagattggtcaaagactttagaagcccaatttaggaacaagatagatacattatcaaaagtgaaccacaagaattttgtaaatcttcttggacattgtgaagaagatgagcctttcaccagaatggtggtttttgagtatgccccgaatggaacactctttgagcatttacacagtgagtacctaccatttcggtgctattattacattggaaataaatcaatgattgagtattctgtatccctatttatggtcatcaacttttaa

SEQ ID NO: 10072 - DNA, 1349 bp, Glycine max
  Peptide Sequence Number=SeqID_126850
atggcagcaatgatgccacgttcttcgtcatctcttgctcttgttttactttgtctttacattaatatctctttctcaaactcaaaggtccttaatagtggttttagtgtggaaatgatccaccgcgactcgtcaagatcaccactgtatcgtcacacagaaacaccgttccaacgagttgccaatgccatgcgtcgttccatcaaccgtgcgaatcatttcaacaaaaaaagttttgttgcctccacaaacacagccgaatccactgtaaaagcaagtcaaggagaatacctaatgagctattcagttggaaccccaccattcgaaatattgggtgttgttgacactggtagtggcattacctggatgcaatgccaacgctgtgaagactgttacgaacaaaccactccaatattcgatccttcaaaatccaaaacctacaaaaccctaccttgctcttccaacatgtgtcaatcagtgataagtactccatcttgctcttcggacaaaattgggtgtaaatacactattaaatatggtgatggttcacactcacaaggagatcttagcgtggaaaccctaactttaggttccaccaatggttcttctgtccaatttcctaacaccgtgataggatgcgggcacaacaataaaggaacctttcaaggggaaggctctggcgtagttggccttggaggaggacccgtgtctcttatatctcaattgagttcttcaattggtggaaaattttcctattgtttggcaccaatgttttcacaatctaactcgtctagcaaactcaattttggagatgccgctgttgtttcggggcttggcgctgtctcaacccctctagtctcaaaaactggatcagaagtattttactacctaaccttggaagcattcagtgttggagacaaaagaatagagtttgttggaggctcctcctcttctggatctagtaatggagagggaaacataataattgattcaggtactacactcactcttttgccacaagaagattactcgaatttggaatcagcagtagcagatgcaattcaagcaaatcgtgttagcgatccaagtaatttcttgagcctatgctaccaaactacaccatctggtcaacttgatgtaccagtgatcacagcacattttaaaggtgcagatgttgaattgaaccctatcagcacctttgttcaagtggctgagggagtagtatgttttgctttccattcaagtgaagttgtttccatctttgggaacttggcacagctaaacctcttggttggctatgaccttatggagcaaacagtctcctttaagcctacagattgtacccagga

SEQ ID NO: 10073 - DNA, 264 bp, Glycine max
  Peptide Sequence Number=SeqID_126851
atgttccaggcagaaattgctcgtcaagaagcaaggctgaagatggagagagacaatctagagaaagagaaaagtgtcttaatgggaactgcatcaaatcaagataaccaagatggagctcttgaaattacaatttgccaaggcaaaaaaataaggctttgctggggtgacaaaaaggaaaagtatgattttgacttctctcccccagggctagtgctgtcgaggaatcacctgaaatgccaagctcagtttaagtacttctag

SEQ ID NO: 10074 - DNA, 2112 bp, Glycine max
  Peptide Sequence Number=SeqID_126852
atgaagaggttgcactccctcactttgcttggcctcatagcaacccattgccgagcaatcaagttaggctccatcgcagatccttacactgccaacaacctcataacttcgtatgcaaaatgcaccgagttaaattctgctcaccaagtgttcgacgaaatgccccacagagacaccgtgtcttggaatgccataatttccgcttttgcaagttccggtgacctggacaccacatggcaactcctcggtgccatgagaaggtctacacatgcatttgacagccgcacatttggaagcattctcaagggtgttgcctatgttggcaagctcaagctagggcaacaacttcattctgttatgctcaaggtggggctatcagaaaacgtgttttctggtagtgccctcttggatatgtatgccaagtgtgggagagttgacgatggatatgttgtgttccagagcatgccagagcgcaattatgtgtcgtggaatacacttgttgccagttattctcgagttggtgattgtgacatggcattttgggtgctaagttgtatggagcttgaaggtgtagagattgatgatggcacagtgtctccacttttaacattgcttgataatgccatgttttataagttgacaatgcagttgcattgtaaaattgtgaaacatgggctggaattgtttaacactgtctgcaatgccactatcacggcatattcagagtgctgctctttgcaagatgctgagagagtatttgatggtgctgtgttgtgtcgtgatctggttacatggaattccatgcttggtgcttacttgatgcatgagaaagaagatcttgcatttaaagttttccttgatatgcagaattttgggtttgagcctgatgcttatacttacactgggattgtcggtgcttgttctgtgcaagagcataaaacctgtggaaaatgtttacatgggttggtgataaaaaggggtcttgacaattctgtgccagtttccaatgctttgatttccatgtatatcagatttaatgataggtgcatggaagatgcattaagaatcttcttttccatggatctcaaagattgttgcacttggaactccattttggcaggatatgtacaagttggtttgagtgaagatgccttgaggttatttttacagatgagatgtctggtcatagaaattgaccactatactttttcagctgtcataagatcatgctcagatttagcaactttacagttaggtcaacaatttcatgtcttagcacttaaagtaggttttgataccaatagttatgtcgggagttcgttgatcttcatgtattctaaatgtgggatcatagaagatgctaggaaatcttttgaagcaacttccaaagacaatgcaattgtttggaattcaatcatctttgggtatgcacaacatggacaaggaaacattgcacttgacctcttttacatgatgaaagagagaaaggtgaaacttgatcatataacctttgttgcagttctaactgcatgtagtcataatgggctggtagaagaaggctgcaactttatagagtctatggagtctgattttggtattccaccacgacaggagcactatgcttgtgcaattgatctctatggtagggcagggcatcttaagaaggcaacagctttggttgaaacaatgccttttgaacctgatgcaatggtgttgaaaactttattaggtgcttgtagattttgtggtgatattgaattggctagtcaaatagcaaaaattttgttagagctggagcctgaggagcactgcacatatgttatactctctgaaatgtatgggcgcttcaagatgtggggtgagaaggctagtgtaacaaggatgatgcgagaaaggggagtgaaaaaggttccaggttggagttggatagaagtgaaaaataatgtgcatgctttcaacgctgaagatcattcccatccccaatgtgaagagatatacatactactacaacaactaaatgagggaattaagttatttgataattttgtcgatcaaatgttactgcaaagtttagataatctagatgtttatgatgatcaaaagttcttatga

SEQ ID NO: 10075 - DNA, 132 bp, Glycine max
  Peptide Sequence Number=SeqID_126853
atgaaatacaagtatcttgatgctgatgattttcattctgaatcaaacaaagaaaagatgcgaatgggaatcccactggcacttacggatgaagaccgaatgtcgggcttgaatcactatgtgataccataa

SEQ ID NO: 10076 - DNA, 486 bp, Glycine max
  Peptide Sequence Number=SeqID_126854
atggacactcgttgtgacatgcttcaaagtattattagctctttagcttacaaggtggcctcattacctactttttccactcctaccactaatttggacgatccaccaagtgttaatggggtctctcgcacatcccttattttcctcgttgctcctgatgacacattgcataatcttacaccctctccacaagctcattcttgccatcataatacccctggttttggttccaataaccagttccctccaccaccctctgacccccttgattggttgttccaagctaaacaagtttttgcattttaccaagttccccctgagttgtgtctttccatgactatgttttacatgcgagtccgctttaggcccttgtcctatgaaaatcaccaagcagagcttttcaagttctaccagtatagcacgacgactgagtatcaacaccactttgagaatctttctaatcgcgttttcgagctaaatgcataa

SEQ ID NO: 10077 - DNA, 231 bp, Glycine max
  Peptide Sequence Number=SeqID_126855
atggatgctcaagtgtacatgatcctgtctaaccagagagtagagacaaaggtttccatgggttacctctatatggtcagagaatttcttgaagtgttccttgaggatatatccagtttaccacctgagagagagatagagttttccatagacctggtacctcgtgctagacacatgtccatagccccttataagatgtctcttgtagagttagtcgagcttaagaaataa

SEQ ID NO: 10078 - DNA, 440 bp, Glycine max
  Peptide Sequence Number=SeqID_126856
tgtctagaaaaagtaaaaatacaatattatccctattcgcctccctccttgcctccgccacgcccatcgctgcgaatctctcggaccgctcctccctctccattcttgttgtccccaatgcctacctcgtcgttgacgaccacctatccccagtgaccctcgccgacgtccttcgctaccacgtcctcctccaattcctctactggttcgacctccgcaccctcctcccctccggcaagctcatcaccatgctccttcaacccattgaccgtgccaccaacaactttggctctatgaacctcactcgcgactccctatttggtgtcatcttgatccgctcccccacactgtactccccctccaacaccaccatcatctccttgataaagaagcacgacgacgctgcgatagatcacgctgaactttcttctcgtcggtag

SEQ ID NO: 10079 - DNA, 309 bp, Glycine max
  Peptide Sequence Number=SeqID_126857
gatgtggatgcaattctaaatattccacttgtcttcctcgactctaagaataacaggatttggagatggagtcttgatggttggtactcagtgccttcatcgtatcatggggctcgtgatttgcttgacatgacttatctgaagggagaccagtcagggtcacagtgttttgcgagaatgctccaaccatatgggatcaacataggcttaaaggagcactcaaaccgtgtgacccccaaggcctacactccgaagagtccgttagggcctctccctcctgattcaggtccaacccagaaaacattttag

SEQ ID NO: 10080 - DNA, 2574 bp, Glycine max
  Peptide Sequence Number=SeqID_126858
atgcttcactccacttctctccttccccataataaccgcttcgtcttctccttccgctccaaaccttctttttttcattcccactctctctctttctccaaatttctctctcttccatcttcttctcaatcctcatgttgccacgtgtctcgaatctccaccgagaccttggaggtctcgccgccgccgcctcccgacttcaacttccgccgcgaaatcgcgcgcctcgccgacctccgcgacaggctctccgcgtgctctactttaaacgagaagctccgcgtgatcgacgccgactccagagtgaagcgcttcttccgttcccgccgcggcctcgctggggttttggcatcgctgcaattgagctccgaccaactgttcctgctcaagtgcgtggttgccgccggacaagagcacgtgctgtgtttgggcgaaacggaatcgttggaatcctccgtcgccacgagtgcagtgaagagcgcgctttacactctggcggatatgattgagaatatggattcctttaacggcaatggcggagcgggttttgggatggctttgggggatcacgagattgcggagttgaacaatttgttagagattttggcagaaattgagcgattctatgactgtattggaggaattgttgggtatcagataacagtactggaacttcttgtacaaaaattgttcgagatgcagaatataagctgggcccaccagaggcatgacgtgaaagaatgccaaattttgggaattaatgcacctaatgggcttaacctttctgaagacacagagtatgcatctcaagcagctctatggggtatagagggtttgccagacctaggtgaaatttatccgttgggaggctctgccgacagacttggtttggttgatcctaacacaggtgaatgcctgcctgctgcaatgctaccatattgtggaaggactttgttggaaggtcttataagagatcttcaggctagagaattcttgtacttcaagttatatgggaaacaatgcatcacacctgttgcaataatgacaagttccgcaaagaacaaccacaaacatgtcacctctctgtgtgaaagactttcatggtttggaagaggtcgatcaactttccaattttttgaacagcctcttgttccagttgttggtgcagaagaaggccagtggctggtcaccaaaccattcagtcccttgagtaagcctggtggtcatggtgtcatatggaaacttgctcatgacaaaggcatcttcacatggttttactgtcaaggaagaaaaggtgcaactgtgcgccaagtcagtaatgtggtggcagccacagatttaaccctcctagccttagctgggattggcttacgtcaaggaaagaaactgggatttgcatcttgtaagcggatcttgggtgccacagaaggagttaatgtgctcatggagaagaaaagtcttgatgggaactgggaatatggtgtgtcttgtattgaatacactgaatttgacaagtttggaattactaccggacctcttgctccaaaaggtttgcagacagagttcccagccaatacaaacatcttatatattgatttgccttctgcggagctagttggatcaagtaagagtgaaactagtttacctggaatggtgctaaatactagaaagccaatagtttacacagatcagtttggaagacgtcatagtgtctctggtggtagacttgagtgcacaatgcaaaatatagctgacaattattccaattcatattcatccagatgttataatgatgtggaagataagctagatacatatattgtatacaatgaaagaagaagggttacctcctctgctaagaaaaaaagaagacatggagacaagtctttacatcagacacctgatggcgctctattagatatcttacgaaatgctcatgatcttctttcacaatgtgatataagacttcctgagattgaagctaacgagaactatgttgattcgggaccaccatttctcatccttctgcatcctgctctcggtcctctttgggaagtcactaagcaaaaattttatggtggttccatatcagagggctccgagttacaaatagaggttgcagagtttttctggaggaatgttcagctcaatggaagcctgatcataatatctgagaatgttatgggctcaatgaagattaatgagaacggtgaatccatactacattatggccaaaggtgtggaagatgcaaattgcaaaatgtcaaggtattgaacaagggaattgattggacttgcggtgaaaacatatactggaaacacgatgtgcagcgatctgaggtgctgcagatcatactgcatggaaatgctgaatttgaggctactgatgttgtcttacagggaaatcatgtgtttgaagttccagatggctacaaactgaaaatcacgccaggaagcccaggtttagcaatcaagttggatccaattgatcaagatatgatggagagtggaagctggcactgggattacaagatagaaggttctcacattcagctagaattagtagaatcataa

SEQ ID NO: 10081 - DNA, 279 bp, Glycine max
  Peptide Sequence Number=SeqID_126859
atgctctcaattattttaaatttcattcaagaagaagaagaagaaatacttcacatttactggaagtgtttcggcagaaacgactctacagtcgatgtcgtttatgctgtggcgcgtaaaagaaacacgcgccaagaaagtggccgtttttgtggctatgcgataagggtaacattattagggtattgcattgggcacccaacaaattgccggtatagtccatacaagatggacaattccaatattatcggattcccattacgaattgacaatccgtaa

SEQ ID NO: 10082 - DNA, 600 bp, Glycine max
  Peptide Sequence Number=SeqID_126860
atggaagaatgcaacttagctaagagtccagttgagtttgaattaaagctaagtgttggtcttgatgaaaagccaatggatgccacattgttcaagcaaatggtgggaagcttgagatatttgtgccatagtaggctagatattgcttatggtgtgggtctgggcacacttgattatggcttgttattctccaaagcaaatcataatcaaggaataaggttaattggtttttttgatgcatactggagtggtgatgtagaggacagcaaaatcaccactggatatgtcttcaaattacttggatcaacaatttgctggagttctaagaagcatgaagatattcagcttgattcagttgttcaacttaacatggacaacaagtctgctatatgtcttgccaacaacccaattgcacatggaagaacaaagcatattgggacaaagtaccactatctcagggatcaaatgacgaaaggaagaataagtttggcttattgcaagtcaaaagaacaagaagctaacattctaaccaaagcacttcatggagagaagttttacaagttcagagaaaaacttgatatagtgaattgcttaaactag

SEQ ID NO: 10083 - DNA, 912 bp, Glycine max
  Peptide Sequence Number=SeqID_126861
atgataaggagcatgctaaaattaaaggggctatcaaaggaactttgggaggaagtagtcaccacaactgcttatatactcaatagatcacctacaaagaagttagaagtgatcataccagaagaagcatggacaggaaaaaagccaagggtgagtcacttcagaatttttggctcaccttgttggaaacatgtcccagatgagaaaagaaagaaactggatgacaagagcactgagatgatcatggttggttatcatcccattggagcatataaactgtatgatccaattgagaagaaagtcacttatagcagggatgtgattttttatggagaaagcttgtatgactggaataaaactaagaaggttcagtcaaaaggcatagtatcaaagccttctacgaggctaagtgatttcgaggtgtacactgatgaagcaatcacaagtgaaggagaattagttcactttgctcttctagctgatgcaaaaccattaggatatgtggaagcactgaaggaagaagtatggaagaaggctatgctggaagaactggcaacaattgaaagaaacgatacttggaaactggttaggctgccaaaaggaaagaagcctatcagtttgaaatgggtgttcaaggttaaaaggaaacctgatggaactattgcaaagcataaagcaagactagttttggatgtaaaatcagccttcctcaatggattacttgaagaagaagcctatgtaacacaaccacatgaatttgagaacaaggaaggtagagacttggtggagtatggagtgtatgtcaaggaagagaatggagacataatcatactatgcctatacgtggatgaccttttaatcacaagcagtaatgaagttgtgattcaaactgtcaagaagcagttgcaatag

SEQ ID NO: 10084 - DNA, 252 bp, Glycine max
  Peptide Sequence Number=SeqID_126862
atgccctcctcatcaacaatgcctctctcgcctgagcctcccttcctatgcgccaatgaggccgtcatcgccggactcctcgacgccgagtcacaccacatgccggaaaaggactaccttcgtcactgtcgtgacagctccgtcgacatcaccacttgcttggccgctttcgcacctggacttttcgttgtcaaggtgtattggctccgcgttatatatgagaatgttaccctatccatcatactccactag

SEQ ID NO: 10085 - DNA, 351 bp, Glycine max
  Peptide Sequence Number=SeqID_126863
atgaaattattactttcagcatatgaaaaatgggatacattgtacatctgcacaggcttcaatgaggagtctccctatccagttgttgtgcttcaaacagtgatgaacctgatttggcagaagcagaactggatgacagtctttgcctccttgctttttcagctttttccaagtaatattgatgagattggtgtttgttccctgcaagagcgttgtgttcccgtgtcctctagcttgaggttcttcatagtcatccacctattcatctgctcccccgaacacaagttcaagatcatcacaggatccaaacacaacaatacacagggagtgagctatcacattcctagctaa

SEQ ID NO: 10086 - DNA, 1029 bp, Glycine max
  Peptide Sequence Number=SeqID_126864
atggcttcattgaaactgccagaggttgtcccttctcctacacaagacagtgaacgactcagaaaggctttccaaggatatgggacagatgagaaagcggtgatattggtattgggacacaggaatgctcaacaaaggaaggaaatcagagaaacttatcagcagctttacaatgaatcgctcatcgatcgtctgaattctgaattgtctggtgattttagaattgccagcaaggttttcaaacttgttcttcctaattggttgactacgcttaatttgctaatgaagaatgctgttattctctggagttatgatcctccagaaaggcatgcaggactagcaaaggatgcattgaaggctaagaagaaggggactaaacaccttcaggttctggttgaaatagcatgtgcatcaactcctaaccatttggtggctgtgaggcaggcttactgctctctctttgattgctctcttgaggaggatatcatagcctctgttgctccacccctcagaaagcttttagtgagcctagtaagctcattcaggtatgataaagtggctgtaaatttagaggtagccaaggaagaggcatcaaaactacatgaagctatcaactgcaagcaattagaggatgatcatattatttggatacttagcaccaggaattttttccagctccgggaaacttttgcatgctacaataacctctatgggaatacgttggaacaggacataaaatgtggtaatggtgatttggaatctctcttacatatggtgatatggtgtatagactgtcctgagaaacattttgcaaaggttgtaagagattctattgttgggtttggaaccgatgaagattccctcaacagagctattgtaactcgagccgaaatcgacctgttgaaagtcagatttgaatatgctaatgtgtacaagaccagtcttgatgatgatgttattggggatacctcagggaactacagagattttttgatgactttgttaggtaaaggttcagagggagagtga

SEQ ID NO: 10087 - DNA, 474 bp, Glycine max
  Peptide Sequence Number=SeqID_126865
atgggggtgatgagatcaatgcaagattggcaaaatctgaagctaatattcttcatgaggccatcaaagacaaagaaaggtcaccatgaagaagtaatcgggggatccttagtacaagaagcaagacccaacttgtggcaactttcaacagcttcaaagatgaaaataacatttctatcaaaactattggaggaaacatctgacgacttctataaggctgtcaatgttgcaattcattgcatcaatgatcacaagaagtactatgaaaaggttcttcgcaatgcgataaaaggggttggaaataatgaggatggacaaacacgtgtgtttgtcacaagggcggagaaggacctgaaggacatcaaagagctatattataagaaaaacagtgttcaccttgaggatacaatggccaaggaaaactcaggatactacaagaagtttctcctcactttgttggggaaaggaggctaa

SEQ ID NO: 10088 - DNA, 309 bp, Glycine max
  Peptide Sequence Number=SeqID_126866
atgttaggtatactacaaaaaaaaacatttttccaatggcaaaaatccgtcggtaacgctaaaaatccgtcgctacatggaaatttccgacggattttcgccggacacgaatccgtcggaaaaatggttgtaggaaatataaaccgacagattttttggtatttttcggtgagcaatcaaaatagtcatcataagagtgcctttgttggtcatctgtctgcttgtcatctactaggtcctactgctggtcttgctggtggtgctgctggtcctgatgttgctggtgaggttgttgttgttgatgaataa

SEQ ID NO: 10089 - DNA, 318 bp, Glycine max
  Peptide Sequence Number=SeqID_126867
atggcatttgggaccatggcagctcacacaagcgagctgatgcttcatcctgaagtaactggctcacccagctcttatatgttgtcgccgcttgagctcccttacgccactgcttctctattcttcttcgcatgtttggtctccttgtgtgttgacgaaaacagttttaatgccttctcttctttgttcttcatcgctattgtttggtttgagattaagaaggtttgggtttgtgacattgctgagattgggagtgatttcgtgcagagtggagcgaagtcttcattgtcattccctacttgttggtgctcagattga

SEQ ID NO: 10090 - DNA, 429 bp, Glycine max
  Peptide Sequence Number=SeqID_126868
atggtgggtgcaagcgatgcaaggcaaggcaaggcaaggcgagtctgtgctgaactgaactcttctggaaactggttggacctcaccgtccacacgaggaaggaacaacgccatgtgcggacgcacgtgagaaccgaatttggcgcgtggggtccaaagcaggaccatccagagccgcaggatctgctgacaatggggcggacgcaaccgatccaatcccgacatggcaaaggtgaagtgggggaggaggaggaggaggaggcaagagggtgtggagaggaggatgaagaagctgcagcggctggtttcgggcggcgcccgaatgaacccggaccggctcttcatcaagacggcggagcacatcttgcaattgaggttgcaactcaatgtgttgcaagccctttccaagattttcaacgccagatatga

SEQ ID NO: 10091 - DNA, 147 bp, Glycine max
  Peptide Sequence Number=SeqID_126869
atggagctctacatgcagcatttggctgaccagcaggcagccaaccataggggccaggtgaaggcaggtcccatagaggccccaagagaggaagacaaagccgaggaagacaaagacatgatagatgtgatggatttcttcctttga

SEQ ID NO: 10092 - DNA, 237 bp, Glycine max
  Peptide Sequence Number=SeqID_126870
atgtctatgaacttaggatcgataatggaacgagaggagaaaaggtttgtgtattgtatccgttgttcttctgatgagaacatgaaagagaatgaaaaaagaagaattttgggatttatgggacttgatttggacaagaaatgggcaagatatggtagaaatatgaattgggaacgagggttcgcgagaggattgaagggttgcagttttctgattttgaaatctgaatttatatga

SEQ ID NO: 10093 - DNA, 591 bp, Glycine max
  Peptide Sequence Number=SeqID_126871
atggctgggaatgaaaaggataatggttgtggaggtggatctgatggggagggtttgtcccttggaaactttagccaaggtgcctgcactacttttcttggacacacggataggtttgaattggaatatgggagtcactgtggtaatggtagttgcaatcctgttggtggtaatggagaattgcctaattttatgctttttcacgccactcgatgtgtggagaggcagaaggttcagattctggtgggtttccctgattccggctaccaggatgctgtgtttccatttcatccgaatacgacgttggtttctgaggggatgtgggatgagaaggagaatcgactatgtgcggttgcatgccggatcttgaacttcacggaatctttggttaatccttatgttggagattgcaagactaggctcagtttaaggtttcctgcagttttatctttgaggaacaggagtacggttttggggcagatttggagtgacaaagtggttggtgaatccgggtacttcagtaaagttggatttcagggttcgtcaagggtatcaaaaagcctccaaaggtttcctatacaagtatgctga

SEQ ID NO: 10094 - DNA, 588 bp, Glycine max
  Peptide Sequence Number=SeqID_126872
agagagctgcacgtcctcaccttcacaggattgcacgtcctcgcctttagaagactacacgtcttcaccttcagagggctacacgccctcgccttcagaggactacacgccctcgccttcagaggagtacacgtcctcaccttcagaggactacacgtcatcaccttcagagggctacatgtcctcgccttcagagggctacacgtcctcgccttcagagggctagacgcctcgccttcagaggactacatgtcctcacctttagagggctgcatgccctcgccttcaatgggtgacacgtcctcgacttcagaggattgcatgccctcgcctttcaagggttttcttgggtcaccccttgatcctggaggagggccaactgtgagagcacaaccagaagaggaggctatcacgcagctactatgcatactggggcaagatttcactcgagccgttgcaaaaagggatcgcgcccacaagacacccagtgaacccgaagaagtccaacagggccctggggttctagctcggattacgggcctctgtcggttctatggagtgatcaccactccgatctccccctgctaa

SEQ ID NO: 10095 - DNA, 621 bp, Glycine max
  Peptide Sequence Number=SeqID_126873
atggcatacactcccggtgaggatgtcaataactccgctcccatactcattgaaagtcgacaacctcaaactgatcatgcacatgtctctcaacccatgggggaggcgcatgagataccctacctcatgcggttgtctgtacaaacacaacatctgctgatcctgacccacgggtcaggtggtaggcggacatacccagcagttgtttgtacaaacacaacgtctgttgattctaacccacgggtggccggtggacatacccagcggttttccgtacaaacacaacatctactgatcctgacccacgggtcaggtggcaagcagacatacccagccattgtccgtacaaacacaacatctgttgatcctgacccttgggtcaagtggcaggtggacatacccaatggttgtccgtacaaacacaattttgctaccccaacctatgagaagtcaggtagcatgcagagacacccaagggttatccgcatgcacattcatgctaccccaacctgtgagaagtccggtagcattcagagataccttttggttatccgcacacttgctttcatttttccgtggctatcaaagttctttttatcatcccgagacaaaccagtctag

SEQ ID NO: 10096 - DNA, 282 bp, Glycine max
  Peptide Sequence Number=SeqID_126874
atggttctgatagtgactattgcagctgcattgatctccataatctcctttatgctcatcatggcctccatcattgtggccatttgctctttcaatgcctctctgtcagccttgatctgttcttgtacctcctctacttcacccattactctagctctagcatgcatttggttaattaggcaagtttgtgaagtgctgatcttgatcaagccaatctatcggcttagcgagccatccgctgagcacaccactcttgcggctgagcacgaggaagaatcttga

SEQ ID NO: 10097 - DNA, 313 bp, Glycine max
  Peptide Sequence Number=SeqID_126875
atgaacaaacctgaacaagtgtgggaaaaaacttggcattggttaagtgatgatattgtatatagtcattgcagatcattaaacactccaggattacatattgatgactccaatctgatgaatctggtattgcttgaagttgaacagctgttacaggccaatcaaagatcacttaaagactatccttccatgtcatatcctgagaacgcaaatttactaacacatgcagacaacgacctcattttgtctgagctcaatttcaacaacgaagaacttagatcagaattcttgaaccttttttctcaaatgacag

SEQ ID NO: 10098 - DNA, 567 bp, Glycine max
  Peptide Sequence Number=SeqID_126876
atgaggaaggccctgtatttgcagtatacagtgggagttctgttctattatggtgttaccgtaatcggatattgggcttatggaacaatggtgtcggcataccttccagaaaacttaagtggtcccaaatggattaatgtcctcatcaatgccatcgtctttttgcagtccatagtctcccaacatatgtttgtagcaccaattcatgaggctttggacactaaattcctagaaattgacaagcccatgcattcaggggagaacttgaaacgcttatttctcctacgtgcgtttttctttacagggaacacattcgttgctgcagcctttccttttatgagtgactttgtaaactttcttggctcattttcactcgttcctctgaccttcatgttccctagcatggtcttcatcaaggttaagggaagaacagctagaatagagaagaaggcgtggcactggttcaacatcgttttttcttttctgctcacaattgcaaccacaatttcagcagtacggttgatagtcaacaacatccaaaagtatcatttctttgcagatgcatga

SEQ ID NO: 10099 - DNA, 950 bp, Glycine max
  Peptide Sequence Number=SeqID_126877
ccgcaattgatgctttccttgcatatcaccatagcaaggagagcccggtggtagctatcttggcggacttatttgatacatttgaccgaaggtgcgagaagaacagcgcacggattgtctgctatttacccgctctttgtgtgtggttggtttcgcacctattccaacaagacataaggcacccgtgtccgtttcaaagttatcgctcgtgcgtcgaaaagagaagagtagattgggaccaatacttggctgggataggaggcagcacaatcaactggtttcctcgatggaaggaaggaaaggagggagttctcttctcatgtggggactacccaaacattccgttgatagggacgagggggtaccccatgaggggagcaccgacggaagagagcctctcgcttttccttgtgagagattttggcgtgcaaagtttcaagatcgtacaaagagtccacaaggcgtgggaaagcccgttaaggaaagataaagaacttaggggcatccgtaatggcatcatcggtggttatcatgaatggctaagagttcatacacgagggttagattggccctccaagttgaaaattatcaacgaggagaacttcgaatctccaaaagaggatgaagaagtccaagctctaaaatcagagctaggaaaggcaagactcgccaaagaaaaattcaagttagtcgctacagacatccagaaagagtgtgccgaattacgagaggaaaatgcggctaccgcaagagccctcgaacaagaaaccaagagggctcgcaaggaagagcatggccgggataaaatccgaggagctttgtggggcagcaacaatgagctcaagctccgaagagaggaaagaggaccagtcacgagtacatggcatggtcttaaaggaggagttaagctgcttgctcaagatccaagaggagtttggtccaacacttag

SEQ ID NO: 10100 - DNA, 774 bp, Glycine max
  Peptide Sequence Number=SeqID_126878
atgggtggtgggcgcctttgccgccggggcaatcatcctcatgtccggtcttcgcatcgcggccggcgggcatttcctcagcgatgtggtgatgtccatcctgttttcggccctgacgacactgtttctgtaccgggtgctggcgataagccaccaccgtcacctcttcagcggtgctgccatctcggccgatacgatcagcctttggcgcaatggccgccacgccatacttacccgcgttcggggctggtggccgaaaatcagggctgcagccacccgtctccaacggcccccggacacgggtgcggcgtcgtcttagttgggagttcgaggtgcagcatcgctggggtgggagcgagcggcaagacagttccgacttatcctcggggttgtccctattgcccgcgcgccttgattttatcgacgtggttagctcctcggcacaaggccgaggatcacgccggaaaccgactgttcctgcgcggtccggttgattgcttcgccgagcaggccggcggtgctcaccacgcggatattatgcgcggactggacaccggtggtcggctggatgctgtcggtgatgacgagttcgcgcagcttggaagaggccacgcgggccaccgcgccgccggacagtacgccatgggtgatataggcagtaacgctggtcgcgccctttttcagcagggcttcagcggcgttgcagagcgtgccgccggaatcgacgatgtcgtcaatgaggatgcagtccttgccggagacatcgccgatgac

SEQ ID NO: 10101 - DNA, 228 bp, Glycine max
  Peptide Sequence Number=SeqID_126879
atggcgggaaggggatgctgccattggcagctgcgggacaggaacccagtcactgcccataccgccattcgtactggcgggatagggatgagtaggagagaggagcatgtcaccattggagctggcgggataggagagagtaccgccattggtgctggtgggacgtgccaacatggacagtcccaccattggcacctgtgttacatgtttgatgggactgatgaatga

SEQ ID NO: 10102 - DNA, 288 bp, Glycine max
  Peptide Sequence Number=SeqID_126880
cgctacggcgtgacattcctcgcgccggtgggcttctcaaccgaagcggaagccagcgccagcgatgtcgccgctatcatcaaacagctccgggccgagcacatcaccacctactttatggagaatcagaccgatccgcgtctggtgaaacagatcgccagtgaaaccggtgcgcaacccggtggcgagctctatccggaagcgctgtcagcggccagcgggccggcgcccacctatgaggcggcgtttaagcacaacgtggaaactctgctgcacagcatgaagtaa

SEQ ID NO: 10103 - DNA, 1062 bp, Glycine max
  Peptide Sequence Number=SeqID_126881
atgaacttagccattgacctttcagggaactacctgtggtacgagtgtgatagccattacaactcctcctcttacaaccctgtcacgtgtgtctccccacactgccctcaaggctcaccatgccttggatgcgatggctcccctcgtaagccaggttgcaccaacgacacgtgtgggtttgatgttgtgaaccctttttctgactccactttcatcggtgacatgggtcatgatttcctattcttgcctcaaataaagttgcctcaaacttttgtttatggctgcgcagaaacttctaggttctcctccatccctattctttctggccttgccaaaggcatcaaagggattctaggccttgcaagaacaccacacacattaccatttcagatctcatcttcatttaatgttcctcctaagttcactctttgcttaccttcttctggtaagggcaaacttttcattggtgggagaccaagctcctctattatctcgctttcccaaactggattcggtggcttttctagcaccgaatacttcattcatgtcaactctatcactatcaacgacaaacctgttaagtttggggcttcttttttgttccgcgatgaaaatggaaacgggggcagtgttattagcaccatgagtccttacactgtgttgcaccattccatctacaagccctttgttagagatttcgtggaggcagcaacggccaaaaacataaagagggtgaaatccgtgcacccttttggagagtgcttcgatgccaataccatcaaggatggaaaggctgtgccagatatcaagcttgccatggatggtcgatttaggaaagtgagttatggcatatgtgcccacaattccttggttgaagtgagaaaaggtgtgctatgtttggcatttgttgatggaggtgaattcgcggtaactggtgttgttcttgatggccatcaactgagggatagggttttggagtttgatttgagtacctcagttctaagctttagctcatcccttctgcttcaaaataaaacctgctcagatcattcttctctttga

SEQ ID NO: 10104 - DNA, 2049 bp, Glycine max
  Peptide Sequence Number=SeqID_126882
atggctactcctacttgtgtcttgtatttctgtgtacttgtcttctttgtttcaccatctttgtcagcatcaaatgaatttcctaagaccggatatatctccctccccattaacatagatccaaccacccatcagcacttcacatcaataggcataggaactccacgacacaacatgaatttagccattgacatttcagggagctacctgtggtacgactgtggtggtaattacaattcctcctcttacaatcctgtcctctgggactccccacaatgccctggacccgaacccttccaatccaattgcgatgctggttttccctttaagccaggctgcaccaacaacacctgtaatgttgcccttgataacccctttgctgactttggtttcggcggtgacttgggtcatgatttcctcttcactcctcagatcaagttgcctcaaacctttttttctgtttgctcagaatcttctaggttcccccagttacctattcttgttggccttcccaaaggcaccaaagggagtctagggcttgcaaggcagtcaccattcacattacaatctcaaatctcttcttcctttaacaacgttcctcccaagttcactctttgtttaccttcttctggtaaaaagggacatcttttcattggtgggagaccaactttctctacccctctttcccaaattggatttgatagccgttattccaattacgattacttctttcatctcaactcaattcatattaatcacaaacctgttcaatttaacacttctggtctgtccgtcgatttaaacgacaacgtgggcactaaaattagcacccttcatcctttcacagtgttacaccctcaagtctaccagccctttgttaaagcttttgtgaaggcagcaaagaccaaaaacatgaagagagtgaaaaaagtgcacccatttgggacatgctacgatgccactaccgttggggatcatagagaagctgtgccagctatcgatctagtgttggaagcagaagaattaggccgctttgggaaagtgagttatgagatatatggccacgattccttggttgaagtgaaaaaaggtgtgctgtgtttggcttttgttaatggaggtataagggcattagatgctgttcttcttggtgcgcatcaactcaaggataggattttggtgtttgatgagagcatgtcgggattcaactacaattggcaattccgcaacaactggacactagttgtgccaactattcaaatagtgttgcaagaaggggtgcagtgcaccagtcatggagtcaattccttggttatggcaaaggaaaattgtggtagtcattacaattcctcatcttacaaccctgtcccctgggactccccacaatgcccccatcccgaagcctacctatccaattgtgatagtggtttacccttcactgctcatatctcatcttcctttaacgttcctcctaagttcactctttgtttaccttcttctggtaaaaagggacatcatcttttcattggtgggggtccaactttgatctctacctcgctttcccaaaccggatttggtgatggtaacttttccaattacgaatacgcttttcatctcaactcaatcaatattaatcacaaacctgttaagtttaatacttctgatatccggttcctcgatggaaacggcaacgcgggcgctataattagtaccattcaaccttacactgtgttacaccgttcagtctaccagccctttgttaaagtgtttgtgaaggcagaaaaggccaaaaacatgaagagagtgaaaaaagtgcacccatttgggacatgctacgatgccaataccattgcggatgtgccagctatcaatctggtgcttgaaagccgcattgggaaagggaattatgacatatctggccacgattccttggttgaagtgagaaaaggtgtgatgtgtttggcatttgctgatggagctaaacaggcattttgtggtgttcttcttggagggcataactcaaggatagaatcttggagtttgatttga

SEQ ID NO: 10105 - DNA, 552 bp, Glycine max
  Peptide Sequence Number=SeqID_126883
atgtttgggaataattttattgtatggttgcaacacgcaactaagttgatgagcgatgaagacctcggcaagggagatcaagcatctataatagggggtgttatagaattcatcaaggagctacaccaagttcttcaagctttggagtcccagaaaagaagaaagagtttgagccctagccctggcccgagcccacgaacacttcagccaatgtttcatcaacttgatagcccctccatgattgggaccaattctttcaaggaactaggagcaagctgcaactctcctgttgcggatgttgaagtgaaaatctcgggttcatatgtgatcttgaaagtcatttgccacagaattccaggtcaagttgcaaagatcataactgttttggagagtctttcgtttgaagttcttcatctgaatatcagcagcatggaggagactgtcctttaccaatttgttgtcaagatagagctgggatgccaactaagtctggaggaactagcaatggaagtgcaacaaagcttctgcttagatgctataattgcgctgtga

SEQ ID NO: 10106 - DNA, 462 bp, Glycine max
  Peptide Sequence Number=SeqID_126884
atgccacccactaggcaccctctagacccggataagtctaacagggccctgggggttcccgtcacacctagtaaggtgatccggccgccgatcacccgagccttcattgagaagtattgcacgcctaggcagacgcagggtgatgcgccacaggccgcacatgcaccgccaccacctcatcaggctgatcctgctgggtcattaggcgtggagcggtatctacagcacttgatacacgagtgtctctaccagctcagcctcagtcaacagggccagggttctgctccttttacgtgccctactccagatcagtttagggctgaggtcgcatggcccgaagattggcccaaggcccaggaggaggaggcgcctgcaggagctcctagtgatgcagaggaggctcgcatggatgaggagatgatagacttgctcgacttcttgggaggaagcggaggcacgtga

SEQ ID NO: 10107 - DNA, 240 bp, Glycine max
  Peptide Sequence Number=SeqID_126885
atggaaaatgagaatccacagctatacaccgttttccccttttgcttcatccttggtcttgtggtttcgttggagaagaaatacagactatcaaaccaaagtatatgtttttttggtaaatgtcatgtcatattttcatggatgaaggatgctagtgattttgtcaagttctattgtagccatgaaaagaaaaatggggaggttgtgaacatgatcaagaagtctaaagcaaaaggttag

SEQ ID NO: 10108 - DNA, 1182 bp, Glycine max
  Peptide Sequence Number=SeqID_126886
atggatgtaaaaggcataacttgggttggaaacatattccagacgtttgaggatatttatgtggacgtggaagacacaatgttggaggaaaccgttaagtacatagggaatcaaatgcagactgttggggaaagcgttaaaaagatctattcagatgtaatgcaagatttacttcctccatcttcatatgatttggatgaaacatcagcccctgagttgcctatagatcaatatgctgatgctggattctcaaagaagtcatttcaaggttccaaaaaaataactgtaaaggatgataccaaccaaatgactgaggattcaaggatcaatcatgatgttgataatgatgtaatccatgctgaattctgtgattctgatgctttgttcatatcagcttcttgcaactctgtcaaaaggaataattttattgcacatgcaagacaatatgttggtagcacacatattaaatcaaacctcggtggtgatgaaaatcaacaaaataaaaatatgcctgcatccaagacagtcagtgaaatcactttgttaaaaacagatacatgcagtatatcacaatcatgtgaagtctcccgggtaaatcaaaatcatgcatccactgtttctaaagcagcttcttctgaagtaacaaccattgcctctgtagctgactgctgcaatgaaatagaaaatgcaagtactgaagaaatccccgatgtgctggtattggctgaatcagcagaagagaaagagatgcatattatttcatattcttccagtgttctattaggagatccatatggggtcactatggtcagaacatttgagcctgacaattattcttaccactcaatcattgcatctcatccagagcaaggccataaaaccatgcatcaagatgatgaactgaagcttgaggaaacttgtgttatggtggctagagatgaacttcaatcagttcccaatgcaaggggtaatctaataactagcaagaacaagaagaggcaacccttttctttgtccaagaaagctacaaggaggcaagagtatgaggagcttgcaatattgcaccggaacaatgaaaaagaaaagggtgattttgcagagaatttatgttcaactttacaggatgatcataagaaactactgcttcctgatatctatgaacctgagtgggagcttctctaa

SEQ ID NO: 10109 - DNA, 244 bp, Glycine max
  Peptide Sequence Number=SeqID_126887
ggctgatgaatgggatgtcaacaaatgggcatgggaagggatattgaaagtcactagcaagggagaagaatgcatcataaaacttgaagataagagcacaggtgaattatatgctcgggcatttttaagaaatggagagccgcatccagtggaacctgttattgacagcagcaggtggttttccttggctgttaatagtttaagttgtttgttatcataccttttttcagttcaggatgcttaa

SEQ ID NO: 10110 - DNA, 1588 bp, Glycine max
  Peptide Sequence Number=SeqID_126888
tcctacagaggccacgtgccttactctaactgctccccatttcctctttttacaaaaactgcgtcaagctctgttactggacccccaatacgtggccctcctccaagatattcgtgatcatcctacgaatcatcccgatattaccactcatcaagacctccttttccgacacggccgcgtttggatccccttcgcaaccccattcactcgggttctattagaggagttccattcgtcgcccctcgggggtcataccggagtcacgaagacccttcatcggctccgccagaatttcgattggccccaccttaaggatgacgtccgtcggtatgtggcccaatgcgccacgtgtcaacagacgaagtatgacacgaagaagagtgcagggcttcttcaacctcttcccatcccttctcaggtctgggaagacttatcgctggacttcgtgacagggcttccgttatcccaggggtacactgtgatcttggtcgttgtcgaccgattttcgaaagcggcccatttcggtgctctccccacccatcacaccgcttacaaggtggcggttttattcctggacatggtatgtcggcaccacgggtttccacgcagtttagtgtcggatagagaccctatcttcatcagcaacttctggcgcgagcttttccggttgagcggcaccaagctccggatgagcaccgcctaccacccgcagacggacgggcaaacggaggtgctcaatcgtaccctcgagcaataccttcgtgcttacgttcatgatcagccatcacgatggtaccgtttcctctcactcgccgaatggtcttataacacgactctgcattccagcaccgggatgactccgttcgaggcagtctacggtatacccccgcctacggtggcccactatctccaaggtcactcctcgaatgatgctgttgactcgctactcaccacgcgcgtgcaaatccacgcccaattgacccaccgtctccaatgggcacaggaactcatgaagaccgccgccgatagacaccgccgcgatttatcctttgaggtgggtgactgggtatacgtccgcctccgaccataccgacagacgtcaatagcccccaaatactccaagttagccaaacggttttatggtccctttcagatttcggcgcgcattggcccagtagcctataaactcgcgttaccggcatcctcgcgcatccacccggtcttccacgtgtccctcttgaagctccaccaaggcccctccccagcctcaccagggacgctccctgagctctccacagacaaccatcccattcttaatcccttcgcaattctagattggaaattggactcttcggtcacaccgccggtgaagcgtgtgctggtccagtgggatgatctccctccagaggaggcatcttgggaatcttgggatgagttaaaagttcttcacaaccttgcggacaaggtcgtttttgacaaagggggtgttgatagtaacacagcaacagcagaccaacatcaacatatggatacaagcaggcctaagagagagtgtaagaagccagcttacttgcgggatttcatttag

SEQ ID NO: 10111 - DNA, 1977 bp, Glycine max
  Peptide Sequence Number=SeqID_126889
atggcgtctgaacaattggctcgcagagagaacaccaccaccgagaaggagattcacgttgagaaacacagggttcccaagatggccacccacttcgagcaccttgcggagcaagctaaagaatctgacatcaccgctgggaaggatactccgcagggtagcatagaagccttgcaagctggagagagggtcaaagatcatgcaggaaaagccatgggagatattggtggacgtgggaaagccagagagactcacgagctgggtgcacactttgaatccctggctgacaaagtaactgaccatgcagcagccaatgtagttggaaacaaagagagtcaaagagaagctcgtggtggtgttcgtgatgttgggaagttcgaaatgagaactgaagggggagaaaaaggaaacaaggatagaccagaactgaaaacacgaaccagagaggtaataggaagaacggagaaagaaagaggaagagaaagtggaggacaagtagtggcagagaaaggaagagaaacagaaactgcaaggggaagggttggtgctgaaaatgaaggtgcaagaacaaccgctgttataacttgcacgttggaaaaaggtggtggtactcagaaaccaataagagaagaagagagagagagtgaaagtgaaagatcagcgtgggaacagatttccaactacagtgatcaagccacacaaggtgtgaaggaaaagtacgagagagcaaagcaagcagcaagcgagacactgaacaccacaacacaaaccgcacaagagaaaagcgcacaggcaaagaatcttgcagcacaagcaaaggacgcaacgttagagaagggtcagcaaggctatgctgtgacaaaggacaccatttcaagtgcagcgaaaaccgcttcggagaaaactgcgccagtggcagagaaggccaaagactacactcttcaggctgcggagaaggccaagagtgcgggtggcacaacggcgagttacgtcggagagaaagcggtgcaggccaaggatgtcgccgtggagagtgggaagagtgcggctgggtatgctgccaaggtggctgctgatttgagggacaaggccaccgcggtggggtgggccgcggcccatttttcggcggaaaagacggtggaagggaccaaggccgccgcccatgttgtcgagggagcggccgggtatgccggacataaggccgcggagcttgcttcgatgtcggccggtgctgttaaagggctggctgcttctgctggtgagactgctaaggaatacaccgcaaagaagaaagaggaggcacagcgggaattggaggccaaaaaaccatctcaacctcagaaccagagtttcatgcatgattcaaaaagtcaacattttgatgaggaagctgaagagaggccatcagaaggaattggcgaaactgtgaggcagtatgcacaaaaaccaaagccaagtgaaagaaaccctcagaaggagggaaccggaagcatcgtgtttacagcaataggcgaaacagtaagcagtgccggtgagaaggtaaagaaaccgtttaaaaacactatgggaggagaaagtgaaggaggaggagggaaagaagaggggaagagtgtcattggtaaaagtttgaccagcattggtgagaagctgggtgatgcaaaacagagagaggagctgttagacaacgtcactggcaacatcaccgagggaggaggcgaggtgttgggagcagtaggtgaaaccgttgctgagattggacagaacatgatgaagccagcggagatagttcaggaacgcgctcacgttcgacaagcgggtggggtcttggatgccattggtgaaaccattgctgagattgctgaaacgactcgagtcatggtttctggagaggacgagagagtgctgaggcagagcgtggtgttggagactcgcgtaactggtcgtgccaagcatgaagaagggtcgcacggtgcttga

SEQ ID NO: 10112 - DNA, 630 bp, Glycine max
  Peptide Sequence Number=SeqID_126890
atggtgatatgccagcccacaattggctatggagggaatgtgaaaaatcatcagacaatgttgggctgcacatttggctgtgatcccactagtccagttgggggggcaagttttatggaggctggaggacttgatgctgggccacgcctggtgaaaaaattagttggctttggagataataggacatctaagattgcggctagaattgctgatgaggaagttgcacatgtagcagttggtgtctactggtttgattctatctgtgaaaaactgaattgtgctccagatttcacttttaaaggttgtgaagtctggcatgcaatcttcaacataattttctgtaaccatgcagacttactaaaggaatacaatgtggaactaaagggtcccttcaattattcagctcgagataaatctggtattcccggtgattggtatgatgatgcatcatccgcaagcactaaggacaagaaagacaaagatggcaatcaaaaacagctctctgcaaggcttagcgtgatgctgaagttgaacgaagtcaataatagttgcttagcttcttggatatcgtgccatggcattagatccttgtacttttttatccgtaaggtagtgtttgataaagagtga

SEQ ID NO: 10113 - DNA, 1647 bp, Glycine max
  Peptide Sequence Number=SeqID_126891
atggaagaaagggaaaacaaagagataaagatagccaggttttcaagttgtcgtggggttgcatttgaaatcaatccaaatagaagcaacccctttgcaattggatcaccaccaaagcaggaacggattggaacttggctatggcttccatggactcgaaacagttcattcaaagttcttcctcagcctcataccattagtccaactcggagccgtgccagcagccacttctgtgacattgacattgatgcaagtgattttgaggtagagttcatagccgaagttcaagatatagaaaaaccggataaagctaatgtggttaaggtgcaaaagctacttcccaaaagtgatccaccaaggaggtcaaggctctccataattttgcttgatcaagggttcacatgctacaaagggctatttctggtttgcatggccttgaatgtggtggcattggctctttcagcagcagggtgtttcccttatgccaagacaagagctgcattgttctctattgggaacattctagctctaacactgtgtagaagtgaggcagctttgagagttattttctggttgactgtgcagactcttggaaggccttgtgtctctcttagaatcaaaactgccaccacttcattccttcaaagtgttgggggaatccatagtggttgtggtgtttcttctatagcctggcttgcttattccctagttcttacattgaaaaacaaagacaaaacttccccagagataattggagttgcattcaccatcctctcactcattctactctcttccttcgcagctttccctcttatccgtcaccttcatcacaatgttttcgagagaattcaccgtttcgccgggtggatggctctcatccttctctggctattcattcttctctccataagctatgaaccttactcacacacctatgacttgaccatgtctaaggtggtcaagaagcaagagtgttggttcactttagccatcacaattctcattatcattccttggctgagtgttagaaaggtgcaagttaatgtatcatctgcttcaagccacgcctcgatcatcaagtttgaaggtggtgttgaagcaggtttactaggtagaataagtccttcacccttgtcagaatggcatgcctttgggatcatatctgatgggaagaaagagcacatgatgctagctggtgcagttggtgacttcaccaagtccttggttagtaccccgccaaagcatctttgggttcgcaccatgcattttgctggattgccttacctagtgaacttgtatcagagggtgttgttggttgccacagggtcagggatttgtgtgttcttgtcatttcttttgcagcctagtaaggctgatgtgtgcttaatatgggtggctaaggacattgaattgaactttggaagggagataatagagttgatgaacaaatattcaaaagagaaggtgatagtgcatgacacagcaatttctggtcgtcccaatgtggctgagatgagtgtgaatgctgccattaagtggaatgttgaagtggttattgtcactagcaaccctgaaggcagtagagatgtgcttagagcatgcaagagggctaacatccctgcctttggccccatttgggactcttga

SEQ ID NO: 10114 - DNA, 258 bp, Glycine max
  Peptide Sequence Number=SeqID_126892
ggtgatgcaccacaggctgtagacgcaccgccaccacctcttcaggctgatcctgctgggtcatttggcatggagtggtatctacaacacttggttcgccagcaggcggccaaccaccgggggcaggtgcagatacatgagtgtctctaccagctcagcctcaatcagcagagcatggatttcgttccttttgcgtgccctactccagatcattcaacggctgaggtcgcatggcccggagattggctcgaggcctag

SEQ ID NO: 10115 - DNA, 1188 bp, Glycine max
  Peptide Sequence Number=SeqID_126893
atgctccaaccatatgagatcagcataggcttaaaggagcactcaaacccggtgacccccaaggcctacactccgaagagtccgtcagggcctctccctcctgattcagtgtctggcatccgttctggctgcacaaatgcacataaattcactagcattaatcttgtaggagggttacccaaaggcagcaaagggatgttaggccttgcaagatcagaacttgcagtgccaactcagcttgcactgttgaagaaactccctcaaggacatgaacatcctcgggatgtgtccaaacatgtcaaaaccactcctcttgttgtcaaccactttgacacaggtcctttgtttgaggaagtgactccctttgaggcatgtttcgattcgagaagcattggaaattccatcactggctttgttgtaccaactattgatcttgtacgtgctacaagggggagtgcaatggcgaagaaaaatgtagcatgccccgcatttgttgatagagggacaatggcaacaatgtcgttttttaaagcctcaattgttataggtgcgcatcaattggaggaaaatcttttggtgtttgatgtggcttcctccaaattaagcttcagctcttcgctttcgctccacaatgtgatagtaacacagcaacagcagaccaacatcaacatatggatacaagcaggcctaagagagagtgtaagaagccagcttacttgcgggatttcatttagacgccttgcggccctgaccgtatcaactggtccgacctgcctcccgtcctccgccatgccggagcaccacacacgccaggttaccaccgataaattggaagaagcggttaaaaccctctcccaggacaactcatctctgaacaacaaaatcgataccattcacgcgtccctcaccgccaagattgacgcacttttcgatcgtttcgccgccatcgccgttaattcccctcagcccccaccgccaacaccagtacattcttcctcttcttcccaccgccatcacacgaaattggaagtgccacgcttcgacggccacgatcccctcggggcattccagagaacgaacggctcaccgtcgcatccttctacatggaaggacccgcgttatcctggtatcagtggatgtgtcgcaacgggttctttccgtcctggccagcgatgctacaggccctag

SEQ ID NO: 10116 - DNA, 180 bp, Glycine max
  Peptide Sequence Number=SeqID_126894
atggttggagcattctcgcaaaacatcgtgaccctgactggtctccctatgatcttacttagtgagagtgacctgacaaacccattgtgtgctaggaatgtgataactcactccctgtgtgttgttgtgtttggatcctgtgatgatcttgaacttgtgttcgggggagcagatgaatag

SEQ ID NO: 10117 - DNA, 1062 bp, Glycine max
  Peptide Sequence Number=SeqID_126895
atgggattacccccttcgtgcctgctaagctgcttcgtttccggcttgattccggaactcctctgggaggtccaagcactgcggccgttatctcttccccacgccacggaactcgcgcgtctacaagaggataagctcttagaccgccgccgcggccaacgctcgtcctccacaacccttccacccaaaacagggcatcctcaaccctcaaattccaccaaagtaccaatcaagcgccttacctctgaggaactcgcggtccgccgcgaacaagggctttgctaccactgtgaggagaagtggtcccacggccaccgctgcagacctcgtctccacctcttcattgcggacgatgacctcgagcctccggcggatttcaacacgagcgacatcccgaaccccatcactgccgacctcgagattaccccccaaatcagcttgaacgcaatggagggcactccagccccccaaacgttccgactcctcggccagctgcgccgtcatcaagtgatcatcttaatagatggtggctcgactcataacttcattcaatccaggctcgcacgtttccttgccttgtcgaccaccccaacaaccacccttagggttatggtaggcaacgggaacactctagaatgcaacactcagtcccttcagggcgtccagtggcttaagcaactaggcccaattaccactgattaccagcaccttaccatgactttttctcatctgggccgcaacattaccctctatgctgatgcacccccatccttatcccctgcgtcagcccaccaactaaaacggctagcccagactcagagcatctccgctctctaccacatttccgcgttaccaatagacaccccttcctccacatgcaccgctaagctccctgtccctgagcccttacctcctcaaatagtatccatccttgaacgctttccagcaattttcacagaaccctcaaccttaccaccctcccataatattcaacatcacatacacctactccctcacaccgcgcccatcaatgtacgcccttatcgttatccccatttttag

SEQ ID NO: 10118 - DNA, 246 bp, Glycine max
  Peptide Sequence Number=SeqID_126896
atgacaatcaattcatggggctccggacttgatggtggaggacgcacgaacaactctaggcaagcaattcatggggctccgaactcgatggctatcaattcgtggggctccagactcgatggtagaggatgcatgaatggcattcaattcatggggctctggatcagatttgatggtggaggatgcacgaacagcactaggcaatcaattcgtggggctccggactcgatggtggaggatgcgtga

SEQ ID NO: 10119 - DNA, 273 bp, Glycine max
  Peptide Sequence Number=SeqID_126897
atggctactcgagtgtctatactaattgcactaatcatcctctccaccttcttcatgactttgcaggctagtaatctccatggccatcccttcattcgtgaaaataatattgcagatagccatcactttcttcacaaatatttagacgacctatcaaagcatatacatgttcaagatgctgatgatgcccctcacaaagatggaaatacgcataggctcgcaccagagggaccagatcctcatcataattttgcaacaccaccaagaaactaa

SEQ ID NO: 10120 - DNA, 348 bp, Glycine max
  Peptide Sequence Number=SeqID_126898
atgaaatcaaaatcaaagaaacataaacttgagaaaagaaacaaacagagatggccgagagagagaaacctatcagtgagaggaagaaaagattatgatgaacagaagaaaaacttacttgtcaatggaggtgatagctcgggatgccaagaatgtgatttactgatgatattgttattaatgatctttgtcgcaacctaccctttggtaggggcacaaaaaggcctctcggacgggcctagggtgcgtattccatcgaaggaaaacgaatggagtcaccaccaatgtttattcaaggaaaatgttggaaaaaccaaattggaaaaggttgaaggtttgcgtatttaa

SEQ ID NO: 10121 - DNA, 478 bp, Glycine max
  Peptide Sequence Number=SeqID_126899
cgagcgtaacaacggcgaggacgttgtcatccttggacgtgtcaaactccacgccgacgtagttagagacgttgccgccgtcgccggagacggagaaggagaactccatggagaggaatgtcaaggcagagaaagcgaagggctcgtagcggcggaagatgccgaagaaagaaggggaagtagtaacgttaacatcaatagagtcaggcttgtgtttgagaacacgttgaaccacgttcaatgccaaagttttgtcgctaacccatatctgttggaaccaaaatgcaaagtcaccagatggcaatgcccagaaggagttatcagcttgtgcagtgagggaagtggccaaggaaacgttcctgagaggatcacggaagaaaaattgaaaatttcacaactgatgagtgatgaccgtggaggtcctgtcatcggtgacaagggaagtggtgcacttatgatggacgaagccaattattaa

SEQ ID NO: 10122 - DNA, 372 bp, Glycine max
  Peptide Sequence Number=SeqID_126900
atgccaactcccagggatcttatcagtaactattgtcttctgagaaaaggtgaagaagccaatagcttgagtaaacccgtaaggcttcgaagttcaaacccactgtctcagactcaatctcgcgtggatagtttagctgagaattcaagaacagaacctcgaagaggcaatggtccaaaacctgggtcagacatgaagatgaacgcgattaggtcagggatagtggtgctgggagctcttgcattcgggtacttgagcatagaaattggcttcaagccttatctggagaaagctcagaaccagaacgcgctctaccaatctgacccttctcaggaagaatcatcttcagctttctcagaacgcccttcataa

SEQ ID NO: 10123 - DNA, 153 bp, Glycine max
  Peptide Sequence Number=SeqID_126901
atgggagaaacagaactcaaaaccctactttcgttaaatctttcacaggcctatgaaaacaaatgccttaagtggaagatgcagcttaattacttgaagagaaatggagaaatagcttccaccattaagtcaaagatcattaatatcctttaa

SEQ ID NO: 10124 - DNA, 375 bp, Glycine max
  Peptide Sequence Number=SeqID_126902
atgaatctacaatgttgtagacttgtagccattgttttgcagctttcaagagggcttagctttttggcattcctggtgttacttattcacttacccaggggtcaagccttcgttgataaagacaatattgaaatgggtaaactgtccgaggatgctgtccatgtaaagcatacaacctgcaaggaccacaaaaggattctcctgtctcagagatttaagccttgttttcaaaagttggtggggttactgacatggatacagctggaggaaataattttaggacatccaaatatacttcactgctggaattttcaaggttccactagcattattgatcggtgtttgagatcacagaaaattgcacatattgattag

SEQ ID NO: 10125 - DNA, 1122 bp, Glycine max
  Peptide Sequence Number=SeqID_126903
atgggggacgccaacttcgccttcttccttctctttctccttcccgcgtttcttctggcgctactctacttcctcgttcgtccgcgtccagtgaagatccccatcaagaaccggcacgtgttcatcaccggcggatcgagcggcatcgggctggcactggcgcaccgcgccgcggcggagggcgcgcgcgtctccattctcgcgcggtcgccggagaagctggaggaggctcgcaacgcgatccgcctcgccacggggatcgaggtggctgcgttcgcggcggacgtgcgggacttcgatgcggtgaagcgcgcggtggacgatgctggccccatcgacgtgctgctcctgaaccacggcgtgttcgtggcgctggagctggagaagatggaattgagtgacgtcaagttcaccatggacgtcaatctcatgggaacgttgaatctcatcaaggccgcgctgcccgcaatgaagaaccgcaacgatccgctgcccgcttccattgctcttgtttcctcgcaggccggtcaggtgggaatttatggttatgtagcttattcggcaagtaaatttggccttcgtggtttagcagaagcattgcaacaagaggttatagcagataatattcatgtttctctgattttccctccagatacggatactcctggattagcagaagaaaacaagagaaaaccagagctcaccaaaatcattgcagcctcctctggttctatgaaagctgatgaagttgctcagaaagctttggatggtataaaatgtggcaattttattgtttcttgcaatttcgagggaattgcactatctctagcaactgcaggtttatcccctcagagatctttcttaatggcatttcttgaggttgttgctgctggaatcctacggattgttgcactaggtatgcagtggacttggtatggaagcatagagaaatatcacagccaaaggaaggccgacatgggaaatggtgtgaggttgtggcaatcaattttgctcgcttggactacagaggtggctaaattaacccatttttctctcgggaaagtgaaaatcaaatcacatgacggtgttgggcacatgaaattggttgatttggttacctaa

SEQ ID NO: 10126 - DNA, 1210 bp, Glycine max
  Peptide Sequence Number=SeqID_126904
gtccccgcagcaatacgtggaagctatgccagtgttggagactttaaggagagtgaagcgtttaagtgaactcgcagggaaattcgggttctcgggtcaatcagagaggtttacttggtcgcatgagaaaagaggttcagtagagaaacgtgtgcatagagttgaatttcttggagaaaagggaggtggtggtggtgggtgtgatttgtttgaaggtaactgggtttgggatgaaagttaccctttgtatcagtcaaaagattgcagcttccttgatggaggatttcggtgttctgagaatggaagacctgatttgttctacacaaagtggaggtggcaacccaaagcttgcaacttgcccagtcgaagtaaacctaaaattgaacttctcaataagcacagattcaatgcaacaataatgttggaaacgctgcggaacaaacgcctagtgtttgctggggactcaattggtagaaaccaatgggagtcactattatgcatgctctcttctggagttccaaacaaggaatcaatctatgaagtgaatggtagcccaattacaaagcacaaggggttcttggtattcagattcaaggattataactgtacagtggaatactacagagctccatttcttgtattgcaaagcaggcctcctcctagaactgatagaaagattaggacaaccctgaaattggatcaaatggattggtactctttgaaatggagagatgcagatgtcctagttcttaacacgggacactggtggaattatgagaaaaccataagagggggttgttatttccaagaaggtgcggaagttaagttggaaatgatggtagaagaagcatataagagaggtggagattggagaaaaggcggaaactgtaatttggaaacactgccagagcttggttcctcattggtgcctaatgataactggtcacaattcaaaatagccaattctgtgctattagcacacacaaacaccagtgaagttttgaaattcaagatattgaatgtaactcagatgacatctcagagaaaagatggtcattcatccatctattatctcggtcctaatgcgggccctgcacctccccatcgccaagattgcagccactggtgtctccctggtgtaccagatacttggaatgagctactttacgcattgctcctaaaacatgaaacttctcatacatggaactag

SEQ ID NO: 10127 - DNA, 201 bp, Glycine max
  Peptide Sequence Number=SeqID_126905
atggaagtttctcggggtcggcgtcatctatgggaacgatgtccggtgaagacacaagagattgcacctcattcaaaattgaatttgagtaaatggaaggttgtgttatgtcctctgctaaaatggtcttatgattgcattgaccttcgggggttgaaatcactattcggagatatattggcttacctcactagagtctag

SEQ ID NO: 10128 - DNA, 531 bp, Glycine max
  Peptide Sequence Number=SeqID_126906
atgacacccggtttggtgaagcgactcaccaagtcattgtctgcaactcttgggttcagatcttcttcctctgtcgccaaggttacaactggaactgaccttctctcgattgcacataatgtttctcttcagaaagctctcacgtgggacgaaggcgttgcttctatgccattctcattttcaaaccatttttatccttttggctcagttactataactaatgtcctctccccacgatgtttcagtacaagaaagtggtcatatttggaatcccggtactttcacactccgcaatcgtatcacgaccacaatgcggtcatatcagccgcatttttctgcaattgtttccaatgggtttgttcagaagaacatgttccaacttacatggataatattgataagtttaaggctaagggaatccatgccgttattcgtgtctcgattaatgatccatttactatgaatgagtgggcagagaagcttcaaggcaaagatgctgtaagttttatacatgtcttcttgccttactag

SEQ ID NO: 10129 - DNA, 153 bp, Glycine max
  Peptide Sequence Number=SeqID_126907
atggtgttgatagtaacaatagtggttggtggtggtggcgacgttaatggtggcgtaacaatgacgatagtggtggtgctgtgtggtgctaataaaggtggtaacaatgatagtgccattagcattgatgatgtagtgacggtgacaaactag

SEQ ID NO: 10130 - DNA, 600 bp, Glycine max
  Peptide Sequence Number=SeqID_126908
atggctgctcgtaacatcgagaagatggcctcaattgatgctcagttgaggttgctggcaccacgcaaggtgtctgatgatgacaaactcgttgagtatgatgctttgttgttggaccgcttccttgacattcttcaggatttgcatggtgaagatatcagacaaacggtccaagattgttatgagctgtcagctgagtacgaaggagagcataagcctgataagttggaggaacttgggaatatgctgactggtcttgatgctggggattcaattgttattgccaagtcattttctcacatgctcaatttggccaacttggcagaagaagttcaaattgcgtaccgaagaaggatcaagttgctgaagaagggtgattttgctgatgagaactctgccattactgagtcagacattgaagagaccttcaagaagcttgtggctcaactgaagaagacaccccaggaaatctttgatgctttgaagaaccaaactgtggatttggtcctaactgctcatcctactcagtctgttcgcagatcgttgctgcaaaagcatggaaggtatatctgttacattatatttagttgttttaactaa

SEQ ID NO: 10131 - DNA, 402 bp, Glycine max
  Peptide Sequence Number=SeqID_126909
atggattgccctggatgtgaaaacaaagtgaaaagtgcactgcaaaaacttaaaggcgtggatgacattgaaatagacatgagcttgcaaaaggtgactgtgaatggctatgctgaccaaaagaaggttctgaaaacggttcgaaaaactggtcgcagggctgaattgtggcaacttccttacacaacggattctcagaaccaatatgttcaacagcaccattgcaatggccctgtcaactattatgcttctcaaccttcctcatcttataactattacaagcatggttatgatagcagtgatcctcgctattataactatccctcagaatcttccatctttggccaccaaactggtgcaacttttagtgatgacaatcctgacgcttgtgccattatgtga

SEQ ID NO: 10132 - DNA, 966 bp, Glycine max
  Peptide Sequence Number=SeqID_126910
atgactgcctccaaggatcgcgagaacttcgtctacatcgccaaactcgccgagcaggccgagcgttacgaagagatggtggaatcaatgaagaacgttgcgaatctcgacgttgaactgacggtggaggagcggaatttgctttctgttgggtacaagaatgtgattggtgctcgcagagcgtcctggaggatcctgtcttccattgagcagaaggaagaaacaaaagggaacgagttgaatgcgaagcggattaaggagtacagacagaaggttgaattggagctatcgaacatctgtaatgatgttatgagagtgattgatgagcaccttatcccttcggctgcagctggtgaatccactgtgttttactataagatgaaaggagattattatcgttatcttgctgaatttaagtcaggcaatgagaagaaggaagctgctgatcagtctatgaaagcatatgagtctgctaccgctgcagcagaggctgatttacctcccacacatcccatccgattgggtctagctttaaatttctctgttttctattatgagatcttgaactcccctgaaagagcctgtcatcttgcgaagcaagcttttgatgaagctatttctgagcttgacaccttgaatgaggagtcatacaaagatagcaccttaatcatgcaacttctcagggacaacctaactttgtggacttctgacatcccagaagatggagaagatgcccagaaagtgaatggcactgccaagcttggtggaggtgaggatgcagaggtgagtaatcctttctatacctgtaccttgagtccgatggatgatggaatcttccataggattcgatgcatgcgtttgggaatgaaacatgagggccgattacttatctgtgtattagctagagatagggattctattgtttcctctttgtttcctgttggattgcccaatacttcccgatag

SEQ ID NO: 10133 - DNA, 948 bp, Glycine max
  Peptide Sequence Number=SeqID_126911
atgtttcttcttcaattccaggttacctgttgcaaacatgaataccatctgccgtgtattattgaatggtcaaaaagaagcaaagagtgcccaatatgttggcaatcacttgctctgaaagaccctgactgccaagagcttctagctgctgtggaagctcagaaacgtatgatattaagaaacttggctaattctcgtgccccccttggacagcttaatgatggccatgatttttgctcagatgaccctgattatgaccagattatgaggcgcctagattctgccgtaaaaagagttcgttatgttccgggacaggaaaggaagagatcacctggtgctggtacatccaaggttcttggtaactcttccatgcatgtttctgggctgcaaacaacacttacaacttcaccatctgggggtagttcaccagcttctggtgttccatctactgttagcattcaacctccagcattaaatactaatcctgatagtgcaaggagaccaaacacttctgatatgttttccttccccaagtccttcaaatccaaattttcttctgcttcagccagatataaggaatcaatttcaaaaggtacacgcgaccttaaagaaaagttacttgctcataatgtctcagtaaaagagctgagtaaaggtgttcagcgcgagatgaatgcaggcattgctggagttgtgcggatgattgaacgccttgatcttagctcaaaacggtcaagttctcctctcattgctgtccatagcggggccacttcagacttcccttcttcaaggaagcctgttgaagagaatggcattgggggttctcctagtaaagagagtggaggtgcagttcatgatgttagttcagatgttctcccacttgttactaacatgcaatcttttcaaacggaaactcctccatttgttcaggttactcctaatctataa

SEQ ID NO: 10134 - DNA, 778 bp, Glycine max
  Peptide Sequence Number=SeqID_126912
atgagttgctgctgtgagtccaaaggctgcaatgaaggagccaaggttttggctgtcatttttgacttagatggcacccttttgaatactgaaagggcaacaaggggtgttttgaatgagtttttggcaaggtatgggaaagaacttgacagggagaaggaagagaagaagaggttggggatgacacaaaaggattcagcagctataattgtaaatgactatgaacttccattgactcctgaccaatttatcaaagaaatcactcctctctacagggaaaggtgggcaaaggccaaagcattacctggtgctaatcgccttgtcaaacatctccagaaaaatggagtgccaatgggtcttgcctcaaattccttgcgagaatatgtagatgcaaaaatttctcatcacaaaggttggaaagaaagcttttctgtaattcttggaagtgatcaagttaagtctgggaagccttctccatatttatttgaagaagctgccaagaaaataggtgtagatgcaattaattgcctggtgattgaggattccttggttggtgtcaaggcagccaatgctgcaaaaatgaagatagtggctgtcccatctcgaagggaagctgattgtcacgggctagcaaatgttgttcttcactcacttttagagtttcaacctgagctatggggtcttccaccttttgatgactggttagataacacactacctattgacccaatacatctgagtggtttgtatgttagtggatgtctagaggaagcgacag

SEQ ID NO: 10135 - DNA, 225 bp, Glycine max
  Peptide Sequence Number=SeqID_126913
atggttgtcattaatggagattacttgtggctcattttgcagcatgtttatcttattgatgcaaacagtgaccttaaacataagcagaagatgcaaatccatcttgttggctacataagagcgtgggataacaaggaattcacgtcaacggaattggagaaactcgaagaatacaagtctattgcgagagcttcactgtatttgccatcattcacttgtttatag

SEQ ID NO: 10136 - DNA, 411 bp, Glycine max
  Peptide Sequence Number=SeqID_126914
atggcagaaaaggaaggaggagttgtgaagaagggtcacgaggaaggcctaaaactcgcggcttcgctgctgcaagaattcgagcttccggaggggcttctccctctggccgatgtcatcgaagtagggtacgtgaagggcacgggatacatgtggatagtgcagaagaagaaggtggagcatgagttcaagttgataagcaagttggtgagctatgacactgagataaaagggtatatttctaagaagaagataaagaagttgaagggtgtgaaggccaaagagctcatgctgtggccaccagtgagtgagatcactgtggatgaccctccaactgggaagattaacttcaagagtcttgctggtatcaccaagactttccctgttgaggcatttgctgctggccagtga

SEQ ID NO: 10137 - DNA, 1755 bp, Glycine max
  Peptide Sequence Number=SeqID_126915
atgtccaacactctgcagcaacagagtcccgaatcgaaacgactcgatctgggttccaacgctcgccggccatgccaccggagatcggtctccgccggagctccgttaatttattccggcggagcaaccttgctcccgagcgggaacatttgcccgtcgggaaagatcctcaaacccggtttaccctctcgcgggccgaaccggaccgacgtgttgggctcgggcaccgtgaactacggccggggcagcatagtgcgcggtggctcgggcaatattccggtgcccgcggccgcaccgccgcttacggtgaagcgcgcgatgagcggctccgatcccgaggaagtgaagagggctgggaatgaattgtacagaggcgggaactttgtagaggcgctggcaatgtacgatcgcgccgtcgccatctcgccgggaaacgccgcatgccggagcaaccgcgcggcggcgctcacggcgctggggaggctcgccgaggccgcgagggagtgcctcgaggcggtaaagttgaaccctgcttatgccagggcgcacaagagacttgcttctctttatctaagatttgggcaggttgagaattcgcggcggcacttgtgtctctctgggaatcaagaggatcagtctgaggagcagaagctggtgttgttggagaagcatttgaatcgatgcgccgatgcgcgaaaattcggtgattggaagagggtgcttagggaatcagaagcagccattgctgttggagcagatttttcgcctcagattgttgcttgcaaggtggaagcctatttaaaactgcatcaacttgaagatgctgattccagtctcttgaatgttccgaagttggaaggttgtcctccagcgtgttctcagaccaagttctttggtatggttggcgaagcctatgttcctttcgtgtgtgcacaggttgagatggcgttgggaaggtttgagaatgctgttgcggctgcagaaaaggctagcatgttagattacggtaatgttgaagttggtaggattgtaaatgtcgtgaaaatggtggcaagagctcgttcgaggggcaatgaacttttcagctctggcatgttctctgaagcttgttctgcttatggggagggcctcaagtatgacaactccaaccatgttctatattgcaatagggcaatttgttggtctaaacttggactgtgggaacaatcggttcaagactgcagccaagctcttaacattcaaccaaattacaccaaggcccttttccgcagggctgcatcaaacacaaagcttgaaagatggtccgaagttgttaaagattaccaggccttaaaacgtgaactccctaacgacaatgaagttgccgagtctcttcgtcaggctcaactagcattagaaaaatctcgacaaatggtgtatggtactaggtttggagttgaagttgaacaaatctgttcattagacaaatttaaagctgcattagcctctgcaggtatatcggtagtatacttcaaagaggcatcaaatgaactatgtgaggaattatctccattcataaatacattgtgtgttagatatccctcagttaaatttatcaaggtggacgtggaggagtgtctagcaatagcaaaagcagaaagcataagaagtgttccaaccttcaaaatttataaaaatggagagaaggtaaaggacatgatccggccaacacatcagttattagaggactcagtaagaaaaagtagtagtctctag

SEQ ID NO: 10138 - DNA, 168 bp, Glycine max
  Peptide Sequence Number=SeqID_126916
atggagaatgaggagaacgaaccccacattcagaaaagtggcggcgaaagcgaagacgctgaacccatagagctcgttctctttcaagtgcccgagtgttacgtctacataatacctccaagaatgactgcagcttcatacaggtttgcgatcaattcaacattatag

SEQ ID NO: 10139 - DNA, 744 bp, Glycine max
  Peptide Sequence Number=SeqID_126917
atggaagcctttgccccacataggattagtgacggttttccagtttgttgtggtgtaattggaagtgggtatggttcatcttcgtctctagtgttggataaggagaagggagagcttgtagaggcccctgtcaaattggaacgcaagggtgtgtctcctgagagaagcattgaagccttgaagaaccatagtgaggcagagaggagaaggagagcaagaattaatgcacatcttgatacacttcgctctgtcattcctggtgctaagaagttggacaaagcaaccttgctgggtgaggttattagacatttgaaagagctgaaaacgaatgcgacacaagctagtgaaggcctaatgataccaaaggacagtgatgaaataagagttgaagaacaggagggtggattgaatggtttcccttactcaatcaaggcatcactatgttgtgaatacaaacccgggttattgaccgatataagacaagcacttgatgcacttcatcttatgataataagggctgagattgcaaccttgggaggaaggatgaatagtgtgtttgtgataattagctgcaaagaacaaaatattgaagatcccgagtaccgccagtttctggcagggtctgttcatcaagctctaagatcagtgttagatagattttctgtttcacaggacatgttagaaagcaggaagagaaggaggatttctatattcagttcttcatctataggagatttcttttga

SEQ ID NO: 10140 - DNA, 522 bp, Glycine max
  Peptide Sequence Number=SeqID_126918
atggctcatgtccctactgttgatcaaagggtaggcatcctcactaaagcttttactccctccaacttcactacttacagatccaaactcagagtggttggactcacaggtcttctccagtttcctgtaacaggagccgagaggcatggtcttcctggtgtcctctctggtgttgcattggggattacaggacttgtggctaaacctgctgctagtatacttgaagttacgggaaaaactgcactcattggaacatctgtacttgtggaagctgatgatggcttaaagttcaaagatgagaagttggtggcttgcaaagcccttaaagaagctggcaagcctgaattccgcggcatccctgttgatttggagtggataattgaatgggagattggattagagaatataattcttgctgactgtagtgaaggggttgtacacatagttggtagtaggccagactccttattgaggcaaaatcagcattctcccaagggaggtagtagtggaagaaccagatct

SEQ ID NO: 10141 - DNA, 414 bp, Glycine max
  Peptide Sequence Number=SeqID_126919
atggaggagaaagggagaatggctagagatggaagtgtgggattcgcgctaagtgcacctttagacttcttcgtggaccttcttctcgctaagcttgagttggctgctaagtggggaaacacgcggggcttgtcttgtgcgctaagcgagttatctcaatcttcaattatcaaactacttctaggcatgaggtttcatactttagggactaattccaccaatgaggcttcatcttcttcaattagtcctgaaccgacaacaagtagtcctctaccaacatctactgataatttaacatctcctaaactgaaggagtcctccaatcctgtgatatctgctccagcctccctatttttatgccatccattgcaaaatctcctcctttatcggtcagacctgatatcagttacttaa

SEQ ID NO: 10142 - DNA, 243 bp, Glycine max
  Peptide Sequence Number=SeqID_126920
atgtctccagctgttagagaagattcattccagctgttaactggagcattggcagaggagatcaaggcaagatatgataaagcagctgtcaaagttgttgacctgattcttacacttctacaatttggaggatatacactagtgcaaaattcagttgatctgtatcgaagctttgggtttgatacacagccagtcctcattgggctcaacatatttcaggcttccagtgcattagacatttag

SEQ ID NO: 10143 - DNA, 192 bp, Glycine max
  Peptide Sequence Number=SeqID_126921
atggagtgcgaaaacaaagccagagaagatggtaacaccaaaggttgcagtggaggaggaggtggcgaaccaccgacttttctaaagggaaataggtgtattggggctttttctttaaattctccacatgttggatattgttatatatttaaagatacgcatcttgggcttcttgtcatgagcctattctag

SEQ ID NO: 10144 - DNA, 1449 bp, Glycine max
  Peptide Sequence Number=SeqID_126922
atggaagaacaagaagaagaagctcccactctgcgactcgagattctgcaaggccctcgcgggggcgaaaccctagaattcaaacccggcgccgccgtccgaatcggccgcgtcgttaaaggcaacactctcccaatcaaggacctcggaatctcctccaagcacctcacgatctcaacggaatccaacaaatggaccctccgcgatttggattcctcaaacggcaccgttttggacggatcccaaatccctccccacacccccttcacgcttcaacatgactccattattaagatcggagaactcacatccatccacgtcatcttcgcccctcgcgaacaacaacaacaacaagaactcgcggttctgccgcgacggaaccccacgcgccgcggtcggaccgaaccggctccaactgaatcggttccgccacgcggacgcggtagacctaggggtttgaagagtaaggttcagattcagattcagagcgttgaggaaaatgatgcgagtgtggaggacgcggaatctgagcgcgtgggtccgccttctagggttacgaggaagacgaacagaggaaggagcgtggttaaggaggattggagtgttgttgttgagaatttggatgctccggagggtaagactcagagcgttgaggagaagaacgcgagtgtggtggaggcggaaggtgagggcgtcggtccgcctgctagggtaacgaggaaggtgaacagaggaaggagtgtggttagggtttgcgacgatgatgatgttccggtggagaaggtagaggagccgaagagtacgaggaatttgagtctgattgtgatttctgattccagcgttgggaattcggatgctccgttggtagaggagccgaagaagacgcgcatgatgcgaaattcgaagaaggtgcctggggtgactactgggaatgtggagaagaagacgaagaggggtgttgctgaaaagagagaattggaggaagaaggcgaagatttgaatggtgtgaaggagacttgtgatggaagaaaagaggggaatttgcctaatttgaaacggagaaggaggggtgctaccgagaaaagagaattggagaaagagggtgaagatgggaatgttgtgaaagaggcttgtgatgggagagaagaggggaatttgaatggagatgataggaattggcatgatttgaaagggagagagagggaattggagaaggagggtgtagatgggaatagtgtgaaagaggcttgtcatgagaattggcctgatttgaataagatgactcttggtgagtggtttgatttcttggaggtttacatgccgaaacagatcatagatgagactgaagagatgattgacttgatgacccaaaaagctgagagactccgtgagtacattgtagagatgcaacaacagaatggcaaggccaaaatgccaatggaggaatag

SEQ ID NO: 10145 - DNA, 592 bp, Glycine max
  Peptide Sequence Number=SeqID_126923
atgcatatcgacgccgaactcaatgaggacggcacggtacgcaagccgggccagaattactacctcaagcccatgaactgcccgatgcaccacctgatctaccgggcacggggccgctcgtaccgtgaattgcccttgcggctcttcgaattcggatcggtctaccgatatgagaaatccggtgtggtgcacggattgacccgggtgcgcggcatgacgcaggacgacgcgcacatctacaccacccgcgagcagatgcatgaggagctgacctcgctgctgcgattcgtgctggacctgctgtccgactacgggcttgatgacttctacctagaactgtcgaccaaggacgaggcgaaattcgttgggtccgacgaggtctgggaggaagcgaccaagacgctggagcaggtggcgctcgattcagggctgcagctggtgccggatcctggcggtgcggccttctacggccccaagatctcggtgcaggccaaggatgcgctgggacggtcgtggcagatgtcgaccattcagctcgacttcaacatgcccgagcgcttcaacctcgagtacaccgccgccgatggcaccc

SEQ ID NO: 10146 - DNA, 801 bp, Glycine max
  Peptide Sequence Number=SeqID_126924
atggagacccttcctctgaataccatccatgtccaaaacctattagttatcatcaataggttacacatgctactccactccactgcactagccttcttgttctattacagactgtgctttcttttccaaccctcagaaacaatagaaagccactcgttaccatggctacttgtttttgcttcagagatcattctctccttcatttggatccttgaccaagcttatcgttggcatcccgttttgcggtccattttccaggaaatattgctggaggatcacaagcttccttctattgatgtgttcatatgcactgctgatccaaccaaggagcccactttggatgtgatgaacacagttctatcagccatggcactggattaccctccacagaaacttcatatgtatgtttcggatgaaggagggtctcctttgactcttcatggggtgagggaggcttcgaagtttgctaggagtagtgtgtacatggaagataagcaaaagatcaaggaaaagtacgaggcttttaaagaggagataaagactttcagaaaagataggacattttccagagatcacccttctgtcaatgaggtgatgcaagaaactatcattgatgatgcagataatgtcaaaatgcctctccttgtctgtgtttctcgcgagaaaaagccttctgatccccaccatttcaaggctggagcattcaatgtccttcttcgtgcctcttccgtgatgagtaattctccatacattctagttctagattgtgacatgttctgtaatgatccaacttcagcttga

SEQ ID NO: 10147 - DNA, 195 bp, Glycine max
  Peptide Sequence Number=SeqID_126925
atggatgggcttatgggaccagttatttcaggaactgatctgctgcaacttaaagaatactttggttcatcaaatgaattcatcagatcacttgcacaaaactgtacaagtgatttggtatctggtcagaaatatgcattgctagaagaacctcactttttggcttcttgtaactatgaaattggcactaaatag

SEQ ID NO: 10148 - DNA, 180 bp, Glycine max
  Peptide Sequence Number=SeqID_126926
atggaagatgccattacagatgattcctctaagagtgatgcttatatggccccacatgttcttgccatgtctgctactcctattccaagaacacttgcacttgctttatacggtgacatgacaatgacacagagatgtggaaatgagctttggaaaaagttttgcagtggtaagcaatag

SEQ ID NO: 10149 - DNA, 684 bp, Glycine max
  Peptide Sequence Number=SeqID_126927
atggctggtccaataaccagaccggcccggttatgccaccggatcccgattcgagattccattcgggctttattcccagacagggaatgcttcactcttgtgcgacctttgaacaacgaaaatgatctacagcgactggaccagatatcaatggataaattaagaactggatttcgagagggccttgatgctttgacaaagtttgttttcgagagaactaggccaaaacaagttggtgcaactatgatgactggacctgtattggttggtataactgaatcttatctgaaagcgctcaacgaaggtgccgtgcctacaatttcttcctcctggcagagtgttgaagaagctgagtgtcatcgggcatatgattctgctactgatgtttatatgtcttcttttgaccgctcatcaccacctgaggaagttgctttgagggaagcacatgaacaagcaaaacaaaaatcaatggctgcttttaatgctattgccataggagttggttcagccaggaagacatatgaggccctccttcttaaattcttcaaaaaggcatttgaggattataggaaagatgctttcatggaagcagatctgcagtgctctaatgctatacagtctatggaaaagaggctgagggcagcttgtaatgcttctgacgcaaagattgataatgtcgctaag

SEQ ID NO: 10150 - DNA, 282 bp, Glycine max
  Peptide Sequence Number=SeqID_126928
atgaattgcagggatggaaaagccgtatgcatcaatacgcagaaaatgcttgtacgggtaatgatccaccaacccgctagttctttttatgaggcacaaacgggagaatttatcctggaagcggaagagctactgaaaatgcgtgaaactatcacaagggtttatgtacaaagaacgggcaaacctttatgggttatatccgaagacatggaaagggatgtttttatgtcagcagcagaagcccaagctcacggaattgtagatcttgtagccgttgaataa

SEQ ID NO: 10151 - DNA, 258 bp, Glycine max
  Peptide Sequence Number=SeqID_126929
atggctagagggagaatcttaccaagggccctggtgattggagaaccctgcttggtaatgccatgtggaggatttggcaagccagaaatgatcttatatttaatgatgctccttggagggtcaatgatatcattgacagagctatcttcactagtcttgaaagctgatcaagctatgcaagtttcttggcataggcatccttcttcggagggtagccttgttgcttggaagcctcccattgaggggtgtcttaagtaa

SEQ ID NO: 10152 - DNA, 700 bp, Glycine max
  Peptide Sequence Number=SeqID_126930
atgacgctgctgctgctggcagtgagcgctatgggcatctacgccatcaattccggcaaccagtcacttgacgccatcaaccgtattcagggcattgaacttaacagcctgtatcagagcaacgccgatctgatgcgtgcccgcgccagcgccgcgctggcggtgcgcaaaattgaaatcggcctgctggacgagggcgcgaccgttaccaaacaggcgcaggcggatgtcgccagctcgcaacgccatctgaccgcgtttattgatgccggtaccgttaccgcgcagggcaaaagtctcgccgatgcggtcgcggccgcgttcagcgcgtatcagaaaggcgccatggcacccatgatggatgcgctgcaaaagcagtataccgatgagtattaccaggtgctggaaggcaacctgtcgcagctggcggctaactattcgaaggcagtgaacgacttcagcctgtatgccgacgaggtctctgccgcacgtctggcggcagcggcgcacaatgaactgcagatgaagatcatgattggtgtcgccgtcgcgctgaccctgttactgattgcactggcctggctgctgctgcgccgcgcgctactgcgtccgctggacggggcgatccagcatctggagcaaattgccgctggcgatttgtcgcagccgctgccggcagcggccaataacgaaatcggcc

SEQ ID NO: 10153 - DNA, 1392 bp, Glycine max
  Peptide Sequence Number=SeqID_126931
atgcgccgcttcttcctcgcgcgacttctggcgcgtgcagctcacgcgccgccgtgccggcatcggaagctgccccttccagtcccggcagcttcgtcatcacttcctgggtctgtttcaggcttcaccttccgcttccggcaagccatttggtcagctcttgagtgttttcccctcttgtgtgttagggtttgttgtttggctcttaaatggcctcctctggacctgtttttttcgttttccgggactccaactatcaccactgcaaagctgaactggaaaaactacccttcgtggtctgcttccgtggagttgtggttccttggtcaaggacaccatgaccacttggagaaaaccttggattctgtttcagttgataaaagacctgaatgggagaagcttgactatcaactatgtgccgtgttatggcaatcagttgagccagatatcttggagatcctccgatcatttaaatcgtgtcgctctttttggaagaaagcccaagaaatctttgccaatgatatccaaagcttgtttgatgcaaccatgaaagttacagccctcaagcaaaccagtcatgacatgattgctcatgtgggtaaggctcgggctgccgtggaagaactgagaaagttccttgtagctgattcattggaagaagtgaataggaagcttgacaagttctacatggttcttattttgaggagcttacattcggactttgatcatgtgcgtgatcaagtacttgatggggaccggattccatcaatggattccctcatcactagacttctctgcgtgcctcagttattgaaggatgagaatcctactgatggagtggagacgtcagccatggttgcgtctcgagggagaggaagcggccgcaacagtagaggaggtcgtagtggaaggggtggacgtcctcattgcacctattgcaagaggaggtcgcaagagacttgctattcattacatgggtttcctgacaaggtcacacaagtttctaaatcagagaaagcagagtccagattctcttatgaggagtatcaggagtatttgaagctcaaatccgagaagcccagcaatcaagcacaaccatcgtccgtaccatgtttttcaataacgtgtatctctcaatccattgaaggtcgcaacccttggatactcgactcaggtgcctctgatcatattttttgtaataagtcctccttctcatccttttctcttccaaaaattcctcacctcgttactgtagctaatggctccaaggaacatgggacggggcgactgattggagaaggacatgaatcacgagggctttattactttgaatccagtccacctgggtcttgttttgctacctctagacccaaacttttgcatgatcgtctg

SEQ ID NO: 10154 - DNA, 132 bp, Glycine max
  Peptide Sequence Number=SeqID_126932
atggagatgggtgagagtgcatcgctgacaactgcttgtgggaagaataaagcaactaagtctcaagctaatcagaggaggaatgaagaaggggcacatgaagaattgccccagattctagaaatggcttaa

SEQ ID NO: 10155 - DNA, 270 bp, Glycine max
  Peptide Sequence Number=SeqID_126933
atgctcaagtatttcaaccgaggtcgggacagccccgccgccgacgcgtcaccgccctcccacgcgcctgcgacgccgtcgtcttcgttgccgtcggcgtctccggtgaccggccccgcgaggcccattcgcctagtctactgcgacgagaagggaaagttccagatggatccggaagccgttgcaacgctccaactcgtcaaggagcccatcggcgtcgtctccgtctgcggccgcgcgcgccagggcaagagtttcatcctcaaccag

SEQ ID NO: 10156 - DNA, 329 bp, Glycine max
  Peptide Sequence Number=SeqID_126934
ggaggacacatgaagtaccccaccacaatctagctaacttcgagcctcgcctcggatacacccatgaggggcaaacaattggtggtgtacccctgccaaacactttggagggttctcagtattacctacaactaaaacccttgcattttgcggtgggaagtgtccctcctgctatgacggaaaagggaaagtttgatcatatagaggaaaggctcaaggccattgaaggaggcggagattatgccttcgttgacatcatagagtggtgcctagttcctgatgtcatcatcccttcaaaattcaaggtgcccaattttgataagtactag

SEQ ID NO: 10157 - DNA, 318 bp, Glycine max
  Peptide Sequence Number=SeqID_126935
atggctccggatagaatgcagctacagaacatgtgcaaaaaggagcacgaatctttcaaaggatactcccaaaggtggagggatatgacagcccaattggcacccccaatgaaggaaagggagatgataacaatgatagtagacatgttatcggtgttctactatgagaaaatggttggttacacgccttcaagctttgcgggtttggttttctctagtgaaagaattgaaatgggtctaagaagaggcaaatttgattattctgctttgacgaatgagaaggctggggcagatggagaggatgagaaggaggaataa

SEQ ID NO: 10158 - DNA, 225 bp, Glycine max
  Peptide Sequence Number=SeqID_126936
atgatgcaatcctaccccgcaaggacattggatagaaagctccaagaagaatggaccagagatgcaagagaagaccttagggttctcatgaaccttaggaaatgtgcagaaacatgtggagtaaagtttcagaaaaatagaaaggaaagagaaatttatttcctagggaaagaggccatcgatgtgggcattgctcgatgttctctagcaaaatacaccaaataa

SEQ ID NO: 10159 - DNA, 548 bp, Glycine max
  Peptide Sequence Number=SeqID_126937
ggtacatcctttgtggtacaagtagagggtacatctacttgagtttgactgagaacaagagagggtacatctcttgtggatcagttctagtggagggtacatccactagggtttcaaagagaacaagggaggttaacatccccaagtacaatcgagagagacgaacagaagaagacacagggagacaaccaaagaataaaggagacgagatacagacacaagttcacagagccacacagcaacgtcagacaaaaccgctatcttacgcggatgctgtgagaaagaaaaacatcactcatcaacgaagaaaggaccaaaagcaacattcccatggatacgaaaactacacttcctcagtatacttaaacataaagacaaaagaaatcaaatggctagaggacgcgtgggttggccgactcaacaacctagccatgttcaaaaggttggtggaggagttgcgatgggagctgggaatggacatagcccctaaatatttaggggatgatctagtcctcttacctggattgactgaagctgaagcggaatga

SEQ ID NO: 10160 - DNA, 2683 bp, Glycine max
  Peptide Sequence Number=SeqID_126938
gtatgtgtcggctcctgaagcatgttggaagattttcgcattcccaatgcatggacgtgcaccagcaattgaacgcctctatttccacctagaaaatcaacatcttgtttactggaaagatagtcaagatattgggacagtactgtctaagagtacaatcaaagaatcaatgttcacaacttggatggattctaataaaatataccatcatggacaagatcttacttatgctgaatatgtgtccaaatttgtttataatgcatgcaaaagatgctggaaaccaaggaaacaaggaaatactataggcaggctcatttgggtgcccccttctagtggagagttattctacatgaggatgatgctttcctccgctaaaggatcacaatgttacgaagatattagaacagtagaaaatgttgtctatcatacgttcagagaagcatgctttgcaaaaggttttctaggaagtgatcaagaatttgttggtgccttacaagaagcaaacagttggggaactccacacttccttaagaagttatttgtgaagcttctatttatgaataccatggataggccagaatatgtgtggaaacaaagttggcaatggatggcagatgatattgtatttaatcataagagacaaggatatgccgccaacccgcaccaaaataatctcatctacaatgaactgggttacgacagagacatattatctgctgaatttgacaaatgctatcagtcgctaacagatgagcatgcttctatttttaataagattatgcatgtggttgcaactcaatcaggtggagtttattttctctatggatatggtggcacatgtaagacatttgtgtggaaaactttatcatctactatacgctctactggtggcattgttttaacagtggcttcaagtgggattgcctcaatactattgcctgggggtagaacaacacattctaagtttgctattccagtccctgcaacacaaaattctacatgtaatatccatcaagggagtgatttggctgaattgttgcagatcacaaaactcatcatatgggatgaagctccaatgtgtcacagatacagtattgaggcccttgacaaaagtttacgggatatcatgcacaatggaaatccttttggaggaaaggtcattgttttcggtggtgattttcgtcaaatactacctgttgtgccaagaagtaatcgctctaacattgtctatgcaactctaaatgcatcttacatttggaaccattgtcaaattctaaagctgacaaaaaatatgcgattgcaatcaaatcctactgaccattccaactttgatgaactaaaacaattttctaagtggctcctagacataggcgatggtaaacttgtagaaccaaatgatggctatggtgaaatcaccatcccagatgagtttcttatcaaggagtttcaagatcctatccaggaaattgttgaagcaacatatctagacttattacacaactacaacaatggagatttcttgcaaaaaagagctgtcctggtctctacaaaaggtgttgttgacaaaataaacaactatgtcttgtctttgattcctggtgaggagaaagagtattgtagtgttgattgtgttgacaaatcagatgaactactcagtcctgcttttggagtactaacaactgaatttctaaactcattgaagacatcaggaatacccaatcacaagctcagaatcaaggttggtactcccatcatcctactgcgaaatctagaccagactgatgggttatgcaacggaactaggcttattgttacacgacttggttcaagtgttgttgaagcggagattattactgggcccaacataggtcatagaacatacataccaagaatgaatctttctccttctgattcaccatggccattcaagctaattagaagacaatttccattcatggtttcatttgcaatgacaattaacaaatctcaggggcagtcgttggcacatgttggattgtatttgccaaccctaggcccacgagaaagaaactgcaatgataactgtgaacgtccatttttgtctctgaatctcttgctcttcctcgccgggtgcgacgcctccgacaacattgtgatgtgtctttgtggcaagcaacttgcaaacattgtgctctttcaaggcacctttctcaatagaagaatgaggtattgtagttttctaccttcgaaaatgtgttaccggttgaagcataagttcgcagagaagaaggttgcgcgaggtgtgggaagtggttgcaagttgcggaataaggtagttgctcttatggattataaccttcctgacctaattgggaatggaagcgaggcaagttgggtgcaaagtactttctctgaagaaccgccttctctgtatgctagtcattctagtgtaacatcttccacattaggagaagaagattcttgtccttctcctttgcctcctgatttgatgccttcaatagatgaaaaaaaaatggatcaaatcaccagggaagattatccaatgaaagtggggatcgagttacaatcaaatcctacacccagtgagttatttcttgacaaatctgtaagttgcatacctagattaagtaagaggcactaccagcaactggataactgtgggtttcacacggtgggttcctga

SEQ ID NO: 10161 - DNA, 606 bp, Glycine max
  Peptide Sequence Number=SeqID_126939
atggacgccttcgccctccccgtcgaaggcactaagactcgcgtcaatgcccaggctgatgcgtacgagtacatggtcgattattcacagacaaacaagcaaggcagttggagaatgttgggggatggtatcactttcaccctgggtagtgaggtagtttttgtggatgttgatgggttgggttgggtgggtgcattgtcaagttgcttcttgcaattttcatctaagaaagctataatctccatgaaacaacacactcccgtggctgctatcaggaccatgaaagtagtgggactctctgcaacattcatcaaattgaaaaaagaaggaaaagtaagtgacttggtcacctcaattcatgagaactggttcagtgcaacttgtattaacacatcaaagcctgctggtgaaggtgctattgttatacaaacagtagcttatatcttgcttgctataaatcttgcttataataacatcatagggacagtcccttactctatttctaacttgactgctcttacaaacctacgtgaatgttggtcacaatcagctccagcaaggactggtgttgactttcataatctttctactctctccacattgtga

SEQ ID NO: 10162 - DNA, 393 bp, Glycine max
  Peptide Sequence Number=SeqID_126940
atgggtgcagagaaacgcgagggactggaaccagagaagcggcacgcaaaccgaggcatgattttagcattcaaaagaaattcagaagctcttcttctcactcccacgttgcttttcttctccctttctcctccaccattgttgcccattaaagctccaaactttgctcatcatttctactccaaattgcaaagggaaaccattttcggagtcgtgaagtgcacctctacgttgtgggacttcgaatttcaggtagaaaagtgtgagattttgagggttagagaagctagatttggggttagtgtaaattggagtctaaagacttttaggaaagcttgggcagagcaaatgagaaaaatgagtgacaaatgtgaaagcaagagtcatttctag

SEQ ID NO: 10163 - DNA, 555 bp, Glycine max
  Peptide Sequence Number=SeqID_126941
atgattacttatatatatgctataataagagcattatcaaatccaaccaagctcacacgaagctataggaatataaaccttgaacaagctggtataactccttttgaacttattgaatatcaagccactgattgtttcgacttcgacatacaacaacactttttagacttatttctcgaaaaagttgggtcactcgctattgttggtgtcccactagtggtggacatgaacactactgcgattgatggagaaggtggtagcgcaagggaagacgagaaacaagggtatttaaggaaaggaattaagagaagctttgaagaaagaactacgtcagcattgtcaactgattttgaatttaaattgggagtttcagcgctgcgagaggttgtagtgccggtggtgagggagtttcagagctgcaagaggttgcaaataagagtgagaaagcgttcaagcgagagcaagagtcagaaaggtttcaaagtgagggaggtcgagcgtttttggcaccaaacaatcattataaaagattccacaacatcaattttaaaataa

SEQ ID NO: 10164 - DNA, 459 bp, Glycine max
  Peptide Sequence Number=SeqID_126942
atgtatgatacattggaaagtgatttcaagaagcctttgtattcggggtgcaagaagtcattggcgttgttgtcagttgtgttaagtctgattaatgtgaaagtcagatatggatggagtgacaaaagtttcactttactgcttcatatagtgcaagatatgcttctagaggaaaacacgatgtcaaaaagttattatcaagcaaagaagtccgatgggtatgaagatccaaaaactgctacatcagacatgtatgggttgtatgtcgatgagaatcctccccgcctggttgcctttggaagagtttatgaggggtcgacagccgttcacaatatccctttcggcaatgatcaagtgaaggtcggtgttgaggaagttcgagatactgatgttcgtgttcctatacccactaaagatgttcaattagtgggaaaaatacttaacactttccttgcatga

SEQ ID NO: 10165 - DNA, 1146 bp, Glycine max
  Peptide Sequence Number=SeqID_126943
atggagatcaaaattacaaaggagcaaatcaagggtcttgttgtcgatttcttctcggcagggacggattccacggctgtagcaacagattgggcattggcagaactcatcaacaaccccaaagtgctacaaaaggctagagaggagatctacagtgttgtgggaaaagatagactaattgacgaagctgacattcaaaacctttcttacatcagagccattgtgagattaatggtgggaagggaccccaaatactgggacaaaccattggagtttcgtcccgagaggttcttagaaactaaaggggccaacattttcaacttctcccatttgggaatggcaacacttcttgcatctcttattcagtgctttgatttgcaagtggtgggtccacaggggcagatattgaaaggtgttgatgccaaagttagcatggaagagagaccaggcctcacgattccaatggaacatagatcaaaagcatcaagcaacattggtgtgaactatggccaacttgggaacaatctaccctctcctcatcggtccattgagttactaacagcaatgaaagcttgtggcattgctgcaaaccaaagcatagctgatgaatggttaaggaaaaatgtcctcccctactaccccaacaccatgatccgctacctacttgtgggcaacgaagtgctgagctacaattcagaacaaggccaccaaatgtggcgtgatcatgtcccatccatgctacgtattgaaagatccctcagagctcagaacatcagagacatcaaagttggcaccccattagccatggatggcaaattccagcagcataagcgaccttggcagtggcttggtctacaccaacttgttggaccaaatgctgactcgctcatcttcgtcatggctaaactcgggtaccccaacatcaacctcgtgatatgcaaaacaggttggcctaactctggcgacggagaagaacttggagcaaatgcaagcaatgcagccacatacaaccgcaaccttattcaaagaatgacaacaaaacctcccattggaaccccagctagacccagggtcacaataaccaccttcatcttctcactgtttggtgaaaacgaaaagcctggtccaggaactgagcgacactag

SEQ ID NO: 10166 - DNA, 528 bp, Glycine max
  Peptide Sequence Number=SeqID_126944
atggcagatgatatcatattcaatcatagaaaagaaggtattcgccttactgaaaaggaaacaattcatttatgcttaactgagattgagaatatgctacaagcaaacagaaggagcttgcgatattttccatccatgccatacccaataggatatgcacgaaaccaacatcataataatctgatccataatgaaatgacatatgacaaagaaatgttagcagaacaatacaacacgacataccaattgctcacagatgagcaaaaaactattgtcgataccattatgtctgtggttaacactcaatcagctgcagtttactttctctatggatatggtggaactggcaaaacatttgtttggacaaccttatcatctggtatacgctccaatggtggaattgtttgtacagttgcttcaagtggagttgcttcattactattgccttggtcggaccacacattccaaatttgctataccagtccttgcaacagaaaattcaacatgcaatattcatcaaggcagtga

SEQ ID NO: 10167 - DNA, 1341 bp, Glycine max
  Peptide Sequence Number=SeqID_126945
atgtcatctactgaagtcccatcatctcaagaagcatccactccaaatacttctcaaaatgttagagggaaaattggtccagcatggggacattgtaaacaaattgatgaggatgctacaaaagtgacaatgatgtgtatttgttgtaataaacgaattaagggaggtggtattaacatgtttaaggctcacttggctggacaaaaaggccaagtagaggcttgcaagaaggggaagaacactctttatgcaaatgactatttcatgcctaaaacaactcctagagctcaacctagtttgaaaagtgtcttgcaaaataagcaaattgtagaaaagtgtgacaaagtcattgcaaaatggatgatagatgcttcagttccatttaatgcaattaactcaacatattatcaacctatgattgatgctattagtagcatgagtccaagttacaaagaagtttggatggaaattggatgtactttgatggttgatgggtggattgactgctctagaagaactgtcattaattttcttgtttattgtcctaaagggactattttcttaaggtatgttgatgcttcctatgcttctaaaactgttgaaatgttgtttaagattttcaaggagatggtgttaaatgttggagcagaaaatgttgttcacattgtgaccgatggtgctataaattatgttgctactggtaggttattggaaaaagagtttcctaaaatatattggtctgcttgtgctgctcactacattaatttgatattgcaagactttgggaaatttgaggaagagatggttagaaggtttcagaggaataaaaagaaagtggagccttatttggaggtccttgataggcgttgggattcacagcttcgcaaaaatctacatgcagctggttattggttaaatctgacttgtagattcaatgctgaagaatttgagaaacatatgaacacacaatctggcattttggaactcattgataggtacacacacggagatcttgagttccaagatagattaaatgaagacatgaaaatatataaaaattctgaaggagattttgcaaaacgagctgcaatacgtgaacataatacaatcatgctagtgttggaggagtcaccaccattcttaactcgtgaagaggtggaggatttacctaatgatcttgcaaacatgttcattcaatcaatttcaaatgatattgataaattaaatctagatgaatatgaggatggtgatgtgtcacaaccaccagacaacaccatggaagatgttaatccaaatgaaaacaatattgacgaagagtctcattcttttgatgaagaatga

SEQ ID NO: 10168 - DNA, 1569 bp, Glycine max
  Peptide Sequence Number=SeqID_126946
atgaagaaggttcccaagaacagctgcaagtctgcatcacacaggctctttaaggacaaggcaaagaaccgtgtggatgacttgcagctgatgttcctggatctgcagtttgctaggaaggagagccgcacggttgatgccgtggtgcttgaggagcaagtccatcaaatgcttcgcgagtggaaggccgagctcaatgagccctcgcctgcttcttcgttgcagcaaggtggcagtcttgggtcattctccaccgatatctgtcggcttttgcagctttgtgaggaggaagatgatgcctctagtccattagctgctcctaagcctgaacctaatgatcagactctgcaggctgggggtaaggtcatgttccaagagattgacatatttctccaaagggcagtatctgcttttacacattgtacttttatccagtattgcaatactggttgggtttcaatattggatttcatcttagattgtaataagtttcctggtttaactgtaaatcagggccaacagcaacattatttcccattggttgatgagtgcaaacactccacctcaagtgttcaaaatgtggcagctaacaacccagatggacatgctttagaatatcatcagtttgatttacatcaggactatgatcatggcttgtatactggttttaatggtacaggttattgtgaggaggatgcgattcctcatatatctagctacctaccaagtatctgccctcctccttctgctttcttaggcccaaaatgtgcactttgggactgtccaaggcctgcgcaagggttggactggtgccaagactattgcagtagctttcatgctgccctagctttgaatgaagggccaccaggcatggcccctgttctacgacctgggggcattggtttgaaggataatttactttttgctgctcttagtgcaaaggcacaaggaaaggatgttggcatcccagaatgtgagggagctgcaactgcaaagtctccatggaacgcacctgagctctttgatctgtctgttcttgagggcgagactattagggagtggctcttcttcgataagcctcgaagagcatttgagagtggaaacagaaagcaaaggtcattgccagattatagtggacgtggttggcatgaatccagaaagcaagtgatgaatgaatttggagggctgaagaggtcctattatatggatccacagccactgaaccattttgagtggcacctttatgagtatgagattagcaagtgtgatgcatgtgccttgtaccgattggaactgaagctagttgatggtaagaagaactccaagacaaaggcagcaaatgattcagttgctgatctgcagaagcagatgggaaggctctctgctgagtttccacatgacaacaaaagggctgccaaaggcagagccaaaattaatgccaaagttggcataggtggtgtctatccagcttcacacagagtgactccactgaatggaacatacgagtatgggttagctgcaccatatgactatcttgtcgacaacatgggtgactactatgggacatga

SEQ ID NO: 10169 - DNA, 1025 bp, Glycine max
  Peptide Sequence Number=SeqID_126947
gaggtgaagagagaactccagaaccaaagccaagatggaacccaaaaccggagcaaatccgcattctggaagccatcttcaattctgggatggtgaatcccccaagggatgagataaggaagatacgggtgcagttgcaagagtatggccaagtgggtgatgccaatgtcttctactggttccagaaccgtaagtccaggagcaagcacaagctccgccacttccaaaactcgatgaaccaaaaccataatgcagaagcacaacaacaacagaaggttgatgcttcttctctctctcagaccacaccaccttcttcctcatcctcttcatctgacaaatcatcttcaaaggaattagcataccctattggattctcctttggcttctcaaatgtcaatgatgttgcagtgcctaattctcccgctgcttctgtgaatcagacttattttcagcctcataaccacattgacaacaatttgctaccacaagctactgagcctttttcctttaccatgcacaacaataatgtgcaaggtgtagtggataaaaataccataacaacacttgggttttctgtccctcaattctcgagcaatatgatgcaatctcaacttcagtgtcaacaaaatgttgggccttgcactagtcttttgcttaatgaaatcatgaattatggaaccttgtcaaagaaagaccaagatgaagacaaggcattgaagataacgcatccacaacttagtttccctctcacttcaactcctccaaccacaaccattgctccttcaatctcaaccgttccatgtcccatcactcaacttcaaggtgttggtgaggttgcaggagatagggcaaaatgtacagtgttcattaatggtgttgaatttgaggttgtgatgggacccttcaacgtgcaccaagcctttggagatgaagccgtgcttatccactcttccggcaatcctgttcctaccgataagagaggcattacccttcacccactgcaccatggtgcttattactatttg

SEQ ID NO: 10170 - DNA, 462 bp, Glycine max
  Peptide Sequence Number=SeqID_126948
atgagtacagccaggtttatcaagtgtgtaacagttggagatggtgctgtgggaaagacatgcatgcttatatcctataccagcaatacctttcccacggattatgttccaacagtgtttgacaatttcagtgctaatgtaaccgtggatggtagtacggttaatcttggtttatgggacactgcagggcaagaagattacaataggctgaggcctttaagctatagaggagctgatgtgtttttgttgtgctattctctcatcagcaaagccagttatgagaacatctccaaaaagggtgaagaactgaagaaaatgattggtgcagtcacttatattgagtgcagctccaaaacacagcagaatgtgaagacagtttttgatgctgcaataaaggttgcattgaggccaccaaagccaaagaagaaaccacgcaagaaaaagacctgtcctttcctctga

SEQ ID NO: 10171 - DNA, 531 bp, Glycine max
  Peptide Sequence Number=SeqID_126949
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaacaacaagttgggtggtaaacgcgcagagacagattctgcgccctttgtcattcggggacagctcgatcgtgtccaacaaaacgcagagacaaataatggtcattctgcgtcttgtatcaaccaagaggaacaaattcgacagtatcaggatgatgtgttg

SEQ ID NO: 10172 - DNA, 159 bp, Glycine max
  Peptide Sequence Number=SeqID_126950
atggtgtggcctgttgcggagcattttccgaggtgtttgggtggacactctgcgacttcctccgccgtgaatcgcccttgtgtcgccgccgacctcccgctcttctatttatgtgtcgtgaccgtgacatttcactgcggcggagtatcaaaagaacct

SEQ ID NO: 10173 - DNA, 951 bp, Glycine max
  Peptide Sequence Number=SeqID_126951
atgtttgtgagagaggcagccaattcacatgggttgcggcaccattcttgcaaggccagcatttcagagttaaagcataaactgcacaagatactgaagagtcaagaaatcattcttgaagagaaaagggtgaaagatgagcaaaggatggagacgcatccctcttacatcaagaagacggagggaataaaagagatcaagacgtggctggaaaggtggatacaagaacaagacatcatgttggaggacaagattacaaataagcaaagcattcaagaggagatcaatccccattcaaccaagcatgtcaagaagaccataaaagggagtgggtcagaatgctgcaataatacagaggttcattcttggacaagaaagcatgtcaagaagaccatggaagggattgggtcagaatgctgcgataatacagaggttcattcttggacaagaaagggagaaaccaaagaggatcactttgtttgtgtgatacatcaagcattagaaacagaacaatacaatgaagtgttgaatgagagtaagttagggagattatcagaatccttgaagccagagaaggagcttgttttctttgaggaagagccaaaaatcatcagaggtagacattctatcaaaggcactggagatgcagtgctagttgttgaagagtcccccatcaaagtccaccaaatgtctcaagttggaaacttcccatgggctcgaattggatctttgtttcaaactccaacagtgtgcctcatactacactcacccaactcaattcaaggtcaaaccacattgttcccagtcaagagcacatgcagtccaacacataatgcaaacaagggaaaatcaatgagtggctacaatgtgattcagttgactgcaaaggccaatgaagtcttttgtcaaaatatgcaaattgggatgaaaatgagagtagcagttacatga

SEQ ID NO: 10174 - DNA, 1050 bp, Glycine max
  Peptide Sequence Number=SeqID_126952
atggagaaccccagcagtagtgaaaggagcagagcaggaatcgaagataacatgctggccatgtttgatgcctccgaaaccaaagatgctcaccaagatgccctagatgaccggattgcttttattgatgctgttcgtgcttcttgtgaacatggaaaaccgcccacttcgacagggaagtctctagagttgattgtgggaagttataagcttctggttgatttagacaagcacttccctcgcgtgtatttatctggcacggatgattcccgatcatcatctaactctccatcaaaattggttgtggttaaagaggcatggtctcccattatcgattttgtggataaggccactgctgttagtgaagctggtgataaacagtctggtggatctcttgacccctctagctttcaagtcttgattgaagggctggctgaagttttagcagagaccaaatttgaagcagcaagcatggagattatggaccttgatatggcaaggaagaaagcagatattgaaggtcgcactacaagagcagacagtccaaggcaatttacttttaattttgtttctttacaaacacctttgatggacataattctggatgaactagcttacaacaaagatagtgtccctgtttttcttaagatggtcagtgaacctaaatggaagctagaaatagttgtgcagtatctgtggaaatacataaccaagccttctgttcgcacccgcaagtcaaatggtcatactgaagatgcaacatttggtggggctttgaaggcgagccctggtgcagcggtaaagttgtgccttggtgacttgttggtcatgggttcgaatccggaaatagcctctttgcatatgcaaggtgcctttgatagaatgtctacctctgatgattttctgtttggtggttcaacggatgatgatgggctgactggctcttcctcaaagaaaacaagctccttctctggcttcaaggattctgataatctccctaacttactctcattcaacacttcattgtattgttctgtttctaatgcttga

SEQ ID NO: 10175 - DNA, 348 bp, Glycine max
  Peptide Sequence Number=SeqID_126953
atgtttgttaaatttctcattttcttctgcaaagcttcaatttgtagcctcaaatcagccactaccattgtttctcttgagacagaagacgaattagaaattcgaatagctgcacgtcttccatggtggcattgccgaatgaaactaccagaaaatgcacaacaactgccacttgcagacatggacaaatcaagtgaacaagcagcaaggactgagcctcagagtagaagaagaagaagcaactcagcgtgggaagaagaagaagaagaagaagcaaccagcagcttcgtaaaccctaatttttttggggaagaagaagcaaccttccatgtgagagagaatttatag

SEQ ID NO: 10176 - DNA, 360 bp, Glycine max
  Peptide Sequence Number=SeqID_126954
atggcatcccttcatcatccatcccagctctcacaagtagcttggcctgaagctcaacttccattggtgagacccaatgaagttgctcctcctgagcctgcaccggcacgggttgaaccaatgccagctgagccacgatctctagtggggaatccacctccttctcttgagcttgaagtagttcccccatctccacctctgattatcatctccgatgcatcatcggatgaaactgctgcccctcctgattcaccggctggagaaacagctaatccccctgattccccagttggaggaattgccgatctttctgattcatcatctgcagaagttgttgctctcactgattccccagtttag

SEQ ID NO: 10177 - DNA, 210 bp, Glycine max
  Peptide Sequence Number=SeqID_126955
gcaatcaattcatggggctccggactcggatgcacgaacagcgctaggcaatcaattcgtagggctccggactcgatggtggaggatgcacgaacaacgctaggcaatcaattcgtggggctccgaataagatttgatggtggaggatgcacgaacagcgctagacaatcaattcgtggggctctggactcgatggtggaggatgcatga

SEQ ID NO: 10178 - DNA, 324 bp, Glycine max
  Peptide Sequence Number=SeqID_126956
atggctcacgggtgcgtcttccaagaaaggaaaatgcacggagttgccaccaatgtttattcgaggaaaacgtcggaaaaaccagaaagcaagatatattttaaccgaacaaaaggtcatttaaggcgttggaccattaaacgatcttttgattttgaaaggacagaaacgttaaggcgttggaccattaacgatctcttgttttttgaaaggagagaaacgttaaggcattggaccattaacgatctcttggggtggtcgacaaaagcggggcttttgctcctacgtatcctcaattacgatgaggaaatcagacctacgtag

SEQ ID NO: 10179 - DNA, 2655 bp, Glycine max
  Peptide Sequence Number=SeqID_126957
atgaattttccatccactattcctcttgcatttcctacctatttgttcattttctttgttctagttaattgctaccaaggtgaggctacaaatggagacaacaaggttatatctataggtgcaataattgatgttaactctcgggttgggaaagaacagcttgtagccatggaccttgcagctcaaagttacaataacacttccaagagccacaagatggctcttcattttcaggaacccaccaaagatcccttcagacccacttctcttgctagaaagatgattaaaacgcagaaggcgcaagtgattataggaatgcacgcatggacagaagcagcttcagtggctgaattaggacgcaaaactcaagttccggtcatatcctttgcagcacctaccattaccccaccattgctgccaactcgcctgccattctcggtaagaatggccaacgatggtactgcatatgcaaaatgtgttgcagatatgggagattatgagatgctagcactgctatctgagaccctccaagaggttggttcaatgattgagtaccgtttagctcttccatcaccttcttatcgaactaatcctggagagttcatacgcgaagagttgaataagttgattaaaaatacacaatcccgggtgttcattgttctgcaatcatcattagaaatggtgattcatttgttcagagaagctgcacaattgggacttgtggatggagaatcggcttggataatcccagagagaataacaaatttgcttgactctgtcaacaagtcttctatttcctacatggaaggagctttaggaatcaagacctactactctgaagatagcagtgagtatcaagattttgaggctcagttccggaaatcttttcgggccaagtatcctgaggaggataaccgcgatccgggattttacgctctgcaagcatatgatagcattaaaattgttgcacaagcaatagacagaatggccagtggcagaaagactttgttaaccgaaatactgtctagcaatttccttggcttgagtggagaaattcgattcgaagaagcgcaactcttgccaaatcctaccttcaggattgtaaatgtagataagaagagttacagagaattagacttctggactctaaaacgtgggttcatcactaacctcactacagaacaaggttcaaatagtgtttctaggaacacagaaagtttaagtgccgtagtaatatggccagggaaactaaatagagttccaaaaggatggaatctgcctactaaacaaaagccaatgcaaatagcagttcctggaagaacctccttttccaggtttgtcaaggttgatcgtgatgagcttactaattcatataaatatagtggattctgcattgaaatttttgagaaggtgttagacattttggggtatgatctgccgtatgagtttcatcccatcaatggaacctatagcgatctggttcaacttgtctataacaagacttatgaagcagttattggagacacgaccataacagaagccagattgcaatatgtagactttactgtgccatatgcagaatcaggattgtcaatgatagttacagaaaagtccaacgaatccacatggatgtttatgaagcccttcacctggcaaatgtgggtggcaactggggccgtgttgacttacacaatggtagttgtgtggtacctggagcgggaaccaaatcctgagtttcaaggcaattggaaaagccaagtcagcactgctcttatgtttaccttctcctctctattctttgctcacagggagaaaatccataacgacttatctcgcgtggtgatggtatcatggctgtttctagtgttgattcttaactcaagctacactgctagtctttcttccatgctcacaattcaacgactgcaaccaaatgtgacagacatcctgtgcctgaagaagtacaacatgaaaattggttgtgacggagattcgtttgttagaacatacctggagaaagtcgaacaattcaagccagagaacatcataaacatggataatgaatacagctatgaagatgcattcaaaaacaactcaatagcagctgcttttctcgaactcccttatgagaaagtatatatgagtaaatactgcaagggatactctgcctctgtacctaccaccaaattcggaggactgggatttatgttccagaaaggctcgccagtggccagagatgtttccaaagctatactgaggctcttggagcagggagaactgaggatgttagaagacaaatggatgaacgatgcaggagactgctccaacaattcgccctcagagagtacagaaagtttgaggcttggaagtttctgggttctgtacgtgatctctggtgccacttctacaatttgttttctactttatacaatccagttgctgaaaactagacaaccaacccatgatgatgcacaagaacgtaatggcaatccaggtgatgaaaaccgatggaaaaggatagttataattgctaagcagatttatagcagaaagcatgcgacagtgacacccgttcctcaccagccccaggctccacaattaccagatatcataacagtgtcttcgccaccaactgttgctattcaaaactcttga

SEQ ID NO: 10180 - DNA, 1965 bp, Glycine max
  Peptide Sequence Number=SeqID_126958
atgtctgatcctgccgaagaggctgctttcatcgagaagctctacgaatacggcgagcaactcaacaatgccaaggacaagtcgcagaatgtgcaggattaccagggaatcatagatgcggcgaagacgagtgtgaaggcgaagcagctcgctgcacagctgattcccaggttctacaagttctttcctgacctttctagccctgctctcgatgcacatcttgatttggttgaggctgaagaactcgggccttgtggttcagggttgtgttggttcgtcaggctaaaagctaaattaataagggaagttgaactgaagagagttagtgagggatacacaggaaggaaaatagtgccatttgttgagattaaacgagacattgggaactgggaagttcgagtgcaagcaattagaggtctgcctcttttttgtaaggatacacctgagaatattgggaagatggttgatattcttgtgcaaattcttgggtctgaggaatttgtggagcgtgatgcagtacataaggctcttatgtctttgctgaggcaggatgtcaaagatattgttggggttaagggtgtgtttggaaatctctttggagccttgtcactggaagttaccactttccaaagccccaaaccttctttgacggctttgtttaagcacattggcagtgttgaagagccaagcacggatgatgttattcgtgagaaagttataaactttgttcgagataaggttttccctatcaaagctgaattgttgaaaccacaggaggaaatggaaagacacataactgatctcattaaaaagagtttagaagatgttactggcatagaatttcgaatgtttatggattttctgaagagtttgagcctatttggagaaaaggctccggctgagcggatgaaagagcttattggaatcattgaagggcaagctgatttagatgcacagttcaatgtatcagatgcagatcatattgaccggttgatatcttgccttcacatggcacttccatttgttgtgcttcctggagaacggaaggtagatttactcagaagccttgcagaattttcaccttatacaacaccacaagactcacgccaaatgcttccttctattgttcagttgctgaagaaatacatgacttggaagaagactggagaagagatgaattttacctatgttgagtgcttgttgtacacatttcatcacttagctcataaggttcctaatgcgacaaatagtttatgtggatataaaattgttactggccagccatctgataggcttggagaggacttttcagagcattataatgattttactgagagcgagaatgagaagacggcgaacgccagacgacggcgccgcgagagaagctgccagaggaaggaacctagaagctgcgagcctgtgacgaagcaagaactagatgacgacggatcagggcatgcccaatcgagcaacggactcgaccttgtccagccaccggggtgtggttggtccaggtttccaaactatggtttgagattgaataatgttgaggagttcacccgggctacaatcaagaaattaactcaaggaatggatgaaaacaacaaatctatggcaggtgctaaaactgatgaagaaaaggaaaaaattaaaactaaaaagcagaatgctacaactgggttgcggacttgcaataacattttgacaatgacaaagccattgcacgccaaagtgccttcttttattggagataagagaatcaatctctcttggaaagaagcaacaaaagcagcatctactgcaccagctgctggagcaaaacggcctgctaatgctgccaatgggtccaacaatattgcatcaaagaaaggtcgaggtgctggtggggcagaggccggggctggggtggtcgtggaagaggaagaggaggagggtatcggtaactttgttgcagatgtgatgtag

SEQ ID NO: 10181 - DNA, 256 bp, Glycine max
  Peptide Sequence Number=SeqID_126959
gatatgggcttcgtgggagtacgtgagctcagttggaggtggggcaacaggggatggtgggttttatgcgcgcattgtggatgtggaaaacttggtgaaacttcctgcttttattgttgaccacagagtggtacctggagatatgtcgcgggggtcaggagaccttggggacgtcaggcgagctcctggcagtcaacagataaaaggaaaacaagaccacaaagcaaggaggcttgtggtggctggccagctatga

SEQ ID NO: 10182 - DNA, 459 bp, Glycine max
  Peptide Sequence Number=SeqID_126960
atggttaaggaggagtgtaaggaggtaagtgtctcctccaagaggttagctaagaaggaaagtcgttttgcaataaagacaaacattatagaaacttcccttcttagacaacctccacatcttctcctttgtaaaaggacacttgttagcactgacatacctcttgagcttgaggttattcctcaagtagagttgctggatgagggtttagttcgtaagagcttaaatccttgtgctttgtcggtgcccaaaataggtattatgaggcaccaaatccctaaaataggtggtatgatgaatgtgttgagtggttcaaccctcttttgtaaaatcacccatgcacccaacatcttcatgactcgtatacatagggacaccatagaaaaagatatgttttattgcattactttccttaattttttaaatagtgatcaaggggttcccacgaaccctaattga

SEQ ID NO: 10183 - DNA, 858 bp, Glycine max
  Peptide Sequence Number=SeqID_126961
atggagctggctttgagtttaggagacacgtccaagtcctttacatttctcgacaaggcggtgactttaccccccaacaaggacccacctgggttctgcttggcgccgagtttcgccgagaaaagaagcgattctgagagaggaaccgcttctggttcttcagatccaccggttcagctcgaccttcttcctttctctccggttctcagaccccaacaacatcctccctctcaccttcggatcccttggctcacccaagcatgtggtggagcggcgagggttctggacgtgaacctatttcccgcggccaccgcggaggatggcgacgacggcacgtcgctgtcgtcgtcgccgaacagcgcggtgtcgccgtttcagatggatttctgcaccaggaacggtaatgcggcggagttcggaagcagaaacaagagagagcagcaagaggctgagggtagagcgagtgatgacgatgaaaatggctccacgaggaagaaacttagactctccaaagaacaatcagcttttctcgaagaaagtttcaaagaacacaccactctcaatcccaagcaaaaacttgctttggctaaacagttgaatctccgtcctcgtcaagtggaggtttggtttcagaacagaagggccaggaaagccattaatatggttatggacttatggacaaagttgaagcaaacagaagtggattgtgagtatttgaagagatgctgtgagaccctaacagaagagaataggaggttgcaaaaggaacttcaagaactcagagccctaaaatcttctcaacctttctacatgcagcttccagccaccactctcaccatgtgcccctcttgtgaaagg

SEQ ID NO: 10184 - DNA, 888 bp, Glycine max
  Peptide Sequence Number=SeqID_126962
atgtgggcgattggtggcggacagggcacccagtgggataacaaaaaacttaccggacaagtgtggtatcaggaatatgctgattattcccgcgttgtctatggcgaaagtcatatgcagtggcaggatacattgttgcagccggatgtggctctgcagtttattcgcggtaccagcttagggaaagcgctggccggagaggtcaatagcacctcttacggtgctcagctcgcgctgagtttcacccctgcattgaactggaaattggactacgaccatattgctgccagccccaatagctggggtaacggttcactggtggtgccttatgcccacaacagttcatcgggtccctatttcgcccagccgtttttcaccagtacccaggatcttggcagtggcaatgcatatatgaccaacctgaactacgtgcttaatgagcatctttctctgggtacacaatattcgtttatggatttaaaaccctcggcacagtctgccagcattaatcagtcggaatatctggtgtatttcacctgggcgttcagcggtgtattaaaaggattaagcgtgaccgattttgccggcgtgcagacatcgcctctgtacgattcacatttctggcagaatccgcctgatgcgaagcatttgtctgcaggagagcgtactggcgcagacgtttttctcagtgccgcctgtcaatgcgctgcaccagccgatcgccgagccactggataccgcacaccagcacgatcagtacggcgatcaccgccaccatcaccgcagtgtcaaaacgctgataaccgtagcgaatcgccagatcgcccaggccgcccgccccgatggcacccgccatttccgaggcgccgatcagcgccaccagcgtga

SEQ ID NO: 10185 - DNA, 1767 bp, Glycine max
  Peptide Sequence Number=SeqID_126963
atggctgattccactaagtacattcccataggtggcaccctcaaatcaaacctcaagaccctcttccccattttcaaaaccagaaaaacactgacttttgcatatgctttttccttcacctttgttgctttcactgttttccttgccttttgcccctctccaaacacctcctctcccttcttcaccaacatattctcctccactgccaccaccacttcctctgctagttcatacaagtcccaactctcttccattttctctttcttcttccacaactccaccactccatcttcaaattcctcaagttctacctttaacaccaacaccactagatctagcaatagcacttctcaatcccctcaaacaagtaaaaagacattcaaaatcaccccttttgaaaaccaaactcgaactactcctccaccacttacaagaaagataccaagtgatcatgttgtgactaaggaaccatcaagtgctaacaacaatcatacccgagtttctgatgaggctaaagctgtaaagaagacaaatcagtcttctaatggtgttgttcctgctgctgcacccaaggtttcaggggtaggttcaaataagaatttgagttctttggtgaatggagggggcacagagaaggatgttgtgcatagtaattacacggcttcgagagtgaaggatgagatgatggagtctttgatcaagtgtgatttttttgatggggaatgggttaaggatgattcctatcccctctatgaacctggttcttgcaatattgtcgatgaacagttccattgtatccaaaatggaagacctgataaagacttccagaaatataagtggaagccaaagggatgcaacctccctaggttggatggacatataatgctggatatgttgagaggcaagaggctaatttttgttggtgattccatcaataggaatatgtgggaatctctaatttgcatcctgagaaacgctgtgaaagacaaaagcaaagtctatgaagcaaatggaagagtccatttcagaggggaagcctcttattcattcgtattcaaagattataacttctcagtggagcttttcgtatctccattcttagttcaggaatgggaagttcaaatcaagaatggaacaaagaaagaaacacttcgtcttgatttagttggtaaatcttcagttcaatataaaaatgcagatataatcatcttcaacaccggtcactggtggactcatgataagacttctaaagggaaggactattaccaagagggtagccatgtctatgatgagctgaatgttttggaggcatttcgaagggctataacaacttggagtagatggatcgatgccaacataaatccatctaagtctatggtcttcttcagaggctattctgcttcacatttcagtggggggcaatggaattctggtggacaatgtgacagtgaaactgtgcctatcaagaatgagaagtacttgagagaatacccccctaagatgagggtattggaaaaggttttgaagaacatgaaaacccatgtcacctacctaaatgtcactaaaatgacagatttcagaaaagatggtcatccctccatatataggaagcaaaacctatcaccagaagagagaaaatcaccattgaggtaccaagattgcagccactggtgcctccctggtgttcctgatgcatggaatgagattctatatgctgagcttctgttgaaagagtatcagaatcagcatcaacagaagcaaacatag

SEQ ID NO: 10186 - DNA, 99 bp, Glycine max
  Peptide Sequence Number=SeqID_126964
atggcgggagctgtacgtgtggttgtgattgcccttggtaagaatatatctttggcattttctttccttcattggcattatgatgatggtgaacattag

SEQ ID NO: 10187 - DNA, 927 bp, Glycine max
  Peptide Sequence Number=SeqID_126965
atgggttcaggtgattggtttaagacaataattagctcaagaaaatcaaaagaaggcacatcaaagaaagtaaagttaaggttttgtgatttggagagtgactgctcatttcctgtaagggattcaactactaagatttatacaagaaaaaagtccaatggtttagcaaatggaatcaaaagcaaaaatctagagtcagatggggtatcagttgaaactattgctgcaacaaggatccaaacagcattccgagcttataaggctagaaaatatttacaccgcttgagaggattcacaaaattgaagatccagactcaaggttcctctgttcaaaaacaagccgccacaactataacttatcttcattcatggagcaagatacaggctgagattagagctcgccgaatatgtatggttacagaagacagaatcaggcggaagataatacattctcaactaaaacttgagtccaagattcatgacctggaggtggaatggtgtggtggttctgaaaccaagaaggaaatccttgcaaggttacatcacagagaagaagctgcggtcaagcgggaaagaaccatggcatatgccttctctcatcagtggagggccaactctagccaagggctaggaaattatgaccttggcaaagctagttggagttggagctggaaggatcgatggattgctacgcgcccttgggaaagccgtgtgccaagtgtaaccattagcccccctaaagatcaaaataagaagccgaacaaagttaagaaggataagaattcatcaacatcaaaaaaaccaatttcagttaaaactccttcagctaatgctaaagggactaaatccttaggtaatgcaaaagggactacaaaagctagaagaagattgtcttaccctgctgccacagaaaaaagcagtgcctga

SEQ ID NO: 10188 - DNA, 366 bp, Glycine max
  Peptide Sequence Number=SeqID_126966
atggcttcatcgtcgtgccgcgtcaaatcccagccaatagtcgcctttgccactgtcactgccaccgttgaagctcactcttcctggatagagcaaccgagaccttcgtatctgaactcctcttgctctttgctttacggtatcctcggcatccccgtcggcgcctctaaccaagaaatcaaggccgcataccgacgattagccaaagtctgccaccccgatatggcggccatcgaccaaaaaaactcgtccgctgacgaattcatgaagatccacaccacatactttactttttccgatcccaacaagcgtgctaactacgatcagaacctattctggcaacaacgttctagagaccagccatag

SEQ ID NO: 10189 - DNA, 381 bp, Glycine max
  Peptide Sequence Number=SeqID_126967
atgatcttccaccaccatcattcccctccaatcaccaccaccatcgccacaaatgtcattgtcacccaccaaaccgcctccactccctcccttctccattttagtgaggggggtaggcaaagtggatttacagtcgtgagcaagttgaagcgtggttacaacaaccttgtaggtgacatgcgtggtgtcatcgactttggttgcagatctcacaaatcgccatgcacttgtgtgatcttgttgacatgtagctgctgcattcctcctttagggaagtggatgcgtacaccaatgagtggtgtccacagtgggtgcttcgattgtgtggcaaaggcttcgagattccaaaactcaaattctagaggaggaaagtggatttag

SEQ ID NO: 10190 - DNA, 909 bp, Glycine max
  Peptide Sequence Number=SeqID_126968
atggatgggcgacatcagaagcaaaaaaacaagtacagtataattgttcctacatataatgagcgtctcaacattggtctcattgtttacctcatcttcaagcaccttggggatgctgattttgaaattattattgtggacgatgggagtcctgatggtactcaggatgttgtaaaacaactgcagcaagtttatggagaagatcggattctgttaagagcacgccctaggaagttgggtttgggaactgcttatattcatggcatgaagcatgcatctggaaattttgttgtcatcatggatgctgatctatctcaccatccaaaatatttgccaaacttcattagaaagcagtcggagactggtgctgatatagttacagggactcgttatgttaaaggtggtggtgtgcatggatggaatcttatgcgtaagctaactagcaggggggcaaatgttcttgcacaaacacttttatggcctggtgtctcagatttgacaggatcttttagactttataggaaatcagtgcttgaagatatcattagttgctgtgttagtaaaggatatgtctttcaaatggaaatgatagtacgggcatccagaaaagggtaccatattgaagagatcttgagtttgatatgtaatagcatttatcagtacagtgtttgccatttatgtttgttggtcaatcctggaactaagcgtgtttccaaatgcatatacacccttttatgtgccttcggttggccttggaattgctttaaagtagattcagtaatgggtgatgatatgtatatgtttgtcccaatcacatttgttgatagagtatttggaagttcaaagcttggtggatcagagattgttgaatacctaaagggcctagcttatctcttggtgacaacataa

SEQ ID NO: 10191 - DNA, 387 bp, Glycine max
  Peptide Sequence Number=SeqID_126969
atgtcaagcatctcgtttgcattaatgatgttgatgtttaaactcccagatcacctccttagagtagttccggtcattggcatacttcatgacaagaaagcattcaaacctgttctaaatccagctgaagtggaagcagtatttgatgcacctttggaaatgtttctcaaggataaaaatcggaggcaggatgagagggagtggatgggagagaagtacttgttgcatttctttgactatggcatcgggcataaaaaatatatcatatggggtttaactgctgggatcttgattaggttgcatcagttgtgtaccaacggctgccagctttcgtggagcagaatcctaaattcaagcttccacaggatgtatccaaggatactataa

SEQ ID NO: 10192 - DNA, 987 bp, Glycine max
  Peptide Sequence Number=SeqID_126970
atggcagaacagaacaaggaatcctcagcttcagatccaaaggagaaaaaatcatcgctagatgatgaaattggaaatgaatttcttggctcctggaaatccatgtcaatggcagatgatgatgcaatggactttagctttgacactgtttctaaaggcaagaagaagacatttgactttgaaaaactggacatgaattttaatctggatggtgaattcgacaagatatcatcatttaagttggacatgtcagatcttgattttacatgcccacctaagaagaattcccagtctaaggataagaaaggcgaagtatctggtgcaaaagctgggaagcaagatgggtttaatttcagctttgattttaatgagttggatagcttcaatcttcattcaagcttcatgaaagaagatactacctccaacagtagcccaaaaaaaaagggagtaactactgaaggaagtgataaaggtggtaaaatgcctaaaaccaatgatgatgaaggtgctcatgcatctaatgatagcacggctgtgaaatcccatgcatcagagaggctggaaactttgaaggttgagactatggttggtatcccagggaatctagtttccaaacaggatggttctgtttccaaaatttcatcctctgggaatcttgacatgccaatggagaatcaaactttagatacaaataaacataaaagtacagaagaaattgatcaagaaagagacttaccagagaagacaaagttaacagaatcaaaatctgagcaggttatcaatatggcatgttctcagtcagtaggtcagagtgattcagaccagcacactatctcagaccagcatacaaatgttttttcatctggaacaagagtcagtaatgtttcaggagataaacaagaggttaacgataagacaacatatcagtgtaaaaaaatgttttcttctggaacaagagaaattaatgtttcgggtgacatacaagag

SEQ ID NO: 10193 - DNA, 498 bp, Glycine max
  Peptide Sequence Number=SeqID_126971
atgggtgcacgggtcaccgtcgttgaaacttcaaagaacaacgacggtgtgctcaccaccgacgttgacatactgtcaaacaacgttggtggtgagcccgccaccgatgttgaaaggaaacccaacaaatacgggtgttcggcgtacctgacgttgaaatggaccacaacaacgacgggtcttcgcgtacccgacgttgaaatggaccccaacaacgacgggttgttcaacatttattgtatctctttttcacagcaaattgcagctaagatgtacatgtctatgtcttactcatatgggaagaaatttgcaagtccaatcacgccattaatcctaaacgttttatgtgtgcttgcttgttggggggaagattcaaaaggggatgcttttaaaaagtatcttgcaaggatccttgattacttatgggtttcagaagatggaatgaccatgcagagttttggtagtcaaacatgggacatttgcttgctactaacctaa

SEQ ID NO: 10194 - DNA, 1269 bp, Glycine max
  Peptide Sequence Number=SeqID_126972
atgatgctgatgaaagataaaaaactccaagatatgcagtcaaatatgttcagcacgccagagggcaaaaggtctttaaaacaaccttcatcaacagttgggacaaagggttgctcccttggcaacaaaaaaaatgctgaaatgctcctcggacccatcactcaagcacgggagaacttcaggtcaaatgatacaagacttggaagcaaattggtaggtgattccctcacatattccagcaaattaacgagggatgcagcagctttgcttggtagtaaagataatcttataagtagtagaaataccagggagggcaatgtttctgatgctacaacatgttcaggaaaattggctggaaataagaaatcattttctgatgaagtaaataaaggcaagaccacgtttctagaaatcggcatgtcaactaaagatgttagtatgtcaagttctcaagttaatccttcctgcttaacagagaagactgctagaattactacccaggtatctgcaaattctcaacctgaagcttcaggcaaggagtcctatcagaaatcaaagattgcttccatagaaggaaataaactttcttcttttaaaaattgcaagatcactcctgctctttcaagcttaaaaacttccaggaactttggagctaacagggttctaacaactttaaaccaaaaagaaacaaactccttagtaagctctggccaaagcatggacatacagggtattacagcatcaaagaatgaccatcctattgacagtggtgacaatcagaagccttcaaccccattcttgaagaggaaaactactgaggcttctgaagctgattttcaatcgttgaggcccctaaagcgcatctcccagtctcctagtaaaagcagaaattctaaagaatcttcagaagaatttgttggagaggtagagagtatgcccaacaatttactctacaatcattcaacctctggacttacaagtccaccagcaattaaagtgacggaagtggaaatacctgattctatactcatggaagataacagcaatgttgaaaaggctgaagcgtatatgaaagaacttgaagatcactacctttatccagaatcagaaggcagcagcctagccaagaaaagtgttaaggtctcttacagcattgggttcagaaacagcaatgcaacaggaagccattactaccgacccagtcgagtgagtccaggaggtccagatgcacaccatcacttcgaagcagtgaataatacgctaaattaa

SEQ ID NO: 10195 - DNA, 500 bp, Glycine max
  Peptide Sequence Number=SeqID_126973
aagtggttcttccggaaacattccggaagaaggggttcttccggaaaggtcttccggaactttggaagttcttccggaagtgcgcgtcttccggaattcttccggatgaaccacttcttccggaaagttcccggaagacgttttccggaagtcttccggaagaactgttcttccggaagacgtttggttacttccggaagaacacttcttccggaaactttccggaaaaggttcttctggaacttccggaagaacccctaacgggttccactgctgaatcaatactggatagtaaaagcaatggagagttagggagactaacctcgaaggctgttcgcggagaagacggagaagaagaagaagcttggctcgtggtgtccggaagaagacgaaagcttggctcgcggtgtccggaagaagacgaaagcttggaggatcaacaggaatggaagaagaaaagaagtagcagtggtcttccgagaagaggagcgcgtttttaa

SEQ ID NO: 10196 - DNA, 459 bp, Glycine max
  Peptide Sequence Number=SeqID_126974
atgaaaaatgcatttgacaaaaaggtgtgcccatgtgagtttagcgaaggggatcttgttacaaagaaggtgtcatatgttcagaaagattttcgagggaaatgggccttgaactatgagggaccttttttggtaaagaaggctttctcgggtggagcactattactcacgaagatggatggtgaagaactgccttcgcttgtgaattctgatattgtcaagcaatactatatgtatggattcacagagagatgtctacctaggagcctacttgaatggggaatatttgacatcaatattttaattatacaatacgcatgcatgtttctcttaattagtgctttgaagggattcatcgatagtcaagaaagtaaatccaaggttgctgctagatcgatcgtatttaaacctttcaagagggtagcaggctcccattcatctttcagtgggatcctctag

SEQ ID NO: 10197 - DNA, 585 bp, Glycine max
  Peptide Sequence Number=SeqID_126975
atgtcgagagagaattggatttggttagacaatgtgtggttggtaaacaaggatcggttttttagcaaggtacggaatgtatcatcaaatattcaatatgattccacgagatctagtttcattcaagtaacgggttctagccaattgaaaggatcttctgatcaatccaaggattatttcgattccattaggaatgaggattcgaaatatcacacattgatcaatcaaagagagattcaacaactaaaagaaagatcgattctttgttgggatccttcctttcttcaaacggaacgaacagagatagaatcagagcgattccctaaaatcctttctggatattcctcaatgtgccgactattcatggaacgtgagaagcagatgaataatcatctgcttccgcaagaaatcgaagaatttcttgggaatcctgcaagagctactcgttcttttttctctgacagatggtcagaacttcatctgagttcgaatcctactgagaggtctactagagatcagaaattgttgaagaaagaacaaaagaaacatcttgttctttccaggcgatcggaaaataaagaaata

SEQ ID NO: 10198 - DNA, 675 bp, Glycine max
  Peptide Sequence Number=SeqID_126976
atgatgtttgcatttacctctaccggtattaagctagaaaaatcaattaatgataaaaaaggacctcctacaattagaatccaaggacaaccaggccacaagattggcagcctattaccaatgcctagaaaagaacccaaatttgcacaattatgcatctctgacataaagaatgaagtgaaaaatagaattaatgccatgaaacaaaatactggaattgaagtaaacatcgttccaagtttaagtcaaatgctagatgagcacaacactcatgcaaagagttttagaatgggtagagatagattgacacacaatgaagtgcatgatatcatattgagattgattgctaaccgtcaaaaggatggttgtgtatataatgtacctactatttcagaagttgatactcttattgaaggtgatgtcgatacatgttcaggaagagatattattctccaaaacggctacaataccctctattgcttccttacaactaagacagatacagacctggcatacttcatctattacatcacagacctgacatacttcatctattacatcaattggctagaaaagaaagaggaatcgtcttacaatcagagagggtttgctttcagactacagtgcagatcaaatgaagcacaaactttattgcagtctaggaaactgttctag

SEQ ID NO: 10199 - DNA, 195 bp, Glycine max
  Peptide Sequence Number=SeqID_126977
atggcttctagagatatcatcctctttggtaacaacattgtggcggtagggactaccagcgataatgcatcaccaaaagaggaaaatcgacaagagggtgcccctgctcctatgtatcctcagttttatgcttttgaaatattcattttaatcaacaaaaagaaaaaggtcgttaaggcgttggaccttgaatga

SEQ ID NO: 10200 - DNA, 759 bp, Glycine max
  Peptide Sequence Number=SeqID_126978
gatgtgcgcaaaaaggcacaggccatccagaaacagaacactgccccccacgtatcaagcaatactttggattggctccatggacgtcccgcagctcttcctccctgcctcctgaagaattacagcagccgacccacaaatcagggaccagctagaggagtccatcacagaaaacgtgacgtgacagctcatgacatcattcagccagatgtagtcccagattcaatcccagggacttgcactgcctcccgagcctctggaaacgatcctgagacgagtgacttagataggtgcggcttgtacatcgaagcagatcctaactgcctggttgccctggggagagtttatgagggatccactattgttcataacactactttgttgcctggccaagtaaaggtgggtgtggaggaggttacagatgcagatgctccagttcttgtatccactgatgaggtttccttagtggggcaggcaattcacaccttccttgcttggccgatacttctggtcaagtctttatcacagcaggcagttgtgtctccggcaaaaccacctcaaaatcccgatccggaggtcgatgatccgctttatctgatgacattgaccatcccaaagcttttcttgaggccttaccaagttacatgggatgccaccatgtttgaggtctttaatccagacttcccgctctacataaagcacgaagacctctctgatatcctacacgatggtcaatgtctcagcatatcagtgttatag

SEQ ID NO: 10201 - DNA, 303 bp, Glycine max
  Peptide Sequence Number=SeqID_126979
atgacgggagatgcatcaaagttcacccatatctctcccaagaaaagtggatatgtgacttatggtgacaacagtaaaggtagaattcttggagttggaaaaatagatatactagacgagatttcagaatcattagaagacatgcatatattcatggagaagatcacaaaggaaaaggagatggaaataatgaagattctcaaattgatgaaatcaaaacaaatgatgatcttccaagagaatggagagcttctagatatcatcctcttgacaacatcattggtgatatatcaaaaggggtaa

SEQ ID NO: 10202 - DNA, 312 bp, Glycine max
  Peptide Sequence Number=SeqID_126980
atgaagggaagaaggcatacatatgggtttaacaacaacaaacgtgagaaggcagagaacaaaaggatcatgggttatccacctgcctccactcctccacctcctcctcctcctcctccttctcctcctcctccttcgaacgcatcggcttcgccatctgccgtgaagcggacacgcaaagcctcacgtctacgatcgttgtctactagaccacctggtgctgaaagaccagtggtgcatgttgatcctgctaccgggaaggccgacggtaggatattcagaaggaggtccctactgctcagaaggacctga

SEQ ID NO: 10203 - DNA, 351 bp, Glycine max
  Peptide Sequence Number=SeqID_126981
atgaagcatgtaaaatggaagttcaggaagacaaacactagtgccaatgtagaggaaagaaaagaaaaagaagcccttgctgcagaaggggggtggacagttgttgtgcaccataagggtagaaagaaaactactgattctgagagtggaattgcagtgggctctgttgctcaagctgctgtagagaataaaatgaccaaaaagaaacataaagaagttggtcaagatttctatcgctttcaaagaagagaagcacagagaaatgaaatcatgacactgcagagcaaatttgaggaggataaaaaacgtctgcagcagatgagagctgccaggaaatttagaccttattag

SEQ ID NO: 10204 - DNA, 1227 bp, Glycine max
  Peptide Sequence Number=SeqID_126982
atggataccatagcaagaaaatggagagatctaagtggccaaagtaactggaaaggtctgctagaccctctagacacagaccttcgtcgttacataatacactatggacaacttgctcaagctgcatatgatgctttcaacacagaaaaggcatctaagtgtgctggaaacagtagatatgcgatgagtgatttcttttccaaggttggtttggaaaatgggaattgtttcaagtatgttgtgactaagttcctatatgcaacttgcaaagctggtgcctctgaatcctttatcttgaagtcttttaacaaggatgcttggagccaggaatcaaattggatagggtatgttgctgtggccactgatgaagggaaagcagcattagggaggagggacatagtggttgcttggagaggaacaattaatgccgcagaatgggttcaagatttacatttccatttggattctgcgccactgatatttgatgatgctcgtgccaaagtacaccatggtttttactccgtttacacctcaaataaaccaggttcagaattcaatgatacatgcgttagacatcaggtcctggaggaggttagaagacttgtggaggaatataatagaaagaatgaagaaattagcataactgtgatagggcacagcttgggtgctgcactagcgactataaatgcagtggacatagttgccaaagggttgaacataccgaaagaccagcctgagaaagcatgttcagtcacaacatttgtattcgctagtcctcgtgttggaaactctcactttgcgaagatcttcactgggcacaagcatctgcgagcattgcgtattcgcaatgaaacagatgttgttccaaaacttccacttaagcatttgttttttctggatggattttcggatgtgggggaagagttggtgatcgacactacgaaatcaaagtacttgaagaaggaggtcagtgctcataacttggaggtttacttgcacggagttgctggaacacaagggaaaaatggagaaatattcgatttggatgagagtcttcgtgatattgcgcttctgaacaagagcaaggatgctttgaaagatgaatatcattgtcccgtggcatggagggttcacgagaacaagggtatggttcaacaaaaggatggtacttggaagcttatggatcataacaaggatggtattctattcttacacgctagattatag

SEQ ID NO: 10205 - DNA, 1020 bp, Glycine max
  Peptide Sequence Number=SeqID_126983
atgatgctttcaactcagaaaagacatcaaagtatgccggcaacagccgataccctaagaaagatttcttttccaaaaagttcctctacgcaacttccaaagccagcgacgcagaagcgtttctgctcaagtccttttcgaaggactcgtggagcaagcaatcgaactgtggccactgatgcagggaaagaagcgttggggaggagggacatagtggttgcttggagaggaaccattcaggctgcggaatgggttaaggattttcatttccatttggatcttgcgcctgagatttttggtggtgattcttctgctcaagtgcaccatggtttttattcactttacacctcgagtaacccgggttcgaaattcactgataccagtgctagaaatcaggtccttggcgaggttggaagactcgtggaggaatacactagcaagaatgaagaaattagcataagtgtaacagggcacagcttaggtgctgcattagcaaccctaaatgcagtggacatagctgctcaaggcttgaacataccaaaaaaccaaccacagaaagcatttccagtcacagcatttgcatacgcttgccctcgtgttggagactccagcttcgaagaaaccttcaatggatacaaagatttgcgctcattgcgaattcgtaacgtaacagatattgtcccaattactccttttctgggcttttcggatgttggagaggaactggtgatcgacacaagaaaatcaaagtacttgaagagcggtgtcagtgcgcataacttggaggcttacttgcatggagttgctggaacacaaggggagaagggagggttcaatttggaggtgaatcgtgacattgcacttgtgaacaagagcatggatgctttgaaagatgagtatcttgttcccgtggcgtggagggttcaggagaacaagggtatggttcaacaatcagatggtagttggaagattgtggatcaagttcacgacgatatggagtctatacactccaacttataa

SEQ ID NO: 10206 - DNA, 609 bp, Glycine max
  Peptide Sequence Number=SeqID_126984
atggcgacttgtaagtatttgactgcttctaaggcctttggcagtggtctcagtatgtatattccccacatggcaaagggccaaggggagctcaaactatggagattgtcaggaaggatgcatggaatgtctgcaaactcttggcatccacgcaccacctttgttgcaagggagcgtcctcctgtatggaaactgcaaattccttcatggagttctctcatgacaaaatctgcccatgggctatttgggcatttgagtagggggggtcatccagtatggttcctcctcttcaacggccataacttctttagtgtctatggtgggagtttggagtgtctcctggatgatagtcttgaagtgcctggtctttttagtgctgtccgtcctattggatggtgcatgtgggagagccttaagttatttggagtgttgattgtgcgtcaaggcctttatcttcctcaactccttctcatggcattgctccatctccacagtgcaattttggagttgctaaagagtatttgtgtttgtcatagctactggtgggaggttggagccttcgaaagggatctcgcgtctgaggccagactgagtgctaaccatgggtga

SEQ ID NO: 10207 - DNA, 696 bp, Glycine max
  Peptide Sequence Number=SeqID_126985
atgggatccttctcttcttcttccctctttctccttttcttcttattctcttcttcacactcaaaggtgttgatattgaaaagccggttttggagttctccccttccggtgtttcttcaggttctccccttctcaaagaggtatgggagcggtgtacgacatcgcgaagagcggcgtcggggttgcgttgatgggcgtgatgaggttgtagctggattgattttgtgcttgattcaagaggagtgtgaatttgacgagttgagtagccaagacagaataagccactccaaaagcaccccaaaccccctccctccaacccccattgtccacaagcacactaaatccaagaaaaagagatcaaatttcgaggaagatggctctatctcttgcaacaagtgtagaccacactcctgcgacaaaatcttcatccttcccttagatcccataattatggctacattcatctcaatcaagatttatgtgcggtgcgtctccggtgaagagaagaagatggcgatcatactcagagcatgcaaaaaattgatgagcgtgcagttcagcagagagcccaagaagatggtgaccgggacaactcatatgggagatcctaaagaagaacaactctttcttggtgaaagagttcggaaggggcactcagagtgtgcagttcagcaaagagcccaaaaatctctataa

SEQ ID NO: 10208 - DNA, 802 bp, Glycine max
  Peptide Sequence Number=SeqID_126986
tagagcgtacatctacttgggttgtaatactgagaacaagagagggtacatctcttgtggatcagttcaagtggagtgtacatccacttggttgttcaaagagaacaagggagggtacatcccttgtggatctttgcttgtaaaggattttacatggttattgaaaatctcaagaaccggtggttgcttggggactggatgtaggcacaggtttgatttcaacctggttaaaggtcttgtcacccatctggtggggattccttatgctttacagagcttctcccctgatgcttgtaaggaggttatgaggagtaattacgagttacacctgattgaaggtcttgtcactcaatctgataatggcggactaaggggataccttgggttttgtaggaatgcataccaagggtggaccttggatcatataagggacatgtttgtcccaagttttgacaagcttgtagggcttcgttggggcttaccaaggatgaaccttaggttttacgagccattggcacgtactagagacttggtgttatgctcttgcatacgtgacactcttaaggtggcacgtattggcggtgtaatgtcgagctcttgcaaatgtgccactcattgtaggtggcacatactggagacgtggtgtcgtgctcgtgcatacgtgtcactcgttgtgggtggcacatattggagacttagtggccttcctagttgggaccaagctttcccgctcggggatcctttttggcttcacctcggacttgccgtacgaggtcaccaggttgaaaagcctgtggtttaa

SEQ ID NO: 10209 - DNA, 1008 bp, Glycine max
  Peptide Sequence Number=SeqID_126987
atgccaacggaagctgaatctagtgttacgcccaaatacctgcaagagaatgaactgagccaagagtgtaaggaagtgatatccaccttacccatggaaagaggttgggttgcaagccatctgcaccaataccaaggcttctggcacaccaccaggcagcttcaaggggttctatcttgtcaaaagcattttaaggcccttgacacagatgtcctcattgtaagcactcccaaatcaggcaccacttggctcaaagcttggacattttccttgcttcacagaaaccaacatgatccaaatacccaaaaccaaaaccatcctttgctattcaacaacccccattttcttgttccattcttggaactagacctctacattgatgacaacactcttcccgaccttacttcattgatcacctctccaaggctcttctccacacatctcccttatgtgtcacttccaaaatctgtgcaagaatcagcttgcaagatcatttatctctgtagagaccccaaagatgctttcatttcactatggcatttcacaaacatgcttaggcccaagagccgagggatgaactcactccaagaggcatttgacaagttttgcagaggagtgagtctctatgggcccttctgggcccatgtgttggactattggcagaagagcctgtcagagcccaacaagatcatgtttatgaggtttgaagaaatgaaaatgaagcccaggcttgttttgcaagagcttgctacttttgtgggttgcccgttttccaaagaagaggaggaagctggtgtggtggatcatattttgaagctgtgtagctttgataacttgagcaacttgcaagtgaacaagaatgggaaactctcctctggtgaagaacacaaagctttcttccgctgtggccaaattggtgactgcaaaaatcatctcactgctgagatgatccaacaactcaacaccatcactcaagagaaactagctgaacatggactgaggttttag

SEQ ID NO: 10210 - DNA, 957 bp, Glycine max
  Peptide Sequence Number=SeqID_126988
atgccaagagataaacaggcgctcgagtatggacaagcattgcccaatgttgagagtggtaacctcaacaagtgtgagaattccaggcgtgtgtggcacatgtgcagtactcttgcatacgtgtcactcgtggagtggacacatactggagtcattgttaactcattggcaagtgcactaatttgtctcaagtttaagcctttcaatgaagaactattgacccttgtaaagagggtggacaaggccatcttggagcaatttttggcctcattggaagcacaagccattctgtctcttttctcggcgagcgatcccctcgttgccttaaacggtattatgggtgacttcgtctggaggccaatcgtgaagcaagttggacctactggtagtgttgtgccatcgtctgctactgatggccttgttgctgctaagattgttcccagtgccccttcctctgtattggttaagaggaagcaggatgatggtgttgggctattgggctgcaagaagttgagggccctttcgagcctttgtgccctgaggcaggctacagggttgacgctcgattctggtcgcccttcaagtgtccaagatgccatttctgttgttgctgaagtgattgcagcaactgctttggctagttctgatgtggcgctctcgtccattgtcgttgcacttttactgagtgtcggtgtggcgaccaccaatgcccctatgacgcctcctccttcctcttcggctccaatgggaatagggtacaaacctgaacagaagacctcagttggctttgtatcagcctttgataaaaatcttatcaagtcaaataggttccagcacgttaaggattctgccaaggttttccttcagcaaagtttgacaattcttgaagaaaataggcagcgacaccaagaagcgctgaacaaagtggcgtccttggaggctgaagctgccaaatag

SEQ ID NO: 10211 - DNA, 420 bp, Glycine max
  Peptide Sequence Number=SeqID_126989
atgggaaagctggatcatctagaggaaaggcttagggccattgaaggaggtgaagattattcctttgctaacctagaagagttgttcccaatacccaatatcatcacccctctcaagttcaaggtgttgaactttgacaagtacaaggggattacttgccccaagaaccatctaaagatgtattgtcggaagatgggggcatacgcaaaagatgaggaattgttgatacattccttccaagaaagtcttactgggaatacacccgaaggtggagaacctggcagctcaagtggcacctcaatgatgaaaaaaacgatgacaatgatagtagacacattaccagtattctactatggaaaatggtgggctacacacgttcaaagctttgcgaatttggtctttgccagtgaaaggatcgat

SEQ ID NO: 10212 - DNA, 123 bp, Glycine max
  Peptide Sequence Number=SeqID_126990
atggcagaacttagagttgagaagctccatgatatcttctctagcgaagctggcgtgggcatgacggttagggctcaacagcagcgacgcgacgatgtcagtgacgggggactcatgcgatga

SEQ ID NO: 10213 - DNA, 510 bp, Glycine max
  Peptide Sequence Number=SeqID_126991
atgccattgaaaaatgacatggatgtgaacatcatgttaatgtataatgatcaattttcatttgttggaccgattgagttgttatgtaccgttggtagaacaacagatgcaattttaaacttacttgaacgcctcagcatccctacacatgatgcgattttgtattacaacgaaaggtggaacatgccacgccaaaataactttgtgggatgtagcatagatcaactgaaggatttgatcaagcaagtagcacctaaagggaatcctcctcatgggattcacgaatcccaagttgtaaggcgtttgttttatcgacaacctagtcatttggagtattctgagaaaattttagaatttaaaattgttgagctgaaatgtgacaacgacgcgatgaaggtgctggtagagtctaattactggaaacaatttgtgccaatagaaattttggctctctttagtaaagtggttatggtaaatgaggacgatgtggttacgtccttacgtgattga

SEQ ID NO: 10214 - DNA, 282 bp, Glycine max
  Peptide Sequence Number=SeqID_126992
atgaagcaactcaacaggaagggaatcggtaagccgataattctattagccaagtcttcgaactccttcaggaacagaggtggagtggtgagggattggtgtggagttgggcgtggtgggggaaggcacaggagcaaggcgattgagaagcttgtccattttaagggtcatagagtgcatggtatcgtcaagacgagcaaaggaatcatcgaggttgtgggagaccataaggacaaacgagagcatcaaatgttacgaacaaaacataatgcaggaaattaa

SEQ ID NO: 10215 - DNA, 99 bp, Glycine max
  Peptide Sequence Number=SeqID_126993
atggctaggattgtaggagatgcagaggtagaggaagagcatttggtatcagaggatgagaatgaactaagtgatgctgatcttgggaatgatgaatga

SEQ ID NO: 10216 - DNA, 339 bp, Glycine max
  Peptide Sequence Number=SeqID_126994
atgatccctgcatctagtagcttgcttcatcatgtctttcttcaccacatcaaggatggtaggattcagcctcctttatggttgccttataggcctggattcatcctcctaaagtattcaatgcatgcatatggaaggattaattcaaggaaggtagtggtttcagctctagggaaggtggctaaatggtgcaaggcaaaggaaggcccacatgggccttccagattcttcctccaaaaggtggttgcttctggaggaagcaacctggctggcctgggcgagctgagctcgcctgggcgagctgggtggcaagctcctcccctattttgctataaatag

SEQ ID NO: 10217 - DNA, 447 bp, Glycine max
  Peptide Sequence Number=SeqID_126995
atgccatcttgcctatgcaacacccctagcaccttccaaagcctctctaaagttcttgaccgatgtattgagaccaaccctattcttaactttgagaaatgccattgtatagtacatgaaggtatagtcgtagggcatttggtttctagtagaggtattgaggtcgataaggccaagattgatgtttctataggagattcatctaggattttagcaagattgcactaccattgtccaagcttctccaaaagtgatgaggacatgaccaagagcaagggcaaggatccacttgaaggacttggagggcctatgacaagggctagagcaaggaaagccaaggaagctcttcaacaagtgttgtcaatactatttgaatacaagcccaagtttcaaggcgaaaagtccaaggttgtgagttgtatcatggcccaaatggaggaggactaa

SEQ ID NO: 10218 - DNA, 198 bp, Glycine max
  Peptide Sequence Number=SeqID_126996
atggctcatatcaagaaattcaaccatattttaaccaattgtgcttcatcgagaaaactcagaagcgcggataaggaacaaaagaagaaccctcgccccaaggagaaaaacgatcgcgtttcgatttgcgcctttaggactagctccgttttcagagaacatgtgtggtgttcgaaaagaggaattgaaggaaaataa

SEQ ID NO: 10219 - DNA, 657 bp, Glycine max
  Peptide Sequence Number=SeqID_126997
atgatacaaggaggttttcctccttatatgcttggaaccggtagacagataatgttttggggaaaaacatcttacctgagaggaaggcgtaatttccataaacgcctcaccaatttggttgatgggagcatagacttggctttggtgaaagagttctatgcaaacttatatagctctgagggcccttcaccaaagcaatcaagagtcagaggacatttagtgaagattgatgttgacaatctcaacatattcctagagacacctgtggtattagcaaaagcccttacatttgagcgcctgagcccgatcattaacttggcctacatcaggaagaactgttggaatcccgaggatctaacagtttcaatccgaggggctaggagggcaagggcgaggccagctgagcttcattctacttctacagctcctactctagcatccacttcatcaaccccttctatcccagctcagatagattctcaacgctttgaagccatgcttcaaagcattcatcaggaacaaatcattttattacagagtttacaggtggcggcgcctccaggatctattccttcagttgagcatttcagggagatggtagcctggcccgggacccaaccttttcttcacaaggaagatgaaggtcccatagcctag

SEQ ID NO: 10220 - DNA, 393 bp, Glycine max
  Peptide Sequence Number=SeqID_126998
atggctccaaagaaactctccacgaagaggtctagaagagacgccacaggagaaggatccagtgctgcctcagaggagagacgtgtccagctcagggaggatgagtatacagacttccaggaggagatagctcgcagacgttggacaccgctagtgactcccatggccaagtttgaccctgagatagtcctagaattctatgctaatgcttggcccacggaggagggagttcgggacatgtgctcgtgggtgaggggtcagtggattccctttgacgtagatgccctcagccagttcctgggcgacccgctagtttgggaggaaggccagcagtgtgagttcagccaaaggaggaacaaggtcgacggtttcgatgaggaagccatcgcctaa

SEQ ID NO: 10221 - DNA, 387 bp, Glycine max
  Peptide Sequence Number=SeqID_126999
ttcaaggtatcagattttgataaatacaaggggactacttgccccaagaatcacctgaagatgtacaacaggaaaattggggcatactcggaaaatgaaaaattgttgatgtgtttcttctgggaaagtcttattggggcagccgtcaccagggatttggcagctcaagtagcaccatcaataatggagagggagatgattaaaatgatagtagacacgttaccggtgttctactatgagaagatggtgggttacatgccttcaagctttgtcgatttagttttcaccaatgaaaggatcgaagtgggtttgagaagagaaaaatttgattatcctgctttgatgaataggaagcctagggcaaatggagagaataagaaggagtga

SEQ ID NO: 10222 - DNA, 1158 bp, Glycine max
  Peptide Sequence Number=SeqID_127000
atgagtgtgttttccaaaacgattaacgaagtcgctgatgaggcagcgaattcaactgttggtgcaaagaaatatgcaacaaaggaagcaaggatatctggaggatttcagagcctttactgtgaggcacagtgcacacctgacctctcaccccaagattgccgaaaatgtctaaatgtttccatagcgaatagtcaacagttttgtgaaggtttagcgtcacctgtttcctctcccagctgtagtattaggtctgatgtgtaccctttctatcgccccagtaccgctctggcaccaacaggagaggtttccacaaatttttccagcacagactcacaacatcctgcttatctttcccacaattgttccagcaacgaaaccatgatcaccacggaccgcgcttttctatccaatctcaagtcccttctctcttccttgtcttccaatgtcaccaccaaaaccggtttctccaagaccaccgtcgatggcaaaaacccctctgacacggtgagtggactcttcatgtgccgcgggaacctttccactattctctgtcagcaatgtgtcctaaatgcgacccaacgaatatcctcagagtgcccctcttccaaagaggccatcatatggtacaatcactgcttgcttcgctactccaataatccctcatccctgatatccacagtggacacaactccaacctatcaaaacttcagtatcgtcaatacttccaatcccaaccagctgcaaagcttcttcacttggactatggcgactgctttacctgaagtgaagtccgtgatagaggacagtaccattaagaattatggaacaaaagaagtaaaactgaatgatcagcaaaccctctatactcttgctcaatgtacgccagatctatctaatggcgcttgcggcagctgtttagacaagattttcaaatacgaaattccatggtgttgtttggcgagtccagagggaaaagtactatctcctagctgctatatcatgtttggattgtccccattttacacagatgatgaccgagttgaggcgtacaggcaacccagtcctcctccaacaactgcaggtgatgttcctattcaagctattttttcatgcaaacatcgcctaattaatcaactttcaaagttatggtactga

SEQ ID NO: 10223 - DNA, 285 bp, Glycine max
  Peptide Sequence Number=SeqID_127001
atggtggtccagtcacggcgccggtgcgccgtcacccctgcactgcgcaacggcgttcactttgtttatgccgctgccgctcgaggtggcgtagaaaccgttggtgttgaaagtttgggcggtgatgatggtcaaagaaatgtgaaggttctggctgtaccggccgatggttgtgtagtttccgatatcgttgttggagtcacggaagtagtggaagtcttggggagtttcgttggcgtttacttgagatatgactgtggttatgaaaaggagacagaatattga

SEQ ID NO: 10224 - DNA, 369 bp, Glycine max
  Peptide Sequence Number=SeqID_127002
atgtatctctacatacttcattctaaggatgaagctttagatgcctttaaagtttttatggccgaagtggagaaacaatgtggaaaacaaattaagatattgagatccaatagaggtggagagtgttatggtagatacatggagaatggacaagcacctggtctatttgcaaagtttcttcaagaacatgagattgttgcccagtacactatgtctggttttccaaatcagaatggtgtggaagaaagaagaaaccaaaattttatggaaatggtgaggagtatgaggagtaatagaaaacttcctaaattcttgtggatcgaagcactaaagacgaatgtgtatatattaaatcgagtaccaacctag

SEQ ID NO: 10225 - DNA, 309 bp, Glycine max
  Peptide Sequence Number=SeqID_127003
atgttatctattagtggtacagacgacataggtgattcttggggggacttaactcttacaaatgaagtcaatgcattgttaaagagattttcacagcttggtgtaggcggtttgagaactccaagtgtgtcccgcaaagatgccaataacaaaaagagaaccaaaaaaattccttatatgaatgaatttcccaatccattgcaacagttcatcgtaaaaaatgttgaagtgagacccgatggaaattatggttacaagataattgcagctttactaggtcagggtgaggaatcatgggctctagtttga

SEQ ID NO: 10226 - DNA, 402 bp, Glycine max
  Peptide Sequence Number=SeqID_127004
atgcggggtcaccttatggttacccgcacctttcctcaacaaggggaaaaagagcccgttgacgcgcggagactaacatcgtcttctgcaccttttgtcgtattgacccctgaagtcaacgacatgcggggttaccttttggttaacggcacctttcgtcagccaggggcaaacgagcctgttgacgcgcggagactaacatcatcttctgcaccttttgtcgtcctgactcgtgaagtcagaacctttcgtcaaccaggggaaaacaagcccgttgacgcacagagactaacatcgtcttcttcaccttttatcgtcttgacccgtgaagtcaagtggcatgcggggttaccttatggttacccgcacctttcgtcaaccaggggaaaacgagcccgttga

SEQ ID NO: 10227 - DNA, 273 bp, Glycine max
  Peptide Sequence Number=SeqID_127005
atggaggaagctgctcaatccagaagcactgacactatgattgatcctccatcttccatcagacaacacaattcgttggaggagcaagcctcacagggttcctttgatgcccatggacgtcaggatgtactgactgctgccattgagcgaccagaacaccctggtcgtggcgtgctactggagcttgtgtcacgatcaagcaatactttggactggctccaaggacctctagcacgtattcctccatggctcccaaagacttggagcagctga

SEQ ID NO: 10228 - DNA, 228 bp, Glycine max
  Peptide Sequence Number=SeqID_127006
atggaatacgattcgctttcaagatgccttggtggtgaaatggtagacacgcgagactcaaaatctcgtgctaaagagcgtggaggggatctttcaattgagaagatccatcgacctgagacgaagagaaagaaagttaaaccaatgattcgttattgggagcagatagcaacaaccatctcatctgggaaaagccatctttttctccacaatgtctttgtcatttga

SEQ ID NO: 10229 - DNA, 282 bp, Glycine max
  Peptide Sequence Number=SeqID_127007
atgaattgcagggatggaaaagccgtatgcatcaatacgcagaaaatgcttgtacgggtaatgatccaccaacccgctagttctttttatgaggcacaaacgggagaatttatcctggaagcggaagagctactgaaaatgcgtgaaactatcacaagggtttatgtacaaagaacgggcaaacctttatgggttatatccgaagacatggaaagggatgttttcatgtcagcagcagaagcccaagctcacggaattgtagatcttgtagccgttgaataa

SEQ ID NO: 10230 - DNA, 495 bp, Glycine max
  Peptide Sequence Number=SeqID_127008
gcaaatttcgcaaaatgggaaccctggcatggaaaattcggattttcctacccttggggaaggtacttaaagattggtgaagttcttcgagaactggctgcatttattcttgcagcaggacactgccttgaagcatcaaaagagcccatggcatctttgaggcagtcacaatgggtccatttagaaacatgcgaagcagttgagacgaaggttgtgtatattctacgagaacttggtgaaagcatgaagcaaatgaggaaatgtgatgcaaaggacaacatttgggaccagttgaaaaatgccagagaagatttaagcttgataatttccacatccaaaatggtggagcttgaggattgccaagtgctagcaattgctagcttcgtgttcttgctcatggaagtggtagggaaggttgaggaattggtcaaagaggtggaggagctaggagacattgctggttttcgcaccaccacaacttcattgtcttcgtag

SEQ ID NO: 10231 - DNA, 291 bp, Glycine max
  Peptide Sequence Number=SeqID_127009
atgtcaggactcatacgcgattctcctcaaatttcagctagcccgcatcaattagactttgcaccttacgcttcagggtcatacaatgctcaatggcatgtcccgaaattcctgcatgatatgcgcatgttgcgttcgagtcgtatcctcggagaaatggaggttgaggaaccttggttggggttatggctaccattgaactatcgagtgggttttgtggttgatttagggatggcctttgtggataactgggtggtaggtaaggagaagggttgtttattggctgagtaa

SEQ ID NO: 10232 - DNA, 189 bp, Glycine max
  Peptide Sequence Number=SeqID_127010
atgtcgtttaaagagtcgacaccgctttgcacaagaatcggttctttgtatggatggacagaagggctcagccagacccggttcaattcgttttttgcgggaataccagcctgccttgtggaggtctctcgggtgtctacggcggatccgatcagtctcgtgaagaagtcttttccgatcttccactaa

SEQ ID NO: 10233 - DNA, 1533 bp, Glycine max
  Peptide Sequence Number=SeqID_127011
atgtcattccacggtggtctgattggggtgatcgtggtgatgctgatcttcgcccgccgtaccaaacgcaccttcttccaggtctctgatttcattgcgccgctgatcccgtttggcctcggtgctggccgtctcggcaacttcatcaacggcgaactgtggggccgcgtggcgcctgactttaaattcgccatgctgttcccgggttcgcgcagcgaagacctcgcgctggcggccaataacccgcaatatcaggaactgctgaacacgtacggcgtgctgccgcgccatccgtcacagctgtacgagctgtgcctggaaggcattgtgctgtttattattctcaacctgtttattcgcaagccgcgcccgatgggcagcgtctccggcctgttcctgattggctacggcgcattccgcattatcgtggagtttttccgccagccggatgcccagcttggcctgttcgaaggcggtatcagtatgggccagattctgtcgatcccgatgattctggccggagtgattatgatggtctgggcgtatcgtcgtcgcccgcagcaacaaacgcaaaaggccgaccgtaccggtaccggcacgctctccatctttggccaccagatgcgtttcaatttgcaggacggttttccgctggtcaccaccaagaaggtgcatctgcgctcaatcattcatgagctgctgtggttcctaaaaggcgacaccaacatcggctacctgaaagagaacaaggtcaccatctgggacgaatgggcggatgaaaacggcgatctgggaccggtctacggcaagcagtggcgcagctggggcaatgcttccggcgaagagatcgatcaaatcagcaaggtgattgagcagctgaaacgcgatccggattcgcgccgcattatcgtttcggcatggaatgtcggtgagctggatcagatggcgctggcgccgtgccacgcgtttttccagttctatgtggcgaatggcaagctgtcgtgccagctgtaccagcgttcgtgcgatatcttcctcggcctgccgttcaatatcgccagctatgcgctgctggtgcatatggtggcacagcagtgcgatcttgaggtgggcgatttcgtctggaccggcggcgatacgcacctgtacagtaaccatctcgaacaggcgcgactgcagctgacgcgtgaaacgcgaccgctgccgaaactggtgattaagcgtaagcccgcgtcgatttttgattaccagttcgatgattttgagatcgaaggctacgatccgcatccggcgatcaaagcgccggcgcagagtgccggttatgaacagaacccaaaacgccggctttacgctgccggaactgctgctggttatggtgattgccggcatcctcagcatcgcagccttacagggctggcagcgctggcaacacctgtggctgcagccgggcgaaaacggctgcctcggcaccgggccgcagcccgcagaagggtgtcagctgcagtcgcgctggctgttccggccaccttatag

SEQ ID NO: 10234 - DNA, 462 bp, Glycine max
  Peptide Sequence Number=SeqID_127012
atgatagttaaccaacaagtgaaggtacctttctccattggaacatataaagatgaagttaattttgatatagttcccatggagattatttacaatggtctaactaatgagattaccttcacccatcttgacactaaatttgtgttgcatcctcaaacaccttcacagaaaaaagaaaagaaaaagaaagatagtaaggcattgtcttcaaaggccaatgggaaggaaaaagaggaaaagaattcctccaagaagactgttaagaaggaaaatcattttgcaacaaaatgtgatatcaaaagagcactccttcttaaacaatctttctatcttctcctatcaagggaaacatcccttagcactgccatatctcttgagtttgaggttattcctcaagtgaaggagttattggatgagggtttggttcgtaagagcttaactccttgtactttgttggtgtga

SEQ ID NO: 10235 - DNA, 426 bp, Glycine max
  Peptide Sequence Number=SeqID_127013
atgattgctgcagcaaatgctggctaccgggctattgcctttgattttagaggttatggactttctgagcatcccgcggagccacaaaaagcaaacttacttgaccttgttgatgatgtcgtgggtccgttggattcattaagcattaccaaggaggctgggagggcagaagcagattttgttcgctttgatgttaagtcagttataaggaacatctacacattcttctctagaagtgagataccaataataggtgataatcaggaaatcatggatttgtatgacccaactactgccctgccactaggggtggaaatgagccaagccaagccaagctttattaggcttgagcttggcttattacctgtcataggcttttttttaaggctcggctcggcttacataaaagcctggcttggaccatga

SEQ ID NO: 10236 - DNA, 567 bp, Glycine max
  Peptide Sequence Number=SeqID_127014
atggcagaatcttcccgctccaagtccaacatggatcacatcaaggatgtcattgcccacttatctaacaaattggaggacctttgtcaaaaggttatctggagacaagctcgcattcgccgacattatccacagccaatctcaatccacttcacccgtcaacttcctctcttcatcaaccaattattttcttatcacgacacaccagaactcgaccgcctcacgattgcttccttctatatggaaggaccggtcctcgcatggttccagtggatgtcgcggaacgaccaactttcatcatggcctggttttttgcaagaattggaggctcgatttgccccttcccaatatgaggatcctaccgataccttattcaagctcacacagaggggaacaatcactgagtatttctctgaattcgaatctcttgccaattgtatcgttggtcttccaccaaccttcttacttagatgtttcgtttctggattagcaccggaaatccgaagggaggtccaagccttgcaacctttgactatggtgcaggctacgaccctggcccatctctag

SEQ ID NO: 10237 - DNA, 432 bp, Glycine max
  Peptide Sequence Number=SeqID_127015
atggccagccccatggactttcagggtcctccacgggtttttgggcctcatcggtttttaccgccgctttatcaaagggtatgcaatcatggcagcccccttgactcatctattgaccactcctcaattggtttggacaaccgaagctcagaccgccttccagaagctgaaagacgccatgagttatgcgccaactctacaacttctgaatttctcagtgtcattcatggtggagacagatgtgtcgggtacagggatgagaattctcctctctcagtcagtctgaagaagcttatgaatcaaacaatccaaactccagagcaacaactgtacctcgttcatcttctcgggtatgactataccatcaagtatagatcaggaaaatccaatacagtggcggatgctttgtctcaagcctttgaagattcatag

SEQ ID NO: 10238 - DNA, 408 bp, Glycine max
  Peptide Sequence Number=SeqID_127016
atgagtcatttctcctctctggtcttactggtgaagaagcacgatgggtcttggcatttctatgctaattatcgagctcttaacgccatcaccatcaaggataggttccttatccccacggtggatgaattgttggacgaattgggaggagcacagtggttcttgaagcttgacttgcttcaagggtaccatcaaattttgatgaaggaggaggatatcaacaaaatgatgtttcgcatccatcatgggcattacgagtttcgcatagtgccctttggattgtgcaatgccctatcctcgttccaagctacaatgaacgacacttttaggccttatttgcacaagtttgtcattgtgttttttgacgatatccttatatacaacaagacgaggactgaccatctctag

SEQ ID NO: 10239 - DNA, 283 bp, Glycine max
  Peptide Sequence Number=SeqID_127017
gcgccgccacggcatccgtcgtcgtagccctgcggggtgccgtgggggaatccctcgacgaagaggtctgagctgctcatcatttcgtctccttgatcggtgcggggagcttgtcgagggtggtgtcccacccgatgtaggtctcggagttcgcggcctcgaggtgaacgtcctccccgcggatgctccggatgatccaccggcgtcgaccgagagtgatcacgtcgccgattcggtgcccgacgatgtcgacgtcgagcttggacgggcggcggtacggtga

SEQ ID NO: 10240 - DNA, 676 bp, Glycine max
  Peptide Sequence Number=SeqID_127018
gtcgactctagaggatcccaccacccggaagaaccacgccgactgccccggccacgctggccacgtcaccgggtggaaccccgaggacttggcgatcgaatatgtgtgcaccgactacgccgcgcacggccacgcttacgccagcagcgcacccaaggagctcacagccgaggagaagcaggcgaaggccgacgatgaggcacagcaggccgccatgctcgcgaaccgcgaagcccgccgccattggatccacgacctcctccccggcaagatcaaccagctcgccggcgtctacgactacatggccgcggcgctcctccgtcacgacgactggaacaacgacggccgagcaccaacggtcacaatggcactgctcgacatcgacgtacccgatgactactacaagcgccgcggcgcgatggacgatctcgtcctctcgaagaagatcgctcccttccgcctcatgctcgccaccgccttcggcatccacgagctcatgctcgaacagggccgcgaagccgtaggccgcgtccgccacttcacccagctcgagaagtggggttacccgctgtcagagatcgaccagaccgcactcgccgaagcgcaggagcagctcaacgccgcagccgcgcgactcgctgccgaagcagaggtcgacgaggacgacgcagcatga

SEQ ID NO: 10241 - DNA, 171 bp, Glycine max
  Peptide Sequence Number=SeqID_127019
atgaggattgcatcacgcaacgtcgtgcttagcgagcagatctcgcgcttagtgtgcggccttgatattgatgctctgccagattcttctgttgcgctaagtgagctgagcccaaatggtgagctgagcgcaactaccacttttagcacttcaagacttagcctcatttaa

SEQ ID NO: 10242 - DNA, 273 bp, Glycine max
  Peptide Sequence Number=SeqID_127020
atggtagccataacccctgctaggtttcctcaacctccatttttccgaggatacgactcgaacgcaatgtgtgcttatcatggaggagctccggggcattccattgagcattgtataaccctgaagcgtaaggatttccaagtttatgccattattgtaaaccacagttacaatgctaaaatggatgaatttgacgtccttgtctctctcatcctttcactaacacatctttgcttattcaacttccactggaatgtgagtgtaagccattag

SEQ ID NO: 10243 - DNA, 210 bp, Glycine max
  Peptide Sequence Number=SeqID_127021
atgtctgaggcagcaaaagaaatcgctgacaagatcggatcgttcgtcccccatggacatcaggaagtcttgactgctgccattgggcgagcagagcaccctggccgtgtccgtgctgctggaatcggtattaccataaagaaatattttggatcggctccacgaatgtcctgcaactcttcctccctgcctcctgaagacctacaatag

SEQ ID NO: 10244 - DNA, 975 bp, Glycine max
  Peptide Sequence Number=SeqID_127022
atggctccgaagaaactctccacgaaaaggtctagaagggacgccactgaagaaggctctagtgccgcctcagagtttgatagtcaccgtttccggagtgctgagcaccaacagcgcttcgaggccatcaagggatggtcattccacagggagaggtgtgtccagcttagggaagacgagtaccctgacttccagggagagatagctcgtaggcattgggcatggctagtgacccctatggctaaattcgacccggagatagtcatagaattttatgtcaatgcctggcccactgaggagggggttcgggacatgcgctcatgggtgaggggtcactgggtcccctttgatgcagatgccatcaaccagttcttgggcgacccgctgattttggaggaagaccagcaatgtgaattcagccagataaggagccaggaaaacggttttgatgaggaagccattgcccagctgttgtgcataccggggcaggatttcacctggaccgctgcagggaggcgggtgcagatcatgcgcactagcatgactaccttgacccagatatggatgacactgctgctcaacaatgtcttgcctaatgaccacaactctgaccttcctctgcctaagtgccagttggtgtatgccatcctgacacggataagtgttcacatggcccaggtgattgctgatgccacttatttgtttgcaggaatgacacctactaggcaccctctggacctagagaagtccaacagggccctggggtttccggctctaatcacgggcctctgccagtcctacggagttcctatcacccccagcaaggtaatccgaccgccgatcacccgatccttcatcgagaagtactgcatgcctaggcagacgcagggtgacgcacatcaggacgcgggcgcaccgccaccacctcagcaggccgattcggatgggccactgggcgtggagtggtatctataa

SEQ ID NO: 10245 - DNA, 2011 bp, Glycine max
  Peptide Sequence Number=SeqID_127023
gttcaaggaatggggatttgataaaggttggggcaacactgcaggaagagttaaagagacaatgaaattgctctccgaggtactagaatctgcagatccagtgaaattggaatcacttttcagcaggcttccaaatatgttcaacatagttatcctctccattcatggatactttggccaagcagatgtccttggattgccagacactggaggccaggtggtatatattcttgatcaagtaagggccttagaggaggagctactccataagattgagctacaaggcctcgatgtgaagcctcagattcttgtggtaactcgtctcataccagatgccaaagggaccacatgtaaccaagaactagaacctgtcacccacactaagcactccaacattctcagggtccctttctatacagacaagggaatgcttcaccaatgggatgctactgccaagattcttgagctcatggaagacaagcctgacctcataattggaaattacactgatggaaacttggtgtcatccttaatggcttctaaacttggagtgactcaggcaaccattgctcatgctttggagaagaccaaatatgaggactccgacgccaaatggatggcgtttgatgaaaagtaccacttctcatgtcagttcacagctgacataatctcaatgaatgcagctgatttcatcataactagtacataccaagagattgctggaagcaagcaaaagccgggacagtatgaaacacacactgcattcaccatgcctggactttgtcgcgcagtctctggtatcaacgtgtttgatccaaagttcaacattgctgcacctggagctgatcaatctgtctacttcccttccacagagaaagagcagcgattgatcgcatttcatcctgccattgaagaactactttttagtaaggatgacaatgaagagcacataggatttttggaagacatgaagaaaccaatcatcttctccatggctaggcttgacaaagtgaagaaccttagtggcctagttgagtggtatgcaagaaacaagaggctgaggagcttggtgaaccttgtggttgttggaggattcttcaatccagccaaatccaaagacagagaagaaactgaggagatcaagaagatgcatttcttgatgaaggagtacaatctcaagggacaattcagatggattgcagctcaaaccgatcgctaccgcaacagtgagctgtaccggtgcatttcagattcaaagggagcttttgtgcaaccagcattgtatgaggcctttggtctcacagtcattgaggctatgaactgtggactacctacttttgcaacaaatcaaggaggaccagctgaaattatagttgatgaggtctcaggctttcatattgatccttacaatggagatgaatcaagtgacaagattgctgacttctttgaaaagtgcaagattgattctgagcattggaacagaatgtcaaaagccggtcttcagcgtatcaatgaatgctatacatggaagatatatgcaaaaaaagtcttgaatatgggatcaatttatggcttttggaaaagattgaacaaggagcaaaagttggcaaaggagagatacaaccatatgttctataaccttcaattcaggaacttggcaaaacaggtacctattcctagtgagagaccccaagatccaacacaaatgccaaagccttctgctccagctccatccagaagaccagcagcaaaagcaaggcctaaaaaagtttctgaacatgggatagttggagctccactaaccctattaacagcagcagcaacaccaaaaattaaagatcatccaaccacaagtggtgaaggtgtgagtgcgagaacagctacttctgaacaaagtggtggtggtggtggtttatttggattacgttggttggtctccataatttcttttttgtgcgccattcattacttgttgaagaatttggatcgtctgttcacaagggagcaatga

SEQ ID NO: 10246 - DNA, 710 bp, Glycine max
  Peptide Sequence Number=SeqID_127024
atggcttctactgcctcaaactctgccttgaagagatcagattcaatcacagatagcatgccagaagccttgaagcaaagccggttccatatgaagagatgctttgccaggtttgttgcaagtgggaaaaggttaatgaaacagcagcatgtaatggatgatgcggagaaaacagttgaagataaagttgagaggaaaaagcttttagatggcatgttgggttacatcttcagttgcactcaggaagcagctgttgttcccccatatattgcttttgcagtgaggcctaatcctggcttctgggaatatattaaagtgaatgcagatgatttgcaagtagaaggtattgaggctgtagaatacttgaagtacaaggaaatgatatttgatgagaaatgggcaaatgatgaaaatgctttggagctagactttggggctattgatttctccacccctcgcatggttctttcttcttctattgggaatggactaaactttacaaccaagatcttgacctcaaggttgagtgagagctcccaaaacataaatcctttgctggattacttattgagccttaactatcaaggagagaatcttatgatcaaagacaccttgaacaccatgccaaagcttcagcaagcactgaaagtggctgaagcatatgtatctgcactccacaaagacacaccataccagaaatttgaggacag

SEQ ID NO: 10247 - DNA, 207 bp, Glycine max
  Peptide Sequence Number=SeqID_127025
atgggcaaacaagcccatagatgcacggagactaacatcattttctgtaccttttgtcgtcctgaccctttgaagtcaggtgatttgcggggttaccttagggttagccgcacctttggtcaactagggggaaacgagcccgttgacacgcggggacaaacatcatcctctgcaccttttgtcgtcttgacccgtgaagtcaggtga

SEQ ID NO: 10248 - DNA, 457 bp, Glycine max
  Peptide Sequence Number=SeqID_127026
atgattattgaggaatccattcatgttgcttttgatgaaactaatgcaattttgccaagaaagaatatactagatgatattttagaatctttagaagaaatgcatattcatggtgaagatcacaaaggcaaaggagagggaaatgatgaagattttcacattcatgaaacaaaaacaaatgctgatcttccaagagagtggaaaacttctagataccatcctgttgacaagattatcggtgatatatctaaaggggctaggttagtagccaaaggatacaatcaggaagaaggaatagattatgaagaaacatatgctccaattgctagattagaagtcattagaatgttattagcctttgcatccataatggattttaaactttaccaaatggatgtgaagagtgcctttttgaatggctttatccaagaggaagtatatgtagatcaaccccctg

SEQ ID NO: 10249 - DNA, 1210 bp, Glycine max
  Peptide Sequence Number=SeqID_127027
atgcaacaattcgaacggcgttacccggagattgagctggagtggatgatcgccgaagatggcgacgttatcgatctgctgcaaagcggccgcgcgcatttgggcatggtggaactatctgctgctgctggagatggcggaacaggggttcggctgggcggtattgccgcactggctggtgcaacaatacggccacaatatgctgaccgagctgcggccgcgcggctggccgaaaatgatctcggtggatgcggtatggtcaaaactgaccccgccgggcccggcggggttctgggtgctgaagcgcctgctgggcgattccctgccttaagcggcggcgttgcgcgcctggatggcgcgcgaaacggtgtcgagcagctcgggaatgtccatcttcggcagcatcacttcaatgaaggccagccgatcgccgtcggctacctcgcgcagcgcctggcgcaagccgtccgaatcgctgacccgcagcgccttcaccggccgctcgccggccagcgcaggcggcagctgcgtccagttccagcgcgcgatgtcgttataacgttgctccggcccgtggatggcgcgctcgacggtatatccctgattattcagcacgaagatcaccggtttaagcccgtcgcgcagcatcgaacccagctcctgcacggtcagctgcgcggcgccgtcgccaatcagcagcactgcccggcgctgcggttcggcggtctgcacgccgaacgtcgccggcagggtatagccgatcgatccccagagcgactgcacgatcaaccggcagccgcgcggcaacgtcagcgccgccgcaccaaaacaggcggtgccctgatcggccagcacgatatccccgggccgcaggaaatcctgcatctgccgccagaaggcgtgctgatccagcccttctccatcgccttccggcagcgccgggcggacgatcggcggcaacggccaacgcgacgccagcgacaggctcaggcgatgcagcgcctgcaccgcctcgcgcatcggaatgcggctaaagcgctgccgcccgacccaggcttcgaacggctgaatgtcgatacatttttccaccggcagatgatgcgtgaaaccagcggtaatggtgtcggtcaaacgcacgccgacgttgatcaccacatcggcgttttcgataagctgtttcaccgccggatcgctggcaccgccgcagtag

SEQ ID NO: 10250 - DNA, 294 bp, Glycine max
  Peptide Sequence Number=SeqID_127028
atgtggatcatgcattgttttaatgatgtcgaaaagaaatcacttgattgtcatcatcaaaaagggggagaatgtgaatgtatgatgattttgatgatgccaaagaagaatcaaacaaggccgcttcaaaggataagcattttcttcaagattaattcaagattgcttcaacaaacaaagccttgtttcaagattcaccaaagatcaagccttgcctcaaaacaaagggtttcaaagtcatgcaaggctctggtaatcgattaccagaagggaagaatgaaaaagagttgttga

SEQ ID NO: 10251 - DNA, 213 bp, Glycine max
  Peptide Sequence Number=SeqID_127029
gtacgtacgcgccggttcagcgaaggggacttggtgttgaagaaagtctcccaagctttgaaagacaacagagggaagtgggccccgaactacgacggacctttcgttgtaaaaagagctttctccggaggggccctggtgctcacccacatggatggcgaggagctaccttcacccgtgaactccaatgttgtcaagcgatactacacttag

SEQ ID NO: 10252 - DNA, 273 bp, Glycine max
  Peptide Sequence Number=SeqID_127030
atgtcgacttacgtacgtctcgttgaccaaacgatcaggctacctctcctatccgcttctctacaaggtctactttcttcttccttcagaccgggccaagcctttagtttaagtaggtttgggctaggtcgttgcgctcctgccacgtcttggcaaaaaagtaggctgatgggcaagcctcctcctgccgcaatggtgtggggcgtcagaggctgttgccccgtggccaactcgaaggggctgaagttcgacgcagagctttttggttgttaa

SEQ ID NO: 10253 - DNA, 336 bp, Glycine max
  Peptide Sequence Number=SeqID_127031
atgaaggccttttcaagtgtctctgcttactgtcaacatctcaagtcactgttgaatcaactcaagaatgccggcttttcggtcgataacacacgatcgatgcttgttctcgaagaattcggccttaagaaggcggctcagacctcgtcctccgccatagtggctcgtgactcgaatgaatctcaagagatgtctgatcattcatcagcatgctgcacaaataatggtggaaaacggtattcaaaccatggcaattctagaaagaatcgcaacaacactggtggtcatgataactcaggcgttgacaagggaggctctggttcaaaaacttattaa

SEQ ID NO: 10254 - DNA, 381 bp, Glycine max
  Peptide Sequence Number=SeqID_127032
atggataagagcttgaaggtaggggaagatgagtggagggagagggagagaaggagcacgaaattttgtgcctcaaatgagtctaggtgtcctaaaatacaagggctgaaaaatcctgcatttctagggtaccatatgatgcaatcctatcccgcaaggacattggatagaaaacttcaagtagattgggcaagagatccaagggaaggccctagggttctcatgaatgtcttttctttggccattctacctcacataagggttacaactttgtttgagtctgtttcttctacacctgaaccttcttcatactccactccctttaatttcccttctatacctatcatacataatcctttgtctaactccgtaggttcatga

SEQ ID NO: 10255 - DNA, 216 bp, Glycine max
  Peptide Sequence Number=SeqID_127033
atgaggttacgagttcttcttgacgttcgaaagtcactagtaaaatcattaaaattaaagaagccaggaggtgaagcaaaggacgtattgatcaagtatgaaaagcttggttcatcctgctatctatgtggcttacttggccatgtagatgattcatgccgaaaaatcctaattatgagcattgactatatatggagttcgaggatggggccatga

SEQ ID NO: 10256 - DNA, 684 bp, Glycine max
  Peptide Sequence Number=SeqID_127034
atgcttcattcaccaggtgttttggcaattggaagtagtaagaaaggagaaaattcatattcacatcatttggactcagatgttggcgtttcagttgttgatcgttttacattttacactcttgctttctttgagaggctgaatatgtatgacaatgcttcattgagcagccttttcaattcatataatccaaatttgttgatgtcaaccgcatattacagaatggatctataccaatgccatttagaggaggtacctgtgacaaacttctttggttctgtaatgaagacgatacatactgattcagcctacagatcccggtcaaataaaaaaatcggggcagcaaaaaccaaaatgtctccggatgaatcaatatctgacagtgactcagatgaggaggatcagtttaataatttaactgctgaggtgaatttaatttatgcctcattcagattgcttttacaatttaaactgtttcacgtaaagctgaaaatcatggacactggattcgctttgcagaaatatctccagtatagtgttggacaactatggagtgttattctcagcaatgcgaatacttttgaaagcatcgatagtttggtgtgctatggactgcttttaatgcttcctttgttgatattttccacatggctatcaaagtatgattggggaaacattccataa

SEQ ID NO: 10257 - DNA, 498 bp, Glycine max
  Peptide Sequence Number=SeqID_127035
atggagcattcaagtgctaacattattgtagattcggttagcaaaaatgatcatgaggcaatcattgctactgactcatgtcctaaacgtgccaacccactctcaatgccaatcaataccacaaacataaatgctcaacggaccgatcagccatcaacgctaaatcaaagcacaatgactcaaccaacgattgatgctatgaacgttgaaggcaatcatacgaatgaattaattattggagataagaagcgacacttgactgatggcagcagcaacatggacgtgaacgaaactaatttagtgcaaccttcaaagaacactattgccccagtttcaaattcctctttcccatacattccttttttaatggtgggccctggcaatcggatccgtcaaggtttattggatgaaactaggcctacatatatagttcaattctcagtttctatgaaaggagatgttgtggaacctataaaccctatggccttaatagggtga

SEQ ID NO: 10258 - DNA, 306 bp, Glycine max
  Peptide Sequence Number=SeqID_127036
atgggaactatcgcaccagtggaggatggttgttttgatggcaaggttcgggattatggtggagaatcgggtcgggttccatcgtccagcttcggggagaagttgagacatgttcttggcattgacattgattcagaatctcttgaaatagcttccgataatgctgaggaacttgaggtattgtctttatgcttattattatgctttttcaagctgttggggcttgccttgaatctccaggactgctacgttggtgaatttggcaaggaagtctgtgaatcgaaggcttcctacttcaaatggtag

SEQ ID NO: 10259 - DNA, 222 bp, Glycine max
  Peptide Sequence Number=SeqID_127037
atgatagggggtgtatgtataagggagggcaatgtgcctaagaccccaaaacagtgtgggaaagagggcaccaccacagaggatggaacgaccacctgtcgccaccagcgtagggccttgcgatggaaggccgtcgtgggttcagcagtgacaagacatggcacgacagtggggctacggagtcttagggaatgcaaatggaatacgaagaaatgtagatga

SEQ ID NO: 10260 - DNA, 405 bp, Glycine max
  Peptide Sequence Number=SeqID_127038
atgggtgacctagaggaagtacaggaacagatgaaagccgacatgtcgactttgaaagaacaaatggcttccatgatggatgccatgttgggaatgaaacaactaatggagagtaatgcggccaccgtcgccgctgttagttcggctgccgaggtagacccgactctccagactaatgcgcaccaccctattccaaacatggtaggacgagaaagaagcacaccggggcacatcaacaacccccatccggggtacaaccgaggaacttacccctacggcttaccacctaattacacaccaccagccatacatgatgacgtaggtcacgttcctcccctcatcctcgaaggggagcctcctcgacatcttgatggggtccacgagaatcctcgagagcatgcttag

SEQ ID NO: 10261 - DNA, 354 bp, Glycine max
  Peptide Sequence Number=SeqID_127039
atggattgggtctcaaaaactatcaaaccaatgcaattcagacaaaatctaacggaactcatcagtgttggcttaattgcatcattcactcttgtaatgtggaaagggttaatgtgtgttaccggtagtggaacacctgttgttgttgttatctctggtagcatggaaccaggattccgaagacttatgattctgctacagggtgatattttgttcttacacatgagcaaagatcctattcgcgcaggagacatcgtggtttacaatctagataaaagtggtaaaattgaaaaatacctccaatattacatggcaagacacattgacatgttgggactaagaatatatttttag

SEQ ID NO: 10262 - DNA, 318 bp, Glycine max
  Peptide Sequence Number=SeqID_127040
atgaggatgtctcctccacctctagaacctcacaatcactcacaaactcagctcaagctctcaggacaaattcctcttcaagctccgttctctgcaggtggccttgttggtgcttgcatgcttagcacaactctggctcgcttagcgcacattagtgaattttggcttagcgctcgtctttttgctcaacggatggactcaagcggtgcacttagtgggattatccctcgctcaacgaacatgcactgctcatccttcttccagattcttcctcgcactcagccaaaggagtgttgcgctcagcagatggctcgttaa

SEQ ID NO: 10263 - DNA, 1284 bp, Glycine max
  Peptide Sequence Number=SeqID_127041
atgaccaattgggaccggggcagcattgtaaacgcaacactacgtggcctatgcgtgttgcccatatcggtcatttcgtgggacaacaaaaagtcgactcaggaggaggaggaggaggagacagagacaccgctcgctcgatttgaaaaggttaagatctggaatcccgttgaagtcgctgagcaagctcgccatgactacgcttcgcagattcatccctcacatctcaccattgatccctccctcgagcttcctcaaatgacacctctcgtcctaaagttgtgcaaggatatgttcaaggcgtggtcgaatttggatgattcttgctttgttgttgagaaaatttccgggggcataacaaatttgttactcaaggtttcagttaaacaagaaaactgcattgaggaaactataactgtcagattgtatggacccaacactgagtacattattgatcggcagagggaattgcaggctaccaaatacatcacagctgcaggatttggtgctaagtggcttggcatatttgggaatggcatggtgcaatcttttataaatgcacacactctatctccttcagatatgcgagagccaaagctggctgctaaaatagctaagcaacttcaaagatttcatcatgtggaaattccaggctcaaaggaacctcaattatggaatgatgtctggaagttctttgagaaagcatctgttcttgaatttgatgatagtaaaatgcagaagacttatgagacaatttcattcaaggaagtccatgatgaaattgttgagctcaagggattgtgtgatctactcaaatctcctgtaatttttgctcacaatgacttgctttctggaaatataatgatgaattgtgaagaagataaactttacttcattgattatgaatatgcatcgtacaactacagaggctatgatataggagaccactttgcagaatatgctggctttgaatgtgactacgacttgtacccaaatatgaatgaacaatatcatttcctcaggcattacttgaaacctgaaagaccccaagaggtgtctgagaaagatcttgaaactttgtatgttgaggcaaatacattttcccttgcttctcacattttctgggcattgtggggtctaattcaggcaaagatgtctgcaattgaatttgattatcttggttactttttccttcgataccacgagtacaaaaggcacaaagagaagtatttcttgctggcacagtcctacctttcaggatgcaagaatgagatgagtagatag

SEQ ID NO: 10264 - DNA, 174 bp, Glycine max
  Peptide Sequence Number=SeqID_127042
ggagaaagaggaggaagaaaagaaaagagaaaggaaaaggagacacttatcttcacaggaggaggaaaggggataagggagcgtgagaataagggggcaccggaagaaggtgccatcgagggaaggttgttgtcacgagggtttgctatcgagggagatggtgtcacgggttga

SEQ ID NO: 10265 - DNA, 174 bp, Glycine max
  Peptide Sequence Number=SeqID_127043
atgcctatatggtggctaggtgctacttacacggctaaaatctcccccttgagggacaatgaaagcacaaattgtcaaaaaggaggcactttgtttttagtgtttttcacatctattggagttgtgaaagatgcagaaatgggagttccttgcagcccaaagcttcaaggatga

SEQ ID NO: 10266 - DNA, 201 bp, Glycine max
  Peptide Sequence Number=SeqID_127044
atggagcatgaaacattccttgcaacttggttggcagagattgatttctctcccaatggcttgagattctcaaatttgcaaccacagcctaggttgatcaaccatgaaaaacctatgctatgtaggtggcataagcttaatcccttgaaaattgagggtaggagatttgccctagattcagctagggactactttccttag

SEQ ID NO: 10267 - DNA, 123 bp, Glycine max
  Peptide Sequence Number=SeqID_127045
gaagtttgctatgggattgctgagaggttggagcgccatctgagcctaggggtagtcacgccaggctcatcaacacatgaggtgatcgaagaatgcctcaggatggtcagaggtgtttcatag

SEQ ID NO: 10268 - DNA, 393 bp, Glycine max
  Peptide Sequence Number=SeqID_127046
atgggatcgagtcagtcgccttcgcttaaaaagaggttctatcaagtcaaggtcaagagcctaggagtcaccagtcttaaagaattagggcagttgatgggtcagctccagcaacaagctcttcgtaaagcttacggtaagatctgggacctagccatggcagaggtctccactgaggccattgcctccttcgtccaatattatgaccagccgttgagatgcttcacctttggggacttccagttatcacccatggtggaagagtttgaagaaatcctgggatgccctctggggggaaggaaaccatacctcttctcgggattctatccctctttagctagaatttctaagatattccaaatctcaacgcaggaattagaccatagaaaataa

SEQ ID NO: 10269 - DNA, 165 bp, Glycine max
  Peptide Sequence Number=SeqID_127047
atggggagaaaaatttggggtttgtcatcatcaaacagggggaaattgtggaagcaaagctacgatgatgattcaccaagagatgatgccaaagctcaaagaggtttttcaagattaaagaatcaagcattcaagattccactcaaagattcaagaatcaaatga

SEQ ID NO: 10270 - DNA, 251 bp, Glycine max
  Peptide Sequence Number=SeqID_127048
atggcaattttgatcgccaatacttcatcaacaattcatagggatgaaagactcgggaatatgcatgcaataaatgggtttatgatcccaacatggttggctcatggggaaaacgcaaggtgccccatgtgtgcagttaagaagacgatatggatctttcaacttcccacgacaaaagacgagacccacatacaacgcatgtgtgacggcatgatgcagatgcgcaaaagcgcaacagggggatgcaccga

SEQ ID NO: 10271 - DNA, 669 bp, Glycine max
  Peptide Sequence Number=SeqID_127049
atgtttatcttcagccatgaagtgatgattctgcgcgtcagtaacaacctggcgaaacgctcatcgcgtttcctcaagcgcactttcgacgtagtggttgcctccctgctgctgctgtttcttgccccggtgttcggtctgctgtgctggatggtaaaacgcgatggcggcaatgccatttatggccacgaacgcgtcggtcaggatggcgtgaaatttaagtgcctgaagttccgttcaatggtgaccaactcgcaggaggtgctgcagaatctgctggccaacagtgccgaagcgcgcgctgagtgggatcgtgatttcaaactgaagaacgatccgcgcatcaccaaaatcggtggcttcctgcgtaaaaccagcctggatgaactgccccagctgtggaacgtgattcgtggcgaaatgagtctggtgggaccgcgtccggtgattgaagctgagctggaacgctacgccggcgatgtcgactactatctgatggccaaaccgggcatgaccggtctgtggcaggtcagcgggcgtaacgatatcgactacgacacgcgcgtctattttgactcctggtacgtgaagaactgggcgctgtggaccgacatcgccattctgttcaaaaccgctggcgtggtgctgcgccgcgacggtgcttactga

SEQ ID NO: 10272 - DNA, 666 bp, Glycine max
  Peptide Sequence Number=SeqID_127050
atgatcttgatacttttatttggaaaggaagcccaactagaaattacagtgagattcgcataccacaccttaatggagagcatgataaacaatgaatccatcaaagtgcaaggaaattggacaactatatggagcctacaaatcccaccaaaggtgaaactttctctggcgcaaactatgagaatgtttactaacaagaaccagacttcagaaaaaaggagttcattgtacaaatttggagcattgaaaataaatgttaatgctggcatagtgattcaagatgagcttagaaggtttctgaaagctaaaactattacatcccatggtaacatcaagccaaaggaagcagaggtgtgggcattgtcgcaagcattgatttggatgactaacatggagttgcagaatgtaacatttgaagttgattgcaaggccgtcatggatggcttcaactccaaccagcagggaatcccaaaattttattttctaatttcaagttgtaatatactattatataattatcctaactctagggtgagtttagtacaaaggcaagcctaccaagttgctcattccttagcaagggcatcttggcttcatgctagcaaccaagtgtttaagcgtatacccaattgtattcttggtcttgtcttgaatgaaacacaataa

SEQ ID NO: 10273 - DNA, 1689 bp, Glycine max
  Peptide Sequence Number=SeqID_127051
atgatgagcgaaactttgactcaggctgttgcccgtgaaatccgtgcgccgcgcggtaatgaactgcactgcgccaactggctgattgaagcggcataccgcatgattcagaacaacctcgatcctgacgtggccgaacgcccggaggatctggtggtgtatggcggaatcggcaaagccgcgcgcaactgggcgtgctttgagcagattctgcgctcgctgcgtgcgctgcagccggaagagacgctgctgattcagtccggcaagccggtcggtgtgttccgcacccatgccgatgcgccgcgcgtactgctggccaactccaacctggtgccgcactgggcgacgtgggatcacttccacgaactggataaggccgggctgatgatgtatggccagatgaccgccggttcatggatctatatcggcgcgcagggtatcgtgcagggcacctttgaaaccttcgctgaagccggtcgccagcactacaacagtgacctgacgggccgctggatcctcaccgccggtctgggcggcatgggcggcgcgcagccgctggcgggcgtgctggccggtgcctgcgtgctggcgattgagtgccaggagtcgcgcatcgatttccgtctgcgcacccgctacctcgaccataaagcctacagcctggatgaggcgctggcgctgatcaaagacgccaccgaagccggccaggcgatctccgtgggtctgctgggcaacgcggccgagctggtcccggaactggtgcagcgcgcgaaagcgggcggcatgaagcctgacatcgtgaccgatcagacctccgcgcacgacccgatcaacggctatctgccggtgggctgggacgtggcgcgctgggaagccgagcgcgtcagcaatccgaaagcagtagagaaagcggcacgcgcctccatggcgcagcacgtgcaggcgatgctcgacttccaccacatgggtgtgccgaccgtggattatggcaataatattcgtcaggtagcgctggatgaaggggtgaaaaacgcctttgatttcccgggctttgtgccggcgtatattcgtccgctgttctgcgagggcaaaggcccgttccgctgggtggcgctctcgggcgatgcggaagatatctataaaaccgacgccaaactgaaagagctgttcccggatcacaaaaacctgcaccgctggctggatatggcgcaggagcgcatcgccttccagggcctgccggcgcgtatttgctggctggggctgggcgagcgtcataaagcggcgctggcattcaatgagatggtgcgcaacggcgagctgaaagcgccgatcgtgattggtcgtgaccacctcgactgcggctcggtggcgtcacctaaccgtgaaaccgaggcgatgaaggatggctcggatgcggtgtcagactggccgctgctgaacgcgctgctgaacaccgccggcggagccacctgggtgagcctgcaccacggcggcggcgtcggtatgggcttctcgcagcattccggggtggtgatcgtctgtgacggtacggctgaagcggatgcgcgccttggtcgcgtactgtggaacgacccggccaccggcgtgatgcgtcatgccgatgcgggctacgagctggcgcagacctgcgcagagcagcacggtctcaatttgccgatgctgaagtag

SEQ ID NO: 10274 - DNA, 441 bp, Glycine max
  Peptide Sequence Number=SeqID_127052
atgcaggctgctgaccgtctgctgctccacgcttaccgccgcgcgccagctgtcgcgccgcgtcatgatgttgaagtcctgacagctgccgctaacctgcgcctctatcgcccattcgccgggaaaggcccacggctgatggggcagcaatggctgttcggcctgttcacagcgcagcagcacgctatcgccgtgcagcaaagtgatcacccgatcgacgccggggaagggcgagaacggcccgtcggcgtcgatggtggcgatgctggcgcgccactcgaactgcgctgcgcccggcggatagctgataatttcgcgcgtctccccgccgccgttgcgccagcggctgaccggcagctgcgcgtagtcaaagcgcgcgttcattgcagcgcccgcatcgcccgggcaaagccagcggcggccgcttcttccgccgcgtga

SEQ ID NO: 10275 - DNA, 1209 bp, Glycine max
  Peptide Sequence Number=SeqID_127053
atggcagtttattttgccccacgcgcacggctggccgacggctggcaggaaaacgtgctgatcgcaaccgacgatcagggatttattcgcacccttaccgccgacagtacgcccggtgacgccgtgcgcctggccggcccggtgattccggcgatggccaacctgcattcccatgccttccagcgcgccatggccgggctggcggaagtggcaggcgatccgcaggacagcttctggacatggcgcgatctgatgtaccgcatggtgcagcgcctgtcgcctgagcaggtcggtgccatcgccacccacctctacattgatatgctcaagggcggctacagccaggtggcggaatttcactatctgcatcacgatccgcacggccagccctacgctgatgatgcgatgctgcaccagctgatgcaggcagcgcacaccgccggtatcggccagacgctgctgccggtgctgtacagctacagcggcttcggtgcgcagccggccagcgacggtcagcgacgcttcattcagcacaccgatgcctatctgcagcagcagcagcgcgtcgcgcagtggagcgcgcagcagccgctgatcaaccacggcctgtgtttccactcgctgcgggcggtaagcgaagcccagatgcatgaggtgctggccgccagcgctacgcatctgccggtgcacattcacgttgccgagcaggaaaaagaggttaatgacagtctggcatggagcggcgaacggccggtggcgtggctgtataaccgctttgccgttgatgcgcgctggtgcctgattcacgccacccatctcgatcagcaggagatggcgcgcatggcagacagcggcgcgattgccgggctgtgtcccaccaccgaagccaatctcggcgatggcatcttcccggcggtagagtacatcgggcgcggcgggcgctggggcattggctctgacagccacgtttcgctcagtgcgctggaggagctgcgctggctggagtatggccagcggctgcgcgatcgtcgccgcaaccgcatcacgctaaccgatcaaccctcggtcggcgatctgctgtggcagcaggcggcgcagggcggcgcgctggcctgtggcattgccagcggatgcgctgctggccagcgtcagttccgccgcgctgctcaatcgctggctatttgccggcagcagccagcagattcgtga

SEQ ID NO: 10276 - DNA, 354 bp, Glycine max
  Peptide Sequence Number=SeqID_127054
atggcaagtaaacagatcgatagcctgtggctgggggccgatgtggtcaccatgcgtgacggtcgctataacctgattgaggatggcgccgtggcggtggataacggcgagctggtgtgggtcggcccgcgcagtgcgttaccggactttgccccgcgccggcagcagcagtttgacggcggcatcattacgcccggtctggtggattgccacacgcatctggtgtttggcggcgatcgcagccaggagttcgaacagcggctcaacggcgtgagctacgcggagatcgccgcgcaaggcggcggcatcctgtcgactgtgcgcgccacgcgcgcggacagccagcaacagctg

SEQ ID NO: 10277 - DNA, 1010 bp, Glycine max
  Peptide Sequence Number=SeqID_127055
atggcacagcagtgcgggcaagacgctgcaggcgcagcagggaatgtggtggctgcaggagcagcagcagctggtgccgcaaacggcagaggccagcctgctgcgcgcataggtaacgattttgttgtcgctccacgtctggcgacggataagcaggcacggctcgtgctcatccagcgccagatgcttacgctggcgcaaatccggcagtaccgcttcaacgatatgctcaccggcggtcagcggggcgacgcgcatcagataggtgtacggcgtcaggctgtggtaatcctggctgaggtagtcaggcgcgaccagcggattgaccagacgatcttccagctgcaccggcagctcattttcatagtgcacgatcagcgaatgatacagcgtctggccggtggagagtcccagcaccgccgcctgctccggatcggccttcatctgacctatctagagaattttgcagctgtgcgtatggccgcgctgggcaatttcatcggagatgttatgcacttccagcattgcggtgtagcccttcatctccgcgacaaaggtcccgacgccctgcatgcgcaccagaaacccttcgctggtgagttcgcgcagcgcacggttgatggtcatgcggctgacgcccagttcattgaccagctcgctctccgacggcacccgctggttggctttccagtgaccttcccggatctggctgacgattgcctgcttaacgcgctggctggaggttgccgcgcccgcattgcggcacgtttcacagaatacgatcaatctggcacagcgcttgctacttgtatagacaagattagacacttatgcttcactcacaacacttatagcgcccctggcggatgccatcgcaacttacgctccgccacaacgtggcagatcacttgtatagacaggagtagactatgtcaggttcggttcaggcaattcgcctcgttcccggtgaagtggacctcgccaccttacgccgcatttatcaggataag

SEQ ID NO: 10278 - DNA, 171 bp, Glycine max
  Peptide Sequence Number=SeqID_127056
atgcctgctcttccaattaatgtctgggcattcctagaattgctaatatattttgcccacttgtgcaaaaagttgaaaggtggaatgaacagagggagaatgagacttttccaggagtttgtggatattcttgaacattctgttggctcatttccttcagttgctgagtaa

SEQ ID NO: 10279 - DNA, 450 bp, Glycine max
  Peptide Sequence Number=SeqID_127057
atgtaccctccattgttctctttgaacaacctagtggatgtaccctccactagaactgatccacaagagatgtaccctctcttgttctcagtcacaacaacccaagtagatgtaccctctacttataccacaaaggatgtaccctccaatgtgttaagacaaatttctcaggcggttagtcctttaaaactttgtgaatggggaaacaaaagaattctcaggcggttagtccttcgaaatcttttgtttatgggaaagggaagaatcaaaagaattctcagactgtgtcgttttgaattctttgacaagggagaagggagacacaaaataattcaggcggttagtccttcgttcttttggaaaagggagaagagagacacaaaaagaattcaggcggttagtccttggcgaattctttttggcaaagggagaagggaatcaaaaagatga

SEQ ID NO: 10280 - DNA, 303 bp, Glycine max
  Peptide Sequence Number=SeqID_127058
atgtattttctaaccagtgcaatattgaagacattaaagactactttggatggtaaaagagaccaagttgcccctcactggattgaagtcaagattgattcaaggattttttatgataacaaagatgatggcaaaaagctcaagagaatgagttcaagattgagtcaagaacacttcaagaatcaagagaaatttgatttcaagattcaagaatcaagtttcaagattcaagtttcaagaatcaagaataatcaagttgaagattcaagaatcaagaaaagactcaatcaagataagtactaa

SEQ ID NO: 10281 - DNA, 3943 bp, Glycine max
  Peptide Sequence Number=SeqID_127059
ccaacagagacagccagatttgttaaccaccaggagaagacgtatgacacaccgtgccccgtttcgccgtttttgccttaccacgctgtttgccagcctgatgctggctggcgtggctgccgaggctaaagagtggaaatccatcaccatcgctactgaaggcagctatgagccgtggaacctgacgctgccgggcggcaagctgggcggcttcgaacctgaactgatggaagatctctgcaaacgcatgagcattcagtgcaagctggtggtgcagaactgggacggaatgattgccggactgaacgccgggaaatatgacgtcatcatggatgcgattgtgattacgccggaccggaaaaaagtggtcaacttcaccacgccgtacgcgtcaacaccggcgaccttcattaccagcaaagataacccgctgctgccggccgataagaacatcatcaaactgcacgacgacgaggctgccatcaatgcggccatcgccccgctgaaggcggcgctcaagggcaaaaccatcggtattgcctccggcaccgtgtatacgccatttatcgataaatacttcaaagatgtggccgacgtgcgcgaatacaccgcttcggcggatgcgattctcgatctgcaggcgggccgcattgatgcggtgtttgatgacgtgaccttcgcgcagtcgatgctggcgcgtaaagagaacagcaacctgacgttcagcggcccgcagttgggcggtccgatctggggggaaggcgaagcgatgggcgtgcgcatggctgataacgacctgaaggccaaactcgatgccgccattcacgctgcgctggcggacggcacggtgaaaaagctgagcgagaagtgcgccgccggtaccacgctgctgctgtcgctggcggcgctgatgattggcgccgtggtcggttccggcgtggcggcggcgaaactctcgcaccagcgctggctgcgctggctgggtgaaagctattcggtggtgtttcgcggcatcccggaactgctggtgatctacctgttctacttcggtggatcggggttgatcacgctggtcggccagctgtttggtgctgacggctttattgaagcaccgccgttcctgattggcgcgctggcgatcgggctcatctccggatcctatcaggggcgaagtcgaagcggcggtagccatcgggatgccgcgctggcgtatcgcccagcgcatcctcgtcccgcagattgtgcgctacgcgctgccggggatgtccaacgtctggcagatgagcctgaaagattcggcgctggtgtcagtgaccggcatcgtcgagctgatgcgcgccagccaggtagcggccgggtcaacgcgcgattacttcaccttttacctgattggcggtggctgctatctgctgctgacactgctgtcgaaccatgcgtttcgccgcgcggaatcgcgcctcggccgcgcatggcaaagtcgcactgcggcacagcactaaggagcagcagcatgatcgacttcgcttttcttgccgacacttttcttaagctgagcgcggcgctgccggtgacgctcgggctgtttatcagcgcctttgtctgcggcgggctgctggcgctgggcattctggcgctgcgcatgagccgctggcggctgctgagcggttttgcgcgcggctatattctggtgtttcgcggctcgccgctgctgattcagctgtttctcatctactacgggctcggccagtttggcgtgattcgccacagcttcgtctggccgtttctgcgcgagccgtttatctgcgcggtgctggcgctgtcgctgtgtaccgccgcttacaccgctgagatcctgcgcggtgcgctgctggcggtaccggcaggtcaggtcgaagccgggctggcctgcggcatgtcacgctggctgctgctgcgccgcatcatcgcgccgatcatgctgcgctatgcgctgccggcgtactccaccgaggcgattctgctggtgaagtccaccgcgctcgccagcctggtcacggtgtgggatgtcaccggcgtggcgcagcagatcatccagcgtacctatcgcactatggaagtgtttgtctgcgctgcggcgatctacctaattctcaactttattatcgtccagctgtacgcgctgttagagcgcctcaccttgtccgccactgatatccataaatccttcggcgctatggaggtgctcaagggcatctcgctgcaggcgcatcagggcgatgttatttcaattctcggtgccagcggctcgggcaaaagtaccttgctgcgctgcatcaatctgctggaaacgccggatgccggcgtggtgagcgtcggcggcgaaaccattgaaatgaagcgccacgcgcgcggccatcagctggcggcgaatcctaagcagatcgaacgcctgcgttcgcggctgggcatggtgtttcaaagcttcaatctgtggtcgcacatgacggtgctgcagaacgtgattgaaggtccgcactatgtgctgaagcgcgacaaaaagagttgtatcgcccaggcagagcagttgctggatcgcgtcgggctgcttaaccgcaaggatttttatccggcgcagctctccggcggccagcagcagcgcgtggcgattgcccgcgcgctggcgatggatccggaggtgatgctgtttgatgagccaacctcggcgctcgacccggaactggtcggcgaggtgctgaagggcaacattgattgcgagggcacgccggaagcgatgtttggcgccagcggttcatcgcgctttaagcagtttatctccagccatcagagccatcacgcggagcagccagtagcgcgacataacgccgaactgacgctgagcgccgccgcctggcagcgcattgcgcgcggtcgcgagatcgtcgaacagatcgttgccagcggccagattgcctatggcatcaacaccgggctgggggcgctgtgtaacatcacgctgccggaagaccagctcagtcagctgtcacgcaatacgttgctgagccacgcctgcggcgtcggtccgctgctgacgcgcgagcagacgcgcgccattctgtgtgcggccatcgccaactatagccacggcaaatccggcgtttcggtggcgctggtgcagcatctgctggcgctgctcaatcagcagatcacgccgcaggtgccgtcgcagggttcagtcggttatctcacccacatggcgcatatcggactggcgctgattggcgtgggcgacgttgagtaccagcaacaggtgatgccggcggagcaggcgctgcggctggctggcttgcagccgtatcgccccggtgccaaagagggcctgagcctagtcaacggtacgccgtgcatgaccgggctgagctgtctggcgctggacgatgcggcgcggttgctggactgcgcggatgtcaccggcgcgatgagcttcgaagcgctgcgcggtcagctggcggcgtttgatgccgaggtgattgcgctgaaagccagccccggcatgcagcacagcggccagcgtctgcgtgcgctgctgagcgacagcccgctgctggcagcgagctgcggcatacgcacccaggatgcgctcagcctgcgttcgatgccgcaggtgcacggtgccagccgcgatcagttcgcccacgcggcgcgtcaggttgagatcgagctgaacgcctgcaccgataatccactggtgctgggcacgccggacaactggcgcgtggtgtcgcaggccaatccgcacggtgaatcggtcgccatggcggccgatctgctggcaattgccatggcggagattggcagcatagccgagcgccggctggatcggctggtcaatccgctggtcagcgggctgccgccgtttctggtggcgcagccgggcgtcaactccggcatgatgatcgcgcaatac

SEQ ID NO: 10282 - DNA, 279 bp, Glycine max
  Peptide Sequence Number=SeqID_127060
atgaaacaagaattgaagcaggccatcaaagttgagttaacccaaatgccattcattggcacattcattgcatggccgagacatattgtgaaacctatatcacatgaggattcaaagaatcttccaaacaaagtctatgaacctgttgaaagcttgagcatgggtgttggagatgatccattgggtgactttattaagaacttgtcagatgtttacccgaagcctgttgagttcttgtgggatgtgactaaatttaggatttcgaatgtttatggatga

SEQ ID NO: 10283 - DNA, 993 bp, Glycine max
  Peptide Sequence Number=SeqID_127061
atggatcgaagttggatgaaagcatcacatataagtgatgagtatgagaatggggttgaagaattcttgcaatttgtgcaacgaaatgcacaagtccacaagtttcacaaggttatcaacaatgttagctttggtgaacttgaaggcaagatttgggtggagtgcaaaagcttcactgaattgctaatgttattgaagaatatgcttcttgacgataacacgttgcccaaaaatcattacgagggtcccacatgtggggtatcacgatacagagtaaaggatgacgatactagtgatgatgcaaccgcaaacaatagttgtacgacaaagacaattgattgtttgtatccagattttgccgaggagcccaaaaacctaatgcttggtcttacttcagatggaatgaatctttttggaaatgatattgatgtgtatctgactcccttgattgaagacatgagaaaattatgggtagatagggttaatgtgtatgatgggaatccccaacagagctttaggttgcgtgcaatgatattttgtaccattaacaactttccagcatatggcaagacaaaggatggtttgaaatgtcgtcaagatttggttgacctggttatacgagaacagttgcatccgatatcacaagagtctgaaagtcccataaggacactcttcatagagcctttcattgaccctagacggttggatgatttggagaatgaggttgtcattgtcctttgtcaattggagatgttttttcctccttcctgttttgacataatgcggtacatgaaggtcttagaaggttataccaagtatcaatatcaactagaagcatcaattctggaaacatacgttgctgaaaaatctattgagttttgtttcgagtacattgaaacaattaaacttgttggtcttcctcaatctcgtcatgactgggcaaggggaagtaagggtacacgacgatacaatgttgtcactatgagtcgatag

SEQ ID NO: 10284 - DNA, 156 bp, Glycine max
  Peptide Sequence Number=SeqID_127062
atggaagaaaccaacatccttgatgatcctaccatgcccaagatgcctgacagttgcacctctttggttatccttgatgagtttctttgcccaattacactagaaatcatgacgtatcctattattgtaacaagtgaccagattgttgcatcttag

SEQ ID NO: 10285 - DNA, 159 bp, Glycine max
  Peptide Sequence Number=SeqID_127063
atggtggctcatggtggccaccggtggtcatgggtggtggaggaggagtttctagggtgtcaaaacgtgaaaacctgggtggtggacctacaatcaaaatttgaaggtgatccaatggttagagaatccgagatcgtggttttacctgaacaagtttag

SEQ ID NO: 10286 - DNA, 420 bp, Glycine max
  Peptide Sequence Number=SeqID_127064
atgatcttcctttgtgaaactttagtaaacatttgccacattaaagaaataaagaaccttctaggctttgaatcttttcttgttgttgatgcaaatagcaggagcaaaggcctagcatttctgtggaaacatccttttgactatacccttctcaactactcctcaaacttcataaatgtcgaggtacttaagcatggcagaggcttggcatttctatggaaacatcctttcgactatacccttctcaaatactcctcaaacttcataaatgtccagatgaaaaatatggcagtcgtgatcacccaaattggctcatcttggggtttggtgaaacaatcatcgatagtggactccatgatcttcttatggaaggttataagttcacctactccaaaagtaaaggaaaacacaatgccatag

SEQ ID NO: 10287 - DNA, 312 bp, Glycine max
  Peptide Sequence Number=SeqID_127065
atggactacttcaaaagccataaggacattgtcaagaatagatcgtccctctacaaaggtagattgctcatgggaaatgcattcgtggaacacaggaaattgcatagggatattgatgcaatcctccataggaagggaccagtcaccagagccatgagcaagaggttcaaagaggattgggctaaagctgctgaagaaggccatagggttcttatgaacctcaggctaagattcatcaaggcttgggcctccccaagccagatgaatttcaaccacctccctaccctagaagccaagcccattttggcatga

SEQ ID NO: 10288 - DNA, 375 bp, Glycine max
  Peptide Sequence Number=SeqID_127066
atgaggacagagaaaacagccacgagccaagagagggagctattgacatcgccaccatgcgctgccctaagggatgtccaccaggctccagaaacaagccgaaaccgccgatactcgtcacccgagacagccctaacgcgctatggaaccacgtcatggagattgccatcggagccgacattgtcgactacgtggcgtagttcgcttggaggtgccaacgcggggtttccattctcagcggtagcagaaccatcgtcaacgccaatcaccgacaacccacgtcactcgatgtcgtcatggcgctccacggatgctgatcaggaacaacacaacgacgacgacggaggaggaggaggagattgggagggtggttag

SEQ ID NO: 10289 - DNA, 423 bp, Glycine max
  Peptide Sequence Number=SeqID_127067
atgacattcaatgtgacaataggcaattctgcttttctatttactgggtttggccaggccagggcacttcttgaatggcataaaatatcacgattttgtggacattgtggagagaaaacagtccctatggaagctgggagacgtaaacagtgctcaaatgaatcatgcaaacagaggatatatccacgacttgacccggtggtcattatgctagtaattgatcgggagaatgaccgtgcccttttgagcaaacaatcgagatttgtacctagaatgtggagctgcttagcaggttttatagagccaggagaaagcttggaggaggctgtaagaagagaaacgtgggaggagactggtattgaagtgggagaagttgtatatcatagctctcagccatggcctggtatatcatattctacataa

SEQ ID NO: 10290 - DNA, 417 bp, Glycine max
  Peptide Sequence Number=SeqID_127068
atgagctggtctggaggagattggatgtgtggtgcttgccagcacataaatttcaagaaaagggatgcatgccaaagttgtgcataccctaaatttggaggccctgacccaacaacttacagatacaactcgactgaaaccttggcaggggactggtattgcactgccatgaactgtggagctcacaactttgccagcagatcaagctgctttagatgtggtgcattgaaagatggttactcttgtagatttgggggaaacatggatggctctggaggatatggttctgattgcaattaccctccagggtggaaaactggtgactggatttgcactagcaatagcatatccatgacacgtttattacctctatttcaggtgacgcagactaagagaggcaatttcaaccgccactaa

SEQ ID NO: 10291 - DNA, 320 bp, Glycine max
  Peptide Sequence Number=SeqID_127069
atgcaggtggggctgccgcccgtgccgtttgaaagcctgctgtcgtggctggccgccctgcagcgtgagcatggcatccgcgtgctggcgctcgccgtggaacgcgcggagcaggcgccgggcatagtgcagttggctgctgttgcgtggccgctgtcgttattgccgccgtcctattgccgtgcgttatccactgctggaattattcctgatgctgatggggataacgctggcctggcggctcggcatcggggtggattggtttttcatgctggcgttggttgcgctgttgctggcgttggcggcgatcgacaaccaat

SEQ ID NO: 10292 - DNA, 279 bp, Glycine max
  Peptide Sequence Number=SeqID_127070
atgtcaagcgggtttcttggggactttccctttgctatccgaagacaaccaagtccgatggcatgcaaagacaaaaatagttgtattcttcccttgtcgagagactcaatgtctattgaccaaggctaccgaactctcccctactatcccgagacaagcaagtccaatagcatgcggagaccatcatggttatccatttttatcgatttcaaggcatcaaggcttttgttgattgagctaatggtcggtcgggtggaaattcggctcaaacgaaattag

SEQ ID NO: 10293 - DNA, 303 bp, Glycine max
  Peptide Sequence Number=SeqID_127071
atgaagctttgcttctacaatgaaaactcaaaaaagggcccccaacgaaggtgttgtggtatctgccaatcgttccaaggtttaagtgtctttttgctaatggagacgacgctaaagaccttacatggcatgcaaatgctaagcgagacattagctcgcttagcgattcaagggaatatggaagagaatctgccacgcatgcacacgcccagcgcgccatcagctcgcccaacgagtcgtttgtctcttctggcgcttagcgtgcctaacgcgctaagccaaaattcacttactcgcgcttag

SEQ ID NO: 10294 - DNA, 615 bp, Glycine max
  Peptide Sequence Number=SeqID_127072
atggcggattccaatatccgtaagacagctttcagaacacaccatggtcacaatgaattcaaggtcatgtcatttggtctctacaatgcaccatcaaccttccaagctaccatgaatgacacccttcgcccttttctccacaaatttgtcactgtttttttcgatgatatccttatctatagcccctgtttgcattcgcatgcacaacacttgaagcaagttctatcgacattttcgcaagcacaattccttttacgccaatctaaatgcctctttgctcaacaaaagttacattatctcgaccacatagtctctactcaaggagtggctcctgatcccgacaaaattcaggcgatgcttacctggccaaccccttccactccttctgccctgtgtggattcttgggattaacaagcttctaccagcattttatcaagagctatgtcacgctcgttgctccacttacttcattgcttcaaaaagacaacttccaatggtacgatgaagcccaaacaactttcaaacaactgaagcgtaagatgatggaggcatttgtcctgctttcacctgatttttctaccccttttaccatagagacaaacacctcatcatga

SEQ ID NO: 10295 - DNA, 270 bp, Glycine max
  Peptide Sequence Number=SeqID_127073
atggctgaactaatgatggagaaatttgttaagtattgggatgaatatagtatcgtgcttgcatttagtgctatttttgacccaaggatgaagttggaaacattaggttattgttatgaaaagattgatccatttacttgggaaataaaattggagaaagtaaagagcaagttgtacatgtttttctcccaatattctagcaaagatggtgagggggaagctgacaaagatgcaaaagtggagagaagttcttccaaggatataatctaa

SEQ ID NO: 10296 - DNA, 282 bp, Glycine max
  Peptide Sequence Number=SeqID_127074
atggatcaaaccctattagatatactatgtattgaattgcgtaaacaatttgacgaaagaaaatttatctctggctttcaattgaaaagccagccaaggtcaacaaacgcaagctcaaaagacctgtctgtccttctcactcaagctgccattccttctccctttcttcctcatcgctcaggctcgaaagacctgtctgtcctcctcactcaagctgccattgaggttttagacattgtcttggctcctggttggtggattcgtgagttcgtgagttcgtga

SEQ ID NO: 10297 - DNA, 267 bp, Glycine max
  Peptide Sequence Number=SeqID_127075
atgtatcgaaaccccctaccactgcaacaacgaccgtctgccaccatcgcccaagttgtcgacgccaacatctctatccaaacctacacaacctgtgaaaagtcacaagccaccatgtatcgaaaccccctaccactgcaacaacgaccgtctgccaccatcgcccaagttgtcgacgccaacatctctatccaaacctacacaacctgcaacaactgtatggaaggagaggggaaggatgggtgtgagaaggaagggttcaattag

SEQ ID NO: 10298 - DNA, 777 bp, Glycine max
  Peptide Sequence Number=SeqID_127076
atggaagtcgggtccaatgatacatctgctatgagtgtgataggttggtctgaaaggaaaataacatcgtcagcgtcttatagtttatgcatccaagtaaagaaatcgagcaatgcgggactgaataaagttatgagtattgccctcgtcgatcgggataacgagacgatgctgttgtctgggtctagttctggaggttcgaggtggtctggtgggaaggaaagggcgtcagaactcgatgcaaagggttcgatgtcctcgtctgcaattaagagatgcaaccaaggaattttaggggctagggttgtgtttggtttgggtatgggagaaattgggtttggtgatgattgggccgtgacttgtgtcaacgataaaggttggagagcctgcacctcccgacgcaagtctggggtcaagtcgaagacgaagcaacttagaagaaaggatagggagccaacaattttgttggcaagacgttcaaactctgatgtgaggaaactgttccccaacatccattggtaccagcacaatgctagtctctccatgcagaaggaagcgaccaactgcgaaactttgaagatccactcgatgggatcgtgtccatcaaacgtgggacgtccagtttcatatggggctgagaaaaaaaaggtgaagttggtatcggcgaggaagaaggagaggagggaacgatggaatggccctgggtcaggcgagtggtcacctcgtctaagcggtcaatggtggcctgcctggtattttgctctggcggtggcatag

SEQ ID NO: 10299 - DNA, 498 bp, Glycine max
  Peptide Sequence Number=SeqID_127077
atgcgcaccaccattcttgtcagcctccaccgtcgtctaatcatgaaaactactgcgaacgctcatcgccgtaatgttcaattcacagtaggcgattgggtgtatctacgtcttagaccatatcgtcaaacatcacttgcaccggcttacaccaagttggccaaacaattttacggtccattccaaataattgaacgcatggggcctgtcacgtaccaactccagttaccatcttcttctaagattcaccccacatttcatgtttcattattgaaactccaccaaggaccgccaccaactcaacctacaattcttcctccgtctagcattgagaaccatcccatcattgagcctcttcatattatggattggaaatgggattcctcctcttccccaccaactaagcttattctggacaaggttggtttggttgaatgggtgatgatagcaattcagacatacaggaacaggaagagcacaaaagcagcaaggaattga

SEQ ID NO: 10300 - DNA, 507 bp, Glycine max
  Peptide Sequence Number=SeqID_127078
gatgtgcggaaaaaggcacaggccatccagaaacagaacactgccccccacattttgtctcgtgggggttatgaatatttggagcagaagctcctggctgagaagacccagaagaagttggaggaagctgcacagtcaggaagcgttgatggcgtcatcaactcttcatcctccgtcagacgccacctgaagtggaagatggcccgcaccaagaaaacaagggagatgacgattgaggccgcaaaggaaatcgctgaaaagatcataagtcattttcaactaaccattagaattatatttgtttattttttgaatgccatgcgtcacagggatccttcgtcccccatggacgttaggatgttctcaccgctgctattggacgtccaaagcaccttggacgtgttcgtgctgctgaaactggtgtcaccatcaagcaatacttcagatcggttctacggacgtcccgcagctcttcctcgctgcctcctgaagaattacaacagctga

SEQ ID NO: 10301 - DNA, 1230 bp, Glycine max
  Peptide Sequence Number=SeqID_127079
atgctcggcttactgctgctggccgctgccggcagcacatggctgattgccggtgggctgtttatcgccggtctcggtgccggactggcttccccggcgctcgccagtgctgtgagccggcaaattgacgcgtcgcggcaaaccgccgctaacacgctcatcaacgccggcaccggcgcgggcatcattgtgtcagtgcccatttttatgctgatgcccggcggctggcgcgcggcctgctgctgttttgccgcgctggcgctaatcagcctgttgctggcacgctattgtctgcccgccggtcgtgccgatccaccgggatcgccggttggctggcgcgatcgactgcacaaccgcgcgctgctgcgggtaatcatcatcgcttttcttagcggtgtcgccagcgcggcgtggtggtgttttggaccggatgtgttacgccagcacagccgcctgaacgaaggccaggccagtatgctgtggctggttagcggcgcggccggcattctcggcgcgctgaccggcccgctggcacgctgcatcggtatgcgtcaggtgtactggctggcgcagctggcgatggccgcaccactgctgttgctggcggcgctcactcactttagctactggctggtaccggctgcggcgctgtgcggcgcgggatacgtcacgctgtcgggtattctgctggtcgcgggtgccgctgccacgccacagaatgcggcctctggcgtggcggcggcgtttctgacgctggcgattgggcaaattggcggggcgatactctttgcgcaaatctacagcagcagcgccgctgcggcactgctgctgttcgctgccatcccggttgcgctgctatttctgccagcggctgaggatgccggcactggagtagccgcgaatgatcgccgcgtagctgtcaaagcgattgctcacttcgcttacctggttgttatacagatcgctctcggcgctcaggacatccaacagcgagcggcgtccgaggtgataccactgatcgaaaaagtctttgcggatgcggccccagctaacgttgattccggtttgccacgcctgctggcgaccgagctgatcctcacgcgtgcttttggttaccgtccagatcagcggatgataatccaggctggccagctgacgattgagatcgccaaaattcatcgcccagcgatcgctggctggcagcgtcacgcgactattgcccatcaggcg

SEQ ID NO: 10302 - DNA, 798 bp, Glycine max
  Peptide Sequence Number=SeqID_127080
atgtctaatagaacagatgtctcttttttttctttgttggatttgatacccccaggcactgctctttatgcgtcacctgtcccaacgattctagtgttctttgggaccacacctcccatctatctacatctattactggcccttggattttactcggagactttaatgagattcttttttctacagattgatttggttgttggaggtcactttacatggaggaagaacactcagaatggtggtcatgttagaaagaagttggatagaggaatgcttcagccctataactctgatcacaaccccttgattgtcacctttttcaagtctcccagaactgcctggatgtcccaccctaactatgccaacttggtctctcaagcttggaatattactcctggggatgccatttgtaaattggagggtgtcaaagaaaaatccattatgttcaattgggatgtctttggtaatattttcaagaggaaaagacaattggagggaaggattaaagaggttcatcgccaacttgatatggtaattacctccgaccttattcaattagagataaatcttcaacaagattataaagaggtccttgctcaaaaagaaatgttgtggtttcaaaaatcaagagaggaatggattaagttgggtaataaaaatatcaaattttttcacactcaaatcaaacgcaggaggaaccaaatttttggcctttttattgatggtaattggggtactgacatgaccctcctccagaatgaagctaaaaaattcttcaagaagctctttcttttttaa

SEQ ID NO: 10303 - DNA, 186 bp, Glycine max
  Peptide Sequence Number=SeqID_127081
atggctacgagaaataagcgagaacgacttcttactgaggccttgaacaacttggcacaagagaacactcgcccacatctagagggagcaggtggtgtcgttgtcccatgggggactttcagacagacttttctggagaaagaagaagaaaatcaaggccgaggcgcttccgtaacactttcgtga

SEQ ID NO: 10304 - DNA, 192 bp, Glycine max
  Peptide Sequence Number=SeqID_127082
atgactttgagtcctatgaaggcgaggactttgagtcctctaaaggcgaggaccttaagtcctctgaaggcgaggactttgagtcctctgaaggaagccaataggagtttgatgacatgggctgatcacgaaagaatttatatgacgaagctaccccttggattcgaaaagaatcccaaagagcttgcatga

SEQ ID NO: 10305 - DNA, 429 bp, Glycine max
  Peptide Sequence Number=SeqID_127083
atgggtgaaatagatgaggtgcaagaatggatgaaggtcaacatggaggccctaaaagagcatatgaccacaatgatggaggccatgatgagcatgaagaatataatggaagtcaatgcggctacagttgctgctaccagcgtcgctgctgagaacaataatgccttcccgccatatggcttgcctcccaactacacactacccaatgtggtgcatactcccgatgagaatgtcaataactccaatcccatactcattgagagccaacaacctcaatctgatcatgcacatggacaagcagttggtggtgtaccccagccaaacactttggagggccctcaatttttcccacaaccacaaccattgcattttgtggcggggagagtctctcctgctatagcggaaaagggaaaggctaagggtcgttga

SEQ ID NO: 10306 - DNA, 603 bp, Glycine max
  Peptide Sequence Number=SeqID_127084
atgtttcttctccctatttcactcttcttcttcctcttctccgtttttcttcttcttctcctacaaagcctcattgttcgtctcaccagtgagctccatggtcgccgacgagatctgtacatgatgatattgttcttttcatggtgttttcgcattctgtcatccttctttttttcttcttcttccttctttcattttccgatgaagctagcatgccaccaccataggccacttctgtgccatcatcgtccccgtggcggccttgcatcacgacgccatgtactagtggcgccggggaggcacgccactctctgtggtggcttctcctattgcggtgccatttgcggagctaggtcatctagggttgtttcaaccctgatgcctgaatgcaggttgggtcgggtcaccctgaccctgttccaacccaatgaacacgagatggaactgttgagattgcaccaaaatgaagaaaatgacaagaaaaagaaaggaattgctcttaaagcatcatcctcaattcaagaagaaagtgatcaggataatgatccagatgatgatgatgatctaagtctctttgtaaaaagattcaacaagtttcttaaa

SEQ ID NO: 10307 - DNA, 364 bp, Glycine max
  Peptide Sequence Number=SeqID_127085
caagacacccagtggacccggaggagcccaacagggccctgggatttccagctctggttatgggcctctgtcaatcctacagggtgctcattccccccagcaagggatcacgcgcgcaagacactcagtggacccggagaagtccaacagggtcttggagttgccagctctgattacgggcctctgtcagttctacggggtgcctgtcgcccccagcaaggtcatcaggccccctactaatcgagctttcatcaagaagtactgcgcccccaggcaggcgcagggcaaaacaccccagcagcgggcaacagacgcaccgccaccacctctagagttcacctcagctcatccacaaaaaggttag

SEQ ID NO: 10308 - DNA, 357 bp, Glycine max
  Peptide Sequence Number=SeqID_127086
atgacgccagaagatatggaaaagactaccttcgtcaccctgtggggatcgttctgctataaggtgatgtcctttggactcaagaatgccggggcaacttatcaacgggctatggtagctttgttccacgatatgatgcaccaagaaatcgagatctatgtggacgacataattgcaaaatctgagaccgaggaggaacaccttgtcaacctacggaagttgttcgaaaggcttaggaagtatcaattgagggaaattgctaggttcatcgtaagccagaaagggatagaagtggaccacgaaaaggtgaaggccatccttgagatgccggaaccccgtaccgagaggcaagtctga

SEQ ID NO: 10309 - DNA, 364 bp, Glycine max
  Peptide Sequence Number=SeqID_127087
gctattgggttgtttccttgcattcaaagtgaaggtgcaaccaaggttcaggaattctgttgttcttaaatattcagatgaattagagttgatcaatgttgtgctagatttgattcccgatagtgagcaatctctgtctattacagctgatcatgatcagtcaatgcttgcctcaagtgagcctacaaagtttgaatctcaatctgtgtctgttaccggggatcatgaccctcttctcaggattccattgacaccaactaagcgcgtatcttctgatgagttggataatgagcgaaaaaactttgagatctcacctgctgaagtttcctcgaaaaaattagccaagcattctcagcctgaatga

SEQ ID NO: 10310 - DNA, 774 bp, Glycine max
  Peptide Sequence Number=SeqID_127088
atgactgtttttgtatgggtttctgattataaagttatgccacgtgttgctgataaaataaaattgatagatggatcaagggaagctcttaagctttctgtaaggatcactgatctttggttcattgggattcccggaaagactgaacaagtcgaaatggtggttgttgattctgatggagatgaaatccatgttgtttgcaagcaggatcagctgaagtctcgcaaggctgatttgaaagagaattttacttatgtgatgcataattttaaagttatcaagaatgatgggaaattcaaagtttgtgatcatgaatataaattatgttttactggagttactgttgttaggcaatgtgatatggaacagttaccttttaggaaattcagatttgtttctttttccagtgtcattgctggtgattttaaaattggactcttggttgatgttattggcatggttgatgaagtggtattccgatatgtgtcatccaaaaatacgagggttgttttgaatttaaaggatttaagtggccaggtactatcctgtacactctgggaaaattactgcttacaatttttgtcttatttgaatgatattgaagatgaaaggccgatcgttattctcttgactcatgctaggattaaggaagcacagggatcatatccggcatcggtcagtaattctttcaaggcgtccaaactcatgatcaatgatctcgtgctggaaattcaagaatttagagagtcttttagatttagggatcgaggttag

SEQ ID NO: 10311 - DNA, 105 bp, Glycine max
  Peptide Sequence Number=SeqID_127089
atggatgaaggggcattcttcagactgaatgacataacattccattcatattgcccgaaaggtcccgtgaaagcagttttgtacctatcaaattcttggatctga

SEQ ID NO: 10312 - DNA, 105 bp, Glycine max
  Peptide Sequence Number=SeqID_127090
atggtcagaagtcgagacgagttgacggcagaagtcaacctagggatggaagcgaatggaggacagggtcacggccgaccgttgtcccttcccggcgctagataa

SEQ ID NO: 10313 - DNA, 116 bp, Glycine max
  Peptide Sequence Number=SeqID_127091
atggaacttggaggatgtgcacaaactacagagccatcaacaacatcatgcaaattccatgatgaacatctagtgcatttgaggagagttttagaggcccagagacgtgagagctt

SEQ ID NO: 10314 - DNA, 819 bp, Glycine max
  Peptide Sequence Number=SeqID_127092
atgtctcgtaacacatcaagagatcagaaaaaggtaaagtccacaaaaaggaagcaagatatagaggtagatgttgttgtttgtaaggaagttattggtcaggagatggatggagtcagaaaatttgataaaactgcagatggttacaacaagatgcaaacctacagaggaatgcttcttgatcctacaaggagattgagaaatcgccatgcagttggaggcctaactactgaagacaggatgttggtttacctcattacctacattctcacacctaggtcaagctatcatgatcaggtaaccaatgatgatctacaaatagcgtatggtaagaaatcaggaattaagatgaattgggttctgctgattgaagaagtcatgctgaaatgtcgtcgccttgtggactatgagtttctatatgttgtgcttgcctcaagattcattgattattttaaggttgatgtttctaatgagattatggattacaccaaagactctagtgatgtaactgaaaagcatctcaagaagtttagtatgaggtatgctaatcatgaatggataatggctagagagcttgctagtagaaacattgaagagatggaagaagatgatgaagctaaagcccaacatgagcctgcacctcaatggagtccttttgaatctctcacaattcagaagatggatgtcatgcttcacctacatcaagagcactcaaccaaatttcacagtcccttagagaataacaattctaggttggaaaacatcaaaaccaggctcaaccttagaaacctccctaactctgatgaggatgattcttag

SEQ ID NO: 10315 - DNA, 294 bp, Glycine max
  Peptide Sequence Number=SeqID_127093
cgctgttcatgtgtcctccattatcaagcgcgaagcctctagtgactgggaaatacattcttctgttgttttccagatcggttccttcgccaaacatgacggacgaaatcagtgtcctatctttgctttcctcttatctccgatgagagatgtttggcaccctctattgcacaatatgagaagtcccgagacgtgccggaaatcaaaaggaagcaggcttacgcgatatgagctcaactcgcctgggcgagcaaggttgcttcaggatgaagtaacagctcacctgggcgagct

SEQ ID NO: 10316 - DNA, 815 bp, Glycine max
  Peptide Sequence Number=SeqID_127094
atgatgatttcaggcaatttgtagacaaggttccaaggggttgtaaaatcacaatcgtttcagattgttgccatagtggtggtctaatagaagcagccaaggaacaaataggagatagcacaaacgaagaaggccaaaactcaccctctctatttcacttcaaaaacctcttccatcgaaacatggaacaagaagaagaagaagaaaccatcgtgaagaatcgttctttgcctctttcaacactcacagaaatactcaagcaaaaaagtggcaaggatgatgacatagaaattgggaaactaagacacacactctttggggaagatgcaagccccaaagtgaagaaatatatgaatttagtcataaacaaactacaacatggaacaagtggtggcgagagaggaggaggacacacaattctggggctggtgggtgatcttgcacaacaatttttcgaacaaaagctaaatgacgatgacaaccacgacgaggaatatgcaaaacgtgggtggagcaagagggaggaacatcatgctgcatcaatcaagcgcaacattttggattgtgggattctgttgagtggttgccagagtgaccaaacttctgcggatttcgcaagtccttatggaaattcggacgcggcttatggggccttcagcaatgtgattcagagcataattgaagagactgatggtgcagtcacaaacagggagcttgtgctgaaggctaggatggtgcttaagagccagggttttgatcagaagcctggactgtattgcagtgacaacaatgttaatgcttcttttctgtgttga

SEQ ID NO: 10317 - DNA, 270 bp, Glycine max
  Peptide Sequence Number=SeqID_127095
atggcggttttccgtggcggattttcgaaaaaacgccaacccttttatcctttggcggttttccgtggcggatattatctgcaccaaatcctacttgtggcattttgctccctcatgggcaaacttgcaaaacaaattgatcttcctaatttccctcttccaaaactaccctcaaacgtaatcctcaaggtatgttggcttcaccaccttcctcttgctcctggtctcttctcccttctgcacccttgctgttggtgcttcctctgttag

SEQ ID NO: 10318 - DNA, 990 bp, Glycine max
  Peptide Sequence Number=SeqID_127096
atctgcaccgacgaccgctccgcccgggctcgcgccctgggttttgcagcgaccgccgcgccctcctactcatcggggcttggtccttgccccgacggccggaactcgcccgcgggctccagctatcctgagggaaacttcggagggaaccagctactagacgggtcgattagtcctttcgcccctatacccaagtcaggacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactcaaagactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgccccattccagcggacttgggcccggtccgccactgaggacgcttctccagactacaattcggacgccgagggcgaccgattttcatga

SEQ ID NO: 10319 - DNA, 702 bp, Glycine max
  Peptide Sequence Number=SeqID_127097
atggtggcccaagcccgggctgttgatatgctcgtggagacgtcatcatcgcgattgtggatggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaaccccatacctgtcgggacccgaaagatggtgaactatgcctgagcggggcgaagccagaggaaactctggtggaggcccgcagcgatactgacgtgcaaatcgttcgtcctgacttgggtataggggcgaaaggactaatcgacccgtctagacggtgcggctgctctgttgagccgccccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcgggttaaaattcctgaaccgggacgtggcggctga

SEQ ID NO: 10320 - DNA, 963 bp, Glycine max
  Peptide Sequence Number=SeqID_127098
atgacggatatttattcgcgtagcgagagaattaaacagcgctggcgcgatcgggctgaagaagatccgttaaccgggttacccaatctgcgggcgctggaagggcatttgcgccaatcgcctcgggttgttattagcagcctgcgtatcgaaaacctggacttccttagccgtcactacggcatgatgatgcgtgtagagtgcaaacggcaaatagcccgccgtctgcagccgctcctggatcaccacgataaaatttatcagctcccgggtagcgagttattgctggtgatagaagggccggaaccggcggcacggttaaaccacatcgtctcgatgcttaaccacgctaaatttaactggcataaccaggatctggatttagagtttggcgcggcgtggggtagttacagcggcattgagaccgaattacaccccatgcttggccagcttagctggttatcggagcaggctggcgccgtgcagcgggtgctggcgttagatatcgcgcaggaagaggtttccgatcaaacgaccgaacaggtacggatgctgacgaaaataaaacaagcgctgaacgagcgtagcctcctgctgtatgcgcaaccgattcagaacgcagaaggggagggctattacgaaatcctcacccgtatgcgttgcggcgagacgattatcacgccggatcgttttattccgcttattgcgcagttcaacctcagccagcgtttcgatatgctggttctggaaacgctgttcagccagatcgatcaccatcctggccgacgcttctccgtcaatttgctgccgtatacgctgatgcaaaaggatagcgccgctcagattatcgcactgtttaagcgttatcgcgtatcgcctgcgtatattacgattgagataaccgaggagcaggcgttctcgaatgccgataccagcttgcctaatattcagctgctgagttga

SEQ ID NO: 10321 - DNA, 456 bp, Glycine max
  Peptide Sequence Number=SeqID_127099
atgaggaacaaggctaggcttgtagccaagggttacttacaacaggaagatgcaatacgcattttactatcctttgttgctcttcatggtatgattttgtatcaaatggacataaaaagcatgttcctcaatggactaatcaaggaagaggtctatgtggaacaatcccctgggtttgagagttctatctaccctcatcatgcagagtttgagatgagtatgatgggagtgttgaagttctttcttggacttcaaatcaagcaaacaaataaaggcataaacatccatcaaaccaagtacgtgaagaagttcaagatggatgatgtaaggccaatgaagacctccatgcatcaaaccactgtacctggactggatgaagactcaaagcagagaaatagggcaattttacaaggtagcctcgttcaagcgaggtataggctgctcaagccaacttga

SEQ ID NO: 10322 - DNA, 309 bp, Glycine max
  Peptide Sequence Number=SeqID_127100
atgggtggggcaagctcttctattctggttcatggtttctcttggctatatggttcatccgggggagagatcgagcttcaagaaatagtgaacggtcttatcaatacacaaatgtataactccccaggaattttaattgcacttttattcatcactgtaggaattgggttcaagctttccccagccccttctcatcaatggactcctgacgtatacgaaggagtgcgatgctacatagttggttctcatccttcagagactacgagtataataggagcatccgtcaacaaaaggatcaccctaagatga

SEQ ID NO: 10323 - DNA, 396 bp, Glycine max
  Peptide Sequence Number=SeqID_127101
atgatattggggaatctcattgctattacccaaacaagcatgaaacgtatgcttgcgtattcgtccataggtcaaatcggatatgtaattattggaataattgttggagactcaaatggtggatatgcaagcatgataacttatatgctgttctatatctcgatgaatctaggaacttttgcttgcattgtatcatttggtctacgtaccggaactgataacattcgagattatgcaggattatacacgaaagatccttatttggctctctctttagccctatgtctcttatccttaggaggtcttcctccactatcaggcaggcttatatctcttagtttcaataggactccttacgagtgtcgtctctatctactattatctaaaaataatcaa

SEQ ID NO: 10324 - DNA, 492 bp, Glycine max
  Peptide Sequence Number=SeqID_127102
atgacccttcgatcgcttttcgaagaacccagaaatccagggctaagagatctgaggccccaattattcagctccccctatctcagctctttctacctttcctctccctccaacaccagcagctccagtccttccggatccttctgcttcgagctcagagcattccttatctatgttgtagagcctgcatcagggccagctcctgatcatgcaaagtctgcaggatgtgaggttggcctggccaggagtgcaaccttctcctttaggaggggtgaggcctccacaacccaagagcctcggcctgcacatgaggatgcatctgctgacatctcagagccctccccacctgagccatttatttttgaggctgatctagagccatctcctcaacctgagccagagccatctgcaccagtgccagacttgcctatttctcaggatccaccatctgcaccagcattggacctgaatgacgctgcacaggatgattga

SEQ ID NO: 10325 - DNA, 189 bp, Glycine max
  Peptide Sequence Number=SeqID_127103
atgttgcttaagacttggatagttacaagcgagtcggagacccagcatgaccacagattcacctccactccttatggctcacatagacccgggcatagtgatatgaatggcagcggaatggagaaggaagagagagagcagacgccacttcaaggagaagatgagtctagaagaagctcaccaccatag

SEQ ID NO: 10326 - DNA, 644 bp, Glycine max
  Peptide Sequence Number=SeqID_127104
atggcctgcgtggccctgattatcgcccagagcagcgcgctcagctttaccctggaagtggcgggcaagatcgacaacgtgaccgacccggtcaacaaaagctatctgttcaccgataagcagctgttggcgatgccggtgcgcagcatcaccacctccacttcctggacgccgcagagaaaattcgaagggatttcggtggccgatatcctggagcgcgtcggcgccaagggcgagacgctgaccttctatgcgctgaacgactattacatcgacgtgccgctgtccgacgtcaaaaagtacaacatgatcctggcctataagatggacggggagatgctgaaactcaaaaacttcggcccgctgttcctggatcgtgatcaaatgaagctgacgacctttaagaacggcagcaggctggcgatcccggccattttcgccgcgctgtttttagtggcttcgaccgtcacgctctattactacagcgccaccctgtctaagaaagggctgtatgccatcgccggcacgcaggaaaactactcctggtcaatcgccaagttctccatcaagctggcggagttcgacacgctggtcgagcagcaaagccacgccgcgcatgtggacaacgacaacctgcggctgcg

SEQ ID NO: 10327 - DNA, 189 bp, Glycine max
  Peptide Sequence Number=SeqID_127105
atgtctagttttgctctggaaattgcttctgggatatcaaagatgtttgctcagaagaaagtcatgctgagcccggggaggcacaagatagtgatactggatgaagctgataggaacctgattcggttggcaatgccaaagctcatggaagctgatgttcagtttgctgtgtatactggtagggtatag

SEQ ID NO: 10328 - DNA, 273 bp, Glycine max
  Peptide Sequence Number=SeqID_127106
atggtgaaatcattcaaagttcaagtgcaaatgcaatttttcaaaggtgacaagacaaagtcgttactcttgaatccaacaatgacgctgccaaatataatcaccgcaatacagtcatcaattgcagataatggtgttacgcctataattaatgtcctttggtatcgttgtcctgtatatcaattcaatggtgaagttcaatatagggcaattcaaattattgacgaagaagagatgcggaacaatgtcagacataaccctcacatgcactga

SEQ ID NO: 10329 - DNA, 543 bp, Glycine max
  Peptide Sequence Number=SeqID_127107
atgggatcaagtcaaaagccttcgcttaaaaagaggttctatcaagtcaaaatcaagagcttagaggtcaccagtttacgaaagttgggtcaattaatgggtcaacttcaacggcaagccttccgcaaagcctatggaattagaccgccaaaggcaagtcgaaaatggggtggtcggaataccgagaaaatatttggagcgatcgacgtttttctcgcctatcataaccacaaggaaagtctggttgtcgctatgctagccgacctatatgacaccttcgaccgaagatgtgaagaaagcaatgcaaggattgtttgctgtactccagctctctatgtggggctggtttcacacctttttctccaagaaggtaggcccgtctatccgctacaaggttaccgctcgtgcgtcgaaaaaggaaaggcgaattgggaccaactcttggctagcatgggggggcgtctgttaattggttccctcgctagaaggaaggaagaatcaagattctatcttcatgcgaaggatgtccaaatgttcccttga

SEQ ID NO: 10330 - DNA, 411 bp, Glycine max
  Peptide Sequence Number=SeqID_127108
atggagtcgccaactatcgcaacctacccttcagtgggagggcgacgcagggctcacgggtgcgtcttccaagggaggaaggcgcacggagtcaccaccaatgtttattcgggggaaacatcgaaaaaatcgaaaagcgtgtgtggtctacgaactttgagtgtgaaaggtttgggagttgtatttacgcacagggaagatattagcaccccatgcgtccgtcacaagggacgacagcctttaatcaagagagaaacattaaggcattggaccattaacgatctcttggtttttgaaaggagagaaacgttaaggcgttggaccattaacgatctcttggggtggtcgacaaaagcgaggcttttgctcctacgtatcctcaattgcgatgaggaaatcagccctacgtag

SEQ ID NO: 10331 - DNA, 595 bp, Glycine max
  Peptide Sequence Number=SeqID_127109
tggtacagccgatcccgcagcaacttccagcgcggcagccacttcggcagagcctggtaaaaatgcagtgaacaacgatattgaggcgattgcagactctgatattcaatggcaatggccattatccggaaaagtcacaaccggttttgatgcccagaccaataagggactcaacattagcggcagttcaggtcaggtgatcactgctgctggcgctggcaaagtcatttatagtgggatggatgtgcgcggctacggcaagctgattatcatcaagcacaatagtaatttgctttccgtgtacgctcatcagggtaactcgctggtgaaagaaggcgtattcgtgacacaaggcattgccgtgcacgtgtttggcagtgaccagggccctacagactggttagcgtggatggcagcgtcccctttaaatatcgcactgaccgtgattggactcgtcagtgcgtttgcgtttcaccgttacatcacccacatcagcactcaacagcgtcgctcagccagcaacctgcccgtctatgccatgatgttgctaggggcttattttatttaccagctcatcagcacggggcactggtag

SEQ ID NO: 10332 - DNA, 231 bp, Glycine max
  Peptide Sequence Number=SeqID_127110
atggataggttgacgaccatgatgagtgcactcctgtcagcccagaactctcaagctgtcgccgctactgtagagcagcccttggtgagcacaaccccgctatctacagtgacttctccacccctctttttgcctccaagttgtacatggggaatgccacctccagtctgtggaagcccccagcccgctgtatctgaagttccacctccttttgctcagcagtcagcaccg

SEQ ID NO: 10333 - DNA, 858 bp, Glycine max
  Peptide Sequence Number=SeqID_127111
atgaaggctactctgaagggaaagtacgatgtcgacaaaaacggcgctgcctttgccaacatcgccgtcaacgccggcgacgtcaagttccgagcctccgtaacggaagccactttcattaacggtcccagcttcaccggcttggcgctcgccgtcgagaaacccggttccttcatcgtcgactacaacgttcccaaaaaggactttcggtttcagtttatgaacacggttagggttggggagaggccgttgaatttgacctacgcgcacagcaggggcgacaacaggaccgtcttggatggaacctttgtgtatgattctgcgaacaaggtttctgccaattacgcgctcgactcagggaactgcaagcttaagtacacctatgttcacaaggggttgaccacgtttgagcccgcctatgacgtggccaagaacacgtgggacttcgccgtttcgcggagggtctacggcggcgacgacacgttgagggcctcctaccagacatccagcagggttctgggagttgagtggtcgcggaatcccaaacacactgctggcttcaagaattgcggtggagatcctatattgactagtgatagagtcagaatagtctatataagcaggatgcgttcatctcatgatgtaattttgggagttgagttaggtccaattccaaattctaatatgttatcagagtctacgttaatgtttgtttgtaagccaatcaggccacccataatcagaccgttattggattacctacaaatgtctagtcagattgtagcatctgttaacttggccgaggaatttaaagctcccaaacttgttgctgagaccacatggaattttgagatgtag

SEQ ID NO: 10334 - DNA, 396 bp, Glycine max
  Peptide Sequence Number=SeqID_127112
atggtgtccttcacatcattcacagaggaagagaaagataaggccatcagcattaactcagtgcaggaagttaatgaagttgtcgcactccatgatccagatcacatgactttaaaatttctttctcatgcggatgggagagaggcagtggccaaagcagctaacttgatttttgtggagaacatgaagcaacataaattgggtggagaactagatcttcaaatccttttagaacctcaattgaataaagcattgcaaattgttggtagcaaaggtcctgagcctggccttttattggtttatggacctgtgaggagccatcttggttttcctgcatggagacttcgttacacagagatcatgttatcaacttggaatagtttgttgatgatttag

SEQ ID NO: 10335 - DNA, 204 bp, Glycine max
  Peptide Sequence Number=SeqID_127113
atggagaagaaaaaaaaaatatcctctgagtataagttgccttttactaagttgttagttctagaattaaaaacaaagaatgaagtctcgctaacttcaaccggaatgcctcgtaagtgtgacacactcgaagtagcccataaggatagcataagaagtatcgcctccatcactatggggtttgactctttttccttcttctaa

SEQ ID NO: 10336 - DNA, 1854 bp, Glycine max
  Peptide Sequence Number=SeqID_127114
atggttgcgggtaaggtaagagtagcaatggggtttcagaagtcaccggcggcggcgcatactactcctccgccgcagaagaagcagcctcctcctccgtcgccgtccaccgcgaaatcctcgtctcacaagtcctcattctctcgctctttcggcgcttactttccgcgctcttccgcgcaggttcagcctcggccaccggacgtggcggagctgctccgcctggtggaggagctccgggagagcgagtcgcgcttgaagacggagctgctggagcacaagttgctgaaggagtccatcgccattgtccccgttctggagaacgagatcaccgcgagggaaaccgaaatcgaaaggagcagaagaagagcggaagaagcggaatcagagaacgagaggttgagaaaggaattgcaggaactgaaggtgaaagcagaagaagagaaaaaagagaacgagagaaaaatcaaagcgctggaagaggaaatagcagagttgaagaaaacggcgtcgtttagtggtagcagtagcagcagcaacagaacagaggcattggagattcacgagcaagaagaagctacacataagctcgtggaggtatcgtttaggtcgaatctgatgaggagtttgaagaaaacagcgtcagatctcggaagcgggaatttgaaaaaagaggtttcggaaatttctgaaaggccacgtcactcgcggtgtaactcggaggaactcgttgattgctctgactcagttctgtttggttctgttgggtcacgggcgccacgtgttccgaatcctccgccgaagcctacgtcttcttcttcgccgtcgtcaccgtcgagcgtttcctccggcgaaacagagcgaaggattccgccaccgccacctcctccgccgaggaagcctgcgtcgaatgcggcggcggcacctcctccaccgccgcctccgcctccggcgaaggcggtaagagtggctccggcgaaggtgcggagagtgccggaggtggtggagttttaccactcgctgatgcggagggactcgcattcgcggcgagactctggctccggcgcagagatgccggcgacggcgaacgctcgtgacatgatcggcgagatcgagaaccgttcgactcacttgttggcgataaaaacagatgtggaaacacaaggagactttattagatacctgatcaaagaggtggagagtgcagcattcacggacattgaagatgtggtgccttttgtcaaatggcttgacgacgaactctcttatttggtggatgaaagggcagtgctgaagcacttcgattggccagagcagaaggctgatgctttgcgtgaagctgcgtttggttattgtgatttgaagaagttggtatctgaggcttcgtctttcagggatgatcctcggcagctgtgtggtccagctcttaagaagatgcagactctcttagaaaaattagaacatgggatttacaatatctcaagaatgagagagtcggcgacaaagagatacaaagtgttccaaattcctgtggattggatgcttgacagtggctatgtcagccagatcaagctggcatctgtaaaattggctatgaagtatatgaagagagtctctgctgagcttgaaacaggtggtggtgggcctgaagaagaagagcttattgtccaaggagttagattcgcgttccgagtacatcagtttgctggaggttttgatgtggagacaatgagggcgtttcaagagttgagagataaagcgaggtcatgccatgttcaatgccacagccagcaacagaaattcttttgcaggtctgcaacatatgatggagcaaactcagcttcagagaattag

SEQ ID NO: 10337 - DNA, 285 bp, Glycine max
  Peptide Sequence Number=SeqID_127115
atggccactggacaactattctcccgtactacacaatctttattttacaactacaagcaactttacatccagaggatgcttgattttgacttcctttgtggcagggaaacaccatcagtttctggaataattagccctggttctgagggatttcaaaaacttttttttggtcaggaggaaattgccatcccagttcatgctacttgtagccaaggggagatttttctttattttaacttcttcagcatgccaattgaatacaaagtaaccaacttcagtgcatga

SEQ ID NO: 10338 - DNA, 2958 bp, Glycine max
  Peptide Sequence Number=SeqID_127116
atggctgaccatgcaacaaggaaaactaccaccgataggcttgaagaagctattactcgtctctctaatagccaatcctccctcctagataaacatgctgacctcgttgacaagtactctgaactttccggcaaggtggatacacatcatctccacctccgatctccggctcgagagcaccatgggacctcttcccagtttcatcagcgtaactccgtcaagttggacgtccctaggtttgacgggcgtgaccctatggggtggatcttcaagatctcacaacttttcgaataccagaatacgccggaagaagaaagaatcactgtggcctctttttaccttgacggagctgcgttaagctggtaccaatggatgtttaagaatgggtttattacgtcatggtcaggtttcttacaagccctcgaatccaggttcgctccttccttttatgatgacccgaagggggcgttattcaaactaacacaacgaggcacggttaatgagtacttaacggagtttgaacggttggccaatcgtgttattggcttacccccacccttcctattaagctgttttgtttcaggtttagcacaggatattcgaagagaagtgctagctctccagcccatttcccttccccaggccatggcccttgccaagttacaggaagacaagattcgtgaccgccggcaagcaccaccacgaggtcacaatacaccatcaccatcctatgctcctcctagccggaaaccacagtctacatacgttcaaagaactccagaagaaatggcccttcgccgagaaaaggggctttgctacaattgtgaggaaaaatggagttccacccacagatataaaggacgcgttcttttattcatcgctgacaacccctccttgctaccagatgagcccaaccccgaacctcctttactgccggaaccgattccagcgtgttccctcgacctagacacaacctcagattttacttcccctcacgtgagtctccacgccctttctggcctcccctcctccgagaccttccgactcgtcggaatcatcaatcactcctccctcaccatgctcatagacagtggaagtacctataacttccttcaaccccgacttgcccagttccttcatctcaaaaccgaaaacacaaacctacttcacgtcctggttggcaatggctctgtccttgaatgcaatcaagtttgccgtgatacttcacttctccttcagggccaccagttcacggtcacgttccatttgctccctatcagtggtgcggatgctgtattgggcatagaatggctacgacaatttgggcctgttattactgactacaccgcgttttccatgaagttcacccatatgggccggcccattgaattacacgctgatatctccactggaccaaaaccaatttcgatccctcaagttaaacggttattacaaaccggatccgcttcagccctcttccacttaaaaatgatacccgaccaacaacccgacccattacttcatcttcctcacccgatacctgcggttgaagctcttctcactcagtttcataagctattccgacagccttcatcccttcctcccccacgatccatcgtccaccatatcaacctcctaccaaacacaaccccaattaatgtaagaccgtatcgttacccacaattccagaaatccgaaatagaaaagcaggtcttagagctcctcgaatccgatctaatccaacccagtatgagtccttactcctcgccggtattacttgtcaagaaaaaggacggaacctggagaatgtgtgtcgattaccgagctctaaacgcagtaacagctcgagatcggttcccgatacccacgatcgacgaacttctggacgagttaggaggcgctgcctggttttctaaactcgacctccggcaagggtttcatcaaatactcatgcacgaccctgacgtggaaaagactgcctttcgaacccaccaagggcactacgaatatcgcgtaatgccctttgggttatgtaacgcgccgtccacttttcaggcggcaatgaataccttgctaacgccatttctgaggaagtttgccgcggtttttttcgatgatatattgatatatagcaggacactagcttcacacctccaccacctcgagctcatcttccagactcttcttcaaagccagtaccatctaaagaagaccaagtgccttttcgctcagaagcaaatcgagtatttagggcacgttgtgtccggccaaggagtcgagccggaaccctccaaggtccaagccatggtgcagtggcccacgtcgtcctcagccaaggaacttaggtccttcctaggactcacaggtttctacagaaagttcattaagaactatgctatgattacggcccccctcacttccctctgctccaaggaaacattcgaatggccctcggaagcccagtccgcgtttgatcgattaaaggcagctatgacttcagccccagtccttgcgctacccgatttcgatgaaccatttatcatcgaaacagatgcttccggcgccggcatgggcgcggttctaatgcagaaaggccaccctctcgcgttctttagtaagcaattcggcccacgaatggttcatgcctccacttacgtcagagaactccacgcgatagtagctgcagtccgcaaatggcgccagtaccttctgggccatcctttcaccatttttaccgatcataaaagcctccgcgagctcatgtcccaagttatccaaacacccgagcaacactactatctttctaagcttttgggtttcgactacacgatacaatacaaggtgggttcttcaaacgcagttgcggacgctctgtcccgtactactccctccggcgagttcctactcctatcagtgcctcaccttgacttcatgcgtgacttacgcaacacactttag

SEQ ID NO: 10339 - DNA, 456 bp, Glycine max
  Peptide Sequence Number=SeqID_127117
atgaagcaacttgctcagtgcatcagagtcaacttggaaggtcacgtgacaagcattgttggagagaaatctgaagtttggtgcacgtttagcgcaaacagtggcggtagaaataccagtggtggttgcgatgacagtgataatggtagtggtggtgacggtgaaggtgaaggtgaaggtgaaggtgatgatggtggtggtgatgccaatgatggtgacagtaacgacgtggtaatgttaacagtgttggtagtggcggtgactaaggtgatattattggtggtggtagcaattgatattgttggtagtggtgattgtgatgataataacgatagtggtaacattgatgatgatagcaatgttgatggtgatgatgatgtcattggtgatgatatgatggtgacaatgacaaaggtggtgttgatggtggtggttttgacaacaatgatgatgatg

SEQ ID NO: 10340 - DNA, 228 bp, Glycine max
  Peptide Sequence Number=SeqID_127118
atgaatagaaaatctacacgagaatattggagctttccaagccactggagctatatgcaaatgtgctatggtgtgttgttcaagatggagaagccaacagaagatgaagttgctatgttgttgtctcacaatgagtcagcgccaccttacatagaagattatgcaacaaagcctgaagctcaacattttgttgagaaactagaagttgttcatgaagatcgatcataa

SEQ ID NO: 10341 - DNA, 615 bp, Glycine max
  Peptide Sequence Number=SeqID_127119
ggagctaaaagtggcagtcagttggagtctgctcaagcaaagaatcaggcactaagggacgctggagctgttgttcccacatcatatgaaacttttgaagctgcaattaaggaagcatttgacaagttggttgaagaagggaatatcacaccagtcaaggaaaccactcctccaccaatccccgaggaccttaactctgcaatcaagagtggaaaagtccgtgctccaactcatattatttccaccatttctgatgagagaggtgaggagcaatgctatgctggtgtatccatgtcttccattattgaagaaggttatggtgttggtggtgtggtctctcttttatggtttaaacgcagccttccccattactgtactcaatttattgagatgtgcatcatgctatgtgccgaccatggtccttgtgcctcaggtgctcacaatgctatcgtgacagcaagggccgggaaggacctaatttccagtattgtatcaggtatgcttacaattggtcctcgatttgggggtgccattgatgatgctgctcgctacttcaaggatgctcatgacagggtatatgatttgtacttttcctgtgaagctggttggaactag

SEQ ID NO: 10342 - DNA, 252 bp, Glycine max
  Peptide Sequence Number=SeqID_127120
atgggtgccatggacaatatgatgaaaaaaacctcgactatatacaaagttatggtcttcaaaccgaagcagaatacccttacgatggaaaagaaggtccatgtctcaatcggtatggtgaaacccgtagtcaggattagaggttacaaaattgtgcctccgaggaacgaggagcaacttctgaaggcaatggcaaaccaacctgttgcagtaggcgttggtgctagtggacaagcatttaggttttactag

SEQ ID NO: 10343 - DNA, 342 bp, Glycine max
  Peptide Sequence Number=SeqID_127121
atggatattagagttgtggaaaagaaaaaagagatgatgacagtgacaaaaaatgcacacatgtgccagcagctctcatttatagaagcccactgtggatcaacatcttctggaatttctagccgatggttcataaaccctacagctccaacaacctgcaagaatccaagagaaactgttgttcatatatgtgaggatggtgactgggactttaatttgatgtctcatcatatttggagtcatctattggactacataagagttgttcctcctcctagtgaacggagagggtctgatagtgtgaagtggcagggatcaaatgatgggtgcttctctatatag

SEQ ID NO: 10344 - DNA, 738 bp, Glycine max
  Peptide Sequence Number=SeqID_127122
atggcttctcctctttcgcggttgtcttttcatgcttcatcattcatagtggcaattctcattttttgcatgtcacactgtgctcttggcattgatggacaaacggtcatagactctcctctattaacagaaaagttaggaatcaatcgcacagaaaaggtgcacataccggagaataagccttatatattcatgagaggaaatggaaaaggaaaaactgccatagtttggtctcaaagctctgaagacaatgtggcttctgccacctttaaagtcgaagcacacgacttcattgcctttggaattagcttcaaggtcaattctctctatatacttaaaactttgcaaccttatgctggaaaagaggaattaggcacctacgggggttgcgtatacctcgcaaaaccaatcagtggcagcagacaaagtggcattttatcattgcgcattttacagtactcaacactctcttcgattgcaaaggttgacattactacgatagttgttacattcaaggaaagcggatatatatttgtggtggatgacaagagggtaacgattaaaggttcagtcactgctcaaaatagggaaagtgaaggtgagatgagtgggtttatcttcatcaaaggcaaggtttatgacattggtggggtgtacctaggaagagcaaagggcccttattctagggtgatttttgctgagacgtatctatccatgaccattgtcccagaagggtga

SEQ ID NO: 10345 - DNA, 492 bp, Glycine max
  Peptide Sequence Number=SeqID_127123
atgggtcataggcccattggaatgagggcagaaggtggactccagtccagcggcatcatcatgattcattcgaattgtgaagtaagaatggagggtggagaggaaggattggagatgatggtggactcaaaggacttacagcaacagagcaaagcgttggacaaactcactgatcacgtcgaggatcgccaactcgattccactcgcgtccaagaggccatggcttccatcgctgcttctgccgaagctgatcgcaatgccatgcgcatcagtttagccaaacagggcaatgtctgttgcgttgtgaggggagccaaaacacccaatagatctttggcaacgggccaaactaagaacaatgcaagtggacttgagagctcatccaacaaaaaccttaaggcattaggtgaatgggtccccgtcgcttatacattgctcaacttgtccattataatccattgtaggacactaggacttccccatcacgcttga

SEQ ID NO: 10346 - DNA, 1023 bp, Glycine max
  Peptide Sequence Number=SeqID_127124
atggctttaacactagacaaaaaatctgttggtacctttttcatgcttttcttgacatgcatatgtcgtgcctcgtcacgcactctctctgagtcttccattgccacacagcatgaagagtggatggccatgcacgaccgtgtttacgctgacagtgcagagaaggacaggcgccagcagatattcaaggagaatttggagttcatagagaaacacaacaacgaaggaaaaaagaggtacaatttaagcctaaacagttttgctgatttgactaacgaagaattcgttgcttctcacacgggagctctctataagccaccaactcaactagggtcgttcaagattaaccacagtcttggcttccataagatgagtgtcggtgacattgaggcaagcttggattggagaaagagaggagctgttaatgatattaagaaccaaggcagatgtgggagttgctgggcattttcagctgtggcagctgttgagggaatcaaccaaataaaaaatggccagttggtttcattgtctgagcaaaatttggtggattgtgccagcaatgacgggtgccatggacaatacgtggaaaaagccttcgactatattcgtgactatggtcttgcaaatgaagaagaatacccttacgtggaaacagttggaacttgtagtggcaattccaaccctgcaattcagatcagaggttaccaaagtgtaactccccagaacgaggagcaacttctaactgcagtggcctctcaacctgtctcggtgctccttgaagccaagggacaagggtttcagttttactcaggaggagttttcagtggcgagtgtggaactgaacttaaccatgcagttaccattgttgggtatggtgaggaggctgagggaaaatactggctcataaggaattcatggggcaaaagttggggtgagggtggttacatgaagcttatgagggacactggtaaccctcaaggtctttgcggcattaacatgcaagcctcttatccgtttctttaa

SEQ ID NO: 10347 - DNA, 1092 bp, Glycine max
  Peptide Sequence Number=SeqID_127125
atgggaaaattacgtaagagtattggaacatttactgtgttctttttactagtgatagtaatagcagaatgccaaaaaataaaaaaacatgaattaatcgatggctttgaaggagatggttttggcggtggtggaggtggatttggtggtggtgctggaggaggtgcaggtggtgggtttggaggtggacacgggagtggtgtaggaggaggagctggcggaggtggtggagctgggggaggctatggaggtggtgttggtggaggttatggaggcgataagggtggaggtgctggaggtggcatagaaggtggacatggtggtattggaggagaaggtggtggtgttggaggaggagctggaggaggtggtgctggtgggataggaggaggacatgctggtggcattggaggaggagggggtggaggtggtggagccggaagtggtgctgcaggcaacgtaggaggtggacatggtggtggcattggagggggagctggaggtgctggtggaggtggtcaagccggaggtggacatggtggtggcattggagggggagctggaggtgctggtggaggtggtcaagccggaggtggacatggtggtggcattggaggtggacatggtagtggaattggaggaggagctggtggtggtagtggggctggaggcaacataggaggtggacatggtggtggtgttggaggaggaggagttggtgttggtggcggttatggaggtggtaaaggaggaggagctggtggatgtggtggaattaataatggtggcatgggaggtggacatggtggtggtgttggtgggggctcaggaggtggtgctgaaggtgacactgggggaggagctggtggaggaggtggacataatggtggtgttggtggaggctcaggaggaggtggtgctggtggtggcattggaggtggaaaaggtggagttggaggaggtggtgttggtagtggcactggaggaggagttggtggtggctatggaggtggaaaaggtggagttggtggtggctttggagtagtagctggtggtcatgcaagtgggagtgctggtggcgatggctattaa

SEQ ID NO: 10348 - DNA, 432 bp, Glycine max
  Peptide Sequence Number=SeqID_127126
atggataaagccactttactggctgaagtgattagccaagtgaaggaattgaagaaaaatgcaatggaagcaagcaaaggttttctgatcccaatggatgctgatgaagtgaaagttgaaccatatgatgatgaaggaggagatggatccatgtcttactgtgcaactatctgctgtgatttcagatctgaaatactatctgacctaagacagacccttgattcccttccactgcatctagtcaaggcagaaatttcaactttggcaggtagaatgaagaatgtgtttgtcttcacgcttctgccacactggatttctcaccaagaacatcgcatgcaagcaagaggagaagattatgctttattgaaacatccacttcctcatgcaaccacggatcttgtttgtgctgatgtcaacaatttgatgtgttaa

SEQ ID NO: 10349 - DNA, 768 bp, Glycine max
  Peptide Sequence Number=SeqID_127127
atggagaaggagaacagtgacaaggaggagtatgtgatgatgttgcaaagatgtgtgaagaagcttcactttggaagccgggaagagaaagaggtggcagcaaaggtaattgaagaagggttggctaaacaagatgttgttaaggtgagagagatgacaagtgagcttggggtggtgagagtgttggtttctatggcagtttccgaggtggctagtcgccaccgagtaggactcaaggccttgatccacctgtccaatggaactcacggaaacaaggctttgatagtggaggcaggaatattgtccatattgcctaagaaaattgaccttgaagatgaatcaataagtgaatttgcacacttactctcttcattgtcatctcaaggcaccatcaaacgacgccaagattctgcatattttgtccttagaggaatggtatcaaatcttttgcccccatccactccacccacacattataaagcaaaaagaataatctccagtgatcttatcatctacaagaagttgcaccatgcagaagtggtctcgatatttcaaaacttaacaagtatggagtctatgctcatcaatttgaaaaacttgcctccttcaatgaacatttggaaaccaaaatggcattcccaaagtccaaacctcaaggattacagcaatgcagtgttggccgaactacttcaaatcaaaaccgaccaggagaaccacctcgaaaaatcattagaaaaagcagcaaatatggacattcacaagttttga

SEQ ID NO: 10350 - DNA, 147 bp, Glycine max
  Peptide Sequence Number=SeqID_127128
atgtctttcactcaccagagcaactccagcgtctttattcaaaggtgtaggcagaagtacaagagagttgatatcagagcagttaagaattggactcgccagattctaagtggtttagagtatttacatagccatatcctcccttga

SEQ ID NO: 10351 - DNA, 2691 bp, Glycine max
  Peptide Sequence Number=SeqID_127129
atgtgtgcacccttcaacattctagttctcttgttatcacttttactcacttcttcttcttgttcttcttctttttcacagcctcgccgtgttctccatcaaccactttttccgagaatatctgttccgccagcacaagctccaagctatttatctcctgagcctcaaccgaagcaacaacatctacaacccaagcttccattttcttctatttcatcttcttcaccaccaccgccgcagaaatctttcttcccttcctaccattctccgccactgccaccttcccccgccgtcctcgctacttttccggccaacatctcctccctccttctcccccgccccatctcccgtcaccaccgctccgccgctgccctcgccgtctccctctctctttgctcaatcgccctcctcgccgccgccgccgccttcctcctccaccaccgccgccgcacacactcctcctctgatgtcaacgacgacgacgacgacaaggcctcgagatcggacagcctccgcctgttcccgccgaacaccgccgcctccgacggcgccgaacgtaaaccccgcggcaaaacgagtcccacatcggagcttctctacctcggcacggtggcgaactccgtaaccaccaccaccacctcaactacaacaacagcaaccactgactcaagctccagccaccatgaaagttttcggccaccgtatcagaaactcggcgactcgccagagctcaacccgctgccgccattgccacgtcacaaattcaaaccatggaccactgaagaagagaataatgataaagatatcatagaaaaggaaaatgaagaagaagaagaagaagaacagtttttttctccaagtggttcttctggtgggaaaattaacaaacaacaaaagagttctccttctccttctggtgttgttgcttccagctcacgtgttttccacgtggataaattcggttccagaagcttcacttctcgaaccccttcttacccacgctccaattcactctctttttctcgttccccttctctgaatttcagccccccaagtgttaaatcattgccaccgaacaacaaccctgcttccccttctttctcttcatcctcttcttctccgagggaagaatggcatgttccatctcagaggaaaaattctccagcggccaccgatttacctactcctccgccgccacctcctccgccaccgccgcagttttgggaggctccggttgataaaagtgttacttttaggaacgagagtgaggagactccgaagccaaagttgaaagctttacattgggacaaagttaaggccagctcggacagggtcatggtttgggatcgcttgggaccaagttcttttcagttgaacgaggacatgattgaaacacttttcatggtaaataataataataataattccaaggagggtttcggtgttgcgattagagataatcataatcctcggcgtcaagtagttcattctgcgtctccaatgcccttggagaatagggtgcttgaccctaagaagtctcagaacattgccattttgcttagagcgctgaatgtgactattgatgaagtttgtgatgctcttagggaaggcaattgtgatacgttggggacggaacttcttgaaagtttattgaagatggctccaactaaagatgaagaatctaagctgaaggagtttcaagatgaatcgcccttcaagcttggcccggctgagaaatttcttaaagtcgtgcttgatataccttttgcttttaagagagtggatgctatgctctacattgcaaactttgattctgaattagaataccttaagaagtcctttgaaactctggaggtggcctgtgaggaattaaggaaaagccgcatgtttctgaagatactcgaagctgttctcagaacaggaaatcgaatgaatgttggaaccaatcgtggtgatgctcatgcgttcaaactggacacacttttgaagttagttgatattaaagggactgatggaaagaccactctcttacatttcgttgtatgggaaattgttagaactgagggttctcatatttctggttctaacaataaccatgccgccgacaatgaccaccaatatactcttcaagatgaggttgacttcaaaaagcttggtctgcaagttgtttcaggtttgagtggggagctcaccaatgttaagaaaacagctgctatggattcggacatgctcagtagtgatgttgctaaacttgccagaggaatcgaaaaaattgtgcaagttgtaaaattgaacgaggagtcacctttgaaagaaactaaccaaaaattttctgacgcaatgaaatgtttcttggagaggggagagcaagagatttcaacaatccagggccaagagaaaaatgccctctcttcagtgaaggagataactgagtatttccatggaaattcagcaaaggaagaagctcatccttttagaattttcatggttgtgagggatttcctttcaatcctagatggtgtttgcaaggaaattggtaaagtaaatgagaggacgttggttggttcccgtcaatctgtaatgcctgcaaatcctataatgcaaacctttttccctgaaattattggtaagcaaccatctgattcctctgaatctgattatcctctcaaagccaatctgacccagatgtaa

SEQ ID NO: 10352 - DNA, 1038 bp, Glycine max
  Peptide Sequence Number=SeqID_127130
atgggcaagctcgtcgaggatttcgacgctctagctggtaccgttgcgttcaagcagcattgttctaatgaagatggcacggcaagaccccttctattggtaactgcttctgttgacaagatggttcttaagaagccaatccatattgaagctgatttgaccattgtgggtgctgtttcctgggttggccggtcatccatggagattcaactggaattgactcagtccgctcaagggaatcccaatatctcaagctcacctgcacttgtagctaacttcacatttgtggctcgcgactccgccactggaaaagcagccccaatcaaccagatctcacctgaaagtgagcaagaaagattgctctgggaagaagcagaagagaggaacaaatttaggaaaagaatgaaacaagaacagaaacatggagagagtgaagaccctgctaggctcaaagcactactggccgaagggcgtatcttctgtgacatgccagcattggccaacagagatagtgtcctgatgaaggatacttgcctacagaactcttttatctgtcagccacagcaaagaaacatccatggtcgtatctttgggggattcttgatgagaagagcgtttgaacttgccttttcaactgcttatgcctttgctggtgcagcacctcatttcctagaagttgatcatgttgatttttttaaacctgtggacgttggaaatttccttcgtctcaagtcttgtgttctgtacacggaacttgacaacatagctgaacccctggtgaatgtggaagttgttgcacatgtgacaaagcctgagcaccgctcaagtgaggtatctaacagattctacttcacatttggtgttgatcctgtggccattaaaaatgggttgaggcttctacatgttgttcctgctacagaagaggaagcacggaaggtgcttgaacgcatggatgctgagaacctgagtttggttaaaaaagatggtaatctaaacgttgtcaaggagaacaagtgtacggagaaaacaaatctctga

SEQ ID NO: 10353 - DNA, 312 bp, Glycine max
  Peptide Sequence Number=SeqID_127131
atggtgtcgaatattaaggattttgctgctccctcgtggaagagaatcgttgagtatgatagagagaaggagaggaagctcgtgggattctcgtggagttcaatgttaggaaatatgagaagatataatgcaagagaaattcccattaatgagtcacaatttaattatataagtgaacttaacactgcattcaacttaaaaccattagactttaagactctgacatattaccatttgattcaagccaaccatctcaaatccttgacacttcttcaacatgaggagttgtgtctaggatatcaagggatctga

SEQ ID NO: 10354 - DNA, 459 bp, Glycine max
  Peptide Sequence Number=SeqID_127132
atggaggacgattacttcaacaagatgttcaatgaagttgacatggatatggataagaatgtggatgatgcacttaaaaatgaagattgtagcaatttttttacaactacagaggtttttcatactcaagatgagttattgaaatgggttctggcggttgtatttgagctcagttttgttattatcattttaagtagtcctagaatcatggattatcttatatcttcaaaacagaacccaaaagagacgaaaggaacttaccttgaatggcgacacacaaaggaaggagggcatacgaagagccgcaatgaggagggtacaggtggaacaaggtggcgggagaaaatgaggagagttattgtagtaagaacaacaaccttcataggagggaaaggcaccgttgcaggagctattgctgtaggtgggaggtgcgtcgtggggaaggaggtgttagggtag

SEQ ID NO: 10355 - DNA, 282 bp, Glycine max
  Peptide Sequence Number=SeqID_127133
gcactatgggttaatgtcaatggtgataatgataatgatgttaactgggctagtggtggcgatgacgacgaaaacgatgatagtggtgatgataacatggtggtaatgatggtagcattggtggatggcgtatatgatgacgattgtggtggctccttgatggatggttcctgcgaatttgcaactactctggcactcaatccaggaagagaatcagttagacggttagggtcacgagtgcaatgtgactgtcaattgacaatcacgtttttggcaccttag

SEQ ID NO: 10356 - DNA, 141 bp, Glycine max
  Peptide Sequence Number=SeqID_127134
atgacaactaacaaatggttgaacattgttgtagatggaaactcagccttgggtccttattggccgaaaattgtttcagattatttggaaaagattgtcaggtttgtaagcccaaagttccacaataaaagttcaaattag

SEQ ID NO: 10357 - DNA, 540 bp, Glycine max
  Peptide Sequence Number=SeqID_127135
atggctgctccggccatagtttctaaaactttgctcttatttcttattctccatgccattctcatgtctctggccacatcacagccaaacttcgtaaaacattactgttttgaccaaaatggccaacctcaatgcccttttgtatccaacctctcttccaacactgaaatcgactatggcttctacaatttctcaaatggccaaaactctgacaaagtcaacgttattgggatgtgtagaggagatcttaagccagaagcttgccgtagttgcctcaacaattcaagaatccttctcacacaacttttccaaaccagaaggaggcaattgggtgttgtcggggaccttctcagaattctaggaaacagagctgctgccggtgattctcatcgtatgtatgctcaagcaaacaaaacaggtccaagctttcaaactgtatttgctcatgtgcaatgcacacctgatttgttagagttggaatgcaatcagtgcttgtttggaaacttaatatcatatatcccaaaatgcaggcagttctga

SEQ ID NO: 10358 - DNA, 189 bp, Glycine max
  Peptide Sequence Number=SeqID_127136
atggcaagatcatgggtggtaaagttcttacaccaagttgtaatactagattcgaaacttaccggcatcttccgtcttcaaaagaggattctgatttgtgcaggaaatagcgacgcgtcacgaactgtactcctcgtcgccatggcagtgctagtcgttagcgttgatttggtgctcggttttatctga

SEQ ID NO: 10359 - DNA, 1995 bp, Glycine max
  Peptide Sequence Number=SeqID_127137
atggctgctccggccatagtttctaaaactttgctcttatttcttattctccatgccattctcatgtctctggccacatcacagccaaacttcgtaaaacattactgttttgaccaaaatggtaactacactgctaatagtacgtttcaggccaacctcaataccttgttgtccaacctctcttccaacactgaaatcgactatggcttctacaatttctcaaatggccaaaacactgacaaagtcaacgttattgggatgtgtagaggagatcttaagccagaagcttgccgtagttgcctcaacaattcaagaatccttctcacacaactttgtccaaaccagaaggaggcaattgggtggtatgatcagtgcatgttgcgctactctacccgctcaatatttggaattatggaatctgatcctttgtataatatacggaacaaccaaaatgcaacaaatgtggatcagtataatgaagttgtcggggaccttctgagaagtctaggaaacagagctgctgccggtgattctcaacttaagtatgctcaagcaaacaaaacaggtccaagctttcaaactatatttgctcatgtgcaatgcacacctgatttgacagacttggaatgcaatcagtgcttgtttggaaaattaatatcatatatcccaaattgctgtgctggaaaagtacgtggcagaatttttacaccgagttgtaatcttagatttgataccaccccatactttgatcctattcctaccacggacgtccctcattcgtcgataccgcaagcatttccttctcctgctccatcagccatgctcatcaaaggcaagagcaactcatggaaaactgccatcgcaataattgtgccaattgtctccattctgatactcttcacctttatgtgcttctttttgagacgaaggaagccaacgaagtattttaaaagtgaatctgtagctgactatgaaattgaaccaactgagaccttacaattagacttccaaaccatcatagacgcaacaaataactttgcagatgtaaataagcttggagaaggtggatttggaccagtctacaagggcaggcttcccaatggcgaagaagttgctatcaaacggttgtccaaggattctggccaaggagatatagaatttaaaaatgaactgctattagtagcaaagctgcaacaccgaaatttagcaagggtattgggcttttgtttggaaacaggagaaaggatactggtgtacgagtttcttcccaatagaagccttgactactttatatttgatccaatcaaacgtttaaatttggattgggaaaggcgttacaagattatacaaggtattgctagaggtcttctttatcttcatgaagattctagattgcgcattattcatcgcgatctcaaagcaagcaacatactcttggacgatgaaatgaatcctaagatatcagattttggcatggcaagactgtttgatgcagatcaaactcttggaaatacacgtagagttgttggaacctatggatatatggcaccggaatatgcaatgcatgggcatttttctgtgaagtcagatgtttttagttttggcgtactagttcttgagatagtcactggacacaaaaatggtgatatccataagagcggttatgtagaacatctaataagctttgtatggacgaactggagggaagggactgccttaaatatagtagatcaaacactgcacaataattcaagagacgaaataatgagatgcatccatattggattactttgtgttgaagataacgtagccaatagaccaaccatggcaacagttgtaatcatgtttaacagtaactctctcgttcttcctataccctcacaacctgcatattctacgaatgtcaaaggtccatcaagatcaaatgaatcaagaaataacttcaagcaagcatcatcaaatgaagtctccattagtgatctagatccccgctag

SEQ ID NO: 10360 - DNA, 231 bp, Glycine max
  Peptide Sequence Number=SeqID_127138
atgctgacatctccgggaagggtgcagatgaccacattggtctctgcttgtcaatcggacttggggtcttcaaatgacgaggtgtctccgcatgctacaggactctcgggtcatgatagcagaattgagacttttttgcggtgtcggccagaagacgctgacatctctgggaagggtgtagatgaccacattggtctctgcgtgtcaacgggctcgcttgcctctagctga

SEQ ID NO: 10361 - DNA, 216 bp, Glycine max
  Peptide Sequence Number=SeqID_127139
atgaaacccctccctcccgtggtgactcctccttccgtgtctcctcattctcatgcttcctcatcctcttccgtgaaggtgtttcataagatttttccgtatggaaaggtcattttgttaaagtatttattcccttgtgaaatgtcaattctaggaagaagagttgagttggagaagaaaagaacaatgaaagtggagggtctggacttgcgctga

SEQ ID NO: 10362 - DNA, 1241 bp, Glycine max
  Peptide Sequence Number=SeqID_127140
gtagtaaagtccaacatatcaattggacaaaaaatgtggaacagtttttaggcgttctaccgaatttacctttcaacggagataatttaaatcaacataccattgtagaaggtttggcacaagctttagtgatgttcccaaaagattctatgacaaaaagtgaatacctcaagggtgaaagacattgtattcttgtggcaacgggtgaccctgttgctaagagcatgttagtgaatttacctttgcttcacaaaggaatatttatttcaggacaattcaaaactttagatgccaccttcataaacgtggctaaaatatttgtcccgctaagggtatctctttcgataataactccaaatccacatccattgttcatatcaattttcagtttggggaatggtctaatcgaaggcactgatctcatcaccgaccatggaaagggtcaacttactgttctattgtctagaaattttaaggaggcacaatgtatccattctaggacgacattggaagaggaccctttaacacggcttttagaacaagagcaaccaatgcctttagatgaaattcttggacaagtgtttaggtcatccacttccacatctagagaagggtcattgcctcaaaatgcatggtcaactgaagttggtgcttcttcatttggtttccctaatacactaggaaactccctcaatcaatttcaaccaccaagcttcccaatattgtatccttatgataatgttagtgatggtgttggtcctagtgcaagtgctggttctagtgttgatgttcgtgctagtgctgctgctcttgttgctgttggtgctgctagttctggtgctattgctgatgctggtgttgttgcttgtgccaatgtcggtgctagtccttattatggtagttatcatcaacaatttccaagtcatcatcgttttgaaatgagtgagataaatccgataggaacatcttcaacgggagcaaacccttggggttctccagtgccaatgatgcctgaatataatgaggcatttctttggccggaaccaccaacgaattttgaagactatgtgcaggcttgggagggatgtttggttggaagaattcactctagtatatcccttaatcaagcaaagaccttgaggagactaacatcatctatcacgcttacgtatcagtggccgagtagattggaaattgtcctcttcttacccaaaacggctgtaagctataccacaaggtaa

SEQ ID NO: 10363 - DNA, 189 bp, Glycine max
  Peptide Sequence Number=SeqID_127141
atggcttcagttgagttccaactaaaactgacacaagtatacagcttgaagcaccaagattctctccccatcgaggccaacggattcgttgctggaagaccgagaaatttaaccagaagtaggactcaggcagagttcattcgtttcctccctcacttccaatcattgcacgtacagtgcctatgttaa

SEQ ID NO: 10364 - DNA, 162 bp, Glycine max
  Peptide Sequence Number=SeqID_127142
atgcattcaaagggagttgtacttgcctgcagcccaatagatgcagccttggtggctactgcaggcggtgatgacagacgatttctcaggaagattggccaaggggattgggcttttgagcttcaaggtatttgcatgacactaaagttagtgatggattaa

SEQ ID NO: 10365 - DNA, 213 bp, Glycine max
  Peptide Sequence Number=SeqID_127143
atggggtttgcaaatagcaattcgaaaaggaattggaagcttgcagatctagatgaggcgacaacagcgacaacaaatggcagcatcgtagtcagaggaggaggaagtgaagtgcccgaggtggtcgcaaaggacatcgatgatgatgttggtagcaacaaacttgtcatgaaactagtgaagaatggagtgcagtggtggccacaccattga

SEQ ID NO: 10366 - DNA, 270 bp, Glycine max
  Peptide Sequence Number=SeqID_127144
atggaacatgggggagagtgtgataaagagaaagaacacagaagacattgcttgtatgagcctggggggatcccaaacaacaacatgaacaacactccaagttccctccacttgatttcgttgtgtgcatgtggtggttctccaactccaaccacatcgtcagatgatggaaaaacgaggaaccgatttttcagttcaaagctaagggaaatttatcctatagattttgataaatttaagtacattagatttcgtgggatcgagatataa

SEQ ID NO: 10367 - DNA, 660 bp, Glycine max
  Peptide Sequence Number=SeqID_127145
atgccgcatccctttctttttttaccctggaccgatattgatgaggactgtcacaggtggatggttcatttcattcaccagaatggcatgcagctcgtttggctagccttaacacctctcacaccattacctgggaagagtacaaaaagaagcaaaaggtacaactggccacagttgactttcagttgtgtctacattaacagcgttaatgagcaaggcaggtcattgtcatgtgatgataaacagtacagagaggaagaagaattaagaaaaggggaattggaagcagatgcagataggatgatgagagagtacagagctcaactagatgctgaaagggctcggaagctttcccaaggaagaaatcactctagtagtaagtctaaacatgtgaaagataagagggacaaaatttcaaggaagcacagcagcagaaagagaaagcattcaagaagatcttctgcatctagctcctcttcgtcatcctcagactcttccagtagcgatgaagaaagagggtcaagaagatccaagtccaggtccaagagatcaaagaaggaaaagaagtccaagtcaagaagcaaggatgctggaagcgatagtgaagacgagggtccagttcgtctttcaagattctttgggaacatcaagagtgaatag

SEQ ID NO: 10368 - DNA, 162 bp, Glycine max
  Peptide Sequence Number=SeqID_127146
atggaaggtaccgggattgagatctacggcgttggatggagaaagagagggttgaggaatgaagctgatgaaaaattggagtatgttggtggggagttagatgtgaggggagtgagaaggagcaatatggcagagtctgggattatgctcatgagcttttaa

SEQ ID NO: 10369 - DNA, 402 bp, Glycine max
  Peptide Sequence Number=SeqID_127147
atggttgctggaccagttcggagtcctccacgatggaaaacaaccttaccccggtgccatttcaacctgagagatgatccttggtttgcagctttgggaaggtcttgcattcatttcacctggaatggccggggagcaatacctctcgagggcttagacttgcgagtcgttgagaatgttgaagaagctgaatttgttttggctcatggtactgaagccttggggaatgccgatggcagttcatgttcaatgaaacttgaagacatggagaggatattggagctttgtgctgccaaaggaattcctatggtggtagccaatccagattatgtaactgttgaagctagagacttgcgtgtgatgcctggtgaatttgctttatctactcctttctccttttaa

SEQ ID NO: 10370 - DNA, 819 bp, Glycine max
  Peptide Sequence Number=SeqID_127148
atggcaccgggtgttgaaatcctatggggggtgtggaagggaaagagggaccttgaaacgccgcgtttcggcgagttgtcggagaccgttcaagttctgaaactgaaatgggcgaatctgagggggtacgggattgagatctacggcgttggatggagaaagagagggttgaggaatgaagctgatggaaaattggagtatgttggtggggagttagatgtgaggggagtgagaaggagcaatatggcagagccatttattggacttgatggctgttttttgaaagggtattttggtggacaacttctgtcagttgttagccttgatagaaacaaccatatttatgtgttggcgtatgctgtgggtcttattccagcattacaagaagtcctacatggtgcaccttatcgtttttgtgcaatgcatttgtggaagaactttacaaaacaatggaagaataaggaattaaaaggggttgtttgggattgtgccaaatctactacacttcttgaatttaatcaaaacttggctcgtgtaaaggcattaaacataaaggcatgggagtatctgaagaataggcccaaagaagcttggacaaaggcttactatagtgagtggtgcaaggtggataatatttgcaacaatacttgtgaggtgtttaactcaaagattgttacctatagaacgaagcctattttgactatgctggaagagattcgatgttatgtaatgagatctatgagtggccataaattgaagttagctgcgagaattggaccattggacacctactgcacaatcttgcacaatattgcataa

SEQ ID NO: 10371 - DNA, 2685 bp, Glycine max
  Peptide Sequence Number=SeqID_127149
atggaggactcgaccaagttgcgtttggtgcggtgccccaagtgtcaaaatgttcttcccgagcttgccaattacactatttatcaatgtggtgcttgtaatactgttcttcgaggaaagcctaaaggttttgaaggtggtggtaggttgtggcagacctcagataaggaacaaggtggaggagatcaaggtacaccaagaagtttcttggggaaaggggtagttgatttgagtgataattcagatgttgaagttaggcccagtgggggttccttctgggagggtcaaagaagggatttggggaaaccaaataaaggacatgagaggtttttggatgattctagggatggggatgagaaaggggttttggaggatggttttaatgtcaataaggacaaaaggggcaagtcaattggaagggagcagaaggagcagaagactcacatgggaggggaccaattctatgggagaatgtctaattggccaaatggggaaagaggtgagatggaggggttttggagaaagacacacgctgatatggagggtgtgagatttcccactctaaattatcctgatgagggatcttcaaatagcttttccagtttttcttacagttatggggagcaatggaggaattacaaggacatggatggtgtgaatagggttcagcaccttgagcaagatcgagccgagattctaaggaagctgggtgagttgtccaatcagttgaacaagtcttctgaggtggttagtaaccccaaagaaaaggttcttcctgagggaaagatggttcctccagatctttttggtggccctgaaaattggtttccagatggatcatcggcaatgaacaggtcctcaggacaattctttggccctactagtaacaaacatatggcaggttctccttatttcaattatcatcaagatccatatgcttatgcaagtgatcatgaaatggctatgcacaacttccatccttctatgcataatccaaattatgttcctggatatggggatccttctgtatcccagatgatgagaagttcacatcctataccccgtcagttcttgcaaaaaccaatgcacccctactttcctggacgctatactgatactgttccagattcctatgatccatatgcacagaatgctatgcttcacccaccttcttgcccatgtttccgttgctatgacaacaaaataagaggttcagtgccggctccacctgctgcattcgttaagagcagattccctcgtaccccaaatgattctatgctataccatcatgagatttcaggggcagttggtccacatgttcataatgctagaactgccatgtctgctgtgagtttacatgaaaaacaactgcatacaagagggcctagagactacagttctgagatgggtggatttgttggaagccgtcctcgaaaagtggtgcctggtactggtagtcggcaatgccttcctatagctggtggttctcctttcatcacatgtcatatttgctttgagttactgcaactgcctaaaaagacactggtcatggtgaaaaatcgtcagctgaaaatgcgatgtggggcttgttctacagaaataaaattctctgtcatcaataagaagctaattatttctcctaattcagaaatggaggaaactaccacatccacaagggttgatgataccactaatgaggttgtgaatagttgtgcattccaagcctgtggtgatgtaaacgcaggtgctgcgaacttctcatctgatgattattctggttatgattttcattcagttgatagagaatctcctgtgctggctgcagacccaatcttgaactctaccaagtcccgggagaggcaaagtttccattcttcatctccctgtatttctgatgatgaaaatagtccagaagttatgactgcaccaattgaagctactaagtccattcatcagccatttaaagcctctcaatctccttcacctagtggttcatttaataatgctgtaaaacgattagggaaaggaaaccagagtagttgctcagatcaagagacggaaaaaatagaaaagaatgcctcaaggcagaattctttgaaagaggtgcttgcaactgagatggatgtcaatgattattctaacaatggggtcttccaggattctggtgatgcaagcggagaacatgatcgttctagatctagcaaaaggggtgaatcatttttagcaaacattatcaagaaagataatggcaaaagtaatgttactgtaaacggacatcccataccagatcgtatgattaagaaggctgaaaagctagccgggccaatccagccagggaattactggtatgattctcgggctggattttggggtgtcatgggtggaccatgtcttggaataattctgccattcatagaagagttccagcatcccatgccagataaatgtgctggtggaaataccagtgtttatgtaaatggtagagaacttcaccaaaaagatttagatttgctttctcgtagaggactccctcgtgatagcaatagatattatatcgttgaaatttctggtagagtcctggatgaagacacaggagaagagctggatagccttggcaaacttgcaccaacagtggagaaagaaaggcgtggatttggcatgaaagcacccagaacagctgcataa

SEQ ID NO: 10372 - DNA, 558 bp, Glycine max
  Peptide Sequence Number=SeqID_127150
atggtgaagagagtgaggtctgattcgggtccattgtccctgcaaaagcacaaccattggtgtgtgaagttaggagtctcaatcttcttggtgggtcttgtcgttcgccttctcttgtgggattcattcagtttctcatcagtggtggtggagacacctcctcctctggaagaggcaaaagcagagtccccggttttcgcttcctctgttcttcaggattctgatgacttcccagaaaatgatcagaaccagacacaaatctccaagaatgaaaaatgtgatctttttgtgggaaattgggtgcaagacctatctgggccagtgtacactaatgagagctgccgtgtgattgagcctcatcaaaattgtatgaaaaatggacgtcctgattcagggtacctctactggaggtggagcccacgagactgtgtattgcctaagttcaatcccagaaagtttctcaaattcatgagaaataaatcaatgtcctttattggtgattccatctcccgcaaccaagttcagtccctactttgcattctctctaaggtattgtaa

SEQ ID NO: 10373 - DNA, 198 bp, Glycine max
  Peptide Sequence Number=SeqID_127151
atgaggccaaatatagagcaagtagcgcaacatgcacttgtcgtaccacccaattgcgtatttctggcagctgcggcattcgtctggtttaacatctcctctgcacagcccaatggcgtatactttgtcagtgtttttgccgtaagagagattgtaaaaaccatagtcgattcctttgttggaagtgagattggataa

SEQ ID NO: 10374 - DNA, 681 bp, Glycine max
  Peptide Sequence Number=SeqID_127152
atgtcgaagaataagaagtctagcttaggtcgccaaaagattccaattgaaaaaatacccaaaaaaagtcatttgcaagttacattctctaagcgtcgttcgggactgttcaagaaagccagtgagctttgcaccctttgtggtgtagagattgcaattgtggttttctctcccgcggataaggcattctcttttggccatccagaagttgagtccctcatcgatcgttacaccacgcgaaaccctccacaagagtctagtgcacaccacctcgttgaggcacaccgaaatgccaatgtttgtgatctcaacatgcaactcactcaggttttcaatcacttggagattgaaaagaagcgagcagatgacctagaccatgtgaggaaagctaggcagaggcaattttggtgggagagtccaattgatgagcttggattgaatgagttgctgcagttaaaggcctctattgaggagctcaaaaagaacatagaaaaacatgctagcaaattcatgattgaacactctagtaatataccttcttcatcaattcttggacctaataatggacttggtccacttgtacgttatgacacctttgagaacaaacctggtgctgagattggtattgcttcatcaattccaaatgcccattatctcgcttttcgcactgggtatctttga

SEQ ID NO: 10375 - DNA, 1530 bp, Glycine max
  Peptide Sequence Number=SeqID_127153
atgataaaacggtttccaagtaggaacaataggtccaaaggcatcaaggttaagcacaatcatgataagaagaatgaatttgccaaggatgcaaaactgtcagtcagtacacagacagatccgatcctgaaacttggtagaagagaccttcatccaggtaagcatgaagaaattcagaatgaaaaacatgaggaagaagaagaagatgaacatattgaagaggatgaagaaactaagcatgatcatgaagaacaacaagatggaaacaagaatgaaactgaagaacgtgaagagaacaagcatgaaggcagactacaaaggggagaagaaaataagcatggagcagaagaccaggaggaagatgtggaagatgtaggaagaggaggaggagacgatgatatcgatgaaaatgatcaagagaaatcagagatggatactattgatcgtgatgatgagttcttggatgaagagaaagagaaagaagaggttgatgagaaggagaacgaaaacgaggatgaagaaaaggagagtttagttgaaaaccacaacaatcatgaggctcgggaggaacattacaagggggatgatgcttctagtgctgtggctcatgatactcatgcaactagcactgaaactgagacacttagcttggaaaactctgatgtaaacttagaaatgaatatcactaaacctgaaaatgagacaacttattcagatgaaagtgtcagaaagcaaaatgattcagatttgaaagtttcagaaggtaatgtgatagatggtatatcttcaaatgcaactgctgttcaagagactggaaataacactttgtccaaccctgtggatgatagctcatttctaaataaaacaactgcaacggactctgacagccactttcaatcaagcagtaacctaacagtagtgaccactgaagcaagcaacaacttgaccttagctggtaatgatacatcaagttcatctgaacaaaataaaacagtgatgttatctgaatctgaccaagctcaaaacagcacgacgaacacaacaatccctggagatgtaaaagatgtgcagacagaaggattagagcagagtggcaatagaacttctgatgaaaacctgcatgataccaattcaacgatctctatcaaaactgaaaatggaggtgaggatgctggagaatcatctaatctagtagcttcaaatgtaaccgagaacgcatacagaaatgagaggtctgaatctgatatttctgaaagtgacaagtccaacggtaacactgaaacaaatgaaaatccaaatgttgatgccacagaagatgagatgttcaaaggtgacacacaaacaggtgaaactgatgaaacatcagactcttcctctgccaacgaaactatggattcagctgaacaagatgcaatcgattcttctgatactcatatccacgaggatgtggccgaggctcgaaccgatcttgatacactgcctgatatcagaaatgaaggagatgacagtgacgaaactgctgcagagtaa

SEQ ID NO: 10376 - DNA, 522 bp, Glycine max
  Peptide Sequence Number=SeqID_127154
atggatatgtttaagcagaaggagaagaagaaaaacacaggccgcaaaaagattgagatcaagaagcttgacaagggtagcaacaagcaagtgacgttctcaaaaagaagagcaggactgttcaaaaaagccagcgaactctgcattttatgcaatgtttatgtagccataattgtgttttctcctgctgacaaattgttctgctttggccatccagatatcgacagcataattggtcgctatctcaaaggagacaatgcagagtttgaatcagcaaagtcgtcaaaaggaaaatcagtgtcatgtgaggaacgtaacagacaatatgaagaggcgatgaagaagttggagttggaaaagaagaacttggcacaaattgaagttttgactaaaggttggaacagaagttggtgggacgatcccattgatcagatgactgatctgcaattggaacagtttatggtgtccatttacgagttaaggaaaaaactagcagaaagggcaggtgaattgatgatgtaa

SEQ ID NO: 10377 - DNA, 293 bp, Glycine max
  Peptide Sequence Number=SeqID_127155
atggcttccttcatgtttgtctacctctttatccttctcaccttgaccaatttcgtaaccactatagcacagttcgaccgtgatattccggaccgcgtttgttcaaacaacctaaccactccaaacagcaccttccaattgaacgtgaagacccttctgtcttatttatcttccaacgccacagctaacaagcaatactacaacaccacagttggcagtagaaaccactccgacagtactgtctatggaatgttcctgtgctggggtgacttaccccctcagctttgtagcca

SEQ ID NO: 10378 - DNA, 522 bp, Glycine max
  Peptide Sequence Number=SeqID_127156
atgaccgaccctctcgatgagtcgatctcttgctttctcataaaggtggacccttgggtactagtacctatcacctttagaggactatatgtcctcgccatcagaggactgcacatcctcgcctgcagagggctgcacaccctcgcctttagagggctacgcgtcctcattttcattcctgggccatcccctgatattggaaggcgaccaattgtgcgagcaaatccagagagggaggctatcacgcatctactatgcataccagggcaagatttcacccgtgtcgctgcaaaaagacgagtgcggatcatgcgcgccaacatgaccactcttacatggatatggatgacgttgctatttagcaacattctgcccagcgaccactgtcgcaacatgccctttgcgggcgtgcaaggcgaggctcacgggtgcactttccaaaggaggaaagatgcgcggagtcgccaccaacgtttatttgtggaaaacgtcggaaaaaccgaaggaaaccggtcgaaatga

SEQ ID NO: 10379 - DNA, 3711 bp, Glycine max
  Peptide Sequence Number=SeqID_127157
atggaatcaccgggtgctttgagggacacgtcagtgatcgtggtgacgctggactccgacgaggtcttcatcgtcgcgagcctctgtaccagaaccgacactcaggtaatctacgtcgatccgaccactggcgcgctccgccacgaggccaagttagggttcgatctgttcaagtcgcagggcgaggccttggatttcgtcaccaacggatcgcggtttgcctgcaggagcaggacgctcgcgagggcgattctaggctatgccgcgttggggaacgtcgcgctgctcctcgtcgcgacgaggctggtcgcgagtgtttccaatctgcccggcggtgggtgcgtgtacacggttgcggagagccagtggatcaggattccgctgcagaacgcggtggcgcaggggaagggagaggtgaagaacgtgcaggagttgacggagcttgatatcgatgggaagcattacttctgcgagacgagggacgttacgcggccttttccgagcaggatgccggtgaacgaaccggatcaggagtttgtttggaacgcgtggttttctactccgtttgttgagattggcttgccgcggcattgtgtcacgctactgcaggggtttgcagaatgtcgaagttttggaagctcgggtcaactagaaggtgttgttgctctcacagctcgtcggagcagactacacccgggtactcgatatttagcaagggggctaaattcatgtttcagtacaggaaatgaagtggagtgtgagcaacttgtatggattcccaaacgagctggtcaaagtgtacctttgaacagatatgtatggcgaagaggcactattcctatctggtggggtgcagaactgaaaatcacagctgcagaagctgaaatttatgtttcagattgtgatccttataaaggaagtgtacagtattatgaaagactgagtaagagatatgatgctcgtaatatggatatacgtgcaggtgagaattcaaaccgaaaagctttggttcccattgtatgcattaacttgcttcgaaatggggaaggaaagtcagagtcccttttggttcaacatttcgaggagtctataaactttattagatcaactgggaagcttccgaatactcgggtccatttgataaactatgactggcatgccagtgtgaaattaaaaggtgaacagatgacaattgaagggttatggaaacttctaaaagcacccactctatctataggtatatctgaaggggattacttgccttcacgacaacgaataaatgattgtcaaggtgaagttatctacaatgatgattttgaaggtgcattctgtttaagaacaaatcaaaatgggattgtacgttttaactgtgctgattctcttgataggaccaatgctgctagtttttttggttgcctccaagtattcacagagcaatgtagacggctggggatatcacttgatagtgatctggcatttggttatcaatcgatgaataataattatggtggatatactgctccactgccacctgggtgggagaagcgttctgatgccgtgacaggaaaaacatattatattgatcataataccagaaccaccacatggatgcatccatgtcctgataaaccatggaagagatttgatatgacatttgaggagttcaagagatcaacaattttgtctcctgtatctcaactagctgaccttttcctacttgctggggatattcatgctactctttacactggatccaaagcaatgcacagccaaatacttagcatattcaatgaagatacgggaggaaagtttaaacagttttctgctgcacaaaatgtgaaaatcactttgcaaagaagatataagaatgcagttgtggatagctctcgtcaaaagcaattagaaatgtttcttggaatgaggcttttcaagcatcttccatcaatttcccttcaacctctacatgtaccgtctcggccgtctggttttgttctcaaaccaattgcaaacttatttcctatttctggtggtgaagctagccttctgagttttaaaagaaaaggcctagtttggatttgtccacaacctgcagatgtagttgaaatctttatttatcttggtgaaccttgccatgtttgtcagcttcttctcacaatatcccatggtgcagatgattcaacttatccatcaacagttgatgtacggacagggcgccatttagatgggcttaaactggtcttagagggtgcttctataccacaatgtgcgagtgggaccaaccttttaatacccttacctggggcaattaatgccgaagacatggctataactggagcaaattctcatctacatgcccaagatgcatcacccttatcattactgtatgattttgaggaactcgagggagagtgggatttccttactcgtgtagttgcgctaaccttttatccaactgtttctggaaggaaaccattaacgcttggcgagattgaaatccttggagtttctcttccgtggagtgatgtatttactaatgaaggccctggtacaagattagttgagcatgtcaagaagtttgaagaggagcttaatcccttcgtatctgattcggatacgaatccatttaactcttcatcctcagaaaaagcgtcaccacccaaacaaggaggcacttctgctgaccatttcattgacctcctgtctggggaggacccgcttccacacccacttgcgcaaccagttactgaaaatattgtctaccaggaaaatgacccacttgatttcttggacctaagtgttgaaaatcatagtgccaaaatcaatggtaaagtttcatcagaagatgccagacatgcagaaagtagtgctgaacaatatttaaagtgccttaaaactcttgcagggccaagtctgcaaagaaaaatcaacttcattgaagccattaaacttgagattgaacgccttaagttgaatctttctgctgctgaaagggatagagccctgctatctgttggaatggatcctgcaaccataaatcctaatacactgctcgatgaagcttacacgggaagattatctaaagttgcaaacaatcttgccttgcttggagaagcttctcttgaagataaacttgttggtgctattggtcttgggactgttgatgataatccaatagatttctggaatattatcagaattggggaaacctgttctggtggtaagtgtgaggtgcgtgctgaaattagaaaggcagttcattcatctaacacaatgtcatctgctggtgcttcagaagctgtattcttgtgttctcaatgcgaaaggaaggcttgcagagtttgctgtgctgggaggggggcatttctgcttgtaggatataattcaagagaggtccaagttgactttcctgtaaatcgtttattagctcaggatggtataatttgtaaacggtgctgccaggatattgtgcttcatgcattgattttggactgtgtgagggttctgattagctttcgaagagcagaacgtgtggaaaaggctgcttacaatgctttgaagcaaatcattggatcatcttgggattgtcatctagaaaagaaacaggtccctgatagcaagtctgctggcaaagcagtacagttgttactgaacggatatgaatccctggctgaatttccttttggcagctttttacacccgatgcatggatga

SEQ ID NO: 10380 - DNA, 228 bp, Glycine max
  Peptide Sequence Number=SeqID_127158
atggtatcaaagcctatcctaacgatcgatgttaggcctttcagaccacctgttatcaggccctcattggaccacccgcagatgtccagtccagcaaacttcatgctcaagatttctagtccttggcgtgaagagtgtgttggagaatttgcattgactagtgatatggccaaagttgtgtacataagtagagggcaaccctcacctcacgttggttttctaggttga

SEQ ID NO: 10381 - DNA, 906 bp, Glycine max
  Peptide Sequence Number=SeqID_127159
atgttgattccatttgtggatgacagctgttgcttatattatacgattggtccacagccttcaagactcaacagtatatactacagtgtcttttcccaagcagctttacctaccttggatgttgaaagacttgtttacgtggaaccagctgttgagatctaccatgacaaggaatatagatcaaagatatggaaatttcgttctcacaacttcacactctcagtaatctggacccctttccttgtcaaagcagctatatttgaggactttaatggagttacctcttcagagatacagctttatctggacacgctcgaccagtggaccaaccagtataagaattttgattatgttgtcattggtggtggaaaatggtttctcaagactgcaatctaccatgaaaacaaaacagtcacgggctgccattactgccctggaaagaacttaacagagctaggattcgactatgcgtaccgcagagtactacaagaagttttcaagttctttacaaagtctaaccacaaagccactgtcctcttcagaaccaccacaccagaccactttgagaatggggagtggtttagtggagggtattgcaatagaactgtacccttcaaagagggtcagatacatatgatagatgtagattccatcatgagaggtattgaacttgaagagtttgagaaggctgcttctctgggatccaaaagggtgaacttgaaacttttggacacaactctcctttcactgctgagaccagatggacatcctggaccttacagaaagtttcagccatttgcaaaagacaagaatgccaaagttcagaatgattgtctacattggtgtttgccaggaccaattgactcatggaatgacataatcttgcaaatgctactcaatgcttaa

SEQ ID NO: 10382 - DNA, 249 bp, Glycine max
  Peptide Sequence Number=SeqID_127160
atggataaggactcgtgtggagtggggttcgtggcagaactgtccggcgaaagtagccgcaaaacagtgagtgcaacgactttggcatttgcatgtgagtgtgagtatgagtctggtgcgtgtggtgtgactgatgctttggagatgctggtgcgcatgacacacagaggtgcttgcggtgtgaagccaacactggagatggagcagggatcatggtggctctacctcaccagttttacaaggaggtag

SEQ ID NO: 10383 - DNA, 1170 bp, Glycine max
  Peptide Sequence Number=SeqID_127161
atggcttctgcttccttaatcaactcgttgacttgttcttcgcgtgctcccactcagcactgttccactttcacccgcaccaccgccgccacgtcactgagacaatttaacagccactgtcggagaccactcgcgacgaggatctcgccgccttccaccgttgtctgcaaagctgtctccgttaagccccaaaccgaaatcgaaggtctcaacattgctgaagatgtcacccagctcatagggaaaacgccaatggtttacctgaacaatatcgtgaagggttctgtggccaatattgctgccaagcttgagattatggagccctgttgtagtgtaaaggacaggattggttttagtatgataaatgatgctgagcagagaggagctataacacctgggaagagtatattggtggaacctactagcggcaacaccggaattggtcttgcctttatagcagcttcaagaggttataaactcattttgacaatgcctgcttcaatgagtttagaaagacgagttctcttgaaagcatttggggccgagcttgttttgactgatgcagcaaagggcatgaatggagcagttcaaaaagctgaagaaattttaaaaagtacccccaatgcatacatgcttcaacaatttgataatccttcaaatcctaaggtatttatagcttattctatgtttaagtgcacaaatcctatgttcttgggaatgggaacccttgcagggtgcatcattatgtccagcctccagattcattatgagacaactggcccagagatatgggaagatacaagaggaaagatagatattttagttgcaggaattggaactggtggaactgtttctggagttggccaattcctaaaacaacaaaatccaaaaatacaggttattggtgtagagcctctggaaagcaacatacttactggcggaaagccaggacctcacaaaattcagggtattggggctggttttgtgcccaggaatttggatcaagatgtgcttgatgaagttatagcgatatcaagtgatgaagcagttgaaactgcaaagcaattagcactccaggaaggcttgctggtgggaatttcttcaggagctgctgctgcagctgctttgaaggttggaaagaggcctgagaatgcaggcaagcttattggg

SEQ ID NO: 10384 - DNA, 204 bp, Glycine max
  Peptide Sequence Number=SeqID_127162
atggagaacaaagccctctttaggcttcttgttattcttctggctcttttcttcgttgtatttgttgctgctgttcctgcaaccagaagctccatgatcgggaaaattgatcctttagtgcaagatcatctggctaaggttcctttttcctctcaaggacaaatatttatgccacatatatgtcccggaaactccataaattaa

SEQ ID NO: 10385 - DNA, 444 bp, Glycine max
  Peptide Sequence Number=SeqID_127163
atggtgttcgtgggtgatgttgtttcagggacgggtcaaaactactctctttgtttggtgggaaggaatatagatcatggacgttggcaatggtgctttcacattttagttctatcatcacaaggatatgtagcgggttatgaagggcgagggccctggactttcgataagcaccttttaattcttagcatcatcaaggaagtgcttgctaaccggttgaaaagggttcttctcaattgcatttctaaggagcagccaacttttattgaagggcgttctatccttgataatgttctcgttgctatagagaccattcaccatatgaagtgtaaagtgataggaaatgaaggtggatttgctctgaagattcatattaacaaggcttttgacaaggtggatgggagaggtgttggacctatcttaccaggccagggaaaggactga

SEQ ID NO: 10386 - DNA, 303 bp, Glycine max
  Peptide Sequence Number=SeqID_127164
atgaggaagtttgcgatgaaacaagggtacatgttggttagcaaaaagggctatatggtggtgttaccaaaggtagatgatggcgtgaaagcaggggttggtgcaagtgtggaagaaagggttggagttagtttaaatacatttgtgaatggtagtgatgaatcattccaagggacatgtttgaaagtctttgacacagaaatggacttggatactgaagatacctttgaagaagtagtggatgatttgaggaatgttgttaattctagaattccatttgatattcttgatgtgatcatatag

SEQ ID NO: 10387 - DNA, 592 bp, Glycine max
  Peptide Sequence Number=SeqID_127165
atggaaacttgcacggctctattgtttttaacggcgatcacagcatacttgatatggttcacgttcatctcacggtcgctgaagggtccacgtgtctgggccttattgggcagtctcccaggcctcatagacaactgtgaccgcatgcatgactggatctgcgacaacctacgcgcgtgtggcggcacgtaccagacctgcatctgtgcaatccccttcctcgccaagaagcagggtctcgtgactgtcacgtgcgacccgaggaacttggagcacatactcaagacacgcttcgacaattaccctaaaggacccacgtggcatgctgtctttcatgatctgttgggtgatgggatctttaacaccgatggtgacacatggctgttccagcgcaagacagctgcgctggaatttaccacccggacgctgcgccaagccatggccaggtgggtgagtcgagccatcaaccggctctgtctgattctcgaaaaagccgagaatcaagtcgagccggttgatctgcaagacttaatgcttcggctcacttttgataatatttgtgggttggctttcgggcgagacccacagactt

SEQ ID NO: 10388 - DNA, 531 bp, Glycine max
  Peptide Sequence Number=SeqID_127166
atggaaccggagcattattttccttgtccttcatcatgcttaaccaggtggtggtcgagggagacggtggcggtggtgaccggagggaacaagggcatagggtttgcattggtgaaccgtcttgcggaattaggagtgagtgtggtgctaactgctagagatagacaaagaggggaagctgcagtggagaatctccgaaagcaaggccttggtgattttgttcactttctacttcttgatgtctctgatcccctttctgtgttaaccttcgcatcctccttccaagccaaattcggagccaccttggatattcttgtgaacaatgcgggagtgtcctacaatgaactagacgaaaactcagtggagcacgcagaaagcgtcataaagaccaacttctacggtcccaagttgctgattgaagctcttctccctctctttcgttgctcttcttcttccatcactcgtgttctcaacgttagctcaaggcttggctccctcgatttaattcgtcaatacagtagtgcaacttga

SEQ ID NO: 10389 - DNA, 678 bp, Glycine max
  Peptide Sequence Number=SeqID_127167
atggcaacggcgagacgcagtttcccgccgatcaccgaatgcaacggaacgacgccgtgcgattccgtcgccgccgacctcgacggcacgctcctcatctcccgcagctcattcccgtacttcatgctcgtcgccgtcgaagccggcagcctcctccgcggcctcctcctcctcctctccgttccgttcattatcttctcctacctcttcatctccgaatccctcggcatccagatcctcatcttcatctccttctccggcctcaagatccgcgacatcgaactcgtctcacgcgccgttctccctcggttttatgctgcggacgtgaggaaggagagcttcgaggtgttcgagcggtgcaagaggaaggtcgtggtgacagcgaatccgacggtgatggtggagccgttcgtgaaggactttctcggcggagacaaggttctaggcacggagatcgaggtgaatccgaagacgaagaaggcaaccggtttcgtgaagaagcctggcgtgctcgtcggaaagtggaagcgtctcgcggttttgaaagagttcggcgatgatgaatcgccggatgttggtctcggagatcggaaaacggaccgtgacttcatgtctatttgcaaggtttgccttctactactgattctgattactatcattactattagcactagctga

SEQ ID NO: 10390 - DNA, 1113 bp, Glycine max
  Peptide Sequence Number=SeqID_127168
atgtcagaaattgacttggcagttattaaacctgagatgatgaagctgtatgtctggcttcagacttcagatgattcaatccaacaagtggaacaagaaattgcaatgttttgcccactgatatgtcaagaaataatacaaaaaggcatgggatcttccaagagttgtgcaatatgtcttcctcaacaagtcagtcctgccatgttgagcttaattcttgactattgtcggtttcatcaagtaccaggccgttcaaacaaggaacgtaaatcttatgatgagaaatttgttaggatagacacagagaggctttgtgagttgacatctgctgcagacagccttcagttaaaacctttggtggatcttaccagtcgtgcacttgctcgaataattgaagggaaaacaccggaggagatacgtgatatatttcatttgcctgatgatcttacagaggtgtctggtgcttgtgagaactctgaagaaaagttggagcccttgagaaatataacggctgacccaaggatcaggcttttgaaccgtttgtatgccaaaaagagaaaagaactaaaagagcgtgaaaggttaaagaatgttgaagttgaggaagagcatgttgatgaacgttcagttgatgaccttttgtcttttattaatggaaatgatggagatccaaagggagttaaaacatcaaagaataaaaagaagaaccggaggaaaaaagagcaacagaagagctcttctttgaaggaggaatctgaactgaacaaaaaggaggtaaatggtcatgatatcagacaccaaagttctgaagctgagagaattagcgagaccttgtatttaccctatgcagatgatgacacattttctcctaaggttgagtttgatgatggtgatatagatgatgagatcgatcctgctttaaaggaaaaaattgacagggaagtggaagattttgcccgcagattaaattctgactggccagaaagaatgcaagaacttttatcttcagggcaagaacgggagacaatactttttactacagatggttttctaaggcgacatgctttgtttgtgcatagggtcttgctaatgagtctgatgtacactgattaa

SEQ ID NO: 10391 - DNA, 1140 bp, Glycine max
  Peptide Sequence Number=SeqID_127169
atggcaactgtggggtctgaacctgcttgtgcaagaacggttcatgatgttgcatcttctttcagctctaaatggcagcactcttctacggttaagaagcagccacgtgctcgaattcttcaatgttctctcaggattagagcttgtagttccatggctaacaaaaaggatatctacaaacaagtggttcttcgtgctgaaacgtttgcatcgacagccttggaaatggaagaagcaacgtggattaagcaggaagaaatggtacgtgattttgatatgtgggatgatccagctaagtccaatgacatccttgtcaagttggcaaacagtgccaaagtggttgattctctaaaggacttgaaatacaaggtagaggaagcaaagctgatcaatcagttggctgagataaatgctattgattatgggctttataaacaagcatatgaaacatcattggatgtgagtgagattgtggatcagtacgagatttctaagcttcttaaagggccttttgatatggcaggagcatgtttggttataaaagctggacctaagggcatctatccaaagctctgggcagaacagatcctaagcatgtatcttagatgggccaaaagacgaggttatgaaggaagaattgttgacaagtgtccgttcaagaatggaggaattaattctgctattatagagtttgaatttgagtgtgcatatggctatctttcaggggaaaaaggagttcactacttgataagaggttctccaaatgaatcttctcagcttgaggctagctcagcaactgtagatgttattcccatgtttcttgagagtgcttgtgatcttgaaattgattctgaggatttgattatctcatctcccttgattcatgggaaaaacaagagacaaactgatcatacagtttgcattcagcatatacctactggcataagtgtccaatcctatggtgagagaagccactttgcaaataagatgaaagcactaaacagactgaaagctaaacttctagtgacaacaaaggaacaaggagttgcaagcgttgaggtgccagacctaaattatgttctggaggggaatattggaccccttattgcagctcatattaatagcagagtcatgtcataa

SEQ ID NO: 10392 - DNA, 510 bp, Glycine max
  Peptide Sequence Number=SeqID_127170
atgaccagtcgggtttcacaactatgggtatatgataattggaaagagtcatacaacatacatgtcaaagatctacaagcattgcaactattcatccctggaacaattgtcagaattcaaactatacctgcattagacaagtcaagccaaccaattccaaacaagttgttacaaaaagacaacccatacggcattgcctggcttgatcaaataccaagggagcaacggaccttggcatggaatgatggaaaacaatggggacacatgaccactaatttggtagagtcactaaacttgatgctaaaaaaaatgagaaaattttcaattactgccttggtcaaaatcacgtataagaagttgagcaaatattttgttgatcgtgggactcaaggtgatgcaatgattgcctccagacaagtttacacactcattgcggccaagttcatcattgaagaagaaactaagtctaacactcacttcgttcagcaatttgaccgccaaagattttag

SEQ ID NO: 10393 - DNA, 1257 bp, Glycine max
  Peptide Sequence Number=SeqID_127171
atggtttcacttggagctatatatagtgtgatctatgtgttcctgtttggagctgttactttggttttgggtggggatatagttcaccatgatgatgttgccccaagaagacctggttgtgagaacaactttgttttggtaaaagtccccacttggattgatggtgtggaaaacagtgagtatgttggtgttggtgcaagatttggccctacattggaatcaaaagaaaaacgggccaatctttctagagttgtcatggctgatcctcctgattgttgtacaaagcctaagaatatgctcaccaacgagatcattttggtgcaccgaggaaaatgtagtttcacaaccaaggcaaatatagctgatgaagctggtgcttcagccatcctcattataaactaccgtacagaacttttcaagatggtttgtgaagaaaatgaaactgatgttgatattggaatacctgctgtcatgcttccacaagatgctggattgaccttggaaaggcatatagaaaataaatccaatgtgtcaatccagttatactctccactgcgtccattggttgatgttgcggaagtgtttttgtggcttatggctgttggtaccattttaattgcttcttattggtctgcctggagtgctagagaagcagcaattgagcaagagaagcttttaaaggatgcttcagaggactacgttaatacagaaaatgttggctccagtggttatgtggaaatcagtactgtagcagcaattttatttgttgtgattgcttcttgcttcttggttatgctgtataaattaatgtcattctggtttgttgaagttctggtggttctcttttgcattggtgggatagagcagctaaatctttatattcttcatgtgttttcagggtctacaaacttgtttggtggctctgttatcatgcaaaatgcttatagtttcagatggtttcaacaacctgctcaaacatttgtgaagatacccttctttggagctgtctcatatctgacagttgctgttactccattctgcatagtgtttgctgtggtttgggcagtttatcgccatgcatcgtttgcttggattggtcaggatatccttggtatcacattgataattacagttcttcagattgttcgcataccaaatctcaaggttggaactgttcttctcagttgtgccttcctatatgacattttttgggtgtttgtctctaaacggtggttccatgagagtgtgatgatagtg

SEQ ID NO: 10394 - DNA, 414 bp, Glycine max
  Peptide Sequence Number=SeqID_127172
atgaaggtgagaaatggtgagataagagcagtgttagaacgcgaggacttgatggaagaacacatcgatggagtggtgggaacgttcctcagagacgtgagaaacggaacgtggaagagccaagggtggccgtcgtactggacggaatacgcggtgtcgaagctggctctgaatgcatactcaagaatgttggcaaagagatactcgtacgaaggaagtgggttgagtgtgaactgcttttgccctggtttcactcaaaccgcaatgaccaagggcaagggtactcacaccgcggatgacgccgccgcgctggccgccaccctcgccttgcttccgccgcacctcttgcccaccggaaagttcttctcgcttggaaagaaggctaccttcctcaaccctacttctaaattatga

SEQ ID NO: 10395 - DNA, 2634 bp, Glycine max
  Peptide Sequence Number=SeqID_127173
atggctgtggtgagtcctatgcctgcaactccaccacaggtcaatcctgtgaacttgcttcgtaatactggggttcctggaatcatgactagtaggagagaaattgtaaatgaacctagtccaagtatggttaatgagacaatctatgttgccgtggcaaaagatgtgaaagatagcaaattaaatctgatatgggcaatacagaactctggaggaaggagaatttgcatccttcatgttcacgtgccagcacctatgatccccttggccttgatgggtgccaaatttcctgcaagtgcgctgagagaggagggagttcaagattaccacgaaagagaaagactaaaaatgcacaagactctggatgcttacctttttatctgtcaaaggatgggggttcgtgcaaggaaactactacacattgaaatggattgcatagaaaaaggaattgttgaactcatctcccggtatggcatacagaaacttgtaatgggagcagcatctgataagtaccattcaaggaggatgacatccctcagatctaagaaagctatatatgtatgtgaacaagctccagcttcttgtcatatacagtttatctgcaacggctacctcatacatacaagggattgcagtttgaatagagggaatgtagaggttgaatttcctttgttgcagcaaatggcaaactctgaagttggacattcacctaacttgagtttccaatcaattttgcaagggcaaaaccatgggataaaattaactaatccagctcaagagttatttcgtagagtaaggtctgttaatgatggacatatgagaagccttgaatctgtttcttcttcagaagggtttttaactccaccaagcaagttcagtaaaaacataagttctattgaaccaggattgaccccaaatttgattaatgatggaagtgagaatgcattagacttgattttgaattacccttctctgattaacaaggatcttcatcattcatcatctcctagtgtactggatgaaggaatggatgatgctctctattatcaacttgaacaagtaatggctgaggcttcgaatgctaggcgtgatgcatatcaagaaactgttaggcgcagtaaagctgaaaaagatgctattgatgctattcacagggctaaagccactgaaaacttgtacaaagaagagctgaaactaaggaaagaacaagaagaagcagtagaaaaagcaaatgaaaaacttaacaatatgaagagccagacagacaaagttaatgaggaactccgacttgccttagatcagaactcatcactagagaatcaaattgcatcaactgaacttatggtaaaggagttgaagcaaaagattatatctgccttggacctgttacaaaactacaaggatgagctagatgatttgcaaatacagcgtgataatgcagtgggagaggctgaggagtttaggagcaaacaaggggaagcctcatcaagcgcacaggagcttcactgcttctcagatttttcctttcaagagattaaagaagcaacaagtaacttcaatccatccaagaagattggagaaggtggatatggaagtatatttaaaggtgtcttgcgtcacactgaggtggctataaaaatgttgaatcctgacagcacgcaaggacctttggagtttcaacaggaggttgaagtattgagcaagttaaggcatcccaatcttatcacacttataggagcctgcgcagaatcttggactcttgtctatgagtatttacctaatggaagccttgaagatcgtctcaaccgcaaggataacacacctccactatcatggcaaactcgaatttgcattgctgcagaactttgttctgctctcaattttcttcactccaataaacctcacagcatagcgcatggcgacttaaaacccgccaacattctcctcgatgcaaaccttgttagcaagctcagtgactttggaatctgccgtatattatcttgtcaagacagttccagtaatagtactacacagttttggaggactgttccaaagggaacttttgtgtatgtggatcctgaattccttgcttctggtgaacttacaccaaagtcagatgtttattcatttggaatcattttattgagattgatgactgggaaaccagccctgggaataataaaggaagtgcaatatgcattagatgctggaaagttgaaatccatcttggatcctttggctggagaatggccatttatgctggctgaagagctgattcgcttggctttgaggtgttgcgagatgaatcggaagaaccggccagaactttattcagatgtttggaggatactggaaccaatgagggcttcttcagtagtcacaaacacctctcaactgggttctcaaaggctatgccaacctcctccttattttatttgtccaatctttctggaagtcatgcaagatccacatgtagcttcggatggttttacttatgaagctgaggctatacgcgaatggctggaaagtggtcgtgacacttcaccaaggacaaattccaagcttgctcatcgcaaccttgttcccaaccacgctcttcgccatgcgatccagaactggcttcaaagtcactga

SEQ ID NO: 10396 - DNA, 285 bp, Glycine max
  Peptide Sequence Number=SeqID_127174
atggcagcaaaaaagccttccatgcggttgaatttcatggacgaagagagcacgaataactttatgagcactctgaaacagtttgagggaactcagatgggagcagacaaacctattttgagagtggatctccatcacaaagagggtggagtttttccccctctacggctacacaaactggaggtgcttcctgatcaaccttggcataccattcttcatatgccccgggacattttaccatttcaacccgctctagcaacgaccagagaaggatctgggaagtag

SEQ ID NO: 10397 - DNA, 252 bp, Glycine max
  Peptide Sequence Number=SeqID_127175
atgattgatgtagggtctgggttctacatagtgaagtttgatctgtcacatgatcctgaaaagtatattgctagctctagtgacggtggtgggtactccgatgaaagtggatatgaggatggtggatgcaacacaagggaggtttgtgacctaaacatgcctagtaagagtgcaccaagaaaccctagcacaaaatctagtaatcaaggaaaaggcgcgattcatgtggagacaaatcaatatggtgattga

SEQ ID NO: 10398 - DNA, 144 bp, Glycine max
  Peptide Sequence Number=SeqID_127176
atgtggacacggaatcaactagatgtatggggtttggcaatcatacttagtaaaggaagtaacctcaaacttgctatttctggaaaggtaggcatttggcaccgcaaaaaacagtgcataaaatattgccaagctacggagtaa

SEQ ID NO: 10399 - DNA, 645 bp, Glycine max
  Peptide Sequence Number=SeqID_127177
atggaagaccccctcccccttaatgatcgtcttatgattatgctaatcgatggagcgtttcatgcatctaaggttgcggcaaaggctgtcactctgtccattaggcaacaatttggtcggccttggcctacttggggagtgattccaaaagatcatcatgatctttttttccagcgttttaaggaagaattcgaggctagattgtctcaagctaggttttatgttgtaccaagtgttggtgaatcacaactcacttctttagacccttttgaagaacaaagacttaagagtcagtattgggttgctgccacgggaccaaagtgtaaggggcacctttatggtactagagacattgcccatacttacaaatacggaaatgacaacttcatgcagaatgtgcaaggatcttctagtcgcgctgaagatgctgcagagattaaccgactgagaagccgcgtcaatcaaaggaggagatgcatgtttttcaatccattgtccttcagttcctaccttctaaagcgtggaacattattcatcaacaataacaacctcaccagcaacatcatgaacaataggaccatcaaccccagcaccagcatgaccaacagcaggaccaggcaaatgatcaacagcaggatcaggtag

SEQ ID NO: 10400 - DNA, 135 bp, Glycine max
  Peptide Sequence Number=SeqID_127178
atgagcaactctgacggctattcagcgctctctttacagcttcctttcattctccgtaagttaggcttaaaaaaagggcttcctgacctcgacgtcgcacttagcaccattctcgcgcttagtgcgagtatgtga

SEQ ID NO: 10401 - DNA, 1081 bp, Glycine max
  Peptide Sequence Number=SeqID_127179
ctatggcatactaactccaacttgctgccttggtgaaatatgccagccaaaagaaaacgctgcattatttgtatttggagattcaatatttgatgttggaaacaacaattacatcaatactactgctgacaatcatgcaaatttctttccatatggtgaaaccttcttcaagtatccaaccggtagattttctgatggtcgcgtgattccagatttcgtagctgagtatgctaagttgcctctaatccccccatttctatttcctggtaatcaacgatacatagacggaatcaattttgcatcagccggagctggggctttggttgaaacccatcaaggactggtgatagatctaaaaactcaactaagttatttcaagaaagtcagcaaggtattgaggcaggaactaggagtagcagaaaccacaactctattggccaaagctgtctacttgattaacatcggaagcaatgattatgaagtctatctgacagaaaaatcgagtgtctttactcctgagaaatatgtagacatggtggttggtagtcttacagccgtgataaaggagatacacaaggcgggtgggaggaaatttggggttcttaacatgccagctatgggttgtgttccatttgtcaagatactagtaaatgcacctaaaggttcctgcgtggaagaagcgtcagcactagccaaactgcataacagcgtgctttctgtggaacttgggaagttaaagaaacaactaaaaggatttaaatattcatacgtcgatttttttaatctgtcatttgatcttataaacaacccttcaaaatatgggtttaaagaaggcggtgtggcatgctgtggcagcgggccttacaggggaaatttcagttgtggaggtaaaggagcagagaaagattacgacttatgtgagaatcccagtgagtatgtcttctttgactcggcggcgtggcatgcttacaagggatattgcggaggtaaaagagcaatgaatgaaagattacgacttatgaaacgtgatggcaaagaagctggcttcgagggccagaacctccagacacaagaagggtaa

SEQ ID NO: 10402 - DNA, 1584 bp, Glycine max
  Peptide Sequence Number=SeqID_127180
atggcatccctggtaccaggagttctactgaagcttcttcaaagtatgaactctaatgtgaaagttcgcggggaatatcgctcagtccttttgcaggtgatcagcatcgtgccatcattatcggggtctgaattatggcctaaccaaggtttcttcataaaagtctctgactcttctcattcaacctatgtctcactctcaaaggacgacaacgagttcattttgaataataagctgcagctcgggcaattcttttatgtggatagaattgaggctggtacacctgttccaactcttgtcggagttagaccagtccccggacggcacccttttgaaggcaatcctaaggatttaatgcagattctagagcaatcagataatgatggagttaatggttcaaagtccatggatttaacagaagccaaagagaatccaagttcaaggcagaagatcgttattaaagaggaaaaagtaggtgttgcatccaggtacatgcaaggtgttctaaatccaaactcaagagtgaacggggcagatactaatataggaagcaaaggaaatgattcagaaaatggggtagatagtaaaaaggtggaatcttcgaaaggaaagcaactagagatcaaaggccaggtgctcccaattactccaactggtactcgacttgaagcactttcaccaaagcaagacatccctcagtgtaacatccgggagactgtcatagcaccttctaagcgcacttctgccaaacacagttctactaaacaggaaaatttgaacatgaatttgttgtctcgtggtaaagataaaagcaataacactgaggcaattccatggtccgctttgccggtcaagcttctgaagcctggaaaggttattcttagaaggaaacatctagcctctcaggttgtagtagaagcccaaaaagaagcatctgcagcagcatcgatagttaaatgcctaagtatgtttgccaatatctgctcatctgcatcatcagagaaccctcatgctacactgaacaaattttttgccctccagcaactcatggaccagccaaatggtacaactcagttgaaagataaaccaattcaactatataagattcctactccggcagaaaaacataaatcaggcaagacggcaggtgtgatgcctgttaaaagcacgtcaaagtctccaaaacccttaaatgaactatcaagaactgagaagcaagaatgggccaaagaggatggcacgaaaaagatcaatgagctgaaagaggtccttttaaatgaaacaagatcatggtttttgatgtacttggaaaagatattagatgctgggttttccgttggctcccaagagatgggcaaggaaagtaaggataatgcaggaagacagatggagcaagccaaccatatagctctcacattatcacaccttaagcatgcaaatgaatggctggacaaattgagaagcagttctaacacggaaagtgaagagctggtggagactgttgacaggttgaagcaaaaagtttattcttgtctgcttgtacatattgattccgctgcattagctttggagaaccgagcttga

SEQ ID NO: 10403 - DNA, 918 bp, Glycine max
  Peptide Sequence Number=SeqID_127181
atgccaatattcaatctgaaaaagactggaggaggaagtcaactaatgaaaacacaatcaacctgcttaaactttaggaatcaaagaagaaggatattgaacaaccttagttgcgtacagaataatctcctggatagattacaaaacacatgtcctatttctgatgagcagagaccaacaaatcaaatttacatgaaagctattcaacctgcaacaaatgatttagtcaatgttggagttcatatgttagaagatgatgaaactaatgaaattggtattgctgatacagatgggaagatccagctaccactgttgagaaggccacctgttgttcttcacagacttctgtatgataaagattcaatagatagtcttttcgaatggctaaggaaagatttaaattttacaaacacaaggaacatgagactacaacttatatttgagagaaaaacaaatggaaggatatataacttatccacaatttctgtggttgcaacattggttccaagggatgttgacattgtagcgaacaaagatatcattagaaactcaaagtggttagcaaataaatcatcaccgtgtatgaaggatggtcaacatagtcgattctttcccaaaaatttccagccaattactattgttcaccacgaaggatatgcagtttacggaagaagaggcaatgttgagaggatatactttcatctaccaaatgagcaatctatactatttgaagatgatgatgacctagactttgtactctctaagccaactatcaaagagtccatgttcacagcaaggtctgaagcaaatgaaatgttccatgatggtaaagatattacctgtgttggatttgttacaaattttgtttacattgtgataagtgctagatttcaattatttttgggattaaattgttag

SEQ ID NO: 10404 - DNA, 1014 bp, Glycine max
  Peptide Sequence Number=SeqID_127182
atgtggtggagatcagcatctttcatcatggacaggcagcggaacgaggaggctgatctgaagggggactcctcaaaccctaaccctaaccctaatatctctgcctactatgagacgagagcggcgcaccacggcgtggtcaccagcgactggctggcccaggctcaggccgctattgggcccgaccccgtccccgaccccaaccctgaacctgaacctcaactcaggcccgatcctgacaagcccttcagtgtcatcgatgagtttaacagctggcggaaacagccccatttggccgaggccgtcgccgccattcgggccctggccgccgtcataaggtccagcaaggctaccaccatgatgcagctcgagattgagctcaagaaggcctccgattttctcaagtcttgggataccacctctatctctctgacagccggctgtgatctctttatgcgatatgtcactcggacttctgctttagaatacgaagacttcaattccgctaagtctcgcttgatcgagcgcgctgagaatctgtatctttggcatcttcattgtgatctgcacttcaacccttgtgtgcacaaattggcagagggaagaccagaccgaacaggtttgcggttgtcgaatgagctggccaaacttgatgtttcagtgaaacttctaatagattctgctgttgcatatactatggatgaggtggacatggtttttgtgggtgcggatggagttgtcgaaagtgggggcataatcaacatgatggggacctatcaaatagcattggttgctcacagtatgaataaaccagtttatgtcgctgctgagagctacaagtttgctcgcctttaccctcttgaccaaaaggatttagcccctgcattacgccctattgattttggcgtacctattccatcgaaggttgaggttgaaaggtccgcgcgggactacacccctcctcaatacctgactctgcttttcacagatttaggtgttcttactccatctgtc

SEQ ID NO: 10405 - DNA, 459 bp, Glycine max
  Peptide Sequence Number=SeqID_127183
atggtgaatggaccaaccaacttaatgataagagagaagcactatcaagcatcaaacaaaactgtgacttggagatcaccggcaattaaactatgtcccactgaaaaaggcatcggtactgaggatcacagcatccatcaagaacaaggtcaatatcttcatctttttctgtcatttaattttatccttaatgttgtgaaagagatgcttttggtttatgaagatcactctcagggcataatctgctaccaagatgagtttggagaaataatttgtgaagggtatgatgaagggtcttgtttccaaagaattccagagccaaccaatcgtccaagagatgctcaaatcacgacgaatcttcttctacgacaaagttggcttcagatagttaaaggagagaactcgaatgatggtctgcaaaaggacttgaactgtaatggctttaactcattctgctaa

SEQ ID NO: 10406 - DNA, 1068 bp, Glycine max
  Peptide Sequence Number=SeqID_127184
atggatagatctggttctcatgtcgctgagacctccatcaagtctttagctgttcatctccaggacgacgatgacgtcgttcgccctctcgttgaggaggcgttaaccatgatatgcaaggtggtgattgcagcaaattctgttgatgtcatgtgcaactgctatggttctcacgtgcttcggactcttctttgcctttgtagaggagtaccattagataagtccggatactatttatcaaaatcaactacagtattagcagaccggttgaattcgaaggagttttcttcaaaaaaatatgatgcaacaaattttcagcctggatttccaaatttactgaaatcacttgtgtcagatatgttaaagcatgctaagaaatgtatcaagatactacaagttgaccaattcagcagtttggttttccagacagtgctgagggtcttggcaggcgatgatgaagagttgttacatgtgattcctatccttcttggctgcaaggataagaataatgcagaggacaattttataggcactagagtagtagcggagctcaagaatttgttaaaagaatctaaatttagccatctaatggaggttgttttggaagtatctcctgaggccttattcaatgaattattcactaaagtattcaggaattccttgtttgagttatcatctcatcaacatggaaactttgttgttcaagcattaatttcttatgcaagcaatcaagatctgatattttcccagatggagttgatttgggaagaacttgggccaaatttggagggtcttttcaaaatgggaaggtcaggagttgttgcttcacttgttgctgccagtgaaaggcttcatattaatgaacacaagtgctgtcaagtccttgctgaagcagtgtgtccagtggatgagtctccaaaatggattgttccaagactattgtttcttgatagctgtttcacaagtgaagataagtccaattggagctggcaaagtggttctaaaatgcatgtcatgggttctctgatcctacagacagtattccgttttagaagtgtccaaatatga

SEQ ID NO: 10407 - DNA, 121 bp, Glycine max
  Peptide Sequence Number=SeqID_127185
atggaaggtggacaccggcagaagaatatgccagggaatatgcatgatcacgaaaacacgaagcaggccataccgccatacgagctttttcttgttcttggtcaacatggatcccacacac

SEQ ID NO: 10408 - DNA, 813 bp, Glycine max
  Peptide Sequence Number=SeqID_127186
atgccatatggaaaaggtgttataattggttatgtcttgatgtggtattacctcaaaatgtggcaacatccaaggaatgaaagcatttttcaaaacaaggaatttgaggaggaatcggtcatacaagaagtggagtttctagcttggtcttggatgaaaaacaagatcaaaggctttgaggtgcatggagcttggctaactgtggaagacgtgcacggaggagggtataggaagtgtgagagtggattgacgattcatgaaagcgaacaatgtaacgagtggattgcaagcgaatcactctcagcatcactcgcagccatctcagcagtcgctttctcagggaatttcgtctcagcacggattgctgtcacatttctcccaaaactctctcgacgaggccgtcacgacgaacgatcaggtcagttaagtgaaggacttgaacaccgaattggcataatggaaacttcattgggcagattcacaatgatcttggattctgttcaaagtgatgtaatgcaagtaaacaaaggaacaaaggaaattactttggaggtggaatgcataaggcagaagttgattgctcaggataactcacttcagttaatgactaaaggacaagaagaaattaaagcaatcattgaagggagcctgaaatctttagctgaacaaatgagccatgtttcaaagaaagagaagttacgggaagtatatttggcggtttctgcgttgcctcagctaattgaagcctctctgcaaaacgtacaaaatgatctccgtaacatcaccaaggaaatgcaggcacgtaccatatga

SEQ ID NO: 10409 - DNA, 273 bp, Glycine max
  Peptide Sequence Number=SeqID_127187
atgatcttatgccgtcatcgaaaaggagaagcgtcgcgaatgtggccgcatattactcatggagaaggagaagtgccactgtggtgtttggacatggtggtgcaggggtggttttgcggtggccgcatggctggagtcaggagcggcgttggggtctttgggtttagatttggccggggtggtggtggtggtgcgcggcatggaggagacgaggtaagatggccgcaaggtgcggaggtggtcggcggttatgatggctgcgcatggaggtga

SEQ ID NO: 10410 - DNA, 296 bp, Glycine max
  Peptide Sequence Number=SeqID_127188
atgacgacgtttgtctctgcgtgtcaacgggcccacttgcctctggttgagaaaggtgtggataaccataagggtcgcttgcccctggtgcggataaccataaggtacccccgcatgtcatcggactcaccgtctctgaatgacaaaggtgcggataaccataaggtgcagaagacgatgtacgctctgcgtgttaacgggctcgcttgcctctggttgacaaaagggcgtctccgcgtgccaatggactcacaggtcacgatcgacaaaaacaatgtgtctattggggaaggaga

SEQ ID NO: 10411 - DNA, 745 bp, Glycine max
  Peptide Sequence Number=SeqID_127189
tacacgccctcaccttcagaggactacacgtcctcgccctcagagggctacacatccttgccttcagagggctacacaccctcaccttcagaggactacacgtgctcgccttcagaggactacacggcctcaccttcagagggctacacgccctctccttaaaaaggactacacgtcctcgcctttagagggctacacaccctcgcctttagagaggactacatgtcctgaccttcagaaggcaacacgccctcaccttaaaaggactacacgacctcacctcaaagggctacacaccatcaccttcagaggaatacacgtcctcgcctttagacgactacacgtcctcgctttcataggactacatgtcctccccttcagtggagtacacgtccgcaccttcaaaggactacacgtccgtaccttcagaggactacacgtcctcaccttaagagtgctacacgcccttacctttagaggactacacgtccccgccttcagagggctacacgtcctctccttcagaggactacacgtcctcacctttagaaggcgacacgacctcgccttcacagggctagatgccctcaccttcggagtactacacatcctcgccttccgaggactccacgccctcgctttcttggggctacacgccctccccttcagaggactacacgccctcaccttcagaggactacacgtccccgccttcagagggctacacgtcctcaccttcagatga

SEQ ID NO: 10412 - DNA, 438 bp, Glycine max
  Peptide Sequence Number=SeqID_127190
atgggggtaccttatggttatccgtacttttgtcatccagagacaacgagttggatgacatgcgggggtaccttatggttatccgcacctttgtcatccagagatggcgagcccgatgacatgcagggtgagcccgatgacacgcagagactaacgtcgtcttctgcacctttgtcatccagagacggcgagtccgatgacatgcggggagacggcgagtccaatgacatgcgagggtaccttatggttatccgcaccttttgtcatccagagacggcgagtccgatgacatgcgggggggcaagcgagccctttgacacgctgacactaacatcgtcttctgcacctttgtcattcagagacggcgagtctgatgacatacgggggtaccttatggttatccacaccttttgtcatcagagacggcgagtccgatga

SEQ ID NO: 10413 - DNA, 475 bp, Glycine max
  Peptide Sequence Number=SeqID_127191
gcttgcgaaggagcatggtgacataaaattggcacagatctgcggcatgattgcctcagatgagaagcgccacgagactgcatacacaaagatagtggaaaagctgtttgaggttgatcctgatggtacagttatggcatttgccgacatgatgaggaagaagattgctatgccagcacaccttatgtatgacggccgcgacgacaacctgtttgataactactctgccgtcgcgcagcgcattggggtctacactgcaaaggactatgctgacatactcgaatttctggtggggaggtggaaggtggagcagctaaccggactttcagaatcagaaggttggaggagagagctcaagcaagaggcaaggagtcgtcaacacttaaattcagttggattcatgacagggaagtactactctaaatgcttgcaccaagggaggagcatggtgaatcttccagcaataccattctga

SEQ ID NO: 10414 - DNA, 783 bp, Glycine max
  Peptide Sequence Number=SeqID_127192
atgcttcaagaagtgattcatcatgtgagaaattctagtaagaaggatggggacatagtgcttaagctagatttggaaaaggcctacaataggattgattggggctgtttgaagcaagcgttaaggttgtatggtttatcgaagaaactgggggcgatgattcaaaaggaggttcaaggggcaaggcctagtcaagctaggggtattgccaaggttttggaggaattttgggtgatgttggtgcttaaagttagtgtggttaaatccaaaacttttgtttcaagaatagtcacgttctgtttgagaaggcgagtcacccatgataattttggtgagctggttgatagagttcattccaaattacatgcttggaagagtaggctgctgaataacccaggaagagtaaccttggttattgcagttattgccttgttaccaacatatggaatgcagattcaatggggtttcatttggtgttgccataatgataaggggttacttatggtcaagtgggagattgttataagaccaaggaagttaggtggtctaggggtgagagtggcgcatgagcagaatatagcgtggttggggaagctagtgtgggagctcttgaacccatcgaatcaattatggacatcggtgttgaagggcaagttagtggtgtggaattctattatgaaagctttggaattccttaaggaaggatttcaaatgaagattggtgagggaaatttggatttctggaatgattcatgggttacaaagaagttattggcagtgtag

SEQ ID NO: 10415 - DNA, 1059 bp, Glycine max
  Peptide Sequence Number=SeqID_127193
atggaggtgagggattatgacttgctcgtccaagctcaagccctaaggcctcaaggggatgttattgctttaaatgtagataggagcgttctgggtaatccgcaagtggcaaggtttggcggtctatgtcgaaatcataatggtgctttcttgttagggttctatggagcagtggagatatcggaggtgctttatgctgaaattttagcgctccttaaaggtctcgagttgtgctgggaggctaggtacaagaagttggtttgttactctgactctctgacaatggttaatcttgtcaacaatggagttcggtcttaccatttctacaacaacatgattatgaagtttcatcagttgttgggaagggattggccttgctcgttgaatcaaaccttgagaaagggtaatcagtgcgcgaatgtgctggttaagatgggtgttgcatcttcatgcctgttggaagttatttatgctcctcctcttatgttattggagcccttgcgagctgatgcaacagaagttgtttttcttagatttgaaggagggaggaagagcttctggttcaaattcctccaccaggtaggcaaggatcacatggatgagaagtccataacaacccaagagtttgaatatggtgaaactgttgttccctcacagccagcaaacgcttttggaaacccaggacaagcaggatttggcggaatcataagggatagtcttgggaactggcacacagagttactcgccatctatcatgatttgaagatagctagagacaaaggaattggaagattgatctgcgaatcagattcgaagcttgctttggacttgatcactggagaaatcaacttgtttcatcaatatttccctaccatcttgttgatccattcgttgaagcagatggattgggaggtgacctttgtgcacgtgtactgtgaagggaacaagtgtgcagattggcttgcaaagacgggaaactcttctcgagaggactttattattcttgatcattgtccctctttcatatatcaagctttacttcttcgaaattttcaataa

SEQ ID NO: 10416 - DNA, 207 bp, Glycine max
  Peptide Sequence Number=SeqID_127194
atggagttgagaatcgaattgaaaagaggtaaatgcgtgatttttagtttatggaaaaataaaaaagagggttcagtctcagagccattgatgagtgagtcagatgaagcaatggaagcattagaaatttttaggagaagagagagtaatgtagaaggagagaggaggagcaagtgtaagggagagaagaagggaccggccacttaa

SEQ ID NO: 10417 - DNA, 644 bp, Glycine max
  Peptide Sequence Number=SeqID_127195
gatttacatgcgattcttctcaagtttcagccagcccgcatcaattagaccttgcaccttacgcttcaggcccctacaatgctcaatggaatgctacggggcctctccatgacaagcacacgttgcgttcgagtcgtattcttggagaaatggaggttgatgaacctcggctagggttatggctaccattgaattatcaagtagatatgggagcaagtcagcataggacactggaattgggggatggcctttgtggacaactgggcggtgggagtcacagcacaggcttctccttcatccttaccctcttcatttgccctagttttctcatttgtccaagcaggatgactaaatttgcctcttttcagacccacatcgatcctttcactggcaaagaccaaatccgcaaagctctgaaggttggtgtaccaggtaacagctaccccagtaagactttcttggaaggaatcaccttgaacttgagaggggtgatgatattgggtactaggaacaactcttctaggggtataccaccaactgcttgcccttcagtggcatatccgaggcaaggctcgaagctctcaatgggtataggagtggagttattgacattcttattgggagtgtacgccacattgggtggc

SEQ ID NO: 10418 - DNA, 666 bp, Glycine max
  Peptide Sequence Number=SeqID_127196
gaagatgaagaagtccgagctctaaaattggagctagggaaggcaagactcgctaaggagaagttcaaatcagctgctacacacatccggaaagagtgcaccgagttacaagaggaaaacgcggccactgcaagagcccttgaacaagaaaccaaaagggcccgcaagaaggaatatggccgagagaaattccgaggagcattgtggggtagcaacaatgagctcaagctccgaagagaggaaatagatcggtcacgggtgcatggcatgatcttaaaagaagagttagttgcttgcgcgaggtccaaaaggagtttggctcaacacttggaagccatggagcaaagcatgctagctatcatatggcaatacaaggaagagttgaaccagactgtggcccatgaacaaaagctagtggaggatcttgcacagttgtacgctgaaaaagaagcaagagggagagtgattgatgctttgcatcaagaagcgactatgtggatggataggttcgccttgaccttgaatggaagtcaagacctcccgcgtctattagccaaagcaaaagccatggccaaagtgtgtacggcccctgaggagatgcatgggctaatcaattactgtcaacacatgatagatttgatggctcacataattagaaaccgttag

SEQ ID NO: 10419 - DNA, 549 bp, Glycine max
  Peptide Sequence Number=SeqID_127197
atggcttccatctcggaggtcatgttaaaactccagaaaactatagaggataaagccacgacaacatcctcgggtacagttagggaagcggagccggtgctgcagcccgccttaaatccgggccgagacagaaacaaggccgtgtttggtcgaaggtatagtccgcaagcttatccttatggcttgcctccggacttcaccccccgtgccaccccggaagatttaagccaagcctttactttcgaggggcaactcccaccttatgacgactatcccgggcaagacgatgaggaaggagatacccatcttggccccctgctccacctcaaagatccgtccccccatgaactaccccaaccgaacatagtccgccatatcccggcttcacccacacctataaaagaatctgttcccttcgcggaagataaggggaagatggaggtgcttgaagagaggttaagagcagtcgagggccttgacaattacccattctcggatttggcggatttatgtctcgtgcccaacatcgtcatccctcccaagttcaaa

SEQ ID NO: 10420 - DNA, 1620 bp, Glycine max
  Peptide Sequence Number=SeqID_127198
atgggagagataacaaatgcgcaactatccttccgatattctctgactctgaggagcccaatcccaatgccatatcatgctaaaggaggaccttcttggatttcattccacacccttaaaattagaaacttgaatgtcattaaggctgttgcagccactttggatgcaaaaccgcacttggatgttcctcaccctcccggttttctgctcgaattctccgagcctcctgatgatagggagaagttgagaagaatgcggatttccaaagctaataaaggaaacatcccttggaacaaaggaagaaagcacactcccgagactttgcagaaaatcaaagaaagaacaaggctcgcaatgcagaatcctaaggtcaaaatgaagctcgttaatcttgggcatgcacaaacttcagaaacaagaaagaagattggcgctggagtgagaagacgatgggaaaagaggcgtggaaagaagatggtgcaggaatcttgctgctttgagtggcagaatttaattgcagaagcttctaggcaaggctatgttggtcaggaagagctgcagtggaattcttatgagacattggatgaacagctgaagcaggactggttgatgagtgttgaacaaaggaaacaagtggcaaggacaccatctagcaaaagagcacccaagtcccctgaacagagaaggaaaattgcagaagccattgctgccaaatgggctgatcctgaataccgcgaaagagtttgttctgcattggccaagtatcatggcagtgaagttggagctgaaaggaaacctagaagaaggccaagtgatggtacccaacctaccaagaagaaacctgcaaaaaaaagagatactgatactagcactcattttaagagtgactccaaaacctgtaagcctatcctgttgaaaaaaagcaaatccccagcctataaggatcctttggtgaattctaaacttgaaatgataaagaatatcagagcacagagagcttccgcggaaaccacacagactcatgccattgaacgagcaagagtattgattgctgaagctgagaaagctgccaaggcacttgaggttgctgcgacaaagagtcctattgcacaattttctttgatagaaaccagaaagctaatagctgaagctattcaatcacttgaatccattgatacacaagctataactgacagtaatgttcctttggttggtttgaacgatgtcaatgaggaaaaaggatcagcttttgaagttctaaaccaattacaaatggcccaagtaaatggacacacaacgttatcatcaagtgactacaagttcactgaagattttggcaaattttccttggagaagccagtaaatggtaatcctgaatttctgctaagcaatggttgcacatctttaccttttagtttgaatagtcagataaatgaatctaatccatcaaatcagcaaagggaagcagagcaggatcagagaagtgaatacgaaacagatccttctccaacagtgatggaaattcactcccttgaaaatgagacaatgtctagttcacctgtatcaactaaaaagtgggttcgcggaaggctcgttgaagtggctgaagagaaacaataa

SEQ ID NO: 10421 - DNA, 840 bp, Glycine max
  Peptide Sequence Number=SeqID_127199
atgggtgactcttccgcggctaatgaccatttgggtgaatccccggccgttgagttaaccggaaagataatgattgtggttattattatcatgttcttcgttattgtaattgctctctgccttcatctcttcgccagaaacttctggtggcgcagccctgctccccaatctcgcagccaccgccgccgccgctttgttttctcgtccggtccagacggtggaagcggactggatcccgcggtgctgagctccctaccggtgttggtattcgaaggccatgcccaagagtttaaggatggtttggaatgtgcggtttgcctctccgaggttgtcgaaggagaaaaggccaggcttttgcctaaatgcaatcatgggtttcacgttgcttgtattgacatgtggttccaatcccattctacttgccctctttgcaggaaccctgttgcatcctcagaagaatcttcagaatctcccacttttcccacaaacgtcttggtttgggggaatcaagctcaaataagttctactggtggtggtggtgcttctttggaggaaggttcatcctcatcctcttccgcttctacttgtgatgatcatggaatgttggtgattgatataccaagtgagatgacttcaacctctctgtcgcctgaagatgacgtcaaatcgcctatgacgggaagactcaggtcattgaagaggcttttgagcagggacaaaaggtttaatccttccagtcctacttcttctccagatattgtatctaatgtttgcaagtacaccatgagggtgtttaatttttctgttcttcagaggtcagagctcctccagctctcatag

SEQ ID NO: 10422 - DNA, 291 bp, Glycine max
  Peptide Sequence Number=SeqID_127200
atgtatatcaacaaggcccagcttgcgcatattttgcttgaaagaagtaggatacaaggccttagtaaacatatcagcaagttgacatccagaaggaacatgagacaagagaatgaggccttcatgaatcttgattcaagccaaatgacaatccacttcaatgtgctttgttctcttatgaaaagagggattctttgcaagctgaattgcaaattcattatcagaaaaagtgcaaaaaggaacaagaatagagagatgaagatcatcacaaagatactttatccattgtaa

SEQ ID NO: 10423 - DNA, 708 bp, Glycine max
  Peptide Sequence Number=SeqID_127201
atgaccagactttatccacaatttttttttgctaggtacctacatgaagttagttcgccatcagttgttcataagaatattaagtcagccaacatattactggatacagagcttaatcctcatctttcagatagtggattggcaagttatattccaaatgcggaccaggctacacagatcgttgtcaatttgaatttcccgtttgtcatggatgcttccaaatatgaagtgttctttgtacaactttctcagtctaacaagatattgaaccataatgttggatctggatatgatgcacctgaagttgccttgtctggtcagtatactttgaaaagtgatgtctacagctttggagttgtcatgttggaacttctcagcggacggaaaccatttgatagctcaaggccaagatctgagcagtctttggttcgatgggcaacacctcaactccatgatattgatgcattggctaaaatggttgatcctgcaatgaaagggctatatcctgttaagtctctttctcgatttgccgatgttattgctctttgcgttcagccggagccagaattccgaccaccaatgtcagaagtggttcaagcactggtgcgattagtgcagcgagctaacatgagcaagcgaacatttagtagtagtgatcatggaggatcccaacgagggagtgatgagccagttctacgagacatctaa

SEQ ID NO: 10424 - DNA, 514 bp, Glycine max
  Peptide Sequence Number=SeqID_127202
gcctgacactctggatccagcactactacgacctggacgattggaccgtaaagttgaatttggccttcctgatttagagagtaggactcagatattcaagatacacacaagaaccatgaactgtgaaagggatatccgctttgaacttttagctcggctttgcccaaattctaccggagccgatataaggagcgtttgcactgaagctggtatgtatgctattcgagccagaaggaagaccgtgacagagaaagacttccttgacgcagttaataaagtcatcaaaggataccagaagttcagtgcaactcccaagtatatgcgtgaatttgatgttgatgccttcgagaatggcagcacaaaggctgttggggtgcctgtgggtggtttggttgctggaagggggatggttaacggtggtgggttactatttcgtgtgagatgcgactgggcagagagcgagaagccgaaaccatctgaatacgagatgaaacgaacttgtgagatcatatga

SEQ ID NO: 10425 - DNA, 819 bp, Glycine max
  Peptide Sequence Number=SeqID_127203
atgaactcaccaccccagctaggttggcctcctaatggtgatgatccatgtggacaatcttggaaaggcatcacttgctcaggcaaccgtgttacagagattaagctatctcatcttggactaactggatcggttccttacggattacaagtcttgacatctttgaatgacctagacatgagtagcaaccgtcttggtggaagcataccttaccaacttcctccatatttgcagcgcttaaatcttgcttataataacatcacagggacagtcccttactctatttctaacttgaccgctcttacagacctgaatcttggtcacaatcagctccagcaaggactgggtgtcgactttcataatctttctactctctccacattggatctctccttcaattctctaacaggtgacctccctcagactatgagctcactttcacgcataaccaccatgtatctgcaaaataaccagtttacaggcactattgatgtccttgctaatctgcctctggataatctgaatgtggaaaacaataattttactggatggataccggaacagttgaagaacataaacctacagaccggtggtaatgcatggagctcaggtcctgcacccccacctcctccagggacgcctccagcacctaaaagcaaccagcaccacaagtctggtggtggaagtaccaccccctcagatactggcagtggcagcagctcaattgaagagggcaaaaaatctggtatcggaggtggtgccatagctggaattgtgatctcggtcatagttttgggggcaatagtagcattctttctg

SEQ ID NO: 10426 - DNA, 1239 bp, Glycine max
  Peptide Sequence Number=SeqID_127204
atggcctttgcaagtgtcatagccattgttgcatttcttcttctacaacctctttcaactacttctgacttcctttctcctttgctttctcccatctttgatgatgtctgcaaagaagtggaatgtggaaaaggaacatgtaaaccttccaagaacagcactttcttgtttgaatgcgagtgtcatcagggttggaaacagagtctttccaatgatgatgatgagtcaagcttgaagtttcttccttgcatcgttcccaattgtacattggactactcttgctccaaagcccctgcccctgttcaagaaaaggcaacaaagtccaatgagtcaattttttatgcttgccactgggttgattgtggaggtggctcatgcaacaagacatccatgttctcctataattgtgaatgtgatgctggctattacaatcttctaaatgtcactgccttcccttgcttcagagaatgttctcttggcatgggttgctctgaacttggaatatcaatgacaaactcatctacttccacaccaccagctttgaatgacaacattaagaatgagggtggcattggtggtgatacaaatggtggtaacaatgacgatatggtggtgatagtagtgttggtggtgacagtcaatggtggcaacattggtggtggtggtggtgacggaggtgatattagtggtggtagcaacgacatttgtggtggtggtgatgaaggtagtggtaacaatgtcaatagtggtagtggtggcagtgttggaggtggtattgttggtagtgatggtagtgacaatgatggtagtagtagtgataacaatgtcggtggtaatggtgatgtcaatgacaacaatggtggcaatgacaatagtattatggtgataccaagtggtggcggtgtggtggttgtggtaggcggtgatggaggtgatattgttagtagtgatgatgacaatgacagtgacagtgacattgatagtggtggtggtggtagcaatattggtggcgacaatgatgataatgacgatggtgttgcaacggtggaagtggtggcggtggtaacaatccgttctgatgatgacaacaatggtgatgctggtggtggcaatgacagacatggtattatagtgatggcgttggcagtggcaatggtggcgacaatggtggtgatgatgatagtggtgatggcaacaaaaaatattattgtcaaatgtgagaaatgtgtatttttttaa

SEQ ID NO: 10427 - DNA, 552 bp, Glycine max
  Peptide Sequence Number=SeqID_127205
atgatctcctccgtacagtccgggaagtatggattagaagaaggctggaaagatttgttctcattccttgttgagactatggagacagctgtaaaatcatggcatgaaacttcttcagtggatgctagagtttactttcttcttgataaggaaaagacagacaccgataagtatgccccagttgtgaatattgataaggcctttgaatcaccacatacacatggcaactgctttgcatttcttaggcagtatgctgaggagtctttctccaaagcagcctgcttggtgactccgaagaacatcattgcttatccacaggtctggaagggccaaggaccaagaaagtggaaacatgcacaaagtgatggtttctttgttcaatttgagtctccttccctgcgaaagctgtggtttataccaagttcgaatgaaaaggggcagacattatgcagggatccagaggttttggacattggtgctcatgaagttcttccccggcaagagttgcagaagaaattcaagaagcttaggaccgatggttggttgagttga

SEQ ID NO: 10428 - DNA, 2232 bp, Glycine max
  Peptide Sequence Number=SeqID_127206
atggagatgtcctggttttgttttatgcagtcagcccttactggagaatctctacctgtcacaaagagaactggtaacgaggtcttttcaggttcaacatgtaaacatggagagattgaagctgtagtgatagcaacaggagttcactcattttttggtaaggcagcatacctggttgacagtaccgaagttgttgggcattttcagaaggtccttacctcaattggtaacttctgcatttgctctatagctatagggatgatttttgaaataattataatgttcccagtggagcatcgatcatacagggatggaataaacaaccttcttgttctcctaattggaggaatacccatcgccatgccaacagtattatctgtaacacttgcaattggctctcatcgtctttctcagcagggagctatcacaaaaagaatgacagcaattgaagaaatggcaggcatggatgtcctatgcagtgacaaaactggaactcttacactgaatcgcctaactgttgatcgaaaccttattgaggtgtttaacagaaatatggacaaggatacggttgttctacttgcagccagagcagctagactggaaaaccaggatgctattgacactgccgtagttaatatgctagctgatccaaaggaggcacgtgcaaacatcactgaagttcattttttaccattcaatcctgtagataagcgtacagctataacatatatcgattttgatggcaattttcatagggccagtaaaggagctccagaacagaacttcacactgttctttacactgtttgctgaataccagattctagatttgtgtcaagagaaagatcagattgccaagaaagtgcacactataatagacaaatttgctgaaaggggattgcgatctcttgcagttgcttatcaggaaattcctgaaaaatccaaggatagccctggaggtccttggactttttgtggtttgttgcctttgtttgatcctccaagacatgatagtgctgagaccatccgaagagcacttaaccttggagtctgtgttaagatgattacaggtgatcaattagcaattgcaaaggagacaggccgaagacttggcatgggaacaaacatgtacccttcttcatctttgttgggtcgcgaaaaagaagagcatgaagctctccctattgacgagctcgttgaaatggcagatggctttgctggtgtatatcctgaacacaagtatgaaatagtgaaaattttacaagaaaagcagcatgttgtcggaatgactggggatggagtaaatgatgccccagcattgaagaaagcagatatcggaatagctgtgtcagatgcaacggatgctgcaagaagtgctgctgatctgatatacgcagtctccatcaccataaggatagtgcttggttttgctctcctagcattgatttgggaatatgattttccacccttcatggtcctgatcattgcgatactaaatgatggtaccataatgaccatatctaaagacagagtgaagccatccccaacacctgacagttggaagctgcctgagatatttgcaacaggaatcgtgattggcacttatcttgctttggttactgtcctgttctactgggcaatagttgagaccactttctttgagagccacttccatgtaagttccatatccagtgacagcgagaaagtatcatctgcagtatatctgcaagtgagcatcattagccaggctctaatttttgttactcgtagccgaggttggtcatttctagagagaccaggggttctactgatgtgtgcatttgtaatagctcaactggtggcgaccataattgctgtgtatgcatatatcagctttgggaaaataagaggaattggatggagatgggctggagtgatatggctgtacagtataatcttctatgtgccgttggacataatcaagttcacagtgcggtatggcttgagtggagaagcctggaaactgatatttgaaagaaagacagcgtttacatataagaaagactacggaaaagaagaaagggcagcaaaggaggagaatggaagggggtcttctttgatagctgaaaaggccagaagacgtgctgaaatagccaggctgggagaaatacacagtctcagaggacatgttcaatctgttctcagactcaaaaactttgaccagaatctcatccaatccgctcatacagtctaa

SEQ ID NO: 10429 - DNA, 1272 bp, Glycine max
  Peptide Sequence Number=SeqID_127207
atggggaggacagggaaatggctcaggagcttgttgacagggaagagatcagacagagagaaagagaaggaaaaggaaaaatgtggcaccaacatgtgtttgttgaatggcatcacaagcacaacagaaacagaaaatccaaccacaccagtttcaacaacaacaaccaccaaggagaaaagaaggtggagtttcaggagatcaccagcttccagggaactgaatcttgcagaatctggtgccattgcttcttcagtcacagtgcaaaatgctgagaatgatcaaagggagcatgatcctgattccaatgggttgtcaacaagatgttctgaagaggctgcagctattaaaattcaatcggtgtttcggtcctacttggcaagaaaggcactgtatgctctcagaggactagtgaagttgcaggcattggtgaggggtcacttggtgagaaaacaggccagggagacactgagatgcattcaggctttggtcatagcacaagccagggctcgtgctcagagggcgcggatggtgttagaagatcaaaacctatcaccctacagaataaccactgaggaaaacttcttcatgcttatgcataatgaaatggacagtggtttggaagagaatgccaagattgtggagatggctgtttgtgaatccaaaggcaactcaagaggaagaaacagcgctgcgaatcgcgagccttctgatcatagattttctgcatattactcatcaaacggttcatactcaaaggaggaaaagtacaatgcatcatcacctgcaccatcaacactgacagaattgagtccaagagcatgcaatggtcattttgaggagtgttcattcagcacagcacaaagcagtccctattactactcagaagaagtgtcaagagtggataataaaattacaaaggctccatttgcattccctaaaccagcatacacagaacccatgtcctatgactaccctttgtttccaaactacatggcgaacacggaatcgtcgagggccaaagccagatcacagagtgcaccaaagtcaaggccagattcgaacgagaggcagccaagccgaagaagagcttcagtggaaggaagaaatgtcccaaggccagtgaggatgcaaaggtcatcttcacatgttggtttcactgcccaaaactaccaatatccatgctcaataaagcttgacaggtccatagtcagtgagtgtggctctacaagtacagtgatcacaaacacaaactctaattacttcacatga

SEQ ID NO: 10430 - DNA, 1182 bp, Glycine max
  Peptide Sequence Number=SeqID_127208
atggatgcaagaaggcttttaaatctgcatgcaggccttgttattggtgtagatggttgtcatcttaagaataagtatggaggtatctttttagcagctattgcaacagacccaaatgatcagtatttgccactggcctttgtgggactagttccaacttttgaggagatgcttggggataatgaacattgtttctgcttaaggcatttatacaatactttcaataagagatttggaggaggcattgtcatgggggatctaatgatgggtgcaacaagagctacctaccatgaagcatatttagagaaaatggctcaactaaaggagatcaatgaagctgcacataaatacttggttgacattggtgaacaacattggtccaagcatgctttcaagacctatgcaaagtgtgatgttctcatgaacaatctaagtgaatccttcaatgctattattctattggctagggaaaaaccaatagttactatgctggaatggattcaaacttactgtatgactagatttgctactatgaatgaaacaactcataaagttgaagggaaaataatgccaattgccaaagccaaggaagaggctcggcaaggaagatcaacacagcatgctatagctgcaatcaattacaaaggagagcatgcagaagaccatgttgacaaatattaccatagggatacttacaagctatgttacagtcatagtattacaacaatcgatggtaggaaaaaatgttctaagactaatgatcctgacttattgcctcctaattacaaacgtgcagctgatgccataagcttggacataacaagaggacttgcaaaaattcccccattcatccaaaaccagcaaagactcgtgttgaaggtgagggagcacccagtgaagaacaacaaagtcatgttcaagttggaccaaatggaacacaagtgcaaactgaagcgaacaccaaagtctttaatggtccctttacacaaaaaatcaaaccttgtttcaaagaaaactggtcctacatctgcatctacatctacagataatcctggtattgcaaagaaagtgagttgtgcaacaacaaaaacgaaaaaagagaccttgaagaaacctcacctgtctgaacaaagtgcacaatgtagcaacactgtttcaggagaagacatggacactccgtag

SEQ ID NO: 10431 - DNA, 528 bp, Glycine max
  Peptide Sequence Number=SeqID_127209
atggccaacaacttttataacaatgcacaatttgctggattttataacaacaccgacccaaaaggatgccggttgtgcaaccaagttttcaccgacactcaggcccttctaacccatgttgagtctcacatggcacaagaagaggattcacttagaaggctcaattcatcaccaccaaatgtcaattctcaaatgcaattgggttcacaacagttcccaccacaacctgctatgggtgatggcaggaatttccaagcacaatcacaacctatgaggatgcctcaaccaattagtaaaaacccaattttcaattctagccaaattggctcatcatcaactccaatcaggcaaatgcaagtttcgccacaagcttttcctttttctggaagtattaatggtgatggctctaagccatatatctcgaagttggagaaacccatcaagaagattgatttcattgacttggttaacatggatggcgatgacaacttagaggtggaagcaatggatttggatctaaagctttag

SEQ ID NO: 10432 - DNA, 531 bp, Glycine max
  Peptide Sequence Number=SeqID_127210
atggcagcagagacgaaagaagtttcaggttcggagatgtctctaaaggatcagggcaacgagtttttcaagtcaggaaagtatctcaaagctgctgcactctacactcaagccatcaagcaagacccttctaaccctactctctatagtaaccgtgctgcagcattactgcaattggataagcttaataaagctctagatgatgcagagatgacaatcaaattaaaaccccaatgggaaaagggatatttcaggaagggaagcatattggaggccatgaaacgatatgatgacgctttagctgcctttcagatagcattgcagtataacccgcaaagtcaagaagtaacaaaaaagataaagaagataaaccaactgatgaaagatagcaagcgagctcaagaagtggagaatatgagatccaatgttgacatggccaaacatttagatacattcaaaactgaaatgggagaaagagaagggaataagttgttcatggagagagacaaaaaggagggagaaatacagtag

SEQ ID NO: 10433 - DNA, 231 bp, Glycine max
  Peptide Sequence Number=SeqID_127211
atgacccagcctggctttggtacacatgcttattcatgtagcccccaccgtagagggaagatggaaataggcgtaaaaaggaaaggggtggtgatggaatggggaatggggaagtgggattataccctgattcattcctccggccggaagcccgtctcctttggagtttcccaggctaattttcctcagcctcgtctctccaacgttcatcatcctcatacgccaatttaa

SEQ ID NO: 10434 - DNA, 849 bp, Glycine max
  Peptide Sequence Number=SeqID_127212
atgggaatgagagattttcatatcaagcttaaggcattccgggtgaaacgttttttctttggaagaaggagaaatagatggagtgcaaacaagccttcatggatgattccaatatcacatggtcatcatgtggtggagcatcatgtaatcaaaggtggttctgatgactcgaacttcgattcagttgtgatacagagagagcaaatggatcacacagaactgtggtactttggaatctttgatactgtagttggagatgaagttaccaagtatatgcaatcccatttctttggcaagaagctcaaagagtgtcatatgaggagaaaaaccaaagaaacactgaagagagcttacctaggtgtaaaaacaaagatcagagaggcacacaagccagaggagctggagacatgcagaataggctcaacatcagtgatggtgatcaatggagaaaagcttgtgatagtcaacatgggagattacagaactgttttgtgcagaaatggtgtagcttatcagacaactggcagatacaatcaatcatcagccaagagacattggtatcgcagactcttttcagttcggatgatagcatgtgaatcaggcaatacaaaaggtacaaagcattctaaaggctcagaacttgtggtgggaggtgatagaatcgattcagatactgagtttttaatcttagcaagcaatggcatatgggaggtgatgaagaatcaagaggctgtgaatcttataaggcacatagaggatccacaagaagcagctgagtgcttggcaaaggaagccttgattaggatgagcaaaagcaacatttcatgcttaatcattcgctttgactga

SEQ ID NO: 10435 - DNA, 153 bp, Glycine max
  Peptide Sequence Number=SeqID_127213
atggtagtgaggacgcacagtggtgactgggcaaagggggttgtgcgcctgcggatctggagttgggagcgacgcacgatgttattaggatcgtggtggtgtggcaaacacacaacagggggtactttcaggcagcattgcggaaagccttag

SEQ ID NO: 10436 - DNA, 952 bp, Glycine max
  Peptide Sequence Number=SeqID_127214
gatcaatccaggtggagacactgacaaggttgaactggagtcaatttctgtcagctcttacagtggagttcatcctgaggttgacaaagaggctagcctagtggcaaacataataggatgtgggggttttggtttggtttataaagcaacgttaccaaatggaactacagtggccatcaagaaactttcaggagatttgggtcttatggaaagggaatttaaagcagaggtggaggctttgtccacagcacagcatgaaaatctggttgcattgcaaggctattgtgtgcatgagggtgttcggcttctcatatatacttacatggaaaatggaagtctggattactggttgcatgaaaaggctgatggtccatctcaacttgattggcctactcgactgaagattgcacaaggtgcaagttgtggattggcttacatgcatcagatatgtgaaccacatatagtgcatcgtgatataaagtcaagtaatatactccttgatgaaaagtttgaagcacatgttgcagattttgggctggccagattgattcttccttatcaaactcatgttacaactgaacttgtaggtacattaggttacatacccccagagtatggacaagcatgggtagcaactctgagaggagatgtctacagctttggggttgtcatgcttgagctgctcagtgggaggaggcccgtcgatgtaagcaagcctaaaatgtcaagggagttggttgcctgggttcaacaaatgaggagtgaaggaaaacaagatcaagtctttgatcctcttctgagagggaagggcttcgaagaagagatgcagcaggttcttgatgcagcatgcatgtgtgtcaaccagaatcctttcaagagaccaagcatcagagaagttgttgaatggctgaagaatgtggggtcatccaaaccgcaaatgaataaagactag

SEQ ID NO: 10437 - DNA, 2029 bp, Glycine max
  Peptide Sequence Number=SeqID_127215
atggtttccaagttaatggtctttgtcttaatactgttccttctgtctggattccttgttcttgttcaagcctcctcgtgtaaccaactggatagagactcgctcctctccttctccaggaatatatcctctccgtcccctctcaattggtctgcttcttctgttgattgctgttcttgggaaggcattgtgtgtgatgaggatctcagagtcatacatctattgctaccatccagggctctctctggcttcctctccccatccctcacaaacctcactgctctctcccgccttaatctctcccataatcgcttatctggtaatcttcccaaccattttttctcacttcttaatcacctgcagattcttgatttgagcttcaatcttttctctggcgaattgccaccctttgttgctaatatcagtggcaatactatccaggagctggatatgtctagtaatttattccacggaacactcccaccttctctccttcagcacctggcagatgccggtgctggagggagtttgacttcttttaatgttagtaacaatagcttcacaggtcatattcccacttctctctgcagtaaccacagtagctcgtcttctctcagattcttggattattcctccaatgatttcataggcacgattcagcctggactaggagcatgttccaatctggagagatttcgagcaggttccaattcactatctgggccccttcctggtgatatttttaatgctgttgctctcacagaaatctccttgcccctcaataaactcaatggaaccattggtgagggcattgttaaccttgccaacctcacagttttggagctctactccaataatttcaccgggcccattccctcggatattggtaagctctccaaattggaacgtttactccttcatgccaacaatataactggtactttgcccacatctctgatggactgtgccaatcttgtcatgttggatgtaaggcttaacttgttggagggagacctctcagcattaaatttctccggactcctcagactcacagcacttgaccttggcaacaatagtttcactggtattttaccaccaaccctttatgcttgtaagtcacttaaagcagtaaggctagcatctaatcattttgagggacagatctcacctgacatacttggacttcagtctctggctttcctttcaatttctaccaaccacctgagtaatgtcactggggctctgaagttactcatggaactcaagaacctcagtacccttatgctctcccagaattttttcaatgaaatgatgccagatgatgcaaacataacaaatccagatggattccaaaagatccaagttctagcattgggtggttgtaatttcacaggccaaataccacgctggcttgttaatctgaagaagcttgaggtcttggatttgtcttataatcaaattagtggttcaattcctccttggttgaacacacttcctgagcttttctacatagacttgtcttttaaccgcctcacaggaatatttccaactgagctcacaaggcttccagcactaacatcacaacaggcatatgatgaagtagaaaggacttacctggagttacccctctttgctaatgccaacaatgtttcccaaatgcaatataatcagatttccaacctaccaccagcaatatatctgggaaacaatagcctcaatggcagtatccctatagagattggcaaactgaaagtccttcatcagctggaccttagtaacaacaaattctctggcaatatcccagcagaaatttctaacttgattaacttagagaaactatacctctcaggaaaccaactttctggtgagattcctgtttcactcaaaagcttgcattttttgtctgctttcagtgtagcatacaataatcttcaaggaccgataccaactggtggtcaatttgatactttctcctcttccagctttgaaggaaacctacagttgtgtggttcagttgttcagcgttctt

SEQ ID NO: 10438 - DNA, 318 bp, Glycine max
  Peptide Sequence Number=SeqID_127216
atggtgacgttgaaccaatcgtcggagccatcgaggaggacaaaaggggttgggagttggtggttgggttttttgggtcgagtccttggaggagatccagacccgagagagggccaatgttacattgaacacacgcacaaagaaattgcatggttgggcaatgatcggagaggaaaggtgacaaagttttgcatggtgggtggcgatgggatgaggcgagaagtgagacaacgcgatgctgggtttggtcctttgttgttggagtttgttgaattgatttgtgatattgttgttggtgtgtataccatgaacctttga

SEQ ID NO: 10439 - DNA, 687 bp, Glycine max
  Peptide Sequence Number=SeqID_127217
atgggtgcggcatttgcacctgcaattgcatcatacattccttgggtagctgttttgggcaaccatgaccaggaaggatccctctctagggaaggggtgatgaaatatattgctggaatgaaaaacactttatctgtagtcaatcctccggaagtacacataattgatggttttgggaactataacttagaggttggaggagttgaaggcactgattttgaaaataaatcagtgctcaatctgtactttcttgacagtggagattactccaagaaagcatacatgaatggaccagtgcctcagaaagaacctgctcctggacttgcatactttcacatcccgttacccaaatatgctagttttgactcatcaaacttcacaggtgtgaaacaagaaggcataagttctaattctgtgaattctggcttcttcacaacattgattgaagcaggagatgtgaaggcagttttcactggccatgatcatgtcaatgacttctgtggcaagctaacagttagcctggagaaaacagagaatggccgttgggaagatgtcaaatcaattaaaacatggaagcgccttgatgatcaaaatctaactggtattgatggtcaggtcttatggagcaagagctttggcagcaaccgcaggaaaaaacaagatggtggctctggagaatttgcatga

SEQ ID NO: 10440 - DNA, 690 bp, Glycine max
  Peptide Sequence Number=SeqID_127218
atgatcgataaaagtgtggccaccctggaagatgccgtgtccatcattccggacggcgcgagcatcatgattggcggctttggccccgcgggacagccgctggaactgatcgatgcgctgattggacgcggtgcccgcgagctgacggtaatcagcaataacgccggcaacggcgacagcggcctcgcggcgctgctcaagaccggctgtgtgcgaaagatgatttgctccttcccgcgccaggccgattcgtgggtctttgacgatctttatcgccgcggcgcgatcgaactggaactggtgccgcagggcaacctcgcggcccgcatgcaggccgccggcagcgggttgggcggcattttcaccccaaccgcctttggcacgccgctggcgcaaggcaaagaaacgcgtgaaatcgacgggcgtcattacgtgtttgaaacgcccttaaaggcggatttcgccttgataaaggcccatcggggtgaccgctggggcaatctggtttaccgcaaagcggcgcgtaattttggcccggtgatggcgatggccgccgccacgacgatagcgcaggtcgctgaattggtgccgttgggcgcactggatccggaaaacgtgataacgccgggcatcttcgtccagcgcctggtggcggtggcgcgccccgcgaccttttccctctctgcctga

SEQ ID NO: 10441 - DNA, 662 bp, Glycine max
  Peptide Sequence Number=SeqID_127219
atgtttgtcgaccaaaacaatgcaaagacagctacattgggtgaagttgcggagactttgcagtatatggtgtcaccacaagggcgtaacacatggacagtggatgatctcgtgccttatgtggagaagctgacgattttatccgaagagcaagagaggatcacaaagcctgtggcacatggtccagcatcagagtgtcgctttccgccacaacagtttgacatgcttccgtccagtatggaaactcgaggttttgacagacgaagggagattgttcaagcggaagatttttcccaacaaatggagcagtgtggccatggaatgtactacacgccaccaacattttctcagtatccttcgcagatgtatcagtattctttcgaaggtcatgatactgatatgtctgcaagcgagcattcgtatggtggtgttgcggaaacacaccctcatttttcatggccgaccatgaccccttcgcagcaacatgatgccccaatggcaacacctaatgccccattagctccgcaatggaatgtacccggggcaatacctgatatgggtgatttattaggtgttgatttgcgtcacgagttttctgctgaggctgagcaacaagggcggcgacagtgggcaagaagaaatcctgatcgtgaagcccaaag

SEQ ID NO: 10442 - DNA, 330 bp, Glycine max
  Peptide Sequence Number=SeqID_127220
atggatgattttcaaggtacactggggtatagtgggtacagaggttcaaagaacctaggggaattagtgagcgatgaccaccccgaatttggtgcactcatttggcacagggaactcataggcctcactttgctactcctaacagactctgagactaaattttttggagttggaaacttagggatcagtatacgttgtaccttggaggactcacccatacaaccaacaacttttagggttaagagatgtcaagggagtcacgccctcggcgagcttggcgtagtaggcaaccaaaacgagtgtggtcgtgccgggagacaagcacgttag

SEQ ID NO: 10443 - DNA, 252 bp, Glycine max
  Peptide Sequence Number=SeqID_127221
atatattgtgctgtcatcccaagagaaggatcaaacattgatgatgcagaggtgctaagatattgcaagaagaatcttgcatctttcaaagtccctgaaaaggtcttaaataccaatagcagacaagatcatgcttatgcttttttgctatcgtgctcctgttccttgccactggtcttgatgaagccaagcattgtctctttgccttttaagttgtacatagttgcaaaacgggtacatgtgaaagaataa

SEQ ID NO: 10444 - DNA, 624 bp, Glycine max
  Peptide Sequence Number=SeqID_127222
atgccgaccaaggtgaaaggcctccttaaatacatatcccaaatattcgaagagaaagaagaagaatttcaaattgggttgccaactgatgtaaggcatgtggcacatattggatcagatgatccatctgcaaatgcaccaagctggatgaacgatatcaaacgaggaaaagaacccccatcaggaaaccctactcagacagttgaagaatgtgagaaaaagtcatcatcaaattccaaacgttccaaaatccgcaaccacctgattcccaagtcccgacacacttcaatcgacattgatcctgatgcgcccaaacaaaagcccatacgccgccacaatcgctcctcggacccctctgccgactcctccaaccatgagtcctctagtggtggctaccgccgtcgtcgtggatccaaccatggtgtagagtcttcgtcatcacaggatatgccaccgactggtgtcaaaacaaaccgaagaaaatcaaaggcctctgaaaacagttcggtgaagaagccttcgtctcgaagatcatccaaagtagattctctaactgatatttctatttcagattttgggtctggctctggacccgaaagtgggcttacagccattaggatttaa

SEQ ID NO: 10445 - DNA, 471 bp, Glycine max
  Peptide Sequence Number=SeqID_127223
atggatttcttggtggctttgttccgaaacttaatcgagcatgaagattggccaatgtcacaagcatgtacagattcgtataacaagactctgaagaagtggcatggttggcttgctagttcaagcttcacggttgtcatgaagcttgctcctgataggaagaagtttatgaacgtgataggaggcactggcgatatcaatgctgatatcgagaaattttgtacaaccttttctcctctccttcaagagattcacaagtttttgattattaatgtaaatgctaaaaataaaagtatcatactcaaaaaatcacatgatgatgatgatgatgatgatgatgatgatgctaaaaataaaagtatcatactcaaaaaatcacatgatgatgatgatgatgatgatgatgatgatgatgatgatgatgatgatgatgatgatgatgatgatgatgatgtactttttgtgcaataa

SEQ ID NO: 10446 - DNA, 255 bp, Glycine max
  Peptide Sequence Number=SeqID_127224
atgacgacttttgtatttgcattagcagcacctttacggtgtaacaaaggaaatacacctccatggagaagggtgtggcccctaacaccacaaggcgtagggtctagaggcgtgaggccgccacaagaaataatgagcaaaaaaagaatagcagccgtccatatggccctcatcggtagtcaaggtgtccatgttggtagccaaggcaaccctcgtcgatggccaaggtatgatgtttggagagggaaagtttaa

SEQ ID NO: 10447 - DNA, 1263 bp, Glycine max
  Peptide Sequence Number=SeqID_127225
atggagttgatgcaacaagttaaaggtaattattctgatagcagggaggaagaggaggaagaggaagctgcagcaatcacaagggaatcagaaagcagcaggttacaccaacaagatacagcatccaattttggaaagaagctagacttgatggacttgtcactagggagcagcaaggaagaggaagaggaagggaatttgcaacaaggaggaggaggagtggttcatcatgctcaccaagtagtggagaaagaacacatgtttgagaaagtggcgacaccgagcgacgtagggaagctgaacaggctggtgataccgaagcagcacgcggagaagtacttcccccttgactcctcaaccaacgagaagggtctgctcctgaatttcgaggacaggaatgggaaggtgtggcgattcaggtattcctattggaacagcagccagagctatgtgatgacaaaagggtggagccgctttgttaaggagaagaagctggatgccggtgacattgtctccttccagcgtggccttggggatttgtatagacatcggttgtatatagattggaagagaaggcccgatcatgctcatgctcatccacctcatcatcacgatcctttgtttcttccctctatcagattgtactctctccctcccaccatgccacctcgctaccaccacgatcatcactttcaccaccatctcaattacaacaacctcttcacttttcagcaacaccagtaccagcagcttggtgctgccactaccactcatcacaacaactatggttaccagaattcgggatctggttcactctattacctaaggtcctctatgtcaatgggtggtggtgatcaaaacttgcaagggagagggagcaacattgtccccatgatcattgattctgtgccggttaacgttgctcatcacaacaacaatcgccatgggaatgggggcatcacgagtggtggtactaattgtagtggaaaacgactaaggctatttggggtgaacatggaatgcgcttcttcggcagaagattccaaagaattgtcctcgggttcggcagcacacgtgacgacagctgcttcttcttcttctcttcatcatcagcgcttgagggtgccagtgccagtgccacttgaagatccactttcgtcgtcagcagcagcagcagcaaggtttggggatcacaaaggggccagtactgggacttcgctgctgtttgatttggatccctctttgcagtatcatcgccactga

SEQ ID NO: 10448 - DNA, 1137 bp, Glycine max
  Peptide Sequence Number=SeqID_127226
atggttacaacgattttgtgcagtgtgtttgcattactaagcctacacttgtttatgtatggatgcaacctgtacatgtggaagagtacaagaatcaaccataatttcatatttgaattctcaccaagcacagcattgaaacacagagatgcatttctgatgtgcactaccctcatgacaactgtgtttggggcaatggtgatacacctgctactaagggctggaggtttttctcctggccaagttgatgccattcctggaatcatttttctgttctttgtaggtcttctcatttgcccatttgacattttttatcgccctactcgtttctgcttcatccgggttgttcgtaacattgcttgctctccgttttataaggttctgctggtagacttttttatggctgaccaactaactagtcagattccattgctaaggcatttggaaacaacaggttgtcacatttttgctagagttttcaagtcacaccaccctgaggcctgccattctggaaggctatacatagaaataccttatcttatctcatttttgccatattggtggcgtgcaatgcagtgtgcaagaagatggtttgatgactctgatgttaaccatttggctaacatggggaagtatgtttcagcaatggttgcagcaggagctagagtcacatatagtaggcaagataaccatctatggtttgctatagtcttgatcacttctgtggtggccacagtttaccaattgtattgggattttgtcaaggactgggggtttttcaatcccaaatccaaaaacccattgctcagagatgatttaattctaaagaataaaagcatatactacatgtctatggcattgaatgttgtcctaagggtggcttgggtggagactatcgtgcacctcaaagtggggcctgttcaaacaaggctactagactttttgttggcttcactagaggttattcgacgaggacattggaatttctacagtaatgaaatagtgaacaaaaatccttgtgaaattgacaacttttttatgaacagattggagaatgagcatctaaacaacgtgggtcgttatcgggcagtgaaggcagttccactaccatttcgtgacatagactcagacagctga

SEQ ID NO: 10449 - DNA, 2067 bp, Glycine max
  Peptide Sequence Number=SeqID_127227
atgacggcgccaccgtccgtccccgccccctctccgcctctcgccgcttcccttccccttcccttcctctccagaaagaaaacaccaaccctcgccgctccacttcccgttccaaccctcgcggccgcagctccagcccctccgatctcccccgccccacccctcgaaaaactcaacaataatcacccccacaacataaccaccaccagcaggcttcacgagaagctcgcgtttctcgaaggcaaagtaaagcggatagcttccgacataaagaagactaaagaaatgctcgacatgaacaaccctgatgcctccaaggtgatcctctccgacattcaagacaagatctccggaatcgagaaggccatggttcatgtcgtttctaacaaggaaaccaaaaatgacgcggttcaagtcgctgctaaagacaagagcttggcgaaagggttgaaattgaacaccgaggaacttgaggcaaggttgttccctcaccagaaactgcttcgtgacaggacagtggttaaggataagggctctgtggtggaggaagagaaggtgctgagtccggttgacgataatttggttgcggtcgagtttttggctctgattgataaagagaaagagaaggtgaatgctggggaggatgtgaaggaaaggggtggaggtgggaatgttaagaggaacaatggcattgatgtgctgctcggggcggatgagaagctcgaggatttcgatgatgatcaggagaataaggagaacaaggaagagacgcttgttgaggaggagatggatgaggctttcaattttaggctgaatgggattggtaccaatgttgctaccggtggctggttcgtcaacgaaggcgaggctgtcctccttgctcaccttgatggttcttgtacctattatgatattaccaattgtgaggaaaaagctgtatatatgccacccccagaagtttcacccaacatatggagagattgttgggtagttcgtgcccctggttccgatggttgctctggaaggtttgtagtagctgcatctgctggcaatactatggattcaggattttgctcatgggacttttacaccaaagaagtgtgtgctttacaagttgatgctggaacagcctcctcaagaattgcacttggacccttacctaacaatattagaagaaattctacatctagcattgtgacagcagaagctacgaagtggtggtataggccctgtggacctctcatcgtgtctacggccagctcacagaaagctgtgaaggtttttgatgttcgcgatggagagcaaataatgaaatgggatgttcagatgcccgttttaacaatggattattctagccctttgcaatggaggaacagagggaaagtagtggtagctgaatctgaatccatttctttgtgggatgtgaactcactcactcctcaagctctgctctctgttcctacaggcgggcaaaaagtttccgctctccacgtgagcaacactgatgcagaattgggtggaggggttcgcaaaagagtaagttcatctgatgctgaaggaaatgatggtgtgttctgcacctcagattctattaacgtgttggactttcgccagccatctggtgtaggtctcaggatatcaaaacacggtgtcaatgtgcaatcagttttctctcgtggggattctgtgttccttggttgctccagcacaagttcaacgggcaagaagcagacctcactgctgcaacaattttcactgcgcagacaaggactttttacaacctatgctcttccagaatccaatgcacactcacaccatgcagcaatctcccaagtttggggcaattctgactttgtcatgggtgtttgtggcctaggactgtttgtgtttgatacagtgaaagatgatgcactaagggttctcaacatggattactctagtgatcaaagttttagagaagttattggtccggatgacatgtattgtccttcctttgattatcttggatctcgtgctcttctgatatcaagagatcgaccagctatgtggaggcatctgatagtttga

SEQ ID NO: 10450 - DNA, 201 bp, Glycine max
  Peptide Sequence Number=SeqID_127228
atgggcactaattggaatcgttgtcacaacaatttcacggtggcatatttggttgacaagtgggtgattgcctttgttcttagggtcagcgctgagcaagtgggtgttggcatgagagcatcacccattggtcatggtcatggtctttgtggactgtggaataatgccatcaaatcactcgatgcgaatattgtttcctga

SEQ ID NO: 10451 - DNA, 1254 bp, Glycine max
  Peptide Sequence Number=SeqID_127229
atggaggatgggagcagggttccggcgggggatgacccctcttactggctggatgcgtgtgaggacatatcgtgcgatgatttcattgattttgatgtctcttccatcgtctctgaccagcccgacaatccttccaatcaggacttcttcggtggcattgataagattttggacagcatcaagaacggtgctggtctccctctcaatcatgctgttgaaccacccaataataatggcactgcagcaggagaagtgtgcttgccttccaatgccactcttgaggatggtgctcctgctgctgatgcttttgaccattctggtggcgttgctcggagtaacggctccagtaagctgtctaatgggaacgaaacaggagttttggttaattattctcaggaaagaggggcaccccctctgaatggaggccacgattttgatggtgaagaaaggtgcagcaaaagggcttggcttggcggctacaataatgagaggccttattattgtagagggaattatcaaggcaaggagagggagaggtgttttaataataataacaggaagaggccacggggtgatagggatgaaattgacaggaaagataaggatggtggtggaaggaaaagagaacattatggtgctgttgccaggagggatgttagagatagggattgtagggatagagaaactaggggttactgggagagggataagtcaggttccactgatatgatctttcgcactggcgcttgggaacctgatcataatcgagatgacaaaatggtgattgacaccaaactggagaactatggaaagcttgataagaagtccgaggatgctattgagagggttcctgaggaaaaagctagacagtatcagttagatgttcttgagcaatcaaaaaggaaaaataccatagcttttcttgaaactggagcagggaaaaccttaattgctgttcttctcattaaaagtatacaagatagtttgcagaagcaaaataagaaaatgcttgcagtatttttagttccaaaagttccacttgtttaccagcaagctgaagtaattcgtgagcggactggttatcaagtaggccactattgtggagaaatggggcaggatttctgggatgctcgaaggtggcagcgtgaatttgacaccaaacattatagcattttaagaattcggattctgttttcttcttcatgtttgtccatattttcctcacgtatagagttggctactggtcaagtgtaa

SEQ ID NO: 10452 - DNA, 1749 bp, Glycine max
  Peptide Sequence Number=SeqID_127230
atgcggggacctccatgttccctttccattctatgtcaacacttcataattgggtcagtgagctacacagtgttggaattcttcccagatggtgtgctggttgactttccaggctcatcatcctgtagactgtacaatgacttgaactcttttggcagaaactttgcagggaataataaggacatgtttggagtgtcggttgacaatgttattgggctctatgactgtgaggattcttctctgtgcaaagcagattgtgaaaccattgacatgcctggatgtgatggaaagggtggaggctcccttgcctgctgctatccactctctgaccataccatatggcatgctggagatggcttttcggtgttttctcagtttggatgcagaggggtttctagttgggctgttctgcgaggctcaacttggggaaaacgtggtgtcaagttggaatgggcacttcccaggaactcctcctctactcatgtttgtgctacgaatgctaacatggccaatgctacggcggttgaaggaggcgtcagatgtgtctgccagaatggatatgttggtgatggttttgctaatggaactggatgtttgcaggcctgcataaaggatggaaaggaagcatatggaagtgactgctatatcaaaagacatgatcaaaggaaatttgttatgattgccggaatcattggcccagttctcattgttgcctccctggttgtactattttatcttcttaaaaggccaacaaaaccagggatgtttgacacagagcaggcttactatcaaaacattacaatccccaaagcttgtaaaactcggttattcagcctccatgagctagaagaagccactaagggttttgaagagggtcagaaactaatgcatgacaataatgggacaattttcgctggagttttaggggatggatctcacatagctgtccacaagttaaagtgtgagaagaatgacttaatccaagtcctgtcacaaatcgaggttctatcttctgttgtgcatagaaacatggcccgaattcttggatgctgtattgaatctggcaacactctagtagtttatgagtatacttccaatggtactctggaggaacatttacatcaaagcaaaggacaacaacttcgtttagattggtatagtagattgactattgctgcacaaacagctagtgttctagcattcttacactacgagaaaaatcctcccatacttcaccataaccttaaatctgcctgcatcttcctagatgatgattattctgtcaagattgcaggatttggcctgatcaactccaatttttactatggttctaacttacaaaagaactgtgaaggatttggcatctgcaaaaatgatgtttatgacatgggtgtgttgcttcttgagattatctcaggctcaaatcagttggattcaccaacgttggccttacagcatataagggctggaaaatttgaggaaattatggacccatttctttgctatgatgaacagccacattatcggcaagagcaaatgcaaataattgcagatcttgctacaaggtgcctgttatttggtgtagatggaaggctaggaatgattgatgttgtgagggagttagtacacatgactaaagaaagtcttgatggaggaattatgaaaggacctgcactggaggagacattctcaaattcaagccttcttcagatgatatcaatgtctcctgattctatgaatgtcccttga

SEQ ID NO: 10453 - DNA, 3283 bp, Glycine max
  Peptide Sequence Number=SeqID_127231
ggacaatttatcacatgaagcattcctaaggaatgccaggaacagtgaggaaactttgcgcaaagaagcaatagagagaacagaccttagtcatctgaaggacacttcaaggttgatctctgttgacacccggcctggaacagtttaccaggtgaagtcaactggggcagttgtgagcctaaattctgctgtagatattcaattcttcgccctgaatttattatggagaggcacgaaaaacctggaggtcccacagaatattcttgcaagcttcaactaccatgctgtttgtctggctgcttgcaagaaactgcatgagatgggtgcattcactgacatgctattgcctgataaaggaagtgggggagaaaaagaaaaggatgaacaaactgatgaaggagatccacttccagggactgctagacatagggagttctaccctgaaggtgtggctgacatactgaagggagaatggatcttatctggaaaagatgcttgcaacaactccaaattgcttcatctttatatgtatgctgtgaagtgtgaaaatctaggccattcaaaggatccgttcttgactcaagtttcaaattttgcagtactttttggcaatgagctggatgcagaggtgttatcgatgtcaatggatctatttatcgctcgaactgtgactacaaagtcatctcttgtctttagggggttgataagtatcactgagagtcagctggcatccctgaaaagctttcatgtaagattaatgagcattgtcttggatgtggatgttgaaccatctaccactccttgggatcctgcaaaggcatatttgtttgtcccaatggttggcgataagtctgtagatcctacgaaccaaattgactggcatctggttgagacaataattggagctgatgcatggaagaatcccctccagaaagctcgaccagatgtttaccttggtactaatgagagaacattaggtggagacagaagggaatatggatttgggaaattgcgtcatggcatggcttttgggcaaaaatcacatcctacctatggaatcagaggagctgtggcccagtttgatgtggtgaaagcttcaggattggttcctaacagagacgccatgcaaacacaaaagcacatcaatatgactaccaatggaaaattaatgatggcggatatctgtactaatgcagaggatctggttgggagaattgtaactgctgctcattcagggaagaggttttatgttgattcaatatgctatgacatgtcagcagagaactctttccctaggaaagaaggttatcttggtcctctggagtacagttcatatgctgattactacaagcaaaagtatggggttaatttgatttacaagcagcaacctcttataagagggcgtggtgtatcatactgcaagaatcttctgtctcctcgatttgagcacagtgaagctcatgaaggtgaatctgaagagatacatgacaaaacttattatgttttccttcctcctgagctatgcctcgtacacccactgcctggatcacttgtccgtggtgcccagaggttgccttcgataatgaggagggttgaaagtatgctacttgcagttcagcttaagaatatgataaattatcctgtcctggcttcaaagatcttgggagccttgactgccgcctcttgccaggagacattctgctatgaaagggcagagcttcttggagatgcttacctgaaatgggttgttagtcgatttcttttcctaaaatatccacagaaacatgaaggtcaacttactaggatgagacaacaaatggtcagtaacatggtattatatcagtatgcattaagtaaagggcttcaatcatatattcaagcagatcgttttgctccatccagatgggcagctcctggggtgctgcctgtctttgatgaggataccaaggatggggagtcatctttgtttgaccaggagcgatccatttccaagatcgagaggatggattgtcacacgaatggatatgaggatgagatggaagatggtgagcttgagagtgattcaagttcttacagagttctatccagtaagacacttgcagatgttgtggaagcactgattggggtatattatgtggaaggtggtaagaatgctgccaaccaccttatgaaatggattggcattcaaatagagtttgatcctgatacaatggagtgtacaaaaaagccatttaatgttcctgacagcatacttaggagtgttgattttgatgctttagaaggtgctttaaatatgaagtttaacgacagggggctgctggtagaatccataactcatgcctcccggccatcttcaggagtatcctgttatcagcggttggagtttgttggcgatgctgtcttggatcatcttattaccaggcacttgtttttcacttacacaaatctgccaccgggacgtctgactgaccttcgggctgctgctgtaaacaatgaaaattttgcgcgtgttgcagttaagcacaaccttcatgtgcatctcagacatggatccagtgccctagaaaaacagattaaagaatttgtgaaggaagttcaagtcgaattgtcaaagccaggttttaattcctttggtctgggagactgtaaagcccccaaggtccttggtgacattgttgaatctattgcaggtgccatttttcttgacagtgggagggacactactgttgtttggaaggtttttcagcctcttttgcatcctatggttaccccagagactctgccgatgcatcctgtgcgtgagctgcaagagcgatgccagcagcaagctgaaggcttagagtataaagcaagtcgtattggcaatttggccactgttgaagtattcattgatggggtccaagtaggggctgctcaaaatccacagaaaaaaatggcgcagaaattagctgcaagaaatgcccttgctgctttgaaagagaaagaggtgggaaaaactcaggagaagaatgatgaaaacgggaaaaagaatggaaaccagacatttactaggcaaacattgaatgatatatgtttacgaagaaattggcctatgccattctacaggtgtgtgaatgagggtggtccagcacatgcaaagaggtttacatttgcggtgcgtgtcaatactactgatagaggatggacggatgaatgtgttggagagccaatgccaagtgtcaagaaggccaaagactcagctgctgttcttctcttagaactactgaacaaattatactcgtga

SEQ ID NO: 10454 - DNA, 636 bp, Glycine max
  Peptide Sequence Number=SeqID_127232
atgagtgagaatggtgaagaggcaggagaaaatcgtccagttccccgtttgaacgaaagaattctttcatctttgtcaaaaagatcagtagctgcccatccttggcatgatcttgaaattggacctgaggctcctcaaattttcaattgtgttgtggagatcactaaaggaagcaaggtcaaatatgaacttgacaagaagacaggattgattaaggttgatcgggttttgtattcatcagttgtttatcctcataactatggttttatccctcgcacactgtgtgaagacaatgatccaattgatgttttggttctcatgcaggagcctgttcttcctggatgttttctgcgagcccgggccattggacttatgcccatgattgacgggggagagaaagatgataaaatcattgcagtgtgtgctgatgacccagaatataaacactttacagactatagagaacttgcacctcatcgcatctctgagatccgacgcttctttgaagactacaaaaagaatgagcacaaggaggtagcagttaatgattttctacctgcaagcgttgctcttgatgccatccagtactcaatggatctctacgcagagtatattctgcacaccctgaggcgatag

SEQ ID NO: 10455 - DNA, 2160 bp, Glycine max
  Peptide Sequence Number=SeqID_127233
atggcgaccgtgaccattaccggtgaacgacaatatcgcggccattattggcgaccagtgatcggcgaccacaactgcgaccattaccggcgaacggcgatcgcgaccgttaccggcgaccacgaccgacgatcggagaccgttaccggcaaaaaagaggcctttgtaaaaggtgttccaataggacaagctcttgatatagacatcccccctccacggccaaaaagaaaaccaagcaatccttatccccggaagaccaatgttggtgccccaacattacatagcgaagcaaagcatggaaagtctctcatttcaattgcatcttcacatggtaaacaagcactggacttggagaaagaaccacttccagagcataatgtcgacctaaggccaacgactgtaaaagaaaataaggacggaagctgcttaaacgtatttaccattatccaagaggcaccctgttcatctgtatcttccgccaacaagaattcaacatcaatatcagtgccactgagaaattcatgtgccctaagggagtttataccttcggtaaaagaggtaataactcgagatgaaaccaacgaatcttttgttactgatgagcttgaaaatcagaagttggagatagatgatggcaagcacacacaaaagactaatgacacttgtgaagtctctaagttggagaattctggtgcttcagaattggttcaaactgagaaaacagatggtcgtaattgtgcattaacaatagatggggtgccaggcaatcagaattacccaagacatgtccctgtgcacgttgttgatgggaaccttggaactagtactcaaaatctatccccagatatggtgtttcaagactccatatttcagccgaagggaggggttaataggcaacctaaccttgtcaccaattctgctacatcacacataagtgaatgtcaaaacaacgccgcacggtcctctattcatcaatcatttcctcctagtcctcctttcgcacaggatgattatcattcatttcttcacatgtcctccacattttcaagtcttattgtctctaccttgctgcaaaaccctgcagcccatgctgcagcgagttttgctgctacattttggccatatgcaaatgcagaaacttctgcagattctcccgtgtgcactccagattttccatcaagacaaattggctcgcctccaagtgtgacagctattgcagctgctacagtagctgctgcaactgcatggtgggctgcccatggactgcttcctttatgtggtccactccatacagcttttgcctgtcctcctgcatcagcaactacagttccatcaatgattattgatgaatcaccacaaaaaacagaacgaggagagattaaaccacaaaatcctcctctgcaagatcagataccggatccagaacactcggaagctcaacattcagctcctaagtcaccagctgtttcttcatccaaatctgaggataggggagatgccaatttagatacttcaccaaaggctactaatcatgagatgaaccaagcaatttctgagaaccccgattccaacaaaatgaagggcagaaaacctgtagaccgttcctcatgtggttccaacacaacctctagcagtgaagagactgagttactagagaaggatgagaaagaaaaggaagagcccaaaacacctgatgcgaacgttttagataccgagcttagtaatcgtcgaagtagaagcattagcaaccttactgattcttggaaggaggtctctgaagaggctctattctccagagaggtgttgccacaaagcttttcacctactcatcatttgataaataaagataatcagatagatagcatcaaggataacgagctaaacacagactacaaagatgaagaccttgaaagcaagaaatgcagttctatttgtgatggggtgcagaaaaatctgctatttgtcaaagataacaatgaggaggagggactgctaaccataggtcttggaccaggaaagctaaagactcgtcgaacagggtttaaaccttacaaaagatgttcggtagaggccaatgaaaacaggatcggaacagcctgcatccaaggtgaagaaaaaggtcccaagagattacgcttgaatggggaggcttcaacttga

SEQ ID NO: 10456 - DNA, 186 bp, Glycine max
  Peptide Sequence Number=SeqID_127234
atggaaagtagtgatgagaaggtacaagagctcaagagtaacgtggcgaaatcagggagtctccctcttgctctccctacacccaacccatccatggcagactcttggtttttcgtctctttacgccacaccatcaagtcctcctcgttcatccctccatttgcgatgtctgagtatgttgattga

SEQ ID NO: 10457 - DNA, 1381 bp, Glycine max
  Peptide Sequence Number=SeqID_127235
atggttgagaagaatgtgagtattttcttaagcagaaaagcaagtaaaagaaggaacccattgttggcctgtcccctttccagggaaagcgaagagatgcatagagcatttgttcggtccaaaaccctaatcagcgttgcttccaatcgcatctcgtcttcaggaccaacatcgttgaatccatggcaacccctttacttgtataggcagaagcaacaagaagcttcccactcctccagctgcaacagcggcaacaccccattcgggtcaccaactcgagtccagaagctaatagcctcccaatcagaccctcttctggccaaagaaatcttcgacttagcctctcgccaacccaagttccgccacacttactccagctacctcatcctccttctcaagttgggtcgctccaaacacttctctctcctcgacgatctcctccgtcgcctcaaattcgattctcaccccatcactcccaccctcttcacttaccttatcaaagtctacgccgaggccgatttgcccgacaaagccctcaattccttctacaccattctccacttcaattgcaagcctctccccaaacaccttaaccgcattctcgaggttctcgtttcccaccgcaacttcattcgtcccgcgttctatctcttcaaggatgctcacaggtacggcgtggaacccgacaccaagtcctacaacattctcatgcgcgccttctgtctcaacggggacattagcgttgcctattctctgttcaacaaaatgtttaagagagatcttgttccggatatcgagtcttaccggattttgatgcaggccttgtgtaggaagagccaggtgaatggagctgttgatcttttggaggatatgctgaacaaaggttttgttccggattctttgacttacaccactttgttgaatagtttgtgtaggaagaagaagctcagggaggcttacaagcttctttgtaggatgaaggtcaaagggtgcaatcctgatatagttcattataatactgttatattgggcttctgtagagaagggcgtgctcatgatgcttgcaaggttatcactgacatgagggccaatgggtgtttgcctaatctcgtgtcgtatcgtactttggtgagtggtttgtgtgacatgggaatgcttgatgaggctagtaagtatgtggaggaaatgttgtccatagatttttctcctcattttgctgttgttcacgccttggtgaaggggttttgcaatgttggtagggtagaggatgcttgtggagtcctcaccaaggcactagagcatggggaagctcctcatctggatacttggatggccataatgcctgtaatatgtgaagtggatgatgatgggaaaatcagtg

SEQ ID NO: 10458 - DNA, 594 bp, Glycine max
  Peptide Sequence Number=SeqID_127236
atgtcaaaggacaaagtttccggtgatccaagacgcgcagtgtgcacaggcatcaccatcttcctcctcttagccggcgtcactctcctagtcctctggctggtctaccgtccccacaagccgcgcttcacagtaatcggcgccgccgtctacgacctaaacaccaccaccccaccgctgatgtcgaccaccgtgcagttctccgtcctcataaagaacccgaacaggcgtgtctccatttactacgacaggttctccgcctttgtctcgtacaggaaccaggccataacgccgcaggttctgctgccgcctctgcaccaggagaagcgaagctcggtgtcggtgtcgccggtgatgggaggcacggcgcttccggtgtcggtggaggtgtctgacgggctggcggtggacgaggcttatgggttggtgggtctgaggctgatatttgagggcagagtgaggtggaaggccggggccatcaaaactgcgcactatggactgtacgttaagtgcgatgttttgatgggtttgaagaaagggttggtgggtcaagttcctctcctgggagttacaccctgccatgtccatctatga

SEQ ID NO: 10459 - DNA, 2088 bp, Glycine max
  Peptide Sequence Number=SeqID_127237
atggcggagaatgggacacgtctgcactccgctgttttgacggaatggaccgcaacttgtttgaaaatgggtctagtggcggctgacaagggttcgatgcagacccaagaggaacagagcgacaatgcctccgctgttcagtgggaacgctttctgcctcggatggtgcttcgggtcttgcttgtcgaagctgatgattctactcgacagatcatttctgcacttctccataaatgcagttacaaagttgtcgcattttgtgacggcttaaaggcatgggagacattgaagaacaaaccatctgacatagatctcatattaacagaagtggatttgccatcaatatctggattctcacttcttactttaatcatggagcatgacatttgcaaaaacattcccgtcataatgatgtcttctcatgattccgttagcatggtactcaaatgcatgttaaaaggtgcagctgattttcttataaaacctgttcgcaggaatgagctaagaaacttgtggcagcatgtatggagaaggcacgccataagcaggcctcctcaaaattttacactaccagagattgaaattggttttgctgcagaaaaccatgctgcaagcaatgactctagtggttctgtggcttctacagcaaaaaatggtgaatgcagcgagaaaacaagtgaggctcaaagcacttgtacatcgccatttttggaagctgagagtacatacttggaaaatatgcaggatatatcgcagctgaagaggtcttcaaatttgagcaatattgacacggtgaagcatgaaaattctaccaaatgtgaaagggaatcagataagcataatgatgaagctggaggtttaaggctaggtcaaggctatgaatgctgtgaaacgagaaatcaagatgtagttctaaaaatagagttgatcaaatccaatcctgaaattaatacagatattcatggatgcagtgatgaactggtagatccttatactggggccattgacttgattgctacattcaagaatcttccaaagagcactgatgaaaaatgtagtttcagtagtggtaacactgccaagtttgattttgatacacaattggaactttctttaagaagaagagattttcctggaagctcatgtaaagctgcatctgaggaaaggcaattattgaaccattcaaatgcttctgccttttctaggtatagtagtagtaagttgttgcagcccctttttccaacaccatcaactatctctgctaaattaacaaattccagtctgagttctcatgaatcccataaattctcagaaaatgcatctacttctcatcaatatggtggaaaaaatcaaaatcaggagaaaattatcactccagtcattggtcagtctggacaagttgatccaaaattaccaaacagtcaacttggatattttcctgctacaggggttacttctgatcacaagtctacaggaaatggaaatgtcttcccttctatgctttatgcagaatcaggtgtccatcccatatggactccaaaatcagtgtgccagaaagaaagttctccatttcccacaatcacttcatcccagtccaatcctcaaagtcacaactcagaatgtcatctctggtcggaagattcaacccatgcttctgataaaaatttaaatgatcaaattaatttggattgtgagacacatgactctcctgatgctagtcagagtgctggtactagttttttccacgacacagcaaatcataatagtagcggtgtatacagaagcatgggctgcagaagtgatggaaatgctacttcagctaaggtagccaaggagagccatggaagttttattgatagtggtcactgcagttatgatggattcatagggacagattctcatcgcacaagccaccgagaagcagctctgacaaagtttcgactgaagcggaaagacagatgctatgagaaaaaggtgcgatatcaaagccggaagagattggcagagcagcgcccccgggtgaaagggcagtttgttcgccaagtacaagatgatcatccagtagcagatgtgggtggtggttcctga

SEQ ID NO: 10460 - DNA, 264 bp, Glycine max
  Peptide Sequence Number=SeqID_127238
atggataaagttgtctctagaatatgtccattggatttaatgatgaaatatgtgcaatttcagagcttagctcatcagtgggctaagcgtgcatccaccgctaagcatagctttagcgcgcttagcgcaacagaagaatctagaagttcatcaatatcaaggccacgcgctattcgtgagactagtgcgctaagcgtagcagctatcttcagccaggctcagcacaagactggcgctaagcccgaatccacttacccgcactaa

SEQ ID NO: 10461 - DNA, 1620 bp, Glycine max
  Peptide Sequence Number=SeqID_127239
atggcggtgggcgaatttgtcgccccgcagggcgagcagatggcgcgtaactaccgggcgcagcagctgtacggcggctcgctggtttcgacgcaaaacggcctgtgggcgaaagacggcaacgactttatctacattgagcgcattaaaggcgacaacgagatcgacggcgtcagtatctatcgctttaccgaccagcggcgtctgctgagcgtgcgctatgccgccaccgcggtctggaataaagatcgcaaactgtgggagctatcgcaggtggatgagtcggacctgaaagatccgaagcagattaccggttcacagagcctgagcggcgaatggaaaaccaatctgacgccagacaagctgggcgtggtggcgctggacccggacgcgctgtcgatcagcgccgctgtcggtggcggtgatgatgctgatggcgctgtcgtttatctttggtccgctgagaagcgtatcgatgggcgtgcgcgtggtcaccggcatcagctttggcttcctgttctacgtgctggatcagatcttcgggccactgagtctggtgtacggtttaccgccggtgctgggcgcgattctgccgagcggcgcgttcttcgccatcagtttgtacctgttgctgaaacggcggtcgatgcccgcaccgttagcgcaacgtctgcacccagcccgcgtgccgttgatgcggataaactgcaaatcacggccaatgttcagctcaatctgttgcgacatctcgcgcgcatcccagcttttcaccgtatcgctgattgcttcatcggcggcgagcgtttcgcccagccacagcgccgccagccgcacccgctcctgcacgcgcgaatcgtcactgttgaggtcgctcttcagccagcggcgcaggtcctgccacagctcgccgatataacgtcgctgtaccgcgcggttaaaaccgaggcgaaattcgtggccctggtcgcgcgccacttcatccagaatcgaatccaccgcgttggcgaccagctcggcgctgtgttcgcccagccattcggtcggcagtactttggctttgatcggatgttcgcgtttcagccagcgcacaatctgcagcgcgataaactcgcgcgtgccgggtttgtgcagcagacgcagcagctgttgcaccgcagcgtccagcagctcctgatggcgattgtttttggtcaggctgtccagcagcagcgcgctggactgggtcagatcgaccttatccagtgcgcgatgcaccgcgcggcgcaaaaagcgctgaatacgctgatcgtcagtaagatcgaggaaaccgcgcatcacctgcagcagtgccagcagcgaatcggtatcgagaaacttctcctgcacgaagcggccaagattctcgccgatgcgatctttgttgcgtggaatgattgccgtatggcgcgagatgaacggtaccggcacgcgacgaaacagcgccaccaccgcaaaccagtcggccagcgcgccgaccatcgccgcttcggcaatcgccttcagccccagcacccagaacgtgggcggcagaaacagcgtcacgacaaaggtcgcggcggcaatcagcagcagcgacagggccagacgcttgctccgttttaa

SEQ ID NO: 10462 - DNA, 225 bp, Glycine max
  Peptide Sequence Number=SeqID_127240
atggcaatacaattcatcctgccatggctcaaaaatggtaccagcccctatgtttcatccaaccataacaatctcaaccatgatctcaaagtggcaaacttaattgaccacaatattggtgattggaagaatgaactcgcgaagacaaatttcaatcaacaagatgctcaatggatcaaagatattctagtcttgaacacatccaacaatggaaaattaatttga

SEQ ID NO: 10463 - DNA, 321 bp, Glycine max
  Peptide Sequence Number=SeqID_127241
atgggacaccctaagagaataaaggtcattcctgagtggcccactccaccaagtataaagaaaattcggggcatccatgacttaacgtacttttacaaaaggtgtcgcaacttacccttcggtaggagggcgacgcggggctcacgagtgcgtcttccaagggaggaaggcgtgcggagtcgccaccaacgtttatttgaggaaaacgtcggaaaaaccgaaacatgtggtctacgaattttaaatgtgaaaggttcaggagttgtttttatgcacggggaaggtattagcaacccacgcatccatcacaatggacgatag

SEQ ID NO: 10464 - DNA, 417 bp, Glycine max
  Peptide Sequence Number=SeqID_127242
atgtcgctcggagaaactgcttgttcatacgcagctctcatccttcatgaagatggaattagtgtaactgtatccttttctgtgcccttaggttttgcgttaacgaataatttcttattgaatcaattgaagagctgtgcaattgtggctgacaagatcagcaccttgttgaaaactgcaaaggttccagtagactcttattggccaaccttgtttgctaaacttgctgagaagaaaaatcttggcgatttgatagcaaatgcggcaggcggtggtgcaccagttgctgttgcagctgccccagttgctgctgctgctggtggtgctgctgccgcagctccagctgctgaggagaaaaagaaggaagaaccggaagaagagagtgatgatgatatgggattcggcttgtttgattag

SEQ ID NO: 10465 - DNA, 321 bp, Glycine max
  Peptide Sequence Number=SeqID_127243
atgggtaacgcttggtttgggaagaagagaagcacaaaggcagtggtgcaccctgaagtggttcgaggcgtgacgacaatcaaggtgcgaatgaccaaagcccaactcatggatttaacacagaaggtggatatgaccaataattatggcaattctgaattaggccgtttgatcgttcaagaatgctccaaaggaaggtttcatgctcgtgttgttgttgttgctgctgctgctgctagtgctgggcatgattcacagagggcacacatgttttcaagggaacggggtttaactccaattcaagaaaacagcgatgaatga

SEQ ID NO: 10466 - DNA, 1245 bp, Glycine max
  Peptide Sequence Number=SeqID_127244
atggagagaacattgtcatcccttctacagattcagcctccaacctatggaaatttagtcactattctcagcatcgacggaggtggtatcaggggcattatccccgcaactattcttgctttccttgaagcccaacttcaggagttggacggtgaggatgcaaggcttgcagactattttgatgtgattgctggaacaagcacaggtggtattgtaacagctatgctaagtgctccaaatgataatcagcgtcctctatttgcagccaaggatatcaagcccttttacttggaacattgcccaaagattttcccacaacacagtggcttgtggggatcggtaggaaagttgctgggatcgttgggaggaccaaaatacgatggaaaataccttaaagaagtggtgagagagaaactagggcagacacgtttgcatgaaacgctgacgaatatagtgattcccacgtttgacataaagacattgcaaccaatcattttctcctcttaccaaatcaagaggtctccttgcttggatgctcgactctctgacatatgcatcagcacttctgccgcacctacttatcttccagcctaccacttcaagaaccaagattcacaaggaaacacgcacgaattcaaccttattgatggtggcgtttgtgctaataatccgactttagtggcgatgaatcaagtaacaaagcagataattaatgaaaatccggacttcttttccatcaagccaatggaatatggtcgtttcctgataatctctctaggcactggaacccctaagaatgaacagaaattcaatgcacaaatggcagcaaaatggggtctgttggattggttaaccaattctggttctactcccttaatcgatgtgtttactcagtccagcgcagatatggttgattttcatcttgctaccgtcactcaagcactgcattcagaaaataattaccttcggatacaggatgatacattgaccggtacagactcttcagttgatattgccacaaaagagaatttggaaaaacttagccaaattggtgagaggttgttgaagaaaccagtatctcagatcaatttggaggatggtctgtttgaatcggtaggaaatggggagaccaatgaaaatgctctcaaaaggtttgcgaaaatactttcgcaagagaggaggctccgagaatcaaaatcccctcacactaagaaggtcccaagctactttgctcgtgaattctga

SEQ ID NO: 10467 - DNA, 747 bp, Glycine max
  Peptide Sequence Number=SeqID_127245
atggaaaccaaagactctccggatataaaatctttcaagaaattcccattaacattgaggttggtgattttagtcgtggtcgtgctttgtggaatatacatttgcacaattattttagagcaaaaaggtgtacacacaagtgccaagttgttaggcatcactgtcttcaagcagccatgttataatcattctggtgtggaagaatgggaactgccttacttgcattatccagaacccaaaatctatagtagagtgattgacgaatctacattgtgcagagaagagtgtgcttgcaatcctgttctgtttttctgcattgtgtcaatgcaaagatctgggagcggttgtgcttccaagaatgagtgcactgcggctgttggcttcaagttgatgcttaatcagggtttgatggagcatcatgaggaaatcgtagaatactttgaacgaagacgagtttctgtgatattcctattcagaaggaacttgctccgtagaatgatatcagtggtagcgaattcctatgacaaagatgccaagccactgaatggaactcacaagtctcacgtgcactctagagtggagaaactaaaggatgttcaagaatttctaagggtgccatacagagatctggagagccgtcaagtaaagatacatacagccgcattatcgaagcagattgaaaactgggatgaggtccaggaatcgctcgcagggacgccataccaaaggtttctcctcaaagactaa

SEQ ID NO: 10468 - DNA, 693 bp, Glycine max
  Peptide Sequence Number=SeqID_127246
atgactatgccaatttcatcaactaaaaacagttttcttatcttgttcgtatttatgatctgtggaggagtgattgcaactcctccagaggatccaattcagtgctcttcaaagaacacagactgcaccatcaccaacacctatggcgtctttcctgaccgaagcatttgccacgccgctgaggttatttacccaaacacagaggaggagctcatatccgcggtggcctcagcttcgaagaacaaaagaaaagtgaaagccgccacacgcttctcccacagcattcccaagctggtttgccctgatggcgaaaaagggttgctaataagcactaagaatctaaacaaggtattgaagattgacaaggaggcaaggacgatgacggtgcagagtggcgtgtcactgagagagataatcagcaagtctgcagaggctggattggccttgccatacacaccatattggtggggtttaaccattggtggactcatgggtacaggtgctcatggaagcactttgtggggcaaaggaagcgcggttcacgagtatgtgctccagatacgcattgttactccagctggacctgaagatggatatgctaaggttcgtaaccttgacgaatctcaccaacaacatctcaatgcagcgcgagtttctctcggggttcttggagttatttcccaggtaaattaa

SEQ ID NO: 10469 - DNA, 1299 bp, Glycine max
  Peptide Sequence Number=SeqID_127247
atgacgttggtattgaagatgaagaacaaaattggcttcgtggactgcacgatttcaaaacctcatgagcaacatccaaactacagttcttggaaacgatgtaacaacctgattcgctcatggatcaatcatccgatttctcctgacatcgcaaccagcattctttggccgaatcaagcctctgaggtgtggaatgctttgcgtacccatttttcccaaggtgattgcgtttggattctacaattgaacaacgatctctattccactaaacaaggtgatctttctgttacgagctatttcaccaaattgagaattttgtgggataagttgtgtaatttttgtccaatccctacctgtgatgcgactcttgttggttcttccaaagcggttcagcttttcaagaagtatcgtgattgtgatactgttttatgctttcttcacggattgaatgagccatttgcttttgcaaaatctcagacattgatgctcgatcctcttcctagtttggatcaggttttctcaatgattcttcagcaagaacgtcaattgcatgttggtgttctgcctactcccactcttctcactgctcaggctccaccaaatgcatcacaaggtcgtggcaaggctcctttcaagttcaattttgtcaaacaaggtcatgctcgtttatgcactcactgcaatcggactaatcacatcattgacacatgctttctaaagcatggatttcctcctggatggaaatcaaagaaatatgtgcatgatgttgcaattgctaatcttcaacctgaggatgattcagaccctggtggcattctttctagcctaaccaaggatcaaattcagagtttgcttgccttgttgccatctgctacgcctactgccgatgctaccagctcttcaaatgtggttggctcttccaaccttgttagctctaatcacatttctactcagcctgatacagataatgtttcgtggatcctagatacgggtgctactgataattttgcttgttttttgaatctttttgcatcttatagagccattaaaccaattcttgttgcattacctaatggcaagtttccatctgctttgtttagaggcattgttgtgctgactaattctttaattctttatgatgttctctttattgaacatttttcagtcaacattatttctattaccaaactcactaaaagtcttgattgtcaaactattttcgctcacaagctttgttttttgcagcagatttatggccagaagatgattggcactgctagtacaatctggttattctaa

SEQ ID NO: 10470 - DNA, 1164 bp, Glycine max
  Peptide Sequence Number=SeqID_127248
atgaaagagatctccgatcaatgcaaagaattccacactcagtcaccgagagttgttagtgttaccctgaatttagagcctctcttcaagcgatctcttacgtatttgatcaaagatgattctgatttaggagatgaattggctagttttggaagaaagcatgagtttgctgatgtaacatggtacccaagtcagcagaaggccgtgtatagaattgatgatcgtgtctccgttaatacatctggaaatggcttatacgatttctttccattccgcccgacactctccgctgcattaactgttgtcagagctacagaggagcttcaagaagcaacacgcgatgctaacgggaagtgcgttggtgcaaagttgataacagcaacactgtcaggcattggttatggattgactgacaacggtatctttcttgggtaccctattgttggatttagcaaccggatgcaggcatcagggacatgtttggatagtcgaaatgatggattgttcacagcatgtccatgggactccagaatcaaaggggaattctttcaccaaacagcattcagcattccattgtctgttgtaaagaacttcattgaggatgtgcaaaagcttgttgagttggagccaaagtcactgtgtggcttagaaacagcaaacggaattctcatgcgctatgttacggcttccagtgcttacctcggaaaatcagaggatgctgtggattttgacatcacatactatcgcagtaaagacccattggctcctaggcttttccaagacatacttgaagagatagaacaaattggattgttcaaatatggggggttaccccactggggtaaaaatagaaacttagcatttttaggagcaatcaagaagtatcacaatgcagacaaatttttgaaggttaaagaggagtatgatccacaaggtcttttctctagcctgtggacagaccaaatgcttggacttaaagaaggggtgacaacattcaaggatgggtgtgcgttggaaggaatgtgtatttgctcacaagatagtcactgtgcaccaaagaagggatacttttgcagaccagggagaatttatacggaagcaagggtttgtactcgtgatgttaagaaatccaaagaagcagatgatgtcaaggacgaactatga

SEQ ID NO: 10471 - DNA, 1134 bp, Glycine max
  Peptide Sequence Number=SeqID_127249
atggataaagaaattgaagctttacaaaacaataacacatggatcctcactgaattacctcttgataagaaacttgttggttgcaaatggatttataagattaaaaggaaatctgatggtagcaatgaaagatttaaggctaggttggttgccaaagggtacactcaattagagggtgtggattataatgaaactttttcacttgttgtaaagcttacttctgtttggctagtgcttgccttagctgctacaaaacattggcatttacatcaattagatgttaataatgtgtttttacatggtgatttgatagaagatgtttacatgaaagttcctcctgggtttaccactgctaattatgaactagtttgcaagttccaaaaatctttatatggattaaaacaagcaaataggcaatggaatgctaagcttactgctgccctcatttctttgggtctccatcaatcttcttctgattattctctgtttgtgaagaatcagaattctcatattagcattctcctagtttatgttgatgatgtggttttgactggtaaccatcttgaagaaattaattatgtaaagagttttttggaccaacagtttaggatcaaggatctaggagaacttaaattttttcttggcttagaggtggctcgatccaagtctggaattgttctatctcagcgcaaatatgccttggagttaataaccgatgttggcttgttaggctgcaagcctattttggttcccatgctaatatatttgactaaaaccagacccgatttatgctttgctgtgcaaaaattgagtcaatctagtgacttcaagcttcgagattctagtgatttagatcgggcagcttgcccagaaacaaggaaatctatcactgatttttccatcttctttggttcctctattgtgtcttggaaatcaaagaagcaacctaccatttctagatcatcatcagaggcagagtattggcccttgacaatcactgcctgtgaactccaatggttaagctatttgctcattgatatgcatcaagaaacttctttgtcgattattctatattgtgacaaccaatcaaccatcaaaatagctcgaaatccaatgtttcatgagccagcttaa

SEQ ID NO: 10472 - DNA, 234 bp, Glycine max
  Peptide Sequence Number=SeqID_127250
atggtggacaaggagagtaaatatgctgcatgtgatattctagtaggacctgaatcaataggagaaaaagcaggaacaatggaattagaaacagaaattgtttatgaggtagagacaggaattgaacccgagtctgcagaaattgtttctgaaagaactggggcagaattaggtgtagaattatttgattctgtaggattggttggtaaagaggacaagtccgaaccagtatga

SEQ ID NO: 10473 - DNA, 321 bp, Glycine max
  Peptide Sequence Number=SeqID_127251
atgatggcacatcaaaaccccccatacttagccttttgcactcctgggcaaaatgaaacaaagaacaaaatccaagaatatcagagggagacaaacaaaaacattcacatatttctcaatgaacatcaaggaataaaaggaatggttccacgatcaacgtcgttgctagcgagagaggtctcaagttcaaagcccaaggcgagtgtcctcacgcttcctattcttgaattcaaggaaggcaagcggtccgaggtcatgcaagagcgagtgccattcctacaaaagtgtgagtatgatctcgtcatggagaaaatgctctag

SEQ ID NO: 10474 - DNA, 327 bp, Glycine max
  Peptide Sequence Number=SeqID_127252
atggagccaaaacttcttctcaaacttgactatggagttaggagatggttcccaaatgtggcacagggtgttgactacttcattgagtaccttcagtttacagtgacatccctagttgagttcgaggaagcaccagagtatgtggagtatttcatatggagggtacaacctacaccgccttactaccgttatgtcaagcttgtatatgtcatagagattttgttttcattgtattatttggacttgtcggagtatgtgctagggccaccctatgccagtatggacttcgagcatacagtgactgtaacatcccaacaaaatttctag

SEQ ID NO: 10475 - DNA, 522 bp, Glycine max
  Peptide Sequence Number=SeqID_127253
atggagattggaatcaggagaatggtggtttccttcttatttcgttcgatgcaagtaacttgcaagggaataaggtccctcatggagcagatccattacaacttgtttcattccaagtgcaggatgccaatgcagttcatcaatttgaaaatgcttcagttaatgttggaggtgtcataccctaatttcttccgggaacctttatttttcggcatgcgacctccgtttcaccacttcaaaatgtttaatacccattgtcatggaatccgtaaagttctgggacatttcggaaagaaaacaaccaaaaacacaaaagtgggggtgaacttatcaaacacaacgggtgcactcaggaaaattatccagaacattctaaagggggtgaacttgtcaattatggggtgcattcaggaatcttcctcaagaagcctctgggcggaaaccacctccattttgttaaaaaatggcatccggggcttccgtaaaatttctgaaaaccttgggttagcatatttcacttaa

SEQ ID NO: 10476 - DNA, 345 bp, Glycine max
  Peptide Sequence Number=SeqID_127254
atggaggagcaaaaactcagattcttgctcaagtccaaggctctgaatgtgatgctatatgctctatcagaaaaggagtacaccaagttcataaacaagaactttagcaggacaaaggacccaagagagagaagtcttttgctcttagcagtcaaaattacaaaaaggcatcatcatctagagaataagtctcaaagaagtctaaagttgttaaagttgataactcctctaatgaggaatctgaggaagattctaatgaagaagaacttgccttcatctcatgaaagatttgcaagatgtggaaaaacaaaggtggctttgttagagatagaggaagcaacatga

SEQ ID NO: 10477 - DNA, 1941 bp, Glycine max
  Peptide Sequence Number=SeqID_127255
atgcctagtttctccatcctcactgttgtctttgaaggggtctattttgaaagtgggggagatcgtttattgtttcttttggggaacacagatttacccatatcaaaaccccatgttgaaaacagggacataaccaatagccattggtctggttatagccaccagccacatcttttgcaagatgatcagattttgcttgttcttaggtacactcagacattcaatttgactagcagggctataaagggtgaaattagaagtataagcaaacatgggagcttgaagtactttgatattgtttatatttcttctcagctgagtcggtattccgaatatcagtttagtcttgaattaatgccaagatcttgtaaagataaacacctttgccaagattggaaacaatatgatgcactcacattcagtggctatgagttttgcaaaactatccaaagtatttcagaacctttcaatgttgtcccaaattataagttcactgataggtatgcttaccaaagcaaactaagacctctccaaccaagaaaggaatttggctttgctaactggagattgaaccgtgaagatttcaggcttgtcttagtgtttcctacatccataccagaagacactgcaagagaaagaacaggcctctccaaccttactttgttagctgaggggacatgggattcctcaagtgggaaactatgcatgattgagttttcaggcgatgttgattcagtgttggaagaatgtaactatcatatatctttgtactttccacgagagtactccatcaagcagagaagtctcatgctggggagtatatccagtattgcaaatgaaacaaacatgttcttccctctgcagattaattatgcaccgcatcctgtgcttcttcatttgagtcttgacccatgtggttcttacttatcatataattacacaatgatccagatagcaacgtcaataagaaggagaaatcagccatcaaaattcagacttctcaagcaatcatcactcttgaagtatccagctttggaagatgaacaagatgtacttgctgctcagctacattttctttccacgaatttaagttttgatgcatacgcaatttgcaagcattgctcagacaaacataactcaagggtcttcatccatatggatgtgttttctttaggtccattatttggtccatatgtacccgggctacgtaaagatgatgaagcaaagaaaccagcaggaactgaaaactcgctaatacccaaattctcaatatctcattgcatcttatactcaatgaaggatcttccaatggtttcaaatgtgagcaccaatgttgagcatggcctagattgtctcgtggatgttaaggttcaggataccgagatacttgttgaatcacctcatggtcttcatgataataaacacatgttgaatcccctagaaatcataacaaggcttcttgtgctgattgccttgcttatcactataaggctgtacaataaggttcacattgttggttgtcttgtgctaacaagtctacttgcaattgaaccttctctcagaaacaatttaaggtctctaggcttgatagattttcttcttctgcctggcgtcttcattcgacaagcacataccctttgtgctcaagacttatttctggttcctcaggctcttcagaagtctgtatggcaaagcaaagttaagcctttgaggaaaatgtactatgttggactcacattgctaaggctaatcctcttttcctatgactacatgagagaccctattctagatccttactctgataatggagagttcaacacaatgaggtcaattttctatccaatttatggtatcactggtgcggcagttcccatcattatggttttagttgcaactgttgtccacattcaacaaagcagcaacattcacaaatcattctga

SEQ ID NO: 10478 - DNA, 885 bp, Glycine max
  Peptide Sequence Number=SeqID_127256
atgctttttgtttggcacggctctgttttgcctgcattgcttccgcggttgggattgcttttaattctttctttattggtcacttattttcatggaatcattttctcttttaaagttccgttaaatcctgcaccacttaccctgttcggtttcgtactggctttattcctgggattcaggaacaatgccagctatgataggttctgggaaggaagaaagctgtggggcgctctgctcaatacttccagggcactgacccgccaggccatcacgctgaaaaatataaaggaagatcaggattcagttcacaattttgtgcagttgctgggtgcatttgtttttgcactgaaacatcagctgagaggaacggacgcttatgaagatttaaaatccaggcttaacgaagatcagctgaaacttgttgccgcatcaaaatataagccggctgttattatgcgccttcttgcagaatgggttcagaagctaaaagatgaagggggaatggattctatccagcaagcacgttttgatgaaaactttgataagctttctgatatcttaggaggttgtgaaagaataatttctacccctattccatacagctacagggttttactgcaccggactgtatatatatactgttttctgttgcctttcggacttgtagattctctcggatggtttacccctcttattgttgtatttgttgcgtatacatttgttgcatttgaagcgatagcggatgaaatcgaggagccgttcggaacagatgcgaatgatttagctcttaacagcatgtgtatcatgattgacgagaccattcatgagatggtgggagaacatattgctgtttcccgaaagaatacccagaatattattgattga

SEQ ID NO: 10479 - DNA, 1389 bp, Glycine max
  Peptide Sequence Number=SeqID_127257
atgtcatcacaagtagagctaagcatggattacaagccctacagctactccacactgctgaaatcatatgcagatgaaactgaaactgatcagacccacaagctcgaagagttcctctctcgcttagaggaagagcgtgtcaagattgatgccttcaagcgcgagcttcctctctgcatgcaactcctaaccaacgccgtggaggcttcaagacagcaactacaagccttcagatcgaaccaaggaacaaggccagttcgggaagaattcatgccaataaagcatccaaactctcaagaaagcactgaaaaaacatcaaacatatctgacaaggcgaattggatgacatcagctcaactatggagccaagcaagcgaaggaaccaaaccacaatccacaattacatcaccaaaaaacggtgctgatatgggctttagcgtgagccctaatccagccctagacaacaaacataggaatgggggagcctttttaccattctcaaaagaacgaaactcgtgccaaggattaagggatcttcctgaggtggcccttgcctcttctgagaaagaaatggagaagaagtgtgaattagagtcagagaaatgttccaaaagggaaaattcaggcaaaggatcagggagttgtgaaggggttgtagatcagggaaaaagtgcttcagttgcatctgaggcacaaacaacaaatactaccatcaccaccacaactaacaacactactggccaaactcataggaaagcaagaaggtgttggtcaccggatttgcaccgtcgatttgttaatgctcttcaaatgctcggtggatctcaagtggccaccccaaaacagattagggagctgatgaaggttgacggtttgaccaatgatgaagttaaaagccatctccagaaatataggcttcacactagaagacctagtccaagcctacaaaccggagccccaacaccccagctagtagtctttggaggaatttgggtgccaccggagtatgccagggctgcagcacactctggtggccccaccctctgtggcccacatcctacctcacatgtgccacctccacactactgtgcacccaccccaatgccccaagagttctataactcggctccgtcactgtccttaccgtcaccagcacatgaaaacatccttcaccaccaccattttcacatgtacaagacagcaccacagacccgaagctctccagtgtctgatgttcggagcggtggcgaccggtcggagaccattgaggatgggaagtcggagagtggtagctggaaagcagagaatggagagaagaaagggttggcagcactaagagatcaagaaggggatgagagcactggaagtgagattactcttaaattctag

SEQ ID NO: 10480 - DNA, 192 bp, Glycine max
  Peptide Sequence Number=SeqID_127258
atgaaggccgatatggaggtgtcataccctaatttcgtccggggaccttttcttgatgacatgcaacttttgtttggtccttgcccttccggaacattttggaagttgggttgcttaaggaggaagcaactcggcggcaagctcctccatgtttttgaaaaatggtttccggggcttccgcggcttccgtaa

SEQ ID NO: 10481 - DNA, 366 bp, Glycine max
  Peptide Sequence Number=SeqID_127259
atggcggcttgtattcttggtatattccataaggagatggtgggtacggaggtgttgtattgcaaacctcaaggaatacaagttgaggcctacccttacgttgttacacgtgtggtttgtgcctttgatgatcttgtgtttgacatacatgaggaacaaatggctagaagttttgatggttgtctgtcagttccagaaacaaaagccactaggaaggggcaaaatggtcatttcctagaattttctgacctaaactcgcccaggtcagcatctggctcgcctgggccatgggaaagctttagccttaagcaattagctcgcttgggcaagccaataccttcaagcctaagcaactggctcgcctag

SEQ ID NO: 10482 - DNA, 183 bp, Glycine max
  Peptide Sequence Number=SeqID_127260
atggatttcatgaggaagaagaaaggtccttaccacactaagaacaatccaaataacaacaagaagaggagaaaaaagctttcttttgcacaaggaagaccaaaactcaagctcccaagagaagaatttcctagaaaccaagttgtccagacaactcacgattattatccattaatcccatga

SEQ ID NO: 10483 - DNA, 129 bp, Glycine max
  Peptide Sequence Number=SeqID_127261
atggatgtcttgtgtcttgttggaacaagtgtgaaaccaaccaaacacagagggcgggcaaggaaagcgtcgatcgctgctaggcctaccaaaccatccacgtttggaagaggacgaccccgaaattag

SEQ ID NO: 10484 - DNA, 762 bp, Glycine max
  Peptide Sequence Number=SeqID_127262
atgagcagcatgaaggtagcgaaagggcgtatcctggttggtaaatacgagttgggaaaaacaattggagagggaagctttgccaaggtgaagttcgccaggaacgtccagaacggtaactatgtcgccatcaaaatcctcgaccgtaaacatgtcctccgcctcaacatgatggaacagctcatgaaagaaatatcaaccatgaagttaatcaatcaccccaacgttgttagaatacttgagacgttgctaaaaagggaatgggctcatatttttcttatggctgcaaatggaagacttaaagaagatgaagcaagaaattatttccaacagcttattaatgctgttgattactgccatagtagaggcgtgtatcacagagatttgaagcctgagaatcttctagactcaaatggtgtccttaaagtttcagattttggtttgagtacatactcacagaaagaggatgaactgctccacactgcatgtggaaccccaaattatgttgctcctgaggtacctactttaggtcctagccttgacatggtgcttaatgatagaggttatgttggttctacatctgatatttggtcttgtggagtcattctctttgtacttatggctgggtacttgccttttgatgaaccaactcatatggctctgtacaaaaaaattggcagggcagaattctcttgtccatcatggttttcgccacaggcaaagaaattgctaaaacacattcttgacccaaaccctctaacg

SEQ ID NO: 10485 - DNA, 1692 bp, Glycine max
  Peptide Sequence Number=SeqID_127263
atgaacaccagcgtcaggccgaggctgctgcataggaaaaaagctccaacgctgttgtcacatgaaaaggcagagatgcggggaagctcgcgagggggagaaaataatgctgctaagggtggaaaagcatcgagcaaagacagaaaattggctttgcaacaagatgttgacaggttgaagaagaagcttagccgtgaggagaacatccacagagcattagagagagctttcaacagacctttgggagctttgcctcgtcttcctccctatctccctccttatacactaggacttctggctgaggtggcagtgctggaagaagaaattgttaggcttgaagagcaggttgtgcatttcaggcaggacttgtaccaggaagctgtctacatgtcatcctctaagatgaaacttgagcaatctgcaggtgtgaacaatgcaaacccaactagtagtcccaaactgggtaaattgaagtccctatcccagtcaatggatgatactgcaacatctgaaactaggcctacaacaacacttccaaaggatagacatggaaaagagaaccaatcatgtactagttcttccaagagcagcaagcaatccatatgtaaaggtcaaactacaaaatcgccgattaagaaacttcccattgacaataaatcactgcagaaacgtcgggatcctccaaaaaagcagcaagaactaaggctgaaggaccagccaattgcggaagtaagaaatctacgtgaaaatccacaaggggatgaatgtccaaatataatctctgaaaatattcttaagtgtttatcaaacattatcttgagaatgagtgctgcaaaaaatttggattctacagctgatgtaccaccctttaggactccaaaatctaaaaactgtgtagaaggaagtgagttttgggatccttatagtatctgtttggaatttggaaagagggatagtggtccattcaagcaattacgttcaattgaagctaaatcattcgatccaaaacgaactgcaaagtctttgtttttactgcatcggttgaagcttcttctgagaaaactagcttgtgtcaacatcgagaacctcaaccaccaggagaagcttgccttctggatcaacatctacaattcatgtatgatgaatgcgtacctagaaaagggtataccagagagtcctgaaatggttgttgcgctgatgcacaaggcaacgataaatgtgggtggacacttgctaagtgcaacaactatagaacattgcattttaagacttccttatcactggaaatttacattatcgaagggagggaaaaatcatgaaacttatggactggaattgtcagaacctctagtgacatttgctctatcctgtggaacttggtcctctcctgctgtgagaatttacagagcatctcaggttgagaacgaacttgaaatggcaaaaaaagaatatttgcaggctgcagttggaatttcgatatcaaagttccttatcccgaagttgctggattggtatttactggactttgcaaaagacttggaatcattgctggattggatatgcctccaactaccaagtgatgtggggaaagaagccattaagttccttgagaaaagaaaaaccgagcccctctcacaatatgtacagattatgccatatgagttcaattttagatacttgctttgcacatag

SEQ ID NO: 10486 - DNA, 891 bp, Glycine max
  Peptide Sequence Number=SeqID_127264
atggcccatttttctctctcccctctctcctgtgcaccttctcctctaccaccacgccgccgaatctttctctctcctcctcgagccgccgcatcttccgccaccgacgtcgtttccacttccacttccacttcatcttctgcttcgaatttcgcgcccaaagtcgttgtcaccagagagcgcggcaagaacgccaagcttatcgctgctctggctaaacatgaaatcaattgtttggagcttccactcattgagcacatgcaaggacctgatttagataggcttccttctgtattaggtgacaatgcatttgattgggttgtgataacgtctcctgaggcaggctcagtctttctagaggcatggagggcgagccctggtgcagcggtaaagttgtgccttggtgacttgttggtcatgggttcgaatccggaaacagcctctttgcatatgcaaggagcttctgggatgcctcatgtcaaaataggtgttgttggggctggcactgcaagcattttcaaggaagctttgcagtcttccaaccgatcccttgatattgcctttgtgccatcaaaagcaacaggaaaggttttggctactgagcttcctaagattggaagtaaatgcacggttctctatcctgcttctgcaaaggctagtaatgagattgcaattcctagactagagtgggctatttgtggtctctacctctctgacagattaactgctgcccctaattcaaacttatttgtcagggcctggaagaatcttctttcagattcagagtggaacaattctgttgcgtgcattggtgagacaactgctacaatggcaagaagtttaggtttcacaaatgtgtacttcccaacacaaccaggcatcgaagggtaa

SEQ ID NO: 10487 - DNA, 735 bp, Glycine max
  Peptide Sequence Number=SeqID_127265
atgagaggagagaaggagggcgtcgtggcttgggatatttggaagcgcttattcccggcacgaagaagcaggtcgggttggctcccaaacataagaatgggaaacaacataaacctgtttaagctctgctctggcctcagagtccttggctacttgatgatcctcttgttcggtgctattgttgccctaacttactacgccgtcgttttcatcacatggggccctctcctcttcttcagctcccctctccgcatcccctccttcttcatcctcctcctcttccacaccctcctcctcctcttaacttggtcctacctcatggtccttctcaacgatcccggccccgttcctctcaattggatccatcttggctccgattcggatccaacatcctccccctcttattgttctcgttgccagaatgggaagcctcctcgttgccaccactgctctatttgccaaaggtgcgttctcaagatggaccatcattgcatctgggtcgtcaattgtgttggggcacgtaactacaagtactttctcctcttcttgattgtgtgccttgatgcagttcttaatttagccttcgccctcagtcttctttgtttcgttgtcatgcatgcatctcttctgttaagcaacacaacttcagttgaggttcatgaaaagaaaaaaggagttaggtggatgtacgacctgggctggaagaggaattttgagcagaaacttgggaagtaa

SEQ ID NO: 10488 - DNA, 1494 bp, Glycine max
  Peptide Sequence Number=SeqID_127266
atgactcggctatttcgatccaagtcttgcggactggtcgagttcaacgctgctccacccagtccacttttccatgatgtgaaaagcgaggatgaatacaatgaagaagaggaagaagaagaagaagaagaagaagaagaagaagaagaattggacagtgatgatgatgatgaggatgcagacgaagatgatgatgtttcgagcaaccatgtttcaacgccgttcatgaatccagggtcaaaagggcatggctgccaatcgaaccagtttgcgatattggatattttggtggctgcgttgaagaagtcgttggtaacttgcagtgtggaaagagaggatgtttcttcgttggatattagctggccaacagaggtgcgccatgtctcgcatgttaccttcgataggttcaatggctttctcggtttgccctctgagctcgagcccgaggtttccaagagggttcccagtgccagtgcaaaggtatttggagtttctgcaaagtcaatgcagtgctcttatgatgaaagggggaacagtgtcccaacgattctgctgatgatgcaaaagcgattgtattcagagggaggccttaaagcggaaggaatattccgaattaatgctgataacagccaagaagaatttgtgcgtgatcagctaaacagaggtctggtaccacttggaattgacgttcattgtttatctggtttaataaaggcttggtttagagagcttccaacgggggtacttgattccctcacccccgaacaggtgatgcattgcaacacagaagaggattgcaccaatcttatgaagttgcttccttcaactgaagctgcattgcttgactgggcaatcaatttgatggcagacgttgttgaacatgaacagttcaacaaaatgaatgctcgcaatattgccatggtttttgcgcccaacatgacacagatggcggaccctttgactgcattgattcatgcagtgcaagtgatgaactttctcaagacattgattctgaagacccttcgagaaagagataaatcaattgccaaggcaagacagctttcatcactcttagattctccctcatgcaaaggtgattcccatcctatggaagttaataacaaggaggaatcttgtgatgaagaaacttgtaccccaaagccacctatgaaaagcaagttctcaaggacttctaccttgggaagaatagaatggtgtattgaagagaaactttggagatctgaggaaaagggaaatggagttgttggggaatttgaatctgttttgggtagtagctcaccttctagatatgagaatggtccattagagaataggtatagaggtatatatgacagtgaacattgggtgaaattgagaaatggagtgcgcaggctttgcagacaccctgtatttcaattgagcaagccaactaagaagcgtgcaagtcttggtgttgtaaatactagggaaggaggtggagaggctttggcctaa

SEQ ID NO: 10489 - DNA, 609 bp, Glycine max
  Peptide Sequence Number=SeqID_127267
atggagggacttttccctatcaatgatcccacgaacgttcctaaagtgctcgacatggcaagggatggttatggttcctttgtgatcgaaaccgtactcttcctctgcgtccttgagaagctgcatgaagagtgggtgtttgaaatacatgagtggcaccacgaacctttcttgctcttctccctgccccacttttattgccaaacaccctttgggcactccccgcttgtgaaaacccttctccgccccactagcacccatcactgcaaattaaacagcctagttaatttgtggggttacagacgaatatctcagagactttggagcgttagtcatggcttagacacacaacaaatcgggagagtaacgcattccgaacacaaacacttgacggagggatatataataccacagagtgtgtcactggcttttccactcagttggactccacaccgttcgatcttcctgactatcctcatcaacggatcttttgtggacccaacagagaatacaaaaagtgggttagaatcggatgcaacgctgacctttcttgtgtcactttacgcccgtacgatcaaggacacttgtgctctcatcgggccctcctag

SEQ ID NO: 10490 - DNA, 105 bp, Glycine max
  Peptide Sequence Number=SeqID_127268
atggcttcaaatcccaaacctttgacttttgaggaggtggctaatcacaacaacaaaaaggattgctggattattatcaatggaaagtttctgggattaccatga

SEQ ID NO: 10491 - DNA, 354 bp, Glycine max
  Peptide Sequence Number=SeqID_127269
atgacgtcgtttcaatttgaagtcattttaattttagaaactctatcagcctatccttcttcctcttggagtctcactttacatcgccgctccactggtcaacctctccttccttcctttcatcgtggcgtcatactaccgccaccttccactctgccgatcccagtctccttccttccttctgcttgcaatctcgctctcggtctctcacagcctcaccttctacgttgcagctcgccaatgcccaacctctccttccttcctctcgtcgtagcgttgtgctgccactaccttgttagactcactctcaattcatctgcaacattatccagaatcgcacgcaagtccacctaa

SEQ ID NO: 10492 - DNA, 306 bp, Glycine max
  Peptide Sequence Number=SeqID_127270
atgatcaatataaatgaccaagatgagctagatgccgaagatgcaattcgtgcacttgacaactttcagtttggaaatgaaaaacgaagactgtctgtggagtgggctaggtttgaaacacaagaagatgctataaaagctcttgagtgcacacatatgaggtcagtgatgaatgataaagtcgcagtaagatactggacagagtggtgtctgagggatgatgatgaaaagggtggcagtcctagaggaggggttgaatatggtagacattgcagtcgttctccaatgcgaaggtctagaacttag

SEQ ID NO: 10493 - DNA, 711 bp, Glycine max
  Peptide Sequence Number=SeqID_127271
atgaatcaggaaatgaatggggttgaggcagagagggtgaaagtgaatgtgcatgacaaaatagattatgtgtttaaggtggtggtgataggggactcagctgtgggtaagactcagatactgtcaaggtttgcaaagaatgaattctgctttgactcaaaatctaccattggagttgagttccagacaagaactgtcacaattaatggcaaagtcatcaaagcccagatctgggatactgctggccaagaaaggtacagggcagtgacaagtgcatactacagaggtgcattaggggccatgctggtgtacgacattagtaaaagacagtcgtttgatcatgtggctaggtgggttgacgaactgagagcacacgccgacagttccattgtgatcatgctcattgggaacaaaggtgaccttgtggaccaaagagtggtacatgctgaagatgcagtggagtttgcagaggatcagggcctcttcttctctgagacttcagctctcagtggtgagaatgtggagagtgcctttttcaagttgctggaagagatccatagggttatctcaaagaggtccttggaatgtggtaatgggaaggccaatgcagacaacaatcttgccactcttaaagggtcaaaaatagatgttatctcaggtgctgaattagaaattactgatatgaagaagttgtcttcatgttcttgttaa

SEQ ID NO: 10494 - DNA, 456 bp, Glycine max
  Peptide Sequence Number=SeqID_127272
atgaagggtgaaaggagaaggaatgaggaagaaggagttccacagtggagtgagcaaattgctgatataaagtttcgggtagcccaccaactacaagctcagctgccgaggcaattgggatcttctagttttggccgtatagatggtgattctcttggttctagggtactgcatgtggctacactaccaatgttagcgcggagcttcatgtcattcacaaaggcttggaacatgggttatagaagtgttgaatgtgaatcagattcgcttgtgtctcttaatctgattgtgcaggaaggtgttggccatcatcctatggcagctatcatcatcaacctcattcaatctttcaaaaccagacagtgccaactttcctttaatcatgtttatcgggaggccagcatttgtgccaactccttagctcgtcacgactcatttaagatcgataaatgttag

SEQ ID NO: 10495 - DNA, 444 bp, Glycine max
  Peptide Sequence Number=SeqID_127273
atgggcgtcatcaagtacctgaccatggatgaattaaagatcctaagtatcccctcagaaatgcttaaactctttaaccattctattttccccacaagggacatcgacaaggtccgcgcaccccccatgaacatacacaacatacaacgtataaacgtgggcatcgtcaagtatatgaccatggatgaattaaagcccctaagcatcccctcagaaatgcttaaattctttaaccactctagtttcccacgcaagggacatccgacaaggtcactgcacccctccacgacatacacaacatccaacttttccacgcaagggacatccgacaaggtcactgcacccccccatgaacatacacatgcacatctcaatgcatttccaacatcatcaacattccatttcaatatcattctcaacataaacatcatctcatctcaatga

SEQ ID NO: 10496 - DNA, 354 bp, Glycine max
  Peptide Sequence Number=SeqID_127274
atggagtgtaccttcccgcttgggaccggacctcgtcctttaaccttagttggggctggtgcccaagtggtaacaccactgaagatacttaaccaagcgatacttggtggcaaggcggtgtccaatgtaaagtgtggaagcaatgacttccaagattattttgatgatgccaaagaatcaagagttaagcaagttccaaagaatcaggagtcaaaaagcttcaagaatcaagtttcaaatattcaagattcaaagaacaatcaagtttcaaagaatcaagattcaagaataatcaagattcaagaacaatcaagatcaagattcaagaatcaagagaagactcaatcaagataa

SEQ ID NO: 10497 - DNA, 486 bp, Glycine max
  Peptide Sequence Number=SeqID_127275
atgaaggtgtaccatgatcaaaagctgatacagaagaactttcagcctggacaacaagtgttgttattcaattcaaggctaaggcttttcccaagtaaactcaagtctaaatggtatgggcccttcataattaaagaagtggggccttctggagtagtggagctggtggatcttgcctcaagtgaccctgagagaagctggattgttaatggtcagcgactgaagatctacactggtggccacattgaaagactgaccagcggagttgactctgacactttgacatataagttcctaagcctggacgcaccaccaccaccaccagttgtcccacctctggctgcctccacttcttatggcccttcttcttcctctcagctggagcagctcctccccatgctacaaagccttcaccatggccagtatcttttgatggaagcttgcttgagaagctttcgtggaggctggatttttgagcttcaatga

SEQ ID NO: 10498 - DNA, 264 bp, Glycine max
  Peptide Sequence Number=SeqID_127276
atggcagtgttctttggatccttaaaggtacccatgaacctattgatgattaattatccagataagcacatctcttactctgcagttgtgttttgcagcattattcaaaaggctagtaatgcattagaagttttaaaagaagtcctcgacgctatcgatgcccaacatcctcaggctgctagagatgaattcaccattgaccttgttgaacaatgttcatttcagaagcaaagggtaatgcatcttgtgatggattctcggtaa

SEQ ID NO: 10499 - DNA, 537 bp, Glycine max
  Peptide Sequence Number=SeqID_127277
atgaagctttatgagtttgtagtgatatttggatacttcatgctgattttggctcaaatgccacatattaatctaatgtctttgattccaaatcgcttatttggaatctttaatgccattcccatcgttgccaacacttatggttgcggaatagttccagaaattgaggcaactttagcacccccggtagaagggaaaatgctcaaaggactatgtgtttgttatgttgtagttgcattgagtttctttagcgtagctatctctggctattgggcatttggatatcaagctgcaggcctcatttttagcaactttgtagatgattacagcaagcctttggctcccaagtggcttatttatttgcccaacatttgcacaatagctcaattattagctaatggtgtggttattgctatattagataaaataaagaatgacaagagccaaaacaaggagctgttgggttcatcaccaaatgaggatgacgatgattgggatggtgaagatcctgaagaaggcatcatttatgtggaatag

SEQ ID NO: 10500 - DNA, 450 bp, Glycine max
  Peptide Sequence Number=SeqID_127278
atgacgttgctacttagcaacattcagcccagcgaccgcagtgccaatctccccctgcggaagggtagcgcccacaagacacccagtggactcgaaggagcccaacatggccctggggtttccagctctaattacggggctctatcagacctacagggacacccagtggacccaaagaagtccaatagggtcctggggtttccagctctgattacgggcctctatcatttctacggagtgcctgtcacccacggcaaggtcatcaggtcccctactaatcaagctttcataaagaagtactgcgcccccaggcaggcgcaaagcgaaacacaacagcagcctggggatggccagcaacaggcaacagatgcaccgttgccaccttcagagcccctcagctcatccacaaaaaggttagagtatttcctacgacacatggccgaccaatag

SEQ ID NO: 10501 - DNA, 606 bp, Glycine max
  Peptide Sequence Number=SeqID_127279
atgacgggcgaaaagaccgcgctgagcctgccgctgcggttccagcaagaggaagacgaaccggcgggcgatcgcgcggacgaccgcgggccgcccgccattgcgccgcgccgctacgccgacgccgccagcggactgaccgtcaccgtgccgtcgcccttgcgggtcggccgcgcgccggcgcgcggccgcttcgacgccctgatcgagatctccagccccgacggctttccgccccgggcgcaggacgccaaatacctgtgccgcgtcggcttcgtggccgccccgcccttggcccggggcgccaaggcgcccgccgcgccgacctggcaggcccagctcaaggccgccgaacgccgccagcgccagcgacgcgcgagcatcgaactgtacgaccactacacgctggccggcagcgccggcatcgactacgtggcggcgcccggcgccggtcccggccacgccgacacgctggagtactacgccgagctgccgctgccgcagggccgcgtccgcatggcctgcgccacccagcgcgacgcgatgccggccgccatgacgatgttccggcaggtgcgcgacggcatccggatcgcgccgcgctga

SEQ ID NO: 10502 - DNA, 846 bp, Glycine max
  Peptide Sequence Number=SeqID_127280
atggaaacactgagccacgagcctcttctctatgataactctgctggagagactccgccaagtccaagcacaccattgcagaattcacgggagaagaaacaactatctgttaaggaagaagaagaggaagaaaaggaggcaaaagcagatactttattggatctaaatgcccctggtggtgattctgctattgggtgcagtccagtgctgaatctgatcacgtgtttggacacagatttgtcaagcaccacatcagaaaaccaacatggctcagagccacgagtgttctcttgcaactattgtcagagaaagttctacagttcacaagctcttgggggacaccaaaacgcccacaagagagaaaggtcaattgcaaagagaggtcatcaaagatcaggatcacgtttgatggcctcagctacaacagctttgggaattccctttctccataatcaccttcaccaccactatgccactatggcttctctgcctctccatggtgcttctagtaataataaaccacttggaattcaggctcactccattattcacaagccttcttcttcaaattattctcatttttcattcaatgggtttggaaccacttttggacatcgtggttggtctagaccccttattgatcaacaacctggaatagggaagctaacgatggaaagttttcataaaacatcaagaggcaatgttgggaaattcgatgtggtgaaaacgaccaggcttaattcagcgaccaatgaagaaatcagtggatatatggttagtggtattagtcttttgaagactaatcaagaggaaatgaagcaccttgacttgtccctaaagctctaa

SEQ ID NO: 10503 - DNA, 411 bp, Glycine max
  Peptide Sequence Number=SeqID_127281
atgatggtgaagcttaaagagcaaggacatagagtcctcatatattcccaatttcagcacatgctggacttgcttgaagattactgtacgtacaagaattggcagtatgaaaggattgatggcaaggttggtggagctgaaagacaagttcggatagatcgattcaatgccaaaaattcttcaagattttgctttcttctttctactagagcagggggcctggggataaaccttgcaaccgctgacacacttgagtgttcagcaaaacacactcagctggttctatataaatatacatctgtgacttgcaaaagtggcacaaagaagaaaagtacaatgagcacacctagcctactgcctactaagtacagagtagatacaacaaaagtcaagaaacagtgcagcagctag

SEQ ID NO: 10504 - DNA, 1707 bp, Glycine max
  Peptide Sequence Number=SeqID_127282
atggtagacagcggtggcgttggtgttatacttcgtaacgatgttggtctccttggggatggagtactgtgtgagaaacgtgtcgggtttgtcgtttttgttggcttacattttctgaatctggatgtcggaccaggactccatggtgacggatctgatgaagttgatatggacgccgagatgcttgccagagcactcaaggcacatgaaggcactgtaggagaccgaggtccacacagatcttgttccccgcctagtactgcaggtcatggagcagctgtgccgctgccacaggatttggaagaaggcgtgggtgaaataaaggttcttcaaagtgatacttctttctttgagattaaggaaaaaattgtgacagaagtgcttgcagttcttgatgaaggagttgcaaattttgaatatgttgatgaggctgaggctgcagcagaggaggcagcacaaaaaagagcaatggagacacttaacagttcagaaaggacacattactgggaggagttgttaagagacaagtatcaagagcataaagttgaggagtttaatgccctgggcaaggggaagcgaaaccggaagttgatggtttccgtggaggaggatgaccttgctggtctggaagatgtaagctctgatggtgaagatgacaattatgaagcagagcttactgatggtgattcaaattccactggaactacaactgctagaagaccttataaaaaaaaagcacgtacagatagcacagagccacatcctctaatggaaggtgaaggaaaagcattcagagtccttggttttaatcaaaatcagagggctgcatttgtgcaaattttgatgagctatggaacccttttcttgtctcatattgctgaagatataactgattccgccacattcgcagatggtgttccaaaagaaggactccgaatccaagatgtacttgttaggattgcagtcctgctcttgataagggacaaggtgaagtatgcgtcacaacatcctcaaactccattgttttcagatgacatattattacgctatccaggattgaagggtgcaaagatatggaaggaggagcatgatttggttttgctacgtgctgttttgaaacatgggtatggaaggtggcaagctattgttgatgataaggatctgaagattcaggaggtcatatgtcaggagttgaatcttccctttataaacttaccagttccaggacacgttagttctcaggcacaaaatggtgcaaatttgacaaatgcagaagtacccaacagtcaatccaaggaaaatggtgggagtgatatagcaactgatggtgcacaaggttctggtgatgctaggaaccaagcacagttatatcaagattcgtccatattatatcattttagagacatgcagagaagacaggttgagtttataaaaaagagggttcttctcttggaaaaagggctcaatgctgagtaccagaaagaatactttataacgaaagaacttattagaaaacacgagcaggggagacatgccctccttggtgatccaaaatcaaatgaagcaacaaatgaagaacttaaaagtgaaaccaaggctactaatttcccaagtgataaattaggggacagtgacaccaaaatgattgatcaacttccgcaagtagaaacaatagacaacagaagttacctagtttgcatcagataa

SEQ ID NO: 10505 - DNA, 1560 bp, Glycine max
  Peptide Sequence Number=SeqID_127283
atgaaaatcttgtgtttacttccaccccttaaaggtccccttccagacaattggaggtgccctgaatgtgttagcccacttaatgatattgataagatattagattgtgagatgcggcctactactgctgctgacaatgaagccacaaaattagggtcaaagcaaatttttgtcaaacaatacctcgttaagtggaagggcctatcctatttgcattgcacatgggtgcctgagaaagagtttctgaaagcatttaagactcatcctcgtctaaagaccaaggtgaacaacttccatcaaaaaatggcatctgtcaatacttctgacgaagactttgttgccattcgacccgaatggactacagttgatcgaatacttgcttgcaggggtgatgatgatgagagggaatatcttgtgaagtggaaggagcttccatatgatgaatgctattgggagtttgagtcagatatttctgcatttcagccagaaatcgaaagattcaatagattgcggtctagatccagcaaattttcttccagtaaacaaaaaaacagtgttaaggatgatgctgaattaaagaaacagcagaaagaatttcaacattatgaacaaagtcctgagtttctttcaggtggtacattacatccatatcagcttgaaggcttgaacttcttacgattctcttggtccaagcagactcatgttatacttgctgatgaaatgggacttgccaatgtggcacttggatttttcctaatactccccctcactaacaacacttttgggcttggcaaaaccatacaaagtattgctttcttagcatccctttttaaagagggtgtctccccacatctggtggttgctccactttcaactttgcgaaactgggaacgtgaattcgcaacatgggcacctcaaatgaatgtgctaatgtatgttggatctgcccaagctcgtaatgttataagagagtatgaattttactttccaaagaaactgaagaagatcaagaaaaagaaatctggtcatttaattagtgaaagcaagcaagacaggattaagtttgatgttcttttgacatcatatgaaatgatcaactttgacacaacatcactaaaacctataaaatgggagtgcatgatagttgatgaaggtcaccgtctcaaaaataaggattcaaaattattttcttcattgaagcaatattctagcaaacatcgtgttctcttgacaggaactcctcttcagaacaacttggatgaactttttatgcttatgcacttccttgatgctgggaagtttggaagtttagaggagtttcaggaagagtttaaggatatcaatcaagaggaacaaatttcaaggcttcataaaatgttggccccgcatctcctgagaagagtgaagaaagatgtcatgaaggagctacctcctaaaaaggaacttattctacgtattgaattgagcagcaaacagaaagaatattataaggcaattttgacccgtaattatcagatattaactcgtcgtggcggtgcacaggcaagattgatgctttaa

SEQ ID NO: 10506 - DNA, 2010 bp, Glycine max
  Peptide Sequence Number=SeqID_127284
atggcaggtgtgggagatggcgatttgtacacgcaactatggaagctatgcgcgggacctttggtggatgttcctcgccaaggggagagagttttctacttcccgcagggtcacatggaacaattgcaagcttcgactaatcagggactgaaccaggaaattcctcatttcaatctcccacccaagattctctgccgtgttgtgcacattcagttgttggcggaacaagaaaccgatgaagtttatgctcgtatcactttgcttccagaatccaatcaagaagaaccaacgagtccagacccaagtccacccgagacccagaaacaagtttttcacacttttagtaagatattaactgcttctgatactagcacacatggaggattttcagttctgcggaggcacgctaccgagtgtctgcctcaattggacatgacccaaactactccctctcaggaattggtagcggaggatcttcatgggtttgagtggaagtttaagcatatattcagaggtcaaccaaggaggcacttgcttacaactggctggagtacatttgtcacatccaaaaaactggttgcgggagatgcttttgtgtttttaaggggagagaatggtgaactgagagttggtgtcaggcgtgtagcccggcaacagagtcccatgccttcatctgtgatatcaagccagagtatgcatcttggagtgcttgccactgcctctcatgcatttttgacaagtaccatgtttgtggtttattacaaacctagcatgcctttccatacattcaggactagccagtttattattggtgtaaacaaatatctggaggcagaaaacaataagttttcagttggcatgcgttttaagatgagatttgaggtggaggactcacctgagagaaggttttctggtactattgtcggggttggggatgtatctccaggatggtggaactctcagtggcgttcattgaaggttcaatgggatgaaccggcaataattccaaggccagagagggtttcttcgtgggagatagagccttttgctgcttccactgctttgaatgtcactcaacaactggtgaagagcaaaaggtccaggactgaggtttcatcttctgaaattgctcctaattcccctgctctagcattctggtatcgtggaccacaagaccctacagcattaggtagcagtacagaggtccaaagcaatgaaaatccagttgtatggtctactcgacagaaagaaattaatggcaatcctatgaacagcagctccaaagtccgcgtggaaggaatgcggccttcttccccacattcaaaaccaaacctttttatggaccccaaaaattgcaaagctgtcccagcacaatcaactgtttcatctaggccgaaagatgatttggcacatgatcccatggaatgtgctaaaaggagtagtcagaatcccatgaattgttggatatttggagtaaatttgactaacaatattactaagaatgttacccttccggataaagaacaattgggatgtccagctattattcccagtggtcccaaagattctattcctgttgctgcatgtgaaactgaggctggtcagaatccctattattcactgtccaataaggagcacaagcaaaatatttctgatggatcacccagtgccagtcagagacacaccaggactcggaccaaggtgcaaatgcaaggtattgctgttggtcgtgcagttgaccttaccgtgttaaaagattatgatgatctcatagatgagcttgagaaaatgtttgatattaagggagagcttcaaatgcaaactaagtgggctattacttttactgatgatggaaatgacatgatgctcgttggtgatgatccatggccggagttttgtaccgtggtgaagaggattttcatttgttcaagggaagatgtgaagaagatgaaaagcaagcattcttcttcttcatcagtgggtgaagaaactttgttgagccaagattga

SEQ ID NO: 10507 - DNA, 618 bp, Glycine max
  Peptide Sequence Number=SeqID_127285
atgggtttagaagcagagagagaggagcagaggagcatagcaaggctaccattgttctccatccagtccccagagagatcaggaatggccactcctccacttcacaccttagcatcagtcccatttaggtgggaacaagtgcccggaaaaccaaggccatgcagtgcccttgtgtccttctccaaccccaagtgcttggaactccctcccaggttgttcacaccttctcccgccactgtctttaaggtttccagcaacagatttcggtctccatctttcagaatgagcgccaattgctatggttcggatacaaaggtgcttggtgccatggttctcaccaaagccaatgactacgcctggtttggttcttggagaaaaaaagccttcaaactcaataaaagagaggtcactggtgccagccatgtctttccttcttccactgacaccgacatcccaaacatgaaacaacgctctgccaattctcgcatctggtttgctcgtactctgcgagaaggcaacaaaagtggtgactggcttgcaaagttcggtgccaacttcatagagttcctgcacacttggtcgtcatgcccagcggctctaggacatagttttagctga

SEQ ID NO: 10508 - DNA, 166 bp, Glycine max
  Peptide Sequence Number=SeqID_127286
atgtataacgctagttatgcctttaactaccaagaatccatccccaaggttgacaccataactgttcaaactgaggatgaaccaactattcacatagagcatttcttcgacatcgcttctctagagagcatgggtttgaacctgaatgaaaccatgctttgttgtg

SEQ ID NO: 10509 - DNA, 255 bp, Glycine max
  Peptide Sequence Number=SeqID_127287
atgaagagaagaaaaaaggttgaatcaagacagttagttaaaaaggatgttgccaatgttcaacaagtcctagttgaccttgagaaatctagcacaaaagagaatgaacaggaaaggtcattgtatactccaccaacttcgacaatccaaaaagatgttcctcaaatcaactacattgctcgtggtgcaatcattgagggaaatattcaagagttgttgaatcaagctgtgcagaagcaaaaagaagaaacttga

SEQ ID NO: 10510 - DNA, 468 bp, Glycine max
  Peptide Sequence Number=SeqID_127288
atgagctatcaagctgggcttagcgagaaaggatgcgctaagcgccaacatcattttgttttaaagtcattggaagtgcgcttagcacaagtagtggcgctaagcctgaatcactcactctgcgtgctaagcgtgccatacaaatttcagtttttaaaaagtagaggcagaggcacttgggttgctaccttggcacccaaacctctgaactctttcacccctgagtatttctgtttttgctttgtgcttattgatcctctgcatccttcttgcttctctgcattacaaatccaatttagaagcccattaggggaaatgtggttaaaaagggtggtcaaaacccctaagtatcttatgggattcgcgatgaacatgctaagcgtgcctgctgcgcttagccaattcatcgcaactgttaaaaattttcagatttctgatgattgtgctaagcggaccatgtcgcgctaa

SEQ ID NO: 10511 - DNA, 516 bp, Glycine max
  Peptide Sequence Number=SeqID_127289
atgcgcacagcgcggtctgcgcaccggggcagatatttacctggtcggcgccgaccgtacccagcatcggtgccagccactgtacggcggcggcgcggtcctcgcgggtgccggcgccgacgtggtagctcatcagttcgccctggcccagctgctggcccacgtgctggaagccggcctccatgccctgcgcgaacggcgcgctgcccagcagcggcgggatgttcatgctcaggtccacgcccacctgctgggccaggtcgcgctgcggcggcaggcggtcgcccgggcgcagcacgccgtcatccaccgcctcgcgcacctgctgggcaatctgcaggtacagcgggccggcgccctcgcggaaggggcggacccaggtgcgattggggtgtttcaggcggcggccggcggcaggtggcgtcatcggcgacctcgtacccacagtgtagccgctccacgcccgggcgctgcgcgcaggcgagccggtcaagcgcgcttcttcaacagggttga

SEQ ID NO: 10512 - DNA, 609 bp, Glycine max
  Peptide Sequence Number=SeqID_127290
atgaggctcagagctcatgagcagttccaaaagagagactctggacggggaactcgcttgcctcctctagctatacttctttcttgccataaccgtcctttttctcggaaagacctttactggaacattctcgttcagagtggggctcgtcttgtcattttggtccttcgccatctttgtgttccctttgatgcttgcgggttgtgtcggcaggtcagagggtgcgaacacgcgaccgctacgggtcacaccactcagccccgtgatattagttaccttggccaacaacgagctgatatcggtggctattccgtggcacgattcgactcaccgctatttcattggtacatccagaggaacccgcatgcacgcttcagcagcctgtttcaagtgatagaggtgtcatcctctgcagaggatcctgaggagttacctcctgagcctgttgtggatgctcttgacttacctgaggatgatgaagacccactccttgatgttgattttccagaggatatcatgtcagtatctgaggcagactctacaaaggagagcggccctggagggacagcgaatagtggagactcttcatcaaagcagatggctccttag

SEQ ID NO: 10513 - DNA, 144 bp, Glycine max
  Peptide Sequence Number=SeqID_127291
atggatattaacccagcttacaactgtcttttgggatgcccgtggatccacttggtgggagtcattccctctaaactccaccaaaaactgaagtacatagtagaggggcatctggacattgtgtcagggaaggaagacatcttg

SEQ ID NO: 10514 - DNA, 486 bp, Glycine max
  Peptide Sequence Number=SeqID_127292
atgtcacatcctatcagagcattgtgtcctgacgttcttcagcacaagggagatcagtcagggtcacgctattttgcgagaatgctccaatcatgcgggatcggcacaggcttaaaggagcactcaaaccgggtgacccccaagacctacacttggaagagtccgtcagggcctctccctcctgattcaggtctaacccctaaaatcattttttgcatgcagacactgctcatgaattatacaatacccacgatctcacactcatgtgaaaaagggaggtacaacaagcaaaaaggagcagaaataaaaaaaaaagaaaatcagaagaagcccaagtctagcaaggcgctaagcgcaggacgcgcccaacgcgcaagaaggcaaggcgttaagtgcacgacatgcgctgagcgcgacgtggcgctgagcacgaggcttcgcgctcagcgagactgcgaagacccaagcccaagtttgcacctataa

SEQ ID NO: 10515 - DNA, 2422 bp, Glycine max
  Peptide Sequence Number=SeqID_127293
atggtgttcatatttccaacgcttctgtccatgaagctccaaccacttttgctgcttcttgtgatgtacttctgtgcatttgctgcttcttctgagattgcttcagaagcaaatgctttgttgaagtggaaatccagccttgacaaccaaagtcatgcttctctctcttcatggagtggcaataatccttgcaattggttcggaattgcatgtgatgagttcaattctgtttccaacataaatctttcaaatgttggattaagaggtacgcttcaaaatctcaacttctcattacttccaaacattctcactctaaatatgagtcacaactccttgaatggaactattcctcctcaaattggttccttatccaatctcaacactcttgacttgtccactaataacctctttggtagcattcccaataccattggtaatctctccaaactcttgtttcttaatctttctgacaatgatctctctggtactattccttctgaaatagtacacttggttggccttcatacattgcgcataggtgataataatttcactggatcccttcctcaagaaataggtagattgatgaatctgagaatacttgatattcctcggtccaatatctcagggactatcccaatctcaatagaaaagttaagcattttgtctcatctagatgtcgaaagcaacaacctttctggcaacattccactgagaatttggcatatgaacctaaagcatttgtcatttgctggtaataacttcaacggttccatccccaaagaaattgtgaatttgaggagcatagagactctctggctttggaaaagtgggctttctggctccattcccaaagaaatttggatgctgaggaatctaacatggcttgacatgagccaatccagtttcagcgggtctattcctcgtgatattgggaagttaaggaacctaaagattctacgtatgtgggaaagtggcttgtctggctccatgcccgaagaaatttggacgttgcgtaatttagaacaacttgacatacgcatgtgtaatcttattgggtcctttcctatttcaattggagcactggtcaatctaacacttataaggctacactataacaaactttttggtcacattcctcacgaaattgggaagttggttaacctccaggttctagatctcggaaataataatctttctggcttcattcctcctgaaattggaaatttgtcaaagcttagtgaattatctataaactctaatgaacttactggaccaatcccagtttccataggcaacttggtcaatttggatttcatgaaccttcatgaaaataaactctctgggtccattcctttcaccattggaaatttgtcaaagcttagtgaattatctataaactctaatgaactcactggaccaattccagtttccataggcaacttggtcaatttggacttcatgaaccttcatgaaaataaactctctgggtccattcctttcaccattggaaatttgtcaaagcttagtgtattatctatacacttaaatgaactcactggatcaattccttccactattggaaatttatcaaatgtcaggggattatactttattggaaatgaacttggtggcaagattccaatagaaataagcatgcttactgctctggaaagtttgcagctagctgacaataattttataggccatttacctcaaaacatttgcattggtggaacgttgaaaaatttttctgctcgtaataacaacttcataggcccaattccagtgagtttgaagaattgctccagccttataagagtgaggcttcagggaaaccagctaactggggatataacagatgcttttggtgtacttccaaatttggactacatcgaattgagtgacaataacttttatggtcaactttcatctaactggggaaagtttggtagcctcacaagcctcatgatctccaacaataatttatcaggtgtgataccaccagaactagctggggcaaccaaattacaacgacttcacctgtcttcaaaccatctttcaggaaacattccacatgatttatgtaacttgcccttgtttgatctctcactcgacaacaataatcttacaggaaatgttcccaaagaaatagcatcaatgcagaaacttcaaattttgaagcttggatcaaataaattgtctggcttaatcccaaaacaactaggaaatttgctcaatttattgaacatgagtctgagccaaaataattttcagggaaatattccttcagagcttggcaaactgaaatttcttacgagtcttgatcttggtggaaattctttgagaggaacaataccttcaatgtttggagaattaaaaagcttagaaacactgaatctctctcacaataatctttcag

SEQ ID NO: 10516 - DNA, 129 bp, Glycine max
  Peptide Sequence Number=SeqID_127294
atgtgtttcagtgaagaaaatccaagccgaggtgctgccgtaacgcttccaagacatttccgtgagcaaatccatgaagattttccgtcgttcttcaccgttattcgttcgttctgtggtcttcaatcg

SEQ ID NO: 10517 - DNA, 359 bp, Glycine max
  Peptide Sequence Number=SeqID_127295
ccagcgatagcagcatcactagcggttccctgagattcctccagtttttttcctctaactgctctgatagagttctcaaacgtcagagtgacaaagaagggattgaagcctccactcgtactgtcttgtttcatgaaaatccaacggttaacgaaactgggatcgtagttttactgaggccgttttgggtttctgcgggaaaggaaaaggctacgatgcaaaggtatttctctcagctcaaacatgatatcaaaattcccaacggtgagaatgctcgaaatcgggttacgaacgtggtgctcaaatttcacgacgatccaacggtgaacgagttcgaaattgtcgtttttctgagacag

SEQ ID NO: 10518 - DNA, 192 bp, Glycine max
  Peptide Sequence Number=SeqID_127296
atggcatatcaacttgctacttcaagaaaaattacagtatctttgagaaagaagtggtacatagatagcggatgctcaaaacatatgactggagatgcatcaaattttacacacatatctccaaagaaaagcggacatgccttaagcatagcctgcttagcgttagtcaactatgtgacaaaggctatctag

SEQ ID NO: 10519 - DNA, 249 bp, Glycine max
  Peptide Sequence Number=SeqID_127297
atgacgatgacgattatgacaacaaaggtggtaacatgtgacaatggtcatggtggtggtggagatgacaacaactatcatggtagtggcggtaacaatgatcttgacagtggtatcgacggtcatgattgtgatgatcatagatgcaatattctagggaagaaagtttgccaggcacacccattaaaccaggtttctagagagttattgtcaaatgcaacgaatttggatagcttggactcactttaa

SEQ ID NO: 10520 - DNA, 162 bp, Glycine max
  Peptide Sequence Number=SeqID_127298
atgacgatgacgattatgacaacaaaggtggtaacatgtgacaatggtcatggtggtggtggagatgacaacaactatcatggtagtggcggtaacaatgatcttgacagtggtatcgacggtcatgattgtgatgatcataggcatattcaactcgtctaa

SEQ ID NO: 10521 - DNA, 312 bp, Glycine max
  Peptide Sequence Number=SeqID_127299
atggcccaggttggagagaaaatgaaattgcaactaagtgaactagatgagatccgtttagaagcctatgagatttccaatttctacagggagaagccaaagaagttccatgacagcttgatagctaagagggactttggggtgggacaaaaagttttattgtataactctaggttgggactcatgagtgctaagtggaggtcaaaggggatgggcccttttgtggtgactaatgtttttccttatggtacaattgagttcaaaagtgaatccacagatacaagcttcaaggtaatgggtaattgtttttga

SEQ ID NO: 10522 - DNA, 183 bp, Glycine max
  Peptide Sequence Number=SeqID_127300
atggttggttacttcggtattcctgtcagggatgtcgacaagaataacaatgtagatattgtagttacagtcgtcgaaggtgtggatgcggtgaaccctgagatagtgtttgccactcgacggtcgtcgccaaggaggttgattctcttaatgatggttgtgggcagcaggaggccagagatt

SEQ ID NO: 10523 - DNA, 525 bp, Glycine max
  Peptide Sequence Number=SeqID_127301
atgaattctttaacgctatttctctccttttgcttgatcctcattaccaattctccttcgctgacaaatgctaatggttctgacctaatttcccaaatttgcaaggcctcagtaaaccaaaaagaatgcacggacatcctgacagcttatcctagaattatgcatgcaaataacttttttgaacttgcagaggccatcttgcagttgtccttatacaaggcaatagaaggacagaagtttcttaggacattgatgaagtcagaaaatgttccagccattgcacaatgtgcaaactctgactatgaaagtgtgattacagcgtataagagtgctctaagcaagttgaaagacgatcctaaaactgctaagcattatgccagagatgctggtaatggtcctgtttcctgtgagacagccttggctgctacaactgtttattttaactttgaaatttctaatcttaacatccaaatggggtcgcttagctatattgcaaccctagccatagataaacttattatttag

SEQ ID NO: 10524 - DNA, 372 bp, Glycine max
  Peptide Sequence Number=SeqID_127302
atggtagtgggaaatgcaactatagaaaaacctagaaaagaatgggatgatgatgaaagaagaaaggttcaatacaatttaaaggctaaaaatataatcacttctgcatcaagcatggatgaatattttagagtctcaaatttaacggcaattgcaaaatcaagagatatcactaatatgtctcttgccactctctttggaaaacttcaagaacatgaaatggaacttatgagactccatcaacatgaagagaatgataaaaagaggaacggaatagcactcaaagcctcatcatcttctattcaagaagaaaatgacaaagaggacttgactgaaatagaagaagatgatgatttcagattttttgtgtag

SEQ ID NO: 10525 - DNA, 723 bp, Glycine max
  Peptide Sequence Number=SeqID_127303
atggccatgccggaagggtgtggtgaaggggttttccttgcaaaccttcccggtgatgcttttagtctatgggggaacttctttgaggcaaagaaacaaatgatggctgatgccaaggtcggcggtgctgggttatggccccgtgctaagttacggattggttggccccctcctcccccccgtgatcagttttgttgccaggaaattaacaacaaaacttgcgccccgttggctaagtcacccccctacaagtggagcatcacgccatcacctggcaagacacaaggtcacacgcacacacacacacacacactcacgcaggcacaagggggaggaggggctggtcgggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 10526 - DNA, 1408 bp, Glycine max
  Peptide Sequence Number=SeqID_127304
gcggtaatccgaggacgccccagttgaagttcggcgtcatcgcctgcccgttgatcgggtcggccgcccgccgcgcccgccagaacgatgtaggaaaacgtcagcagcagcatcagcgacgaggtcaccgaggtcatcggccccagcagttttgcgccgctgttggagatgtaggtcgagaaggcgaacaggaagatgctgatgatcgccgtggtcagcggggtaaacacgtagtcatagcccaggaacgcgtaagaagcgtaggcgatgacgcgcggcagcagcgcggcataaacgccggcctcggagttgcggttgagcgagacgaactcggcgatgatcaggcaaaagggaatgaagccaaacttgccgatggtgtttctgttcgacgcagccatagagattctccgaatggtgtaggggacttcgcggtgagcctggtggttttcgaagatcgccacgttgcctttgccgacccggcgtctctcgccttcgccgctgaaaaactcgcggtcggtttcgtcctgatagggcgctaccgtcgtcagcgcccgtttgtcggcgacctcgacggtctcttccccctcaaggtaatagtgcacatcgaagtagcggcggttgccctccagccaaccgtgctggcggccggcgccgacgctcagccgatacgtcagcgagtcgccgatcgaatggcacacgttcgggctgatgcgatcgacattggcgatcgcctccatgcagcgcagccacttcttgccgctcgtgaaaccgtagctgaacggcgccagatagacccggtgggtatccagcacttcggagccccaggagttggagccgaggccgaggatctggtcgtccaggttcagcgtcaggcagtcgctcggtgccagctcgttgatgtgctgggcctggtgcagcatctcggcgctgtagggccacaggctgaaattgatcggccgccgcggctggatgaagatccccttgcccgccgcgtcctgcaaactcagccagcgcacgtcctgccgattgccgttgtcctgcgggaacggatagtgttcgaacagcgcgtcggcgcgctgccggtagtggccaatcaggttggcccggcagctgtcacggtagttctcgcccggcccgcggccgtagtattccacctgctcgaagcggcggctgatgccgaaatcgaggccgattttcgggataatctggcggaaatcgccgtaaggctcaccggccagatccaggctgacgtagccctgcggggagatgcgccagcggtaggtgcagcgcatgccgaagtcgaacaccggcggcgcgatcaggctatgtacctcgatcagcagatcctcgccctgccattgccgattgaggcggcggaagtgctgctgcatgatggggaagtgatgcg

SEQ ID NO: 10527 - DNA, 138 bp, Glycine max
  Peptide Sequence Number=SeqID_127305
atggaggttgaggaaccctggcaagggttactgctaccattgcattatcaagaatggcagtcgcagcatgggtttcaccatcattctcaccctcttcatttgccccagttttcgcattcatcaaagcacgatgattag

SEQ ID NO: 10528 - DNA, 692 bp, Glycine max
  Peptide Sequence Number=SeqID_127306
atgtttatccgctacctcggttcggatttgcagtatcgaagcaatcgcggcctggacgcctggggttatgacttcgacctcaactacagcgccgtacagctgggtggcaatttgctgcgcgccgatggcgctgaaaatagcgtacgtggcggcgtcgcctatacgcgcggcaacacgcgcattcgcccgcatgccgctgacgggtacagctccaccagctttgatagcgatacgttgtcactttatggcacctggctgagcagcagtggctggtatgtggatggttcgctgagctggagcggctaccgtggcgaaaccgacattgcgcggcagaaagcggtcgctaaacccaaagggcacggctggacggcgtcagtcgagtctggctatccgctgatgctggccggtgatgtgcgcctggaaccgcaggcacaggttagctggctgcgtatgaacatggacagttttaccgatgctgacggcgcgcgcgtctcttttaacgattacgatcaaaccataggccggctcggcgcacgcgtggcgcgcagctggcaggacagcagtcagaaccagtacacgccgtatctgcgcgctgactactatcgcggctggggcggtacggcgcaggccagggtcggcaccagcgacagcgacctgagccagagcttcagcagcggcaaatttggccagat

SEQ ID NO: 10529 - DNA, 951 bp, Glycine max
  Peptide Sequence Number=SeqID_127307
atggtttccttggagcacaggtgtgacgatcgaattcataagattcaaacaattaaaatgatggaaggaatcctcatttgtgtggctcctcattgtctcaagtctttcttgaagaaagctgattttgaatctcatatccaagacagccacggcagccttcttcgacccaatgcagataaagaagatggaaatgagtcggaggcacagagtgttaggcaatcaacggcttcagattccactgctcgcggtccccaaagaccagttttttctcctggttcaaattcccagcaacatgatctggaagacaaatctcgtagacagacacacctagagagcaaccaaagccaccatattatgggctttcatctacaaaattttgacatgcagcatcccccacaagatccttcccagtttgctgacagacaacaggaagttggtccagaggccccatttctcgggtatccagcaatgcaccctgcaaaaacttccaatgttcccttgctggttacttcaaacccaatgccggaccctcccatgacatttggctatcccccttacccaaacgaacgagctcagccattttacggtgctccctatgatatgcctaggcaggactcaggttctgatgtaggtggggaccagagttcattactgggtttcccacaaggtgtcccaaatggcccaaattttccaggaaattatccccagccatggaattcaggaatgggtggtgtgccttttgaacaagcacagggtggtatggttgtggatccaagggagggcaaaggtatattggcaccacagcccatgcccctcccaccgccacctccccctccatcccacatgtcatatgggaaacagaactactattctggagagcttgggcatgatggtcagagttatggggggtggcagcatgatacccgtgatagctttggtagccaaggctag

SEQ ID NO: 10530 - DNA, 204 bp, Glycine max
  Peptide Sequence Number=SeqID_127308
atgatcccagacgacgactcatccctcttccatcgctccctcctgacccttttcctaattgcaccaccctcaccttcctctccctcaccttttgctaagccccctacgcgagtgcttctaggtgcacccagcattattgctggtgcacccagcactaaccacgaaaagacagaaataccccttacggatcaagttgatccgtaa

SEQ ID NO: 10531 - DNA, 273 bp, Glycine max
  Peptide Sequence Number=SeqID_127309
atgacgattttccaaccacggatctcagcgccttcaggcgcaagacctctcaaagtggtgagagtttggtggaaaactcggagcagtggaccgagattctctcctgggagccaagagcgttcatctatcacaattgtctgtgctaaatctataatgttgtgtgcctgcatccatatcagggaaaattgtggagttcaaattgaaatttctgctatacttgattcaacaggttccttagttgagtttgcttgtgaagtggaaataacagagtag

SEQ ID NO: 10532 - DNA, 270 bp, Glycine max
  Peptide Sequence Number=SeqID_127310
atgaggtatgtcaaggatattcattcggcaagcggttcagggataagggaatgccccacgttatttccaagatacacatgcaacaatgaagatttagaaatttatgcaaaattgatcatgcatgcacccatgtggacactcaaacatcaagtttgtggtcatgtgacactaagatgcccttttatcaatttatgtattcacccgagtccgtttaggcattcggaaaaacttccacagctttcacccttcaggattagaaacagtttgtaa

SEQ ID NO: 10533 - DNA, 1756 bp, Glycine max
  Peptide Sequence Number=SeqID_127311
tccagaggcatgtgcagcaatcttgtggaagaccgccaaagcttctccaaaggctgctgagaaattgaagattactgccactgaattgtgcaaattacaaattgcagacggtgttatacctgagccacttggtggtgcacatgcagatccagagtggacctctcaacagataaaaaaggctatcaaagaaaccatggatgaactcacgaagatgaacacagaagaactgttaaaacatcgcatgcttaagttcagaaagattggtggattccaggaaggtattcctatagatcccaagagaaaagccaacatgaagaagagggatctatctattgctaagattcctgatgctgaactagaagttgaggttgagaaactgaagcaacaggttttggaagctaaggaatcttctcctgttcctccaaaactagatctggatgagatgctaaagcaactggcaagggaggtcggtctagaatactctgaggcagttaaagccacgggcttgacagacagtttgctgaaactaagggaggaagtttcaaaagcaaatgcagatagtcaaattgttgatccattgctgaaggataagatagaaaagctaagggtggagtttgaacagcaattgcgtgcagctcccaattatggtaggctgcagaataagtttaagtatctgagcgaattatgtaaagtaaagcttctttcagatgcaaacaaggacaatcaggctgtcacctttaagcaagagttggagaaaaaagttgataatgccttgagtgatccaaaaataagggaaacatttgaagcattaaaggctgaaattaaaggtgctggtgcatcctcggcaagtgatttggatgacgagttgaagaagaaaatcgttgggtttatgatagaactaaaagaagtaaaagaagtaaaagaagtaatagaaaatcaaattgaaagtttggtaaactcatcggatgatattaagagcaagatactgcaattgaaattggagcttcctaaggctggagagacgcctgattcagaatcaaataatagaattggtcgtttgtttgtgattgaaaattttcaatgtcttgttaagatggacgaagatcaatggatgtatgataatataatgtctgaaaaagtttatatgaataaacaaaatgaagatgaagttggtgtgaatgaagaacatgttgattgttttgatgcgttcaatacttttcaagtgtttgctactcgagatgatgttctacattgggctcgatctgttgcttatgaaattggatttgtggcagtgattatgaggagtggtcagtataggtctacgaaaaaagattttgtaaaaatagatgctgacaataggaaatgtggatgttcctttaagcttcgtgagaaaccagtggttggaggccaagggttatctgaattcgaggttagcataacagaagagatggaaaccatatccaagcggtttgaagaacttgatgccaattccaaatgtgctcagaagaaaccaatgaccaaacatcaaagatcaacaaagcgtgatccgtcttattgggaatatgttgatgctttaaattttgtgcaaaatagtaattctttagtcaaacgtaatacatcatcatctgaccaagcaattccaagaaggactatgccgatattggatttcattcgtgcattcatgattccattgaaaacattatcgatgtcaaagctaacggtaactgtggatatcgtgcaattgttgtcttattag

SEQ ID NO: 10534 - DNA, 483 bp, Glycine max
  Peptide Sequence Number=SeqID_127312
atgtctgatggtgtttgttggatgtctcacggtggccaccgtgcagttagagagttcgagctgatttcttgttttttcgaacatatccgatggggtcccgttgttgtcatacaccgaccaaagaaggttgtgatgcattttaggtatgttcatactactcctccacactctctggattcaagattacgtttagaagatattgacaacggatggatgcacttctctaagtaccttgcaccggtgggtcagatttgtgttgtgcctgagcaatgtgcgttagactacatcgactggttctacatgatttcgcatcccttcatgaggccggcacagcctggggatctagttagacatccacctatcatgcagatgacacgtatgtggaaccagatattcctcagtacctggtggcgacaacagctatggagggagcacatgcacatgcaccttctcatgtggagtagcctcaacatgaagtggtaa

SEQ ID NO: 10535 - DNA, 1110 bp, Glycine max
  Peptide Sequence Number=SeqID_127313
atgaagaatgcttttctccatggagatgttgaagaagatgtttatatggatatcccactgggctatatgccctcttccagaaccaaggtgcatcggcaaggaaaggtaactactctaaatgtttatgtagatgacatgattattactggagatgacaccgaagaaatttcaagactacaagagcaattggtagctgagtttgaaatgaagaatttgggtggactcaagtatattttgggaatagaggtgacaaggtcacaaagaggtattttcttgtctcaaagaaagtatgtgttggacttattgactgaggtggggttgctcgactacaaactagcagatactccaataatccaaaatcacaaactttctcaatacacaaaccaagtgcccgcagataaaggaagataccaaaaattggtggggaaacttatctatttattgcatactcaccctgatattgcctatgctgtaagtatgaataatcacttgagtgttgaagggtacaccgatgcagattcaacacggaatgttctagacagaaaatccacatcaggatacttcacattcgtgggagggaatttagttacatggagaagtaaaaagcaaaaagtagtggccttatccagtgctgaagctgagtttaggggcatgggtaaaggtctttgtgaactattatggctcaaaaggttaccaatggagattggctttggtcctagcatggagatgaacctattctgtgacgataaagctacaattgatatctcacaaaatcctatccatcatgatcgaacaaagcacatggaagtagatagtcatttcatcaagcaaaatcttgaggagaagatcattcgattttcgtttgtcaagtcggaagaccaattggtagacattcttacaaaggcagtgtccagtaagaacttccgtgaattacttgacaagcttgctgatattgaaggaagaaacatcacttttgaggatcttaaaaagcctccaccagggtatcctcgaaactacaacattttcctcaaggcctttgaggccatggaaatggctaatactggtttcaaggaccagttcctcctagaagaagaagaagaaggaaattga

SEQ ID NO: 10536 - DNA, 471 bp, Glycine max
  Peptide Sequence Number=SeqID_127314
atgaatacatacattcacactttcattttggttatgaatttcccatccaatctctttgccaaagctgagttagagagagcattaccaaaaaggtttttggaaagagtgaagaataggggagtggcgcacactggttggtttcagcagcatcttgtactgaaacactctagtgtggaatgccatataggccatggtggctttaattccgtgattgaagctctggccagtgattgtgaactggtgcttttgcctttcaaggcaggtatagaggtgaattataggagtgaagatgtggactttaagaaagaggatatactgaaggcagtaaaaactatcatggtggaggatgataaagagctagggaagcaaataaaagaaaaccacatgaaatggaaggagtttttatcgaataaaggaattcagaacaaattcatcactggtctggttgcccagttgaaggctatggcttag

SEQ ID NO: 10537 - DNA, 255 bp, Glycine max
  Peptide Sequence Number=SeqID_127315
atgtcaatgtctgttactcaggcaataaaaatattttctgatgtacgccctccgggaatctataaacctgagtacattgatgcattatatgcattttatcatgaaaaaaagcctgaaatgatagtttgtcctcctacccccaagtggaagagaactcctgagcttgttgatctcaatggtgaagcaatgccagatgatgacgatgatgatggagtgccaggctctcctttgcatgtatggataatattgaagtga

SEQ ID NO: 10538 - DNA, 603 bp, Glycine max
  Peptide Sequence Number=SeqID_127316
atgagggcagcattgggtagtccacgcttcttatttatgtataggtgcttgtttgaggtcctgaggcttattctatcattcactgtcatccaatgtgatctatttgagcacttgaatgtggctatttctcaactccacccaaatagttcgacaatgatgaatttgatggaaaagattggttgggtctccttgaacaatatgtccaacaagttgttcaaacctattgaccctcgtggagagggtggacaaggtcatcttggagctaccggccttattggacgcgcgggtcattctatctcttcccttggcgagcgacccctttgctaccttggatggtattatgggggtcaacctattattgaggttggccctgttgttattggtaccactgagattgcttccaatacccgttcctctgtattggctaagaggaatgagcaagatgtgcctttagctccaccagccatcgttgttgatgttgttgctacgcttgtaggcctaggatcttcttcatcaatggattcctttgcttcttggaagatgaatggcagtggaatggagaaaggaagagagagaggagacgccacttcaaggagaagatga

SEQ ID NO: 10539 - DNA, 408 bp, Glycine max
  Peptide Sequence Number=SeqID_127317
atgggaccttgcacatgtggtatgtttcacagccaaatcaccagctcctttgccatgttcttctccatgcccaaccacaaaccaccaccctacaatgattctgacaacatttatgactattcttccttcgctccctcttcctcttcttccgttgactgcaccctctccctcggtaccccttccacctacttctctgaagacgaagaaaaacgaagccgccacgaacgttgtttcgtctctaacttctgccgggacttactacaatccaaacacaacaaccctcaatcccattccaagtcctcccaaaccaccaacaccaccgatcctctcctcgttcgccgttgcgccaattgtgataccacttctactcctctcgagagaaatggcccccgtggccctaaggattaa

SEQ ID NO: 10540 - DNA, 246 bp, Glycine max
  Peptide Sequence Number=SeqID_127318
atgggttcaaagaaccaaagaaatgatgaaaaacgaggtgtgattggtggtggttgggtgggtggtagtggtggaacagattcaggatggcttggggttgtaggaagtggttcagagctgattggtagaggtagactcagagtggcagcttgtgcttgtggatggtatgtgggatgtttgaaatgctttgtggtgaggttaagcaacaggtggtggtggtggtggtggtgcagcaacagctcctag

SEQ ID NO: 10541 - DNA, 147 bp, Glycine max
  Peptide Sequence Number=SeqID_127319
atggagatcagcaaggttagagggaaggagccttggtcgtggacaccaaatgttaacttctctagaccagtggactggagaagttggggacaacccatcccttgtgctcaggaatccttacaactcaagagaccctcggtcccttaa

SEQ ID NO: 10542 - DNA, 105 bp, Glycine max
  Peptide Sequence Number=SeqID_127320
atggcgatggtggtgccttcatcacttcattttcaaccgaagcttatcaaattggctttggagcacctagatgttgaagaaggccttggagcatcaacggattga

SEQ ID NO: 10543 - DNA, 2010 bp, Glycine max
  Peptide Sequence Number=SeqID_127321
atgaagtttatgaaacttggatctcgttcggacaccttttacactgcagagtctacgattgatgatgtatcagctttaggtgagacaatctcttctgaagtttcaagtgacctcataattcaagtgaaaggaactagatacctacttcacaagtttccactattgtccaaatgtttgcgcctgcaaaggttatgctcagagagttctgattctccacagcaccaaatagtccaactccctgattttccgggtggggtggaagcatttgagctgtgtgccaagttctgctatggcataaccatcactctcagtgcttacaacattgtggccgcgcgaagcgcggccgagtacttgcagatgactgaggatgttgagaaggggaatttgatttacaagcttgatgttttcttcaactcttgcatcctcaatggctggaaggattccattgtgactctccaaaccacaaaggcattgcctttgtggtcagaggatttgacagtttccagcagatgcattgaggccattgcctcaaaggccttaagccacccctcaaaggtgagtttgtcacacagccattcccggagattgaggaatgatgtgtcttcatacaacgaaaccgaaagcctgagacacaaatcaacaagcaagggatggtgggctgaggatttagcagatttgagcatagacttgtattggagaaccatgatggctatcaaatctggtggcaagacaccctcaaatctcattggtgatgcattgaaaatttatgcatctagatggctaccaaatataaggaagaatgtgcataatgtcaagagggagactgaatcagactcagattcagattctgctagtgaagtgaattcaaagcataggctgcttttggaatcaatagtgagcttgcttccagcagagaaaggtgctgtttcttgcagcttcctttttaagctcttgaaggctgctaatattctcaatgcctctgcttcttctaaagtggaattggccacaagagtaggacttcaattggaggaagcaacggttaacgatcttctgatacgctcggtgtctaagagtactaatgatatgatgtatgaagtggacttggtgatgaccatattggaacagttcatgttgcaaggtcagagtcctccaaccagccctccaagatcaaggttggccgtcgaaagaaggcggtctcgttccgcggagaatattaacttcgagtttcaagagagtaggaggtcctcctcagcttctcatagctcaaaacttaaggtggcaaagcttgtggataggtaccttcaagaggtggccagggatgtgaatttggctctctcaaaattcattgctattgctgaaactataccagattttgcaaggcatgaccatgatgatctgtacagagctattgacatttacctcaagaattactgcattttgtacatgctagaaataaataatggccaacatagaggggttcccggggggactctggttgaacatgtttcagtggcacatccagaactcagcaagagtgaaaggaagagactatgtagaattttagactgcaaaaaactgtcaatggaagcatgcatgcatgcagcacagaatgagcttcttcccctaagagttgtagtccaagttctcttctttgagcaagcaagagcagcagctgctggaggcaaagtgagtgacatgccaagcaacatcaaggcattgctcacagctcatggcattgacccttcaaagcacacagcaccattgagcaccacgactagtattcatgctgatgacaattggagtgtttctggattcaagtcaccaaagtcaacaactaggaaccctaccctcagaatgaagctagctgaggatgacttggatgaaaatgttgtgccccgtgatgagattggaagaacttctaaatttaagggtcttggtcttcccactcagcccaaacgaatgtttagcaaattgtgggctacaaacagaagtgccactgaaaagaattga

SEQ ID NO: 10544 - DNA, 186 bp, Glycine max
  Peptide Sequence Number=SeqID_127322
atggtggtggtggcaacaacagtggggacgacgaccatcaaggtggtggttgttgatgatggtgaggcgaaggtggtggcggttgatgatagtagtggtagcgacgataattatggttgtggttctagtagtgatcaaggtggtggcagtgacaatcaacactactacaaaatggggcttctatga

SEQ ID NO: 10545 - DNA, 134 bp, Glycine max
  Peptide Sequence Number=SeqID_127323
atggtcatacagtacttgatttgggatgcggttggggatcattggccttgtacattgccaagaagtacgctaactgcagggttacagggatcagctagtccacaactcaaaaggcttattggggaaaagtgccg

SEQ ID NO: 10546 - DNA, 219 bp, Glycine max
  Peptide Sequence Number=SeqID_127324
atgggctatgaagcagagatgcacaacataagggtggccatagccattaacaatcacgacattaacatggtgatggattctctccacagcttcttcctacatgtcaccaccgaagctactggaccctatcattgcccatcccatgagaagtatgcaccctatgtggcatggctagctggctttggggataatgtcaatgctgaccagggaggtgtctag

SEQ ID NO: 10547 - DNA, 312 bp, Glycine max
  Peptide Sequence Number=SeqID_127325
atgaaagtagcccaacagctattttgctatatgagtagtgggggcaatccaactggctcagcgtggcgttcattaagaccaaaatcttgggcggaatacgtggttctattgaccagcatgaaaaggtgcaatattaatgagaattcctttattttatggcaccagagattaggacatatctccattgagaggattaaaagattaatgacagcggaatggagaaggaggaaaggtgattggagacgtcacttcaaggaaaagatgagtcaagaacaagctcaccatcacaggaagccatggataagagcttga

SEQ ID NO: 10548 - DNA, 204 bp, Glycine max
  Peptide Sequence Number=SeqID_127326
atggataagagcttgaaggtaggagaagatgaatggagggagaaggagagaaggggcacgaaatttatgtctcaaatgagggacacaattacttttggtgcaaatcaacatccttgtacaaagagtccttcaataagtgatgatgatgatggcgaagaacatgataatgataaggaggaacatagctctcaaccaaaaaaataa

SEQ ID NO: 10549 - DNA, 483 bp, Glycine max
  Peptide Sequence Number=SeqID_127327
atgactaacttgagcgcaatatgtcctttcttgccctttactttcttcttcgtaaaatggacacattcaaaggcaatagtagcattatatgtgatcattctatttggcacaaaggcacaatggatttcatcaacagtaggaggcaaaatatgttttatcctattagcaattgttttcatgagaatcttaaaaatcaagttgcaaattaggctaataggtctaaattcacttggttgggatggattcttttaccttggggatcaaagcaataagagtctttttgagatgtgtgggatcctccctatcattcagaactctaagaagaagactcgtgacatcctctccaacgacatgtactactacaaagtaaggctttctacatcggttattcgagccattctacatcggttttcaaccgtcgtcgtagtgaacgctgtaaaaaggggaagccttttctacgacggtcgaaaacgaccatcttag

SEQ ID NO: 10550 - DNA, 228 bp, Glycine max
  Peptide Sequence Number=SeqID_127328
atgggtgctcaattccatatggagtgtccaaaagctacttgcctaaatggcatgaataagcacaggccccaatttggtacatacccactaaccattacttcaaaaagctttcttactacaaacataagttgtgcacacgctccaattacattttcatcaattccactgcaaagctgccacatcgaagacaaaggaaataattataggtttgagcaaggtcaaggataa

SEQ ID NO: 10551 - DNA, 357 bp, Glycine max
  Peptide Sequence Number=SeqID_127329
atggtgcctaaatgccagaatctgatatggaaggcttgccaccaaatcctaccagccaaacaaagtctggttaaaaaaggaattaatgttgatcctttgtgcccatggtgcatgatggaggaagagtctatagaacatgaggaggaacacataggtctttttgcaaatggagcttcagttaaagcaagtcttggagatggcaagtggcttgggatcaaacagaaaacacaagaatggaagacagaagccaaccatcaagtttggagaccccctccaagctctcaaataaaattcaacttggatgcttcaatcaaggctagaattggcacatgttttggtcgtatatcacgacaatga

SEQ ID NO: 10552 - DNA, 297 bp, Glycine max
  Peptide Sequence Number=SeqID_127330
atgaccgtcgaccctccatccccaattgcaagacatgtgaagtggaaaatgactcgaacaaagcaatataggtttgttcctgatggtcgtgccgacatattgaatactgtgcttggccggttggagcatcctggtcatgattcacacaataatgtgttgaaaccagttggacctgttgaaaggtgcaatacagttgctggagacgatccattgggagaattgatgaagatcttgtttatggatgactggagtacaagcttaggtcatggtttagtgtatagtttccttgagccttag

SEQ ID NO: 10553 - DNA, 384 bp, Glycine max
  Peptide Sequence Number=SeqID_127331
atgggggagacacatgaagtaccccgagaccatactctggccaactttgagcctcacctcagatatgccactgaggggaaaacatttggtggtgtacccctgccaaacactttggggggccctcagtatcgcccacaaccacaactacaacccttacattttgcgatgggaagactgcctcctgccatggtggaaagcgaaaaattcgatcatataaaagaaaggctgagggccattgaaggaagtagagactgcccttttgtcgacatggcgaaactatgcctagtgcccgacgtcatcattcctccgaagttcaaggtgtcagattttgacaaatacaaggggactacttgccccaagaatcacttgaagatgtattgctag

SEQ ID NO: 10554 - DNA, 189 bp, Glycine max
  Peptide Sequence Number=SeqID_127332
atggtggcattattccacgacatggtgcataaggagattgagagaggaataaaggtggatctagacaaggtaaaggcgatcctcgagatgcccgagccacgtaccgagaagcaagtccggggtttcctggggaggttgaactacatcgcaagatttgatgcaatcctaccccgcaacggcattggttag

SEQ ID NO: 10555 - DNA, 384 bp, Glycine max
  Peptide Sequence Number=SeqID_127333
atgaatggaacaagggagttgatagacaaggttgcaacaaaaaacgggtgttattgtgtctgtcccgacttcttcaatggggacccttttgatcctaagaatgagaacatgcctttacctgtttggttaaaagatcatgaaccagaaaaaggtattgaaacaacaaaacctgttattgaagccttaaaaagggaaggtgcttctactattggagctgctgctcaccttaggtataacctcacagaatctatactaacatttactttacaatttactgagtatgcaagtgatgataaatcttgctgcgaaaaggttggacttggatctcctcgaaaggtgacacggagtggctggttagtttgctttctcaactgccctttttaa

SEQ ID NO: 10556 - DNA, 468 bp, Glycine max
  Peptide Sequence Number=SeqID_127334
atgtgcaaaagggagcgggaatccttcaaagaatatgcccagagatggagggatttggcagctcaagtagcgcccccaatgatggagagggaaataatcacaatgataatagacagtttacctatgttctactatgagaagatggtgggatacatgccctcaacttttgcagatctgatttcccccctgcccaacactcctccaaccaagaatgcccaatcaaccacaaagacttccccaacatcacccacaaaatacattccctacacaacccagaccgagtgtaaaccaaaaccccaatacaaacaccaacccaaggaggaacatcctagagataaaactcgtggagttcaccccaatcccaatgtcgtatgccaacttgctaccatccttgctcagcaaccaaatggccatagtgagcccaagaaaggtctatcaacctccatttccctaatgatacaatcctaa

SEQ ID NO: 10557 - DNA, 330 bp, Glycine max
  Peptide Sequence Number=SeqID_127335
atgaggttgcagcgcgtcacgactaatgtcgacagtgttgttgcaatgcctcgagaggttccaatgccatcgatgaccgagttacagtgccacgagaggttgcaaattagagtgccaaagcgttcgagtaagagtggtcagaatgagagtgggagtgatgagagtgagaggattcaaacgttctctaaggttgaaccacacaaacctcttaacttcaatattttctctgataccttgtcatcactactacaaatggtgcattttacgacgcacattctaagatggttatttggaaccgtcttagaatgtgacgcggtggcaaacttgtaa

SEQ ID NO: 10558 - DNA, 750 bp, Glycine max
  Peptide Sequence Number=SeqID_127336
atggcgacaagaacgctgctgaagctaaagccaaacctcaaacttccgttacgtttcttccgcaaccccactctggccctgacccgacccgttgtcccgcttacccgacccgttttcccgcttgcccgacccgaatccccctcgctcgccctcttcaaacccttcaccgttcagttcccgggcatgatcgcaaggcaaatggccactgcgaggtcgccacgtggcgcctcaaaaaggaacgaggagaaggaggaggacggcggcgacgacgatgatgatggtggtgctgattttgacgacgaggatgggttcgatcttgacgaagagttcgacggttccgatgaaagtgacggttttgatgacgaggaagaagaagagaaacccaagggaaagaagaagagatgcactctgtctcctccgtcgcacggttctgcgtcgacaacgcctggtccacctgctcctgtttcggcggcgacagaggctgcgtgtggtgtggatagacggcgtcgaagcggcggggaagtgacagatctggcatgcgaagacaaagagcgcattaaagaggaggaggatgaaaaagagtttgcatcaaaacgacgtcattctaaatcaccgcacagagttatgaacagtgaaaggatttgcgggaatggcgaggtgggtttcatggaggagaagaagttgcaggcggctggaggtggtggaagggagagcgacgagagagaaggaagcgatgggacaactctataa

SEQ ID NO: 10559 - DNA, 183 bp, Glycine max
  Peptide Sequence Number=SeqID_127337
atgatagtgaccccgcctgagaaatgggatgccattacacgcaagagcagtgacatgtcattgtccatggtggtaaagctcttaattattgatgaagtccatctactcaatgatgataaaggtcctgtgatagaggctctagttgccaggaccctacggcagacattggcttatgacagctag

SEQ ID NO: 10560 - DNA, 609 bp, Glycine max
  Peptide Sequence Number=SeqID_127338
atgtcgtccctgttgcatccaaataagaacaagcatgtcaagctttcaaatctgtgctcaaacagtcacatcatggaccacaaccaccacaacaacaacagggtgccaagaatccatgcattcttatcaccaacaccgccttctcctcccatgctttccttcattgctgctctttccatcacaacactaatcttcatgtgcctctacgttttgtcacccattgtttccgtggccattcttctagccctttacatcaccaccctcttcctttgcaggttcatgcaagataggagagaattgagagaaagaacctcttttcatgcacaaacaccacaaaataaccaaagggtagtgagggttttcaataagcttttttgggttgttgaggaaaaaaggggtggcaagaggcaacaagttaagaagctgttaggatgtgtattgtgttttggaagccaagcaatggcatcatcatgtagttgtcccatcgcttccttctctctcgtcgctctcccttccaccacctccagccgcctgcaacttcttctcctccatgaaacccacctcgccattcccgcaaatcctttcactgttcataactctgtgcggtga

SEQ ID NO: 10561 - DNA, 354 bp, Glycine max
  Peptide Sequence Number=SeqID_127339
atggaaaacgacactagtttccctctcatccccaacgtgttctccggcttcaactccctcgtggcctccgcggcatgtggctccctctccgtggcacgtgtcttaacggggcagtttaaccccactaatggcattggcttggccaacactagcttagccttcttcgggaatcgtctcttcgcgcttgccgaatctgacctcccttacgccgttaacgtaacccctgacggcgacatcgacaggctcggccgtcacgactttgacgaaaaactcacgttcagcatgacggcgcaccctaagatagacctcgacacagtggagtgcttcgccttccgttacggccccgtgccatga

SEQ ID NO: 10562 - DNA, 258 bp, Glycine max
  Peptide Sequence Number=SeqID_127340
atgcctgaggagagtgaagaggtgcaagctttgaaagctgagctcgaaaagacaagagtggcgaaggagaagttgaaggtggcagtcactagggttaggaaagaatgttatgagctgaaagatatcaacatgatcgcggatgaagcactagagcaggaaatgaagaaggtgaacctagctgctaatcacgggcagatgctagaagatgaacaggcaaaggtgtcggccttgtgggttgaaagggaagcgagagaaggg

SEQ ID NO: 10563 - DNA, 222 bp, Glycine max
  Peptide Sequence Number=SeqID_127341
atgaatgtaagtagcgcttgctcatcttcaatggacaaaatagtgcgactgtggcatttgtctagcaagtcttgtctgaaagttttttcccacggtgactatggtatttatcttggactgattggaaagaggatttctactccctcaggtgcaatatatgttggccttgaaacgcattatgttccatctggaaagttaagtttatttaaggatgccctgtag

SEQ ID NO: 10564 - DNA, 280 bp, Glycine max
  Peptide Sequence Number=SeqID_127342
atggtatctaatcgaaggggacaaggtggtcgtggaaaccaaggaggacgagctggaagaggaggtcaccctcaatgttcttactctaaaactgccaaggaatctctaacatcatctactataagtggtcataactccactgcctacatttcccaatctggtaataatcaaagtccatggataattgattcaggtgcttctaatcacattgctgcaacaggaatcggccatgtatcatccacttcttctttgtctttaaactctgttttgctcatacctg

SEQ ID NO: 10565 - DNA, 867 bp, Glycine max
  Peptide Sequence Number=SeqID_127343
atggctgagaagacccaccacttcacattacttgatggggagatgattatcgatacattgccagattcaaaaaagcaggaaaggagatacctcatatatgatctgatggcagtcaatggagtatcagtaatagagcgaccattttatgaacggtggaagatgcttgagaaagaagtgattgaacccaggaatcaggaacggttccagagcagaaatccttactatagatatgacatggagccattccgggtgaggagaaaagatttttggttgctctctactgtcacaaagcttttaagcgaattcataccaaaactctcacatgatgcagatggtctcatatttcagggttgggacgatccttacatacctcgcactcatgaaggcctcttaaagtggaaatatgctgatctaaattcagttgattttctctttgaggtgattgataacgattgtcagctgctttttctgtatgaacgtggaaaaaagaaactcatggaagggtacagggttgcatttgaagaaggttcgaatcccttgcattattctggaaagatcattgagtgttcttgggattctgatagacaggaatggatattcaagcgaatcagaacagataaatcaactccaaatgactttaatacttatagaaaggtgatgcgaagtataagagacaatatcacagaggatatcctgttgaatgaaataagtgagataattcgccttcccatgtatgcagacaggataagaattgatagcaaagccaatcaccacaccaacatgtcacggcgaaggtgtaaacaagatcaaatgtatctattgatgtctgcccgtggccatcatccaaaggttcctcacattatgtaa

SEQ ID NO: 10566 - DNA, 261 bp, Glycine max
  Peptide Sequence Number=SeqID_127344
atgacaaatgatgatgttttgggtgatgagattcctaatgatcagcaagatgcatttcgtcagttctgctttcaaacactcaaactaggtgttgggcaagtgaatatggaccaagtcacacaacagcttgaagccattttgcagacagcaaatcaatcaaccctgcaacaggaaatgagaggagaataccaaggtggcatgatggagaacaggggacctagtcacacaatagagaagacccaagttgcaccatgcagctaa

SEQ ID NO: 10567 - DNA, 321 bp, Glycine max
  Peptide Sequence Number=SeqID_127345
atgacgctgattttggttgttggttttgggagaattgcgttggtggaaaaatcatggcagtttatgcgacccaacgggaacgtgttcatggggcgaaggcagaagcaattaaagaggaagaaaatgggagatgctggacgcagaagacattgtgcagcgcttctgttgtgtctagtcactggtgcatgcggtgttgaagccacaaagtgtgattccaatgtgagtgtttccaaggtgaagaagggaggggttattgaagagtatcaacaatacgaggagagcggggacgccaaattagggctgagatggatgaatccatga

SEQ ID NO: 10568 - DNA, 627 bp, Glycine max
  Peptide Sequence Number=SeqID_127346
atggaatgctttatcctgaaagcagtcatagagaggcttcatcttttaaatttagtgtttgaagacttcccaaatggactcaagcaaaagagagaaaatcaagtcactgtcaaaccatgtctagtaattaaagtttctggtattggagtgttaacaaaatctgcatctgatggcatatctccttcaccccctgaagttcaaattccatccgatcatacttctccattgcctgatactctgaactctcaagattcttcaagctttggaggaacttgcagcaagaacgaaaagagtggtgttgctccagaccaatatgttggttgcaacaataatgatgcttcttggtgttctgaagaagtttctgagagtaaagcagagcagttatatttaagtgaatctggaagtgtgtcagaaataactactgatggcaatttgagcagtctaccatctgaagaagacatgtttaagcaacattttggtagcttatcaaatacacacaaggtaaagtcgagtaattcattagttagaaggttttctgcaggatatattgtgcaatgggattgcaagaaactgtttagcagtcctgttaggaataaaggtgcaactcatactgtatcagaagaatga

SEQ ID NO: 10569 - DNA, 198 bp, Glycine max
  Peptide Sequence Number=SeqID_127347
atgaaccacaaaggaatccgctcctttgtgttcaatgattacaaccaagaagttatgcccacttcttgcaatgaacccaaaagcgtgatcaaccaagaagcaaatcatgcttcttgcaatgaacccaaggaacgttggtcccttgtgtttagtgttcaaccaagaagaccttctcttgaaaacagtcaccaagagtag

SEQ ID NO: 10570 - DNA, 198 bp, Glycine max
  Peptide Sequence Number=SeqID_127348
atggccaatagttttggtgatgttcggggtagtggtggtgtcaataatggtgatgtcgatagcaccaacgacaacaatggtgatcacggtttcattgttctagtagtggtggtgatagtgttggtggtggtacatggtggtaccaatagcgatgttgatggcattagtgtttatgacgacgacaacaacaataattaa

SEQ ID NO: 10571 - DNA, 1320 bp, Glycine max
  Peptide Sequence Number=SeqID_127349
atggcgtcaatacttgctaggccattcttttgtcatcttaacggaccatcgcagcctgaaggaattgatacggggaaggccaatgtggcaactgatgccttatctcgaataccagaagtcacctcgggaaaattgttggcatttaccatacctcacttagtgtttatggaggatctgaagaatgagcttcatcgtcatcctgcatacctggaactacgatatagtattactgacactcttgacacttactctaattttagcctcactgaatttcattccacacccattggtgggcatatgggcattgctaaaacactggcacgggtgtctcagaatttcacatggccaggtatcaaagatgatgtgcgcaacttcatccttcactgtctgcactgccaacagaccaaatacgatcatcagaaaagtccaggcttactctgtcccttgccagttccgatgagaccgtgggaagatttgtcattagacttcattggaggattaccatcctttcgagggtactctgttattctggttgtagtggatcgcttatcgaaaggaatccatttaggaatacttccacccaatcatacagcctccaccgtagctcatctcttcttggatatcgtatcggatggccagactgaggtgttgaacaaagtcatcgagcagtatttaagatccttcgtccatcaacaaccatcatcatggggaaaattcattctttgggcagaatggtcttacaatacttccattcattctgccacagggatgacgccatatgagattacctttgggaagctgccactgtctattccccattaccttcctgacactaagaggcaagaaatgcagttcaaggttggagatatggttttggtcaaactccgaccatggcgtcaaaccaccgttactggcgtggttcagtcgaaactgggcaaacgatattatgggccattttgtgtgctggagaagataggcccagtggcttgtcgcttagagctaccctcagattctcgaatacaccctgtattccattgttcacttctcaagccttttcattcgaatcatgctatccccacccctgttgatggccttccaaacacttcaatagataatgagcccattatcactcccctggttattttggcaacaaaatgggcctcgactgataatgggcctgaattattggcgctggtacaatggcgtggtctacttccagaagacacctcgtgggagtcttggactcagctaaaagaagaataccaccttgaggacaaggtgcttctcgatgtggcgggggatgttatgaaacaaccatag

SEQ ID NO: 10572 - DNA, 2226 bp, Glycine max
  Peptide Sequence Number=SeqID_127350
atggccgacaacactcgctccaagtccaacttggattgtatggaggaggcaattgccaaattggcctctactcagctccatgttacctcgaagcttgacgaaattattcatcgccttacgacactcgagtccagccaccaagcttcttcctcatctttaccttcctctgccaatcaacattcacccacagcctcaattactcaccttcctcgcatgaagctggatgtgcctcgtttcgatggctcggacccttctgggtggtgcttcaagattacccaattctttgagtaccactcaatgccagaggcgaacgattgctcatcgcctcgttcgtcattgaaggctcggctctcgcttggtttcagtggctctcccggaacggtcaactttccacttggtccgtcttcttgcgcgcgattgaggcccgatttgcctcttctcaatatgaggatcctatcactcttcttttacctttcccaattcgaacatcttgccattcggattgtgggtctccctccatccttcctgttgagttgcttcgtctctggcctcgctcctaatgtccgccgcgaggtccaagcccttcagccactgaccttgactcaggcagcaggactcgcgcgactccaggaggagaaactcatcaccccacgctgtcctcccattggccgacccctgaccttacccactgcgcccctttcaccaccctcacctacctccttgttaccctcacccacaaaactcactaaatctcccccacccgtggtgcatcgtctgtcccccaaggaaatcacccttaggcgtgaaaaaggcttgtgttttaactacgacgagaagttctccagaggccataagtgttcctcacggttcttccttctcgtcgccgaggacgataggcctggaaccctagctactgacccctcttttgaacccattgcaatgccccaaccccaacccgaatcacctgacccgccccaagcccaaattagtttctatgccctgtcgggtcatttggcgcctgagacactccgcttgttgggttgtgtcgcacaccactcaatcaccatcttgattgatggccttcgtcgaattattcaaaataacggtgctagcgccttcttccatattcgaatccttgaccctgaccttccttcaaaccaaccaaacaccacttcccaccctgagcttacccagatcctcaccaaatactcatccctcttccaaacaccaaccacattgcccccttcccgaaacaccaatcacgctattcatctcctcccaaattcaaacccaattaatgtcaggccctaccgctatccgtattttcagaaacaagaaattgaaactcaagtagcttctatgcttcagaatggcatcatcaggcccaacacgagccctttttcctcaccagttttattggtcaaaaaacgcgatggcacttggcgtttctgtgtagattacagggccctaaatgccattacggtcaaggatcattttaccattcccaccattgatgaattgttgaacgaacttggtggtgcacgttggttctccaagctcgacttattacagggatatcatcagatattgatgaagccggaagatgtggacaaaacggcctttcgaactcatcatggccactacgagttcctcgttatgccctttggcctgtgcaatgtgccatcgtcattccaagctacaatgaacaatgccttcagtccttacttgaggaagtttatcttcttcgacgatatactcatttatagctcatccctgtctgaacacatgaatcacttggaacatgcttttgaggtgcttctggccggaggattcttcctcaaactctcaaagtgttcatttgctcaaaatcagattgaatacttggggcatatagtttcacatgcagatgttcaccttgtgccagctaaaattgaagccattcgtgattaccctacaccgtattcgatcatagctctgcgcaccttcttaggattgtcgggattctatcaacgttttattcagggttatgctttaatcgttgctcctttaacaaaacttttggccaaggatcaatttcagtggactcctacagctcagcaagcgttcgacaaactcaagactgccctgtgcagtgctccgatattgggcttgcctgatttttctcaaccctttacggttgagacgaacacatcaagggttggaatgggcgcagtgctctctcagtag

SEQ ID NO: 10573 - DNA, 215 bp, Glycine max
  Peptide Sequence Number=SeqID_127351
cccatgagcacgaaatctaccctaaggctcatgagaatcctagggtcctctcctgcatctctggcccaatctacttggagtcttctatccaatgcccttgcggggttggaattcgcacgcggtggcgagactataggcatggtgggatggtggactaccaacatgtgattcctgctcatgctgatgttgctcggaggaagaatgttatgtcctag

SEQ ID NO: 10574 - DNA, 204 bp, Glycine max
  Peptide Sequence Number=SeqID_127352
atggattcaacactactcttgtctgccacaagaatctccttgaccactcataaactgccagctcagcgatggtttcctatagagtggctcgtgttgtgttctgtcatagataaaggtggtttcatggatctggatcacgaggatgttatgattatagtgcctccaattttcgctccaaaagatgtgccagaaaatttagtgtaa

SEQ ID NO: 10575 - DNA, 234 bp, Glycine max
  Peptide Sequence Number=SeqID_127353
atgtattgttatcatttcacattacctactcagaggaggggcatgactaatgacaatgatgataataatgattttagtggtcgtggtaacggtgacaatgatggtcaaaatgataatgatgatcatgatggggttgtgatgtttatcatgcacaaatgtcctctttacatcaacaaatggggtcgacgtagtgatactacaacaattggagtaaaaccgactcgatatgattga

SEQ ID NO: 10576 - DNA, 405 bp, Glycine max
  Peptide Sequence Number=SeqID_127354
atggcaaagattttgggtggattgatgagaagtggtattttttctaggtatagagtggggaatgaacaggtagaggtggcttttttgcaatttgcaaatggtacactattctttgttgaagctaatataaacaatgttatggaaaccaaggctatgttgggatgttacgaatttatctttgacttgaaggttaatttctataagagttgcttggcaggtatgcggaaatgcttaattgtgttgggtatgagacttccgtttctagatcttgtcattcctattaggggaaatactaggaatgaggattctctgtggttgagggacctaactaggatatgtggtgagggcacaaagcatccttggtttgaagaagtaggaatagtggaggcaagatacacgggttag

SEQ ID NO: 10577 - DNA, 303 bp, Glycine max
  Peptide Sequence Number=SeqID_127355
atggagaaagaggagagcacggaacagcgaaagcaagcgaagcttgccattatggagctcgccaacatgataagtgctcccatggcgctaaacatcgtcgttcgcctcaacgtcaccaatgtcctctggcaaggcgacaccaacaaccccttctccgccgccgagatcctccccgcatccttcccgacggcggcgacgatgccatcgagaacctccaatggcttctccgcatgctggctagttacgacgtcttctacgagcacctctctgcaaaagctatccccattctatattttcttctga

SEQ ID NO: 10578 - DNA, 455 bp, Glycine max
  Peptide Sequence Number=SeqID_127356
gaaaccttacaaacctaaaagaagaaaaacctattctaatatttatagagaaaagcggacccaaccttggcccatgggctcagaaatctaccctgagggaggattgcatcacacctattggtagatttcttgagtaccgaattaatcgactcagcaagattggtggtcatttgcccccatcgttagccaccatcccatgcgagaatccaattttcttgtggaacctcgctgagccaattaatttcttggttaaaaagaggatcagtagttgggctaagcacgcatccatcgctaagcgcagcttcaacgcgcttagcgcgacagaagaatctggcagagcattaatctcaaggccgcacgctaaacgcgagatcaatgcgctaagcgcaactgttgtctttagccaggctcagcgcatgactggcgctaagctcaaatccacttactcgtgctaa

SEQ ID NO: 10579 - DNA, 435 bp, Glycine max
  Peptide Sequence Number=SeqID_127357
atgtgtatctccggaacatcttaccggagaggaacatggagctcgctgaaggaatgttcaatgaattttacggagagctccagcggagccagtggcactaggtactcacaaaactcccggagaagcaaattgacgtggctcttgtcaaggagttctattccaacatctacgacccagaggatggagctccaaaatattgcaagagaagactatccgacatactcccaatacctgcacatatacccggatcaccaagccattgcggcaaagttatgcacacccggaggaggatttgtcttgaatgccaatggggccccttggaagctattacagaaggatctcgctaggcttgctcaaacatggagcatactttcttattttaaccttgcccctagttctcatacttctgatctcaatgttgatagggctaggtga

SEQ ID NO: 10580 - DNA, 720 bp, Glycine max
  Peptide Sequence Number=SeqID_127358
atggtacctcttgttctgaactttgaagccctttttgcaaagaatcatgacaagaaaagcattttgcttggaaatgaatggcttgaagtgaatgaaattgctgtaaggataattgtaatggcggctttcttgttgcaactccatctcctgcagctaacatggtcaacaagaaaggctgatacaaaacagaaggacctttggattgctgagaagaaggttttgcatgtgatttttactctatatgcagtagggatcttgattgcgttgcttgtgcaccaaaacaacaccttgcatggtgatgtggtttattcatctagcctttcacaacaacactcattttgggagcacttgaaatcttgttcaggtttggtattagatgactttctcttgcctcaaattctgcttaacatattcatgaattccaaagggaatgctctttcttgttcattttactttggaactagtttggtcagactaattccccatgcatatgatctctttgaggctcttgcttatgttgatggttcatgcttatatgcggatgagattgcagactattactccactgcttgggatataatcattcctttggtaagcctgatgtttgcctcaattatccatttccaacaacggtttggtggttgcagcattctttcttggagaatcaagaccaagggtgtagaagaatatgaaaaagtgcctatggtgactgaagcatag

SEQ ID NO: 10581 - DNA, 246 bp, Glycine max
  Peptide Sequence Number=SeqID_127359
atgttggttccacaaaggcaggcgtcagttcaagtagtggagtatgaatcacaacaaagaaagaaaaagttagcttgtctgaaagacatcatggtacgatatgaaaaggagagattaaaagccaaaaaagatgtagaaaatagcaaaaatatgaaaaaggaaggcccaacccaagatgcacttagcgcacagcacgtgcttagtgcgaaaacacacgttggcgctaagcgagaagagtcgcgctaa

SEQ ID NO: 10582 - DNA, 1212 bp, Glycine max
  Peptide Sequence Number=SeqID_127360
atgaaggaagagtatcaggcactgatgagaaatcagacctggacactggtgaaaccatctgaatcaaggaaacctataggctgcaagtgggtttttcgtgtcaaagagaattctgatggctctctcaacaagtataaggccagattggtggccaaaggcttccatcagcagactagaagtgatttcactaaaaccttctcacctgttgtaaaacctgttactgtcagaatagttttgactcttgctgtcactcacaagtggaccatccaacaaatagatgtgaacaatgccttcctcaatggcactcttgaggaggaagtgtttatgcagcagccacctggatttgagtcttctgacaagtcccttgtgtgcaaattaaataaggcaatttatggattaaaacaggcccctagggcctggtttgacaagctcaaaaatgccctcattcagcaaggttttctggccagtaaatgtgatcccagtctctttcttctgcatcatggaaaacttcagattattatgttggtgtatgtggatgatatcatcatcacaggaaattctacttcatttattacagctttgatcaaacatctaaatgatgttttctgtctcaaacagctaggaaaattagactattttcttcgcattgaagtcacacatttgcctaatggttccctactactctcacaaagcaaatacatcactgatttactggctaaggtgaatatgacaagtgcaaatgacccagatgacaagcgatccacctctggtgcttgtgtgtttctaggccctaatttggtatcctggtggtctaaaaagcagcaattagttgcccaatctagtgctgaagcagagtatcgcagcatggcacatctggctgcagaattgttatgggtgcagacattgctcagggagttgcactgcccttttcagacccctaaagtattgtgtgacaatctgagcactgtgactcttgctcacaatccagtcctccataatagaaccaagcatatggagctggacattttctttgtgagagaaaaagttctcaacaaaagtcttgtcgtggctcatgtccctgctcaagaccagtgggctgatgcccttaccaaacctctatctgcaaataagtttcttccactgtgttctaagctaagagtttttgacaaacatagtttgcttggactaccctcagcttcaaagggggaatga

SEQ ID NO: 10583 - DNA, 1272 bp, Glycine max
  Peptide Sequence Number=SeqID_127361
atggttccaaattcaaaccccaatgagtccaagttcaaagacttcccacatggtcaattccaagttggttactaccttggtggtgacaaaattgttggtgctgacaccttccagaaactgagacagaaacaagttacccttcgaataaagagtgtgtatgaaactgatgtctctggcttactcaaagttggagctaccttgttaataagaagtgccagctcctattaccgtgtgggaaacttcacacgtggcaaaagattgaagaaccgtaagcgtttcccaagttcaataatgtttagtcttgatgggttctgggcagaatcttcagggaggctttgcatggttggaacaggaagtggctatagcatgcaacttttggaggttgttctcaagctttataatgttgtcaattcgagtaatactatttctaccttggttattggaagcttggagagcttgagttctaagaatgagctgagttattttgaacccattttgctgtttatttttcctaaaatggattatgaatatagtttggatactatggaaacaaaaaatgagtattctgatgaaggtgaagtagtaccgggtttatccattaatccgtcctattggggggatgccaaccaattgccttatattgtgtctttgaaagaactggtttgtttagatgttaagcaaagggtgatagaattgattgggtttcgcaatagtggtgatagatggtctttcaatcctaacactacattagttggagaagggtggtgggatgaggaaaagaaccaattgtctatagttggttgccatttcttgggaatggaagactcaatggctagtgttcatgtgggttatttcaagagggtggttttaagaaaatttgggggccaaagagttcaaatttcaggcacacaatatgagtatagccaacttgacaaagtgagaaagatgtgcctaagacaagaacctctaaagaacaaggaaataaggtatccagatgtttattcttctgacatgagatttgacatctacacactcccacctatttctccaaactctaacagcactagcttgttcaaagttatagtcatgtttcagttcccaccgcttgatgcaaagaacaatggaggttacattaaaggtagtattgaaagtatgcgggaaaagtccaatcctctttacttcaaacagttggatgtgatttcagctgcattttacacagcagaagcatcacaaatcttgaagaaaatagatatggaggtcatagtgattctg

SEQ ID NO: 10584 - DNA, 1653 bp, Glycine max
  Peptide Sequence Number=SeqID_127362
atggattctctttttccttcttcgcaagtgaagctccctcatcttatctctgtcaagcttgatgataagaatttcaagcaatggaagcaacaaattgatggtgttattcgtggccacaggctgcaacgatttgtcactgtaccggtgattccaccaccgccgtcgtctggttctgattcgtcccttcacgatgccaattctagtgaatcactggtttcgattggcgatctcgttcctctccgtaacctaattgagattgtgcttgatgcactgcctgaggaatacgactccattgtcgccgccgtcaacagcaaagaagaagtcggttcacttgacgaacttgagtcgtcactgctggcacatgaatcgcgattggaaaagcatcgtaaagctgttctcactgagccggtgatggtcaatttgactcaggcttcgaaaccgtcgtcgtcggctacttctgatcaatccagcgctggcactgacgcttttccacagggaacaagccatgtaactgccaatgctgagaatcatggctatggctcacgtggtggacgttctaaccatggaggtggtcgttttggccatggaggtggtcgttttggcaaaactcagtgtcaaatttgccataaatctggacatgatgcgtccatttgttattatcgttactccaattctgctgctgcgatgtatcagcctcaaagagctccctttaatcccttcttgatgccatcacgacctatgtatcaacctccctttagctatgctgctccacgagctgcttctcctcgtgcacctcagccacaggtgcgtcccatcatgttactcctgatccaagtctttatgggaaacggccaaggtttgtccattcactctattggttctatgccttttcctttaccaaactatcctcacatgtcactcactttacagaatctcttactcgtgcctcacatcactaaaaatctcatgagtgttagcaaatttgctcaggacaataaggcttcttctgaagttctactacgtggtctggtgagagctgatggtctctacaaatttcttattcctgcctcacaaatttccaagtctccaccaagtctcaactcttgcatagctgagtcttccaataagtgtagtagtagttctttatgtagttctgtagccaatgaaaatgattcatacaattgtatctctctatgtactacagacttattcatgaataaagataattcaatgtgttccaattttccttctctcaatgctactacttatgactctttatcatctcagcatgtgaataactctctgtctatagcaaccaacaaatatgttttgtggcattctcgtttaggtcatcctcatcaccatgctctcactgaggtgttcaaactttgtcatctccctgttccttctaaaccacctgcagaactatgttcagcctgttgcttaggcaaatcccacagacttcctacatcattatctgccactgtctacagtcaaccttttgagctggttgtttgtgatctatggggtccagctcccatgcagtccttaggaggttatagctatttcctaacttgtgttgatgccttctctcgatttgtgtgggttttccctcttagacttaagtctgatactctccctcaatttatgtag

SEQ ID NO: 10585 - DNA, 1308 bp, Glycine max
  Peptide Sequence Number=SeqID_127363
atgagtctgagccaaaataattttcagggaaatattccttcagagcttggcaaactgaaatttcttacgagtcttgatcttggtggaaattcattgagaggaacaataccttcaatgtttggagaattaaaaagcttagaaacactgaatctctctcacaataatctttcaggtaatctctctagcttcgatgatatgacgagcttgacatctattgatatatcatacaaccggtttgagggtccacttccaaacattctagccttccacaatgctaaaattgaagcattgagaaataataaaggcttgtgtggcaatgtcactggcttggagccttgctcaacatcaatctcgtatcatttatgccaaacctcaacgaaaaaagaagaccaggctacaaatatacaaactcctaacatatttgcaatatggaattttgatggcaaaatggttttcgagaatattattgaagccacagaagattttgacgacaaacatctcattggtgttggagggcaaggatgtgtttacaaagcagtgctgcctacaggtcaagttgttgctgtgaagaaactccattcagttccaaatggagagatgctcaatctgaaagctttcacatgtgagatccaagctttgacagaaattcgacatcgtaacattgtaaagttatatgggttttgttcacattcacaattctcatttttggtgtgtgaattcctggagaatggcagtgttgagaagactctgaaggatgatggacaagcaatggcatttgattggtataagagggtgaatgttgttaaagatgtagcaaatgctctgtgctatatgcaccatgaatgttcacctcgaattgttcatcgtgatatatcaagcaagaatgttcttttggattccgaatatgtagctcatgtctcagactttggaacagccaagtttcttaatccagattcatccaattggacctcattcgtaggaacctttggatatgctgctccagaacttgcatacacaatggaggtgaatgagaaatgtgacgtgtatagttttggggtcctagcaagggaaatacttattgggaagcaccctggtgatgttatatcttctttattgggatcatctccatctactcttgtggcctcaagactcgatcacatggcattgatggataagttggaccaacgtctccctcatccaacaaagccaattggtaaggaagtggcatcaattgcaaagatagcaatggcctgcttgactgaaagtccacgatctcgccctaccatggagcaggttgccaatgagctg

SEQ ID NO: 10586 - DNA, 297 bp, Glycine max
  Peptide Sequence Number=SeqID_127364
atggggagtaaagcccctcgaaaaatttcatataatcatatcaaaatcaaagaaattaaaatcgggcatttctccctccgaagacattatttcacaaattccaatggtgaagatgtgaaaaacagagttctgaacctggtgttcatgttgcacgatgatctagtggttaacaagtccgggatcatagtttttccgggacaggaaagcaagggtggtggaaatgaagaagaggtagctgatgcagaaaccagactgggagaggacaatcacgatgttgatggcgaagcggtccattag

SEQ ID NO: 10587 - DNA, 291 bp, Glycine max
  Peptide Sequence Number=SeqID_127365
atggttggagcattctcgcaaaataaagtgaccctgactggtctccctatgattttacctagtgagagtgacctaacttaccagtatgtgatctgtcttgtcatgtactcctgggcacccgacgagatttttcactcatatgtcgagtttggcaccaacaggcgaggccgagtcgattcgacaccatcattcaatcccaaaaatggcccagcaccaacatttcaagcccataatcgacctggcacttgctacaagcccagaatctacctagcaaatgtattcaacacttga

SEQ ID NO: 10588 - DNA, 318 bp, Glycine max
  Peptide Sequence Number=SeqID_127366
atggactcatatttgattcaactcgagagtattgaggactataagcatgcggtgtttgagggaccttggaagattgcagaccactacttgttggttcagaaatggcgactagggtgctttatggaggccgatttggaaaatagggtggtagtgagggtttgcatgcctaatctacccattgaattgtcaaatgaggagtttcttacacgtgtgggcaatattgttggggttatgctaaagattgattcagtgacctcccttcacttaagtggaaaatttgcttgtttctgtgtagaattggatttggagaagccgtag

SEQ ID NO: 10589 - DNA, 1173 bp, Glycine max
  Peptide Sequence Number=SeqID_127367
atgggcggttataaggctccgggcctagatggtcttcaagctatgtgttttcaatcttggtggcatttggttggtgaggacccgattgaaggggccaccagattgaaggatttttgccctatcggtctttgcaacgtttcatacaagcaaagcatggataatatcgttatagcccaagagatattttattctatgaaaaacaagaaaggcaagaaaggttggatggctattaaagttgacctcgagaaagcttatgatggccttcagtgggaatttttgagggaaaccttgtctgacattggttgtcctcataattatttgcaaatggttcttgatgcattcatttctaaaaaaagggttcaccaaggtgatcctattttcccttatcactttgtgctttgcttggaataccttattcatcttattaatctagcagttgacaacaaaacttggaagccaattcaattaaacaaaggggccccacttatacctcacttggcctttgcagatgacattcttctttttgcggaagcttcagttgaccagattgatgtcatcaagattgttctcaatctattttgtgaaagctcgggggacaaagttagtgatcaaaagtcttatattttattctccaataatgtcaattggcaaactaagcatgacattgtgactcgaagtggtttccattgtacaaatgatcttggaaagtatctcgggtcaatagcatttgagtttgtggaaggccaatatgatgttcatggtagggcgacagtgaggattctaggaaaatccatactttggcttggggtattgctaggggcacccgacaacattgctgtgttgtgcgatatttggagctttgagagagtttggggtgtggtgaagaatgttggaatacactatttcaaaggcacaaaagaacttcttccacgagagtgcatggaagaacgttcttccgcagtagaaattaacaactgcggaagaacgttcttccctgcactcctacggaagaacttctttcgcgagagtgcacggaagaaccttcttccgaatgcatggaagaaggttcctccgcagttgttatgttcagttgtagaagaaggttcttccgtgcactctcgcgatcgagcttatccctaccgacgaccaagaatattgtgcctccgcgaatga

SEQ ID NO: 10590 - DNA, 1287 bp, Glycine max
  Peptide Sequence Number=SeqID_127368
atggatgagaagagaaagaaaaaactagtggaagctgctcaatgcagaagcactaacaccgtgattgatcctccatctcccatcagacgacacgtgaagtggaagatgacccacaccaagaaaactaggcaaatgacatctgaggcaagaaaggaaattgctgagaagattgatttgttagaggagcaggcctcacagggttcctttgtcgcccatggacgtcaggatgtactgactgtttcccttgggcgaccagaacaccctggtcgtgtgcgtgctgctggagccggtgtcacgatcaagcaatactttggaccgtctccaaggacctcccacatgtcttcctccatggctcctgaagacatacaatcacaaggactcgcactgcctcctgagcctaaggttggtccttcagctgcttgtgtcagaacaaaggagagttgtgttgatccctcagggaacgatccaaacataggtgactcagacaaatgtgggttgtacgtcaaagaaaatcctcccggcctagttgccttaggaagactttataagggatccacaaccgttcacaacatttctttgttacatgatcaagtcaaggttggtgttgagaaggttagacatacagatgctcccattcttgtacccactgaagaggaagctgtgggatcggcaaaacctacagataggccgaagcatgatgtcgatgatcccatatatctgatgagattgaccatcccacaactttttctgaagccgttgcaggttatgtgggatgctactgtgtttggggtgtttaatgagaacttccccttgtatataaagcatgaagatctgtctgaaatagcacacggtgcggggaatgttgatgtgtatggattccttgagccacagtccatccagagatctggacaatcacaatttgaatcagaaagttacattaagaactggatgcagaattctaaacgggatgtgtacctaagagccaacttgaatgggccagacaactacctcaaaagaataattaacagtgttttgaaagaacttgacaatactacacaaagtaaatccaatgttactgctaggtggattgttgttaaaggccagatgaggctactgaagaggaggcaaatattcttcaaaaggagtcataagaaaaataaacgcaaggttgatggcgagggtcatgaggggacaatgtggaaggcattggtactgatgaccaatggttcaaaaattctttggagagaccccacatgtctctacaatggcggacctaggttcatttga

SEQ ID NO: 10591 - DNA, 189 bp, Glycine max
  Peptide Sequence Number=SeqID_127369
atggccaactcaagcgtagtcatcccattgctcgagctaaaatcagtgaatccttcatctaacacatccaatcctgctgaaaagtacatccaggtgctgtggagtccctgcaaggagctattcaagccggcagacaaatacaatcagaagcttagtctgtccaatggaccaaaagaaaaagaagcatag

SEQ ID NO: 10592 - DNA, 795 bp, Glycine max
  Peptide Sequence Number=SeqID_127370
atggaacaaccccctaagcccgaaacagtgactgaatcgcacgtcccgaacggcttctccaccaccaccaccaccgtcccgaacggatcgggatcggaatcccaggcccccaaggaacacaccgcatcgtcgtccagtagcaccaaaaaatcggtgcactggagccccgaattggttactgaatccacgttcacctcttccccttgcgaatcgcgctccaatccatacttttcctcttcttcttccttctcccaacctcccccaacgttcatggagacggtggtgaccgttcgcaatgtgctgggaagatggggcaggaaggccgcggaggctactaagaaggctgagagtctcgctggaaacacgtggcagcacttgaaaacaagccctagctttgctgaagctgctatggggagaattgcccagggaacaaaggtcctggcagaaggtggatatgagaagattttcctgaatacatttgagacagttccagaggagaggcttctgaattcttatgcatgttatctatccacgtctgctggtccagtaatgggagttttgtatgtatccactgcaaagattgcatattctagtgacaatcctatttcgtataaaaatgacaaccaaacagaatggagctattacaagattatattctcctccccaaataagaaactttccaacactcctctcaagttggagcatacaaatcatatgcaccaagctttttactatggaactgaaattcaaggaccccgaagagactttgtaaggatatctagagctgataactag

SEQ ID NO: 10593 - DNA, 261 bp, Glycine max
  Peptide Sequence Number=SeqID_127371
atgaataaaagtttgaaggtaggagaagatgagtggagggagagggaaaaaggggaacacaaatttcagagagagaagaaggagaatgagcgagcgtctgctaagcacaacactcctgggctaagcgcgaggaagactctggaagaagatgagctgtacaagttcgctaagtgcaccacttcatctcaccaagcgcaccacttcagttcatccgctaagcgagaaaggtgcgctaagccaaaaatcactaacgtgcgctaa

SEQ ID NO: 10594 - DNA, 849 bp, Glycine max
  Peptide Sequence Number=SeqID_127372
atgtctgaagaagttgatatgaatgaagaaaataaagaggaacctagtgtgaatgaagaactaaatgaatgtcccttgaagactagacatgtatggattgcattgttggtgtttgctacctgtgatgatgttttgcattggactcgatctgttgcttatgaaattggttttgtggtgctaattacgaggttagacacagatactggtattagaggaaggacctcatttgttttaattggttgtgaaaggagtgatcagtataaggccaagaagaaagatttagaaaaaacaattactggcagtagaaaatgtgggtgtccctttaagctgcgtgtaaaaccagtggtggaaggcaaaggatggatggtgaagttaatgtctggaagtcacaatcatgaattggtcaagtcattagttggatatccatatgttggtcgattgactaaggatgagaagattattattgctgatattacaaagtcaatggtgaaaccaagaaatattcttctaacgttaaaggagcacgatgtcaatagttatacaacaatcagaaaagtatacaatgcaagaaatgtttatcgttcttccataagaggcaataatactaaaatgcaacaactaatgaagcttcttgaatgggatcagtatattcattggcatagattgaaggatgaagatgttatagtaccaacaaaacaaacaagtgaaggctgctgtcgcgacctctcttccggcgggggcgcaaaaaaggcactcggatgggacaagggtgtttcttccgttgaaggaaaatgcatggagttgccacaaacgtttattaggaaaatgttagaaaaaccacaaagatga

SEQ ID NO: 10595 - DNA, 378 bp, Glycine max
  Peptide Sequence Number=SeqID_127373
atgactgtgagttgggctaaacgtgcatccaccgctaagcgcaaattcagtgtgcttagcgcgacaaaagaatctggtagaacatcaatatcagggtcatgcgctaagcacgagatcagtgcgctaagcgcagtagttgtcttccaccaggctcagcgcatgactgacgctaagctcaaacccacttactcgcgctatgcgcaacgtctcggattaagagtctatttaaagtctgtcttgtgcagaattagggtacacacttttacagagacttttgcagaggattctagagcacaccacagtgcctatttcgggaatagagctctggaggcagcaagaggagcagcttttgcaaagatacctaggttttgtaattag

SEQ ID NO: 10596 - DNA, 1299 bp, Glycine max
  Peptide Sequence Number=SeqID_127374
atggaagaactccaagaaagatttgatggtatgcaaagggaagtcgaagccctccgaggaagagatctgttcgggaaggacgcctgtgaattatgcttggtcccaaatgttactatcccacacaagttcaaggtgccagacttcgataagtataaagggaactcttgtccccgcagtcacttggtgatgtacgcgcggaaaatgtccatgtatactgacaatcataagctgcttattcatttctttcaggacagcctaactggggccgctctgaagtggtatatgaatttggacagtgcgagcattcgtactttcaatgacctgggtgaagcgttcatccggcagtataagtacaatttggacatggccccagatcgtgatcagctccgtgcgatgacacaaaaagagaaggaaacgttcaaggagtatggccaacgttggagggaagtggctgcccagattgtcccgccgttggaagaaagggaaatgaccaaaatatttctgaagaccctgagccagttttattacgagaaaatggttgcaagtgcaccaacagacttcaccgaaatggtcaacatgggggtgcgattagaggaagtgccccatgctgcaagcaatgccaagaagtttggaggccactttgcgaagaagaaagatcaagaggtggggatggtagctcatggtaagcctcagcagaatttcaccccatatcgtcaggttgcgaatgtcgcatccgctatcccaaacccatcatatcaccaacaaaggccacattacccctacccataccctccacacccgtaccctccacaacaataccctccacaacaataccctccacagcaataccctccacagcaataccatcagccaccataccctcaaaaacaacaaaatcgcccgcaaaccccccaacaaccatatcactcacaaaaccgccagaaaacaacctttgatccaatcccgatgaaatatgctgacttactccccgccctgctcgccaaaaaccttgtccaggtcagaacaccccctcgtacaccagatgttttacctccctggtttcgtcatgatttaacctgcgctttccaccaaggggccccaggtcatgacgttgaaaactgctatgtcctgaagaatgaagtgcaaaaactagtccgggccaacttgctatccttcaaagatcagaatcccaatgttcaggcgaaccctctgccgaaccatgggcctgctgtcaacatgatacaagattgtgatgaagacggtgtcatcctgaacgtccagcacgttcgaactcccctg

SEQ ID NO: 10597 - DNA, 745 bp, Glycine max
  Peptide Sequence Number=SeqID_127375
agcgctacacgccctcatcttgagaggactacacgacctcaccttcacagggctacacgccctcgccttgagagggctacacaccctccccttcacagggctacatgccctcgccttcagagaactacacatcctcaccttcagaggaccacacgtcctcaccttcagaggactacatgtccatgccttgagaggactacacatcctcgcattcagagggctacacgccctcgccttcagaggactacacgtcctaacctttagaggactagacgtcttccactttagaggaccacacatccttcccttcagaggattacatgtcctcaccatcagagggctacacgtcgtcgccttcataggtctacatgtacaccccttaagaggactacaagtccttaccttcagaggaatacacgtcctcgccttcataaggctacaagtcctgcccttaagaggactttacgccctcaccttcagaggactacatgttctcgccctcagaaggctacatgtcctccgtttcagaggactgcatgtcctcgccttcagaggactccacgtcctcccattcagaggactccacgtcctcaccttcagaggactaccggtcctcgccttgagaggactacttgtcctcccctttagaggattacacgccctcgccttcgaaggactacacgccttcacattcagaggagttcacgtcctccaatttagagggctacgcatcctcgctttatga

SEQ ID NO: 10598 - DNA, 249 bp, Glycine max
  Peptide Sequence Number=SeqID_127376
atggataagagcttgaaagaagaagaagaagatgagtggagggagaggaagagaaggagcacgaaattttgtgcctcaaatgaggtgaaaaagaggccaagtcatgaagtgctaaaagcgacagttgagcatagctcatcagctgggctaagtgcgcatccaccgctaagcgcaactttagcgcgacagaagaatctggcagagcatcaatatcagggtcgcgcgctaagcgcgagatcagtgcactaa

SEQ ID NO: 10599 - DNA, 642 bp, Glycine max
  Peptide Sequence Number=SeqID_127377
atgtggaagcatgcaatgaatgaagagatgcaatctatgtcagttaatggtgtatgggagctagttgagttgcctgagaattataaggcaatcggttgtaaatgggtctttaagacaaagaaagaatggatcgctgaggcctcttttatgttggggattgagattcacagagatagatcgcgtcatacactcgggttatctcaaaagggttacatagatagtgtcttagagagattcaatatgcaaaattgtaaacctagagatgttctagttatcaaaggtgacaaattcaacaaggaccaatgccctaagattgagattaagccaacagagatgaatgatagacgttttgggagtgctctgggtagcctcatgtatgctcaggtatgcactagatccgatattgctttcatagttggcgttcttggtagatactggtcaaaccctatgaatgatcacttgatagctgctaagaaggtgaagaggtacttgcagaagactaaagagtatatgcttgtgtataagagagttgagaacttggaggttgtggggtacacaaattcaaatcttggtgggtgccccgatgataggagatcaacttctggatacatctttatcatggttgggggtgcgatatcctag

SEQ ID NO: 10600 - DNA, 747 bp, Glycine max
  Peptide Sequence Number=SeqID_127378
atggcaagctgtgacggtggtgaccagccgggacggtggtcacgacgacaacaagccatgacaatgcatgacaacgatgggttgaaattgattgctatcaagaggactgtctctaaagatcttctaagtggtcagccaaaaaaagcgatagttaaggagttcctcaatgctctaggaaagaagtaccaagtatttgataacgtagagtttaggtgtctaatgaagcagttaacaaacatgagacatgataatgttagggtcctacctactgatttcacacaaattaaaattgcctataataccattggtaagaaatggactgtgaacaaccttattgccaagtgtgttgttgaggaagagaaactcaagaaagataagagtgacatagctctgttatcaatccataacaaacccatttttggaaaaagacactggaaaaatacaaagagggcatctaatgcttctcatagatatcaaggtttggggaaaccaagtaaggataagcaccaggatgtaggaggtcctaggccagctatctttaacaaaggtatttggtgcttttggtgtaaagagaaagggcataagaaatctaattgtggaaagttcaaggcttggctagagaataagcagaaatcaagaggtaataactcaacttttgtctgtcttgagtctgatcaagttgatgttcctatagattcttggtggattgatagtggttccacaacccatattgttgtgtctttttag

SEQ ID NO: 10601 - DNA, 480 bp, Glycine max
  Peptide Sequence Number=SeqID_127379
atgtacaacaggaagatttctagtaacaagttcaacttatggtttagcaacgggttcggcttgatggacaacaagaacatgtttagtagtaggttcaacaatagttcaacttcattcctagcaggaacaggttcaggttcgacatcaagaaaagaggaagctccacgctgtgatgttcgaaaatcttgtctcaaatacttacttgatgaccaagtcataagttgcacgatctcttggaaaaacgctagtaggatcatacctttcccccggatggttggactaagttcaatgctgaggcttgtgtttagagtgcagggtttgccactatctatggggggttttgcgctattatttcaatgcttggaagttgggtttctgcaggaagttgggagcttgctccattccggcagcagagatttgggggattatcttggcattggagaatgcttggtgtttgggggtgaagaaggtttgggttga

SEQ ID NO: 10602 - DNA, 2097 bp, Glycine max
  Peptide Sequence Number=SeqID_127380
atggaggaggattcagaagagtatggaagtcctgtggttttgtcatctgccattgcagacattataaagtcccgaactgaggcacttttgaagaaaaccaagacagcagtttctcctaagccaattgtaatgagagctgagtatgcacattgtcctaaccttactattattgacacacctgggtttgttcttaaggcaaagaagggtgaaccagataacacgcctgatgaaatcctttctatggtgaagtccttggctagtcctcctcaccgcatactcttgttcctccagcaaagtagtgttgagtggtgctcctcattgtggttggattctattcgcgaaattgacccaacatttagacggacagtgattgttgtctccaaatttgataaccgtctcaaggaatttagtgaccggtgggaagtggatcgctatttgagtgcgagtggttaccttggagataacactcaccccttttttgtggccctgccaaaggacaggggtaatgtttcaaatgatgagttccgcaggcagatttctcaggtagattcagaggttcttcatcatctccaagagggtgtcaagggaggttttgatgaagaaaagttcaagtcctatattggttttggccgtctgagagattatttggagtctgagcttcagaaaaaatacaaagaagccgccccagcaacccttgctttactcgagcaacgctgcagtgaattgacttctgaacttgctagaatggattcaaaaatacaggccacttcagatgtttcccatctcaggaaatctgcaatgctgcatgcagcttctatcagcaatcatgtgggtgcattgattgatggtgcagcagatccttcccctgagctgtgggggaaaacaactgtagaagagaggtcacgaagtggtattggggtttggcctggtgttactgctgatgtaaatccccccaatgctactcttcgtctttatgggggtgctgcatttgagagggtgatgcatgagtttcgctgtgctgcatattccatagaatgcccctcagtgtcaagagagaaggttgcaaatatattacttgctcatgctggccgaggtgggggaagaggaataacagaggctgctgcagagattgcacgagctgctgctaaatcatggcttgctcctcttcttgacactgcttgtgaccggctttcttttgtcttgggaagtttatttgatttggctctagaaagaaactgcagtcatgattcagaatgtggtattaaaggagatgacatggatggctatgtaggtttccatgctgctttaaggtgtgcttataatcgcttcataggggatcttgctaagaagtgcaagcaacttgttaggcaccaccttgattcagttactagtccatactcacaggtttgctattttaatgactttcaaccatgttctggcccaaatgcactctcttatagcaaagtccttgagttgagtgatactagttcagcttcccgtgatgtaaggagggatcaggaaaatatacctcccgaaaaaaatgctcaagaaaccacaccaggtaaaacaggagaaaccagagatgttttgagagaaagtcacataactatccctgagaccccatctccagatcagccaggtgatgcagcatttggggtggttaaaaaggagcctggaatttgcaatgacatggggccaagaaagagagcgtccagaatgggtgggaatagcaaaaattctgacaatgttagactgcaaaatggtgtcattttatttggaaatggggagagatcaggttcaccttactcagatatctgtgtttcagctgcccagcattttgcacgtattcgtggagttcttgttgagagaggcgtgacatcaacattaaattctggattcctaaccccttgccgagatcggctattcgtggctcttggcttagatttatttgctgtgaacgatgagaaattcatggacatgtttgttgctccgggtgccatagatgtgctagaaagtgaacgagagtctctctcaaagcgtcagaagatactccagtcttgcttgaatgagtttaaaaacgttgctcgggcactatga

SEQ ID NO: 10603 - DNA, 294 bp, Glycine max
  Peptide Sequence Number=SeqID_127381
atgccaatgatcactatagaggcaaatgctacataccacttcctgttcaagcatatccctcagcatgatatcaaccatatcatttcctactatgcttactttgggtctgtgcagttggacaacctgctgcaattcttgcagcaattcttcgagcatgatgccaatgggaggcctactagacctactttttgttgggatacaaccattgaagtccacgaggatgtgagagatttcaacgacgatgaggatctcatgtcatccgagatccctttctatcaggatatttgcagttaa

SEQ ID NO: 10604 - DNA, 168 bp, Glycine max
  Peptide Sequence Number=SeqID_127382
atgtcgtcccagagcacaagatcagcaggagaaatgatggaggatgtgatccatggtcacaactctacagtgcttggctcaactttctcatgtagaagcaagcttcatgatgatgaatcaagtatgaatcaagtagttttgatgaggacaaaaggctcaaaagaatga

SEQ ID NO: 10605 - DNA, 288 bp, Glycine max
  Peptide Sequence Number=SeqID_127383
atggcgtcggatgtatgcaaagtgcacatggaggagcgcctcttcctccaccatgtagctctagcggtagctgccaatccacataagcatcctccgcggatgctccatgaccttcccctaaaattggtggttgcaagggtgagtccttcgttcctcaaacgccacaagcaacagcacacagatccagaacatggaagcaagctcgaaaatttcaagataacatgttcaaggaagtttaacaacaagcataggattcaagagttagagagacccccttacctctcgtag

SEQ ID NO: 10606 - DNA, 423 bp, Glycine max
  Peptide Sequence Number=SeqID_127384
atggcaagaacaaagaatcaattatacaaagagacttctccctgcaagaagataaagcaactaaaggaggtagcatcttcaaagcaagctccaaaggccaagcctcaacaaccttggatggttcatgaaccgtctaatgataatgagaggttcttcaacaaatatttcaaggataggagccaggcatttgcagtgaatcccttgtctaggatttctatgctaatgccatccttcaagatgatttcaaagaaaagaagtcctaggtcagaggagatctttagcattgctacaaagatgagctttcatcttggtctactagccctaatcactgcattgtgtgttagaaagggtatggatattgttgaagactgggcccaatcttatgtggatttgcaaccaactagtgatgctaattacatttag

SEQ ID NO: 10607 - DNA, 216 bp, Glycine max
  Peptide Sequence Number=SeqID_127385
atgcagggtgagctcgcctgggcaagcaccactgcacctggaaacataaaaacgaggggaggaggagtttctctccacccaaaactcccctccctcattcaaaaatgcaacacccactggattttcagattttcgcccttaggtcaccatttttgcgcttttgcttccatttttagtgtctttggtaactccatacaaacaacttgcgagaattag

SEQ ID NO: 10608 - DNA, 537 bp, Glycine max
  Peptide Sequence Number=SeqID_127386
atgggtaaagcggaggaggtacaagagaagatgaaggccgacatggaggccatgaaagagcaaatggccacaatgatggaggccatgatgagcatgaagaagataatggaagccaatgcggttatagttgccgctactagcgctgtcgctaaggtgaacccgatgctcccatctagcctcaagcaaatgaatcatccaaacctcaatatgggcaagcagttggtggtataccctttgaaaacactttggagggccctcagtttcgccccacaaccacaaccattgcattttgcggtgggaagagcccctcctgctatggccgaaaagggaaaggcggatcatctaaaggaaaggctcagggccattgaaggaggtgaagattatgcctttgctaacctagaagagttgttcctaatacccaaacatggtcattcccaagttcaaggtgccggactttggcaagtacaaggggactactcgctccaagaaccatctaaagatgtactgtcggaagatgggggcatacgcaaaagatga

SEQ ID NO: 10609 - DNA, 189 bp, Glycine max
  Peptide Sequence Number=SeqID_127387
atggcattcttaggagaaacttcctctcagacgatcgttaactcaaggttggccttcacttttccaaatggatccatcattcacaacaagtgtggggtttattttcaaagttcaacttcagtgcccatgcgagtaccaaacatgtgcgattttgcaactcttaaaagcagaatacacaacacccttcag

SEQ ID NO: 10610 - DNA, 207 bp, Glycine max
  Peptide Sequence Number=SeqID_127388
atggcggaagtttttgtttcaaagacacgaaagaacgtcttccacgtgattcgttggaagaaccttcttctgcaggttcttccgtggaatcacacggaagatgttcttccgcaggaatgcacggaagaacctccttccatagttataacattaactacggaagaaccttctttcgtccattccggtagaagaacatcttctgcgtga

SEQ ID NO: 10611 - DNA, 192 bp, Glycine max
  Peptide Sequence Number=SeqID_127389
atggacgaagatcaatgggcgtatgacaatatgatgtctgaagaagttgatatggattttaaagatgaacaacattgtggtgtgaatgaaggacatgttgattgttcatacgcttttaatacttctcaagttataactcttccaatggttttcttaaccagatatgaagagtctataaaagcaagaccttga

SEQ ID NO: 10612 - DNA, 255 bp, Glycine max
  Peptide Sequence Number=SeqID_127390
atggggatgaggggttgcatcagctacaatcccgttcttgctataagacaacttggctaccctatgagaggggcgccactagaggatgagctcacgcctgtcatttcacgagatttcaataagaccaacatagagacagttcagaaagtccgcaaggcatgggaggttttgagaaccgctaaaagagaggaagttgaggcaccagaggaagacaaagaagtgcaggcccttagggcggaactcgagcaagcctaa

SEQ ID NO: 10613 - DNA, 273 bp, Glycine max
  Peptide Sequence Number=SeqID_127391
atggttcagcttcttgcagaactcctcttgcagagctcccttgtcatggagcttggtgtccgcagcagtggtttgggaagaactatcgtcggggttcttggcgaggaggaacaggaccgtggagagaatgtacttgaggaggcactggctaatgtcattcgtcgccgccgtcatcaggtggaagtggtggtgccagcgactgctccatttcaaaaatccgaggaggagtcaaagagggagaatcagagagcgacaatcagagagtcagattaa

SEQ ID NO: 10614 - DNA, 138 bp, Glycine max
  Peptide Sequence Number=SeqID_127392
atgttgagcccacttaagccaaactcttccttcttggatagtcctctatcatattcacatttcgcagtggtttggcggcaagcggtggtggctcgtggtggtcatcggtggtcatgggtggagaaggagaggttttag

SEQ ID NO: 10615 - DNA, 336 bp, Glycine max
  Peptide Sequence Number=SeqID_127393
atgacaaatatgaggaagactctgatgaagatgaggtcaccttcatgtcccgaaagattggagaaatatggagaaaccaaggtggctctagatggaaaaattcctcatgaaggcttacaaaaacttgcgaaaagatttcaaaaactatccaaagatcatttgaaactggagaaaacccttcaagatcaaactagacacatgacgtccaagtgtagagatcgacctaagaagggtacaaccaacatctttatggctaaaacaaaagcatgcataaagatttgggtacctaagaaaaagattattcctattgtagatgtccctgataacaagaagtag

SEQ ID NO: 10616 - DNA, 366 bp, Glycine max
  Peptide Sequence Number=SeqID_127394
atggaccttttcaggtcttggagaggatcaatagcaatgcctataggttggaccttccagaagagtggagctgatattgaggaggaggaaccaacagatttgaggtcaaatcctcttcaagggggaagggacgatgcaatcctctctaggaagggactagttaccagagccatgagcaataggctccaagaggattgggatagagctactaaagaaggccctagggttctcatgaaccttaggctaagctctagcttctttaggaatcttctcaaggaacttctcaaggagcttctcaaggaagttttctcaaagaagcttctcaaggaagttttctcaagaaagcttctcaaggaagctacctag

SEQ ID NO: 10617 - DNA, 358 bp, Glycine max
  Peptide Sequence Number=SeqID_127395
atgtgggaagttgttgggcttaacatgtgggaagttgctgggctttggagtttaattaagccaaaattctatcaggcaaaacgaaaaactaaggaatcaggtaaacactactccaaacatctcaatctctctcattatgcaattcctcctcaaatggatctatgcttggaagatctctcaactgccaagagaatttcagacagcttatgcacactcgcaatggacaaaaccacaaaggaagtacttgaacatcaatgcataaactatgcaagattcaagaagtctagaagcaaaggaagcaaaagcatatgccttgctccgtgctataaaatgggcacaagagttaaacatctcaaag

SEQ ID NO: 10618 - DNA, 276 bp, Glycine max
  Peptide Sequence Number=SeqID_127396
atgttgtccttcagtcagatgcagtcccagtttcaatctcaaatgcaatcattgggacttgcactgcctcctgagcttgaggttggtccttcagctgctcgtgtcagcacaaaggagagttgtgttgatccctcaaggaataatccagacacgggtgactcagagaaatacgggttgtacattaaagaaaatcttccccacctggttgccctaggaagactttatgaggggtcgacaaccgttcacaacatccctttacgacatgatcaagtcaag

SEQ ID NO: 10619 - DNA, 396 bp, Glycine max
  Peptide Sequence Number=SeqID_127397
atgggcttctgtcagtcatacagggtgcccgtccccccagcaaggtcatgccatcgtgacatagggatcgcgcccacaagacacccagtggacccggagaagtccaacagggccctcaggtttccaactctggttacgggcctttgtcagtcctacagggtgcccgtccccccagcaaggtcatgccatcatgacatagggatcgtgcccgtaagacatccagtggacccgaagaagtccaacagggtcctggggtttccagctttgattacgggcctctgtcagttctacggagtgcctgtcgcccccagcaaggtcatcaggccccctattaaccggactttcatcgagaagtattgcacccccgggcaggcgcagagcgaggcatcacagtag

SEQ ID NO: 10620 - DNA, 258 bp, Glycine max
  misc_feature (18)..(18): n is a, c, g, or t
  Peptide Sequence Number=SeqID_127398
gctgccaaccacgggggncaggtgcagacccataagtgtctctaccagctcagcctcagtctgcaaagccagggtttcgctccttttgcgtgccctactcctgatcagttcagggcagaggttgcatggcccggagattggtctgaggcccaggcaggggaggcacccacagaggctcccggcgatgcagatgaggcccgcatggatgaggagatgacagatttactcgatttcttgggagggagcggagccacatga

SEQ ID NO: 10621 - DNA, 360 bp, Glycine max
  Peptide Sequence Number=SeqID_127399
atgacggaagggtgtggtgaagggttttgccttgcaaaccttcccggtgatgcttttagtctatgggggaacttctttgaggcaaagaaacaaatgatggctgatgccaaggtcggcggtgctgggttatggccccgtgctaaggctcccagtggttggccccctctccagcgcgaaaaaagttttgttgccaggattttgccaactttggcttgcgccccgttggctaagtctgtgcctcggtgggtggatcatcatgtcataacatggcaagacacaaggggaggacgaatcaaagcgacaagggctgaatctcagtggatcgtggcagcaaggccactctgccacttacaatacccc

SEQ ID NO: 10622 - DNA, 354 bp, Glycine max
  Peptide Sequence Number=SeqID_127400
atgaatgaagttctttcggaattacggggcgtccacacctatgttggcgaacactttgattccttggatggtcgcattgaaggaatagatacccgcattacccagcttgaagaggatgaatttaattgtcatcataaaaaagggggagattgtagaagcaaagactttgactttgatgttttgatgatgccatatgatcatgcgcttctcaagtttaattcaagatgcatcatcaagaagatctctagtgatttaggaagtgaattccaagttgaaacaacaagaggtttggccaaagaatatgagttaaaatgtttttttcaagaaatttactctctggtaatcgattactag

SEQ ID NO: 10623 - DNA, 237 bp, Glycine max
  Peptide Sequence Number=SeqID_127401
atgagtaaggtaggaaggtttgaaggtttgggaatggagggacgtcgcaaggaggaagaggctgcacaggggtttctgaaaaacgtggtatttatagaccaagacgcattgtggaggcagcctattggtaatcgattacatgaagactgtaatcgattacaggccatctgttctagtgtaatcgattacagtattcatgtaatcgattaccagaacaaaacaatagccttttcctaa

SEQ ID NO: 10624 - DNA, 558 bp, Glycine max
  Peptide Sequence Number=SeqID_127402
atggcttccaactcccaacaattcagtgcaaaaaatgatgttattgttcttagaggagtccatgaggtggccacagattcatcttcatctactgaaaataaaaatcttgaaggaaaacttgatgccttggtcaacctagtaactcagcttgccatgaatcaaaaatctacacatgttgcaagagtcggtggtctatgttcttctacagatcaccatatagatctctgtccttctttgcagcaatctggagtcaatgagcaacctgaagcttatgatgcaaacatttataatagacctcctcagcagcaaaaccaacaacaacataataattatgatctttcaagcaacaaatacaatccaggttggaggaatcatccaaatttgagatggacaagtcctccacaacaacaacagcatgtcccttcctttcagaatgttgctggtccgagcaagtcatatgttcctcctccaatgcagcaacaacagcagcagtcacaacaaagacaaccagcaactgaggctcctcctcaacctttcttagaagagttagtgaggtaa

SEQ ID NO: 10625 - DNA, 210 bp, Glycine max
  Peptide Sequence Number=SeqID_127403
atggagtttccaattgtcgcaacctacccttcgacgggagggcgaggcgaaaggccaaaggtgcttcttcccatgaagaaaatgcgcaagagtcaccaccaacgtttattcgaggaaaacattagaaaaaccaaaaagaaagggtcgacaagggtgttgcccttgctcctatgtatcctcaggtgcgatgaggaattcaaacctacgtag

SEQ ID NO: 10626 - DNA, 176 bp, Glycine max
  Peptide Sequence Number=SeqID_127404
acccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttagttag

SEQ ID NO: 10627 - DNA, 1215 bp, Glycine max
  Peptide Sequence Number=SeqID_127405
atggcgaatactgattcaactctgccgcacgccgcgcgtgccgcagcagggaaaacccacaccggccgtcttgctgcggccagctccatcggcaccgcgctggagtggtacgactttaccgtttacaacatcatggcggcgctggtatttaaccatgtgtttttccccagcttcgacccgctggtcgggaccattctggcgttttcaacttacgcggtcggttatgtatcacgtccggtgggtggttttatctttgccatctcggggatgtcgccgggcgcaaggcgtcttgatcaccacgctggtgatcatgggcgtgaccacggcgctgatgggcatgctgcccggttatgcgctgtggggcatctggagtccgattctgctggtggcgctgcgctttgtgcagggcatcgcgctgggcggcgaatgggccggcgcggtgttgctctccatggagcacggcgaagccacggcgaacagtttcaggagtggggctggcgcatcccgttcctgctcagtctgctgctggtgatgtttggcctgtggctgcggcgcggcgtggaagaaaccccgactttcgtggcgatgcagcaggcggaaaaaaccagccacacgccgctgaaagaggtgttcctgcgctatccacgtgaactgctgatcgccggcggctcgcgcatcggctccgacgtgctgtacgcgctggtggtggtgttcaccctgacatacgtcaccaccgtactacagctgccgcgtccgctggcgctgatggcaacgatggtcggcgcgattggcaacgcgttgacggtgccgctgtttggcgcgctgtccgaccgccttggccgccgtccggtgtacattgccggcgcgctgctggctattgtctggtcgtttgtgttttttgtcctgctcgacagcacccagccgtggctgattgtgctggcagtggtgatcggcctgctgattcacgccatgatgtacggtccgcaggcggcgtttgtcaccgagcagttcccgagtcacgtgcgctatgccggttcgtcactggcctatacgctggccggcatcatcggcggcggttttgccccgctgatcatcacctcgctgtacaaagagctgggcagcacgctgtgggtgtcgctgtacgtgacgctggcgctgacgatcaccctgtttgccttatggaaagccaaagaaaccgcgcaccagtcgctgtaa

SEQ ID NO: 10628 - DNA, 960 bp, Glycine max
  Peptide Sequence Number=SeqID_127406
atggcctggtggcacggctcggcggcgatgagtttgtgtctcggcatcgcgctggcaccacaggatgccgacaacgccagcgatctgctgcgctttgccgacatcgcgctgtataaagcgaaaaacagcggccgcaaccagtggatatttttcgaccgtgacatggaagagaaaattgtgcagcggcgcgaaatggagcatgagctgcgcgcagcgctgcaggagaaccagctgcggctggtgtatcagacgcgctatgacctgatcgcgcagcgcatcagcgcggtcgaggcgctggtacgctggcagcatccgcggctgggcttactgatgcccgatcagtttattccgctggccgaagagaccggcctgatcagcgcgctgagcgactgggtgctgctcaatgcctgcgaggacatcgcccgctaccggccggaaatggcggtttcagtgaatatttccgccagcgaattgcaggatagcgccttagccgaacgcatcacccgggtgctgcagctcagcggtctgccgagccagcggctggaaattgaagtcacggaaaacgcgctgctgagcgatccggacaaaaccctggcggtgatgcaggcggtgaaagcgctgggggtgagatttctgattgatgattttggcaccggctatgcgtcgctgtgctacctgcgcgccttcccgttcgatggcatcaaaatcgataaatcctttatttttccgctggccgattcgccccaggcgcgccaggtggtggaaaacatgattggactcggcaaagcctattccctgtcggtaactgcggaaggcgtggaaacgccggtgcagatgtcgcagctgcaggagctggcgtgcgatgccattcagggttactacatcggacgaccgctgccgctgccgcaaatctcgaccgagccgccgcagagtgaaccggcgctgcacatgaatatttaa

SEQ ID NO: 10629 - DNA, 696 bp, Glycine max
  Peptide Sequence Number=SeqID_127407
aatccggacttctggcgcaaaatcggtaacggtcagcattttgtcggtcgctttgagcgtaagaccgccagcggcgagcgcatctggctggaggcgagctacaacccggtgtttgacggcgatggtaaggtctacaaagtgattaagatcgcctcggatatcaccgcgcgcgttgaggcggcgaagcgcgtggcggatatcgcgctgaccacctctgagcagacctcacaaattaccgataacgccaatgaagtgctggatgaaacggtgcgtaactccggactggtggcgcagcaggtgaacgcggccgccgaaattggtgcgcaactcaccgcctcggccaggagcatcagcgacgtggtggaaaccatcaacctgattgcttcacagaccaacattctggcactgaatgccgccatcgaatccgcacgcgccggcgaggccggacgtggcttcagcgtggtggcaggtgaagtgcgccgcctggcggcctcgaccgccagtgccaccaaacagatatccgtggtcgtggagcaaaatgccgacctgatccagcagatgtatcagcagctggatgaggtcaggcaatttgtggtgactgaacaggagaagatcagcgtgctgtcgcgcagcctgcgggaaatcaacagtggcgtacacgagtttgtgaacgtcattcaccggctggatgtgtga

SEQ ID NO: 10630 - DNA, 514 bp, Glycine max
  Peptide Sequence Number=SeqID_127408
atgctgctgatggtgctgctgatttttctctcctttatggtggcgctggtgacgctgtgctttatcgccagcgatctcaaccagcaggaggcgcggcaaaaccgcctgttgctggagaaggcgttgcagacgcgtcaggaagtgatgcagtttcacctctccgataatgcagaatggggcgaagcctaccaaaacctgcaccgcacgttgaatactgactgggcgtggacgcggcagaatctgggtgagtcgctgttccagacctttgcttatgagggcgtgtttgtcatcgcgccgcgcggcgacacggtttacagcgtgatcgacggtcagctgcagcaacgcgatttcaccggctggctcggtcgccagcaactgcccgcgctgcgtcagcagttacagcacaatgacggtaaggcgctgtcgcgctttgtggtggtaaatcagcagttagtgctgctgtgcgcggcatggatcaccaccggtggcgataacagcgtgccgcaggtgcccg

SEQ ID NO: 10631 - DNA, 810 bp, Glycine max
  Peptide Sequence Number=SeqID_127409
atgctgatagccagtctgctgctgtaccttgccggcggcttttttccggagtggtcgctgatgacaccggaaagccgcaacctgctgcccggcctgatatttattaatcctgagacgctgacgcagctcaccggcattgaattccgctccatggccggatcgttctggtctctctatgttgaagcgctgttttatctgattattggcgcggtttatttcaccctcggacgtaaatattgtctgccggcgctgattgtgccgatgttattactttccgcctcatcgatattgaaatcactcggccatccattattaatcgatgtcatttcaaaattcggttttattcactacgcctggtttatggtcggctgtctggtttatgaacgtctgcacgggcgcgataaacgttatcactacgcactgaccgcgctggccttgctgattaatttcagctactacgttaaaaacagcggcgtggtcgccgtgataccgctgctactggtaatgctgttttttatcgccagcttttattccagacagattgagcgctggctttccctgcgctttttcaccgccatcggatttgtcagttacgcactgtatctgattcatgaaaatttaatgatcgcgatattgattaagcttaatggctatatcaaaaatgaggcggtgatgacgatgctgccggtggtggtggccagcgtactgtattacgttgcctggctgatcagtaaatatgccgaaccggcgctgcgtaatgcgctgaagtggaagcggcagcccgcgccgcaggcgggcagcgggctgtaa

SEQ ID NO: 10632 - DNA, 489 bp, Glycine max
  Peptide Sequence Number=SeqID_127410
atgttaatgtgcaatgagcaatactcgtgtgttggccctatagaattattatgtaccattattagaacaccggatgctatactcaacctgcttcaatcaaccatcactcctactcatgatgcaattatgtattacaacgggaagtggaacataccacgtcaaggtgagtttttgggttactcctttactggaactaatccaataagatttggcattccttcgggatgtggcatggagaaactcaaggatttaatcaaacaagttacacctacaggtgttccccctaatggaattcacggatcacaattggttagacgattattctttcgacaaccaggtcattctaagtattccgaaaatttgattgaatatgacataacagaattgaaaaatgatgaagacgtgctaaaagtgttagcacaatccaactattggaaacgattctgcacaatagaaattttggctatttttagcaaaccagtaatctaa

SEQ ID NO: 10633 - DNA, 228 bp, Glycine max
  Peptide Sequence Number=SeqID_127411
atgcacccttataaatggcaaagtggaagtagcaaatctaaggggagggacaagcttaagaggcagaggatggcaaagtgggaagccatggaaaaggaaaacgaagagatggaaaggaaaaggaaagaggaagagtttattcatgagagggaatgggaggagagaatgaactacaggggttggaatggaagaagagggttgacgaggctggaatggtttttatcctaa

SEQ ID NO: 10634 - DNA, 507 bp, Glycine max
  Peptide Sequence Number=SeqID_127412
atggggtccaataatcgtggcaactcgaaggagtttctagaactcataaagtccatcggcgagtcccaatccacggccgaggaggactgcatcgtcctctgcgagatcaaaaccctaaaacgctgcatcaacgacgtcgacacttcgaaacgcaagatcgaaacccgttctagtacatggaagaacaaccccatcttgccttctgatccttaccaaagagccttggctcatttctggtccaaattcattgatgataaggacaagaagttctttggaggagaggagattgggttggtagatattgttgttgtctacacagcattttgggtccctgtggttcaagaaattgcagggttggagttattcacaagtgagaaatttcctaagctccacaattggagccaagaatttttgaaccatccaattgtcaaagaaagtctgccccctagagatcttgttttcacctttttcaagggtctctatgaaagcctttttggttcaaaatag

SEQ ID NO: 10635 - DNA, 402 bp, Glycine max
  Peptide Sequence Number=SeqID_127413
atggacggtgcaggcatcgcgacgatgatgaaactgggtgccagcggtgtacagctcggtacggcgtttgtgctgtgtcccgaatcggcggccagtgcggcctatcgtcgcgcgctgctggcagctggcgagcgtggcacggtaatgacggcggcgatctccgggcgtcaggcgcgctgcgtgcgcaacgcattttgtgaattgtgccatgacgtaacgccggaggagatccccgactatccgctgacctatgcgctgggaaaagccctggcggcagcagcagctgcgcacggcgaggacggcttcggtgcccagtgggccggtcagggcgtggcgcgggtgcgcgcgctgccggcggcacagctggtggagacgctgattgcagagtggcagcaggcataa

SEQ ID NO: 10636 - DNA, 780 bp, Glycine max
  Peptide Sequence Number=SeqID_127414
aaagcgcagcacgtagagcatttccgcactgctgacgaacgcggtgcacaccgagacaatgccccaggtcaccatgatgcgcgaaatccagattttggcgccaatcttctgcatcgcgaggttgcttggcacctcaaacagaaaatagccaacaaaaaacaggctgcttgccaggccaaacaccgctttgctcagcccgagatcttcattcatttgcagggacgccatgccgatgttgccgcgatcgataatggcgatcagatagcagacgatcagaaacggcagaatgcgccagatgacgcgttttacggtctgctgctcaatatcgggcacagcggccgcgcgggttatcttcacgggaaaataccagcattcattccgtcaggcgacagtggaattactttgcaacatcttgccgtttacccgcggcgtcattctgcgggcgtggtcgacgggctgtactacccgttttacatggagtggacgcgccacgcttacatgcgcgaggcgctgggtatcgacattgaagaagagttcagtcagggcaagatttacatggtgctggagtacacgctgcgcttccgcaagagcctggtgaaaggcgataaggtggaagtcacctgcgcgctggagcagaatgagaagcgcaatcgcgtgaacttcgtgcagcaaatcaaggtcgacggcgtggtgtatgccgaggccacgtttgtcgccacctgcctcgccaatgggcgcccgtcaatgccggaagcggtaacgcgcgcgctcggtctgtaa

SEQ ID NO: 10637 - DNA, 369 bp, Glycine max
  Peptide Sequence Number=SeqID_127415
atgcccctctatgccaaatttttgaaggatacgctaactaagaagaaccggtacatccttagtgacagaattgttatggaaggtaattgtagtgttgtgattcaatgcattcttccaatcaagcacaaagatcctggagttgtcacgatatcgtgttctttgcgacttggagagatagagataatgcctacatgcttgaccctccagttagctgaccgctccatcacaaggccatatggagtcattgaagatgttttggtgaaggttaaacaccttatattcccatctgatttcgttgtcatggacatagaagaggatgttgacattcctctcattcttggccacccattcatctctactgcaagctga

SEQ ID NO: 10638 - DNA, 480 bp, Glycine max
  Peptide Sequence Number=SeqID_127416
atgggggggatacatgaaataccccaccacaatctagccaacttcgagccttgcctcgaacacgccactgaaggacaagcagtaggtggtgtacccttgccaaacactttggagggtcctcagtttcgcccacaaccacaacccttgcattttgcggtgggaagaggccctcctgctatggctgaaaagggaaagttggatcagatagaggaaagactaagggtcgttgaaagaggcgaagattatgcccttgctgacatggaagatttgtgcctagtacccgacgtggtcattcctctaaagtttaaggtaccagactttgataaatacaaggggactacctgccccaagaatcacctaaaggcgtactacaggaaaataggagcatatgcgaaagatgaaaaattgctgatgcatttcttccaagaaagtcttactagggcaaccgtcaccttgtacactaatctggaaccttcttga

SEQ ID NO: 10639 - DNA, 201 bp, Glycine max
  Peptide Sequence Number=SeqID_127417
gcaacgattggtacctcaaagccttacactggggcaatgaggggcaccgtgcatgagcctcaagtgaacataggggccgatcaaaagttcacacccgtcgatgtttttaaactagaaaaaaaagggggagacaagccctgggatttcaatggattgatcaaacatcaaacagctctattgccatcactccaaaatggtcaa

SEQ ID NO: 10640 - DNA, 174 bp, Glycine max
  Peptide Sequence Number=SeqID_127418
atggatgaatttgacatccttgtctctctcatcctctcacaaacacatctttgcttattcaacttccaccggaatgtgagtgttgtgaaaacaaagatggatgcctcagagccctacactgggggaatgaggggcatcgtgcatgaacctcaactgaacctaggtgcagattag

SEQ ID NO: 10641 - DNA, 204 bp, Glycine max
  Peptide Sequence Number=SeqID_127419
atgtatagcaatgagattgggcttatcaagaagttgatgcctttgtgtgaggtgcagcacactctccatgagggaaatcagtgcgcagacgtgttagcaaaactgggagctaattctttgagtcctcttgatgctttgcatgatcccccagttgcaggcagatgcactgagggttgtcttcccaaggctgtaattcacttttag

SEQ ID NO: 10642 - DNA, 231 bp, Glycine max
  Peptide Sequence Number=SeqID_127420
atggctcaggaggaagggacttccacagatcagatacttgagccatctcttgcacctgttcttgaggagacccagccatctacaccagttacggagccagagcagcctatccatgattcatcaccattagaagagaatgagcatgtgattggaagcatgactgaaaatgttagtcagtttgtcagattgattgtgaaggaatgcattaaccgtatcccggtgaaagtttga

SEQ ID NO: 10643 - DNA, 1254 bp, Glycine max
  Peptide Sequence Number=SeqID_127421
atggcgcttgcctccaaccgaaagctgctgatcgccgacgagccgacgacggcgctcgacgtgaccatccagggccagattctcgacctcatcaagacattgcaggaagaggagggcatgtcggttctcttcatcacccacgatatgggcgtggtggcggaagtctcggaccgcaccatcgtcatgttccgtggcgatgtggtggaaaccggcgccaccgacgacattttccatcgtggccgccacccatatacgcgtgccctgctttccgcggtgccgaagctgggttcgatgaaggaaaggctgctgccggcccgtttcccgatcatcgatatcaagaccggcgaaagtcagcctgtggcggacgtgaaggatactgtctccggcggccgcacgcccatcctttcggtcaaggatctgaccacccgtttcgacatccgctccggcctattcggccgcaaatccggcgccgtgcatgcggtggaaaaggtttccttcgatctcgccgagggcgaaaccctctcgctggtgggtgaatcgggctgcggcaagtccaccacgggccgctccatcacccggctgatcgagccgacgtcaggcgatgtcatgctcgatggctacgaggtgctgaagctcgacaagacgacgctgcgaaccatgcgccgcagcgtgcagatgatcttccaggaccccttcgcctcgctcgacccgcgcatgagcgtcggcacggcgatcatggagccctttatcgaacatcgcctcggaaccaaacagcaggcccgggaaaagcctgccgatcttctggaaaaacgccagcgcatcgccattgcccgctcgcttatgctcgatcccaaggtcatcgtcgccgatgaggcggtatcggcgctcgatgtctcgatcaaggcgcaggtctgcaacctgctgctcgacctgcagcagaacctcaacctcgccttcctgttcatcagccatgacatggcggtggtggaacgcgtcagtcaccgggtggcggtgatgtatcttggcgagatcgtcgagattggcccgcgcgcggccgttttcgataatccccagcacccctatacgaagaagctgatgtccgccgttccggtgcctgatcccgcgcgacggcagatcaagcgcaacatggcgaccgacgagatcagaagcccgatccggccggtggactatgtgccgccgcagcggctttatcgtgaggtttcggcggggcacctggtgcaggaagcggcttga

SEQ ID NO: 10644 - DNA, 565 bp, Glycine max
  Peptide Sequence Number=SeqID_127422
gccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcacctccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcacccctctctggcgcccccttccaggggacttgggcccggtccgccactgaggacgcttctccagactacaattcggacgccgagggcgaccgattttcatggtgggcttttcccggtctcgttgggagcgtgcgtgcacgcaaagggtcgtcgatgggtccagaactgaccggctcgcacgtgattggtctcgagcgtggctcatccaccattttatcacggcgaagtcggccatga

SEQ ID NO: 10645 - DNA, 1392 bp, Glycine max
  Peptide Sequence Number=SeqID_127423
atggagctggaagacgaggaaggcaaccgcatcagcctgattgaaaagtacgacggcagcgtggccaacccggcgatccgccgatgcgagctgatgacccgcattcgcggcttcgaaaatatctgcaacgagatgggatatatcggcgagttctacacgctgaccgccccggcgcgctatcacgccacaatcaaaaccggttatcgcaaccgcaaatggaacggcgccagcccggccgacacccagcgctatctgtgcagtctctggcaaaaaatccgcgccaagcttcaccgcgaggaaatccgcattttcgggatccgcgttgccgagcctcatcacgacgcgaccccgcactggcacatgctgatgtttatgcgtcccgaacaggttgagcgcgtgcgcgagattatgcgcgactatgcctgtcaggaagacagcggtgagctaacgaccgacaaggcccgcaaggcccgctttcacgcggaggctatcgacccggagaagggcagcgcaacgggctacgttgctaagtacatttccaaaaatatcgacggctacgcgctggatggcgagacggatgacgaaagcggcaaagagctgaaagagacagcgccggccgtttccgcctgggcggcacgctggcacattcgccagttccagtttgtgggcggcgcgccggtgaccgtttatcgcgagctgcgccgcatggccgacagcgaaaccgcgcacgggctcagcgttgagtttgcagctgcgcacgacgctgctgatgcaggtgactgggcagggtacgttaatgcgcagggcggcccgttcgtgcgccgcgatgaactggccgtgcgcacctggtatcaggccagcgaagaagtgaacgaatacggcgaggaaaccgtgcgcatcaagggcgtttttgccactgaagtcggagaagatacgccaattttaacccgtctcgcgcagtggaaaattgttccgaagcgtgccgttgattttgcttttgaccttcaggacgcgcacgcgtcctctcggagttctgtcaataactgtacgggaggtttgagatctgaggattcgaacccgccggaaagtttcgacaaaattgaccctgacggcatgagcaggaaggtgcgccggcgattgctggcgcaaatcagggcgcagcaacctcaaaaactacataagaagctccggcgatcggacaaaatcgaagctgcgtgcgacaacctgataagccaggtgagagatttaagcggtgaaactatcagtcgcggtctggccgtgcgcctcattggtggtactcagaccgagattgccgggcggatgttccgcagctccgcttatggtgacctgctcaggccgcatcgtggcactgatcctagtgggatcctctag

SEQ ID NO: 10646 - DNA, 399 bp, Glycine max
  Peptide Sequence Number=SeqID_127424
atggatatgatggaaagggatcttcctaagaagggttcaaccaataccttcatggataacactaaaggacccaaaaagatttgggtacctaagaaaaatattattcttgctgcaaatgtccttgataacaggaagcagacgcctatcatggagaaaagtgtatgttccaatgcctatcgcggtggaatagtcactttcagagggaatcaaagagaaagaataaccggagtaggtattaagcccaatctactgagcataattcaattatgtaatagtggatatggtgtctccttcaacaaggataagtgtgtccttctatgtcatgatgtgtctcctttattctcttccaagagaaaaggcaacctttacaaaataagactgggaggaactctcagatga

SEQ ID NO: 10647 - DNA, 291 bp, Glycine max
  Peptide Sequence Number=SeqID_127425
atggtagccataaccctagccaaggttcatcaacctccatttcttcgacaatacgactcgaacacaacgtgtgcttgtcacggagaagccccggggcgttccattgagcattgtagggctctgaagcgtaaggtgcaagatgtctctaatgactcctcaggattttcaactttcaccggaatatgggtgcaagccattggtctgtttgctcaagcaacctgtgctcttgagtttggacttccaagaccgttcaatcagagattactcgtcttgcacgttggtggggctgcc

SEQ ID NO: 10648 - DNA, 279 bp, Glycine max
  Peptide Sequence Number=SeqID_127426
atgaagaatgccacttctgaatctcagattttgcagcctcaacttcattctggaatatgcaatgatccaggaaacatttttaggaaattaataaaaaggtgtactaagaaatacctctcacgaagagacaaaatcattcttgttgtcacaccagaagcagcatcttcacttttattattgtttcatgcacttctcattgctccaagctgtgggatgaggatggatgatgagaagttctaccagaagtcaggtagcctattaactgttttggcttgctaa

SEQ ID NO: 10649 - DNA, 421 bp, Glycine max
  Peptide Sequence Number=SeqID_127427
tcctggaggagggccaacactgcgaattcagtcagaggaggagctaggcctcgtgcatgaccaccctaacacagatttggatgacattgctactcagcaacatcctcctcagcgatcacaattccaacctcccccgccgaagtgccagctagtctatgccatcttgacccagttttatgcggtgccagttacttccaccaagcttatctggcctccccttaacaaggccttcatagaaaaatattgcatgccaaggcaggcacaacagcagggtcaagcacagcagcagcaggcatccgcagatgcgccgccaccacctctaggtgttcagacaggggcagaacccgcagggactaccggagatggagatggagcacaagatgatgatgacatggccgatgtgatggacttcattctttga

SEQ ID NO: 10650 - DNA, 195 bp, Glycine max
  Peptide Sequence Number=SeqID_127428
gaaatggccccgaggaagctagcctcaaagaggtccaggaaggacaaggcgaccgaaggaactagttccgctccggagtatgacagtcaccgttttaggagcgcggtacaccagcagcgcttcgaggccatcaagggatggtcgtttctccgggagcgacgcatccaactcaagacgttaaagaagcgctactag

SEQ ID NO: 10651 - DNA, 354 bp, Glycine max
  Peptide Sequence Number=SeqID_127429
gaacgtcctgagttgaagttgtcctcccatggaaggaaggtagataaatttgataggcctgctccagagattgaaggcttagtggctgccacaagattaagttctctaattgcatgttccttggacactagtgataggggacttgtatctacttttgtggagaggtggcataagggaactagtagtttccttctaccggtaggagaggtcactatcaccctggatgatgtggcatcgttgctacatctgcccattataggcaccttccatagctttgaggcttttcatgtggacgaagtcatggacctattagttgacttgcttgaagttagtttagaagaagcaagagcttag

SEQ ID NO: 10652 - DNA, 258 bp, Glycine max
  Peptide Sequence Number=SeqID_127430
ccctctctctccctcacgttgccattctcttcttcttcattctccattgaagctccacacaaagcttcaacctttggccatcatttctgccccaaatcgcgaaaggagagcattttcggggtcgtgaagtgcgtggctacgagtgggacttcgaaaattcagcttgggaggattgatggggacccggtgttgagagaaacgaggatatgggctacgtgggagtacgtgagctcagttggaggtgggcaacaggggatg

SEQ ID NO: 10653 - DNA, 426 bp, Glycine max
  Peptide Sequence Number=SeqID_127431
atgtggaaattcttcatcgttcttcaccgttcttcgtcgttcttcggtcttcaaacgctagaggcaagcaagcccgttgacatgcggagactaacgtcgtcatctgcacctttgtcatccagagacggcaagtccgatgacatgcggagataccttttggttatccacaccttttgtcagctagaggcaagcgagcccgttgacacgcacagactaacgtcatcatctgcacctttattatccaaagatgacaagtccgatgacatgcagagataccttatggttatccgcactttttgtcagctagaggcaagcgagcccgttgacatgcagagactaacgtcatcatctgcacctttgtcatctagagatgacaagttcgatgacatgcggagataccttttggttatccacaccttttgttag

SEQ ID NO: 10654 - DNA, 660 bp, Glycine max
  Peptide Sequence Number=SeqID_127432
atggagggaggtgtccctgaagctgatggctctgctttcaaagagtgcatttctctttcaaagaacaacccttatgttcttcgccttgctttttctgctggaattggaggccttctctttgactatgacactggtgtgatatctgggtctcttttgtatatcagagaagatttcaaagatgtggacagaaagacttggcttcagatttacccagaaggggaagttgaagctgagattcaaaatttgagggaatcaactgaaatggaaatcaaggaagtagaagctggaggtaaggtgagcctggtaaaaatgctcaaaatcacaagtgtgaggagaggtttatatgctgggatgggcatagccattttccaacagtttgtgggcatcaacacagtcatgtactacagccccaccatagctcagttatctggttttgcctccaatcaggtagcaatgcttctgtcactcatcacagcaggggtaaatgcatttggttccattctgagcatatacttagttgataagactgggagaaagaagcttgctcttattagtttggttggagttttggcatcccttgttcttcttactgtcgtttttcgccattccgagatttcctcttcactgcagctaccaaccacgatcaatgggatttcatga

SEQ ID NO: 10655 - DNA, 2211 bp, Glycine max
  Peptide Sequence Number=SeqID_127433
atggctgatagtagtgggtctatgggggcaagttgtcccactgcaccaataaggggacaacgaactccaccggaatctgaatcacctgctgactccaacactcaatcttcatccgaaggttcgcaggaggtgcgtagcaaaattaaacgtagtcatgagcttgtggatcaattcaaccaagaaaaatttaattctgcgattacaaggatgattatcgttgatatgcttccatttgaatttgttgaaaatcccggatttagagaatttagtgctctgctagcagctccagtggaatcatttggagaattttttagcgctcttctgacaattccaacggaatcacctgttgtggcatctttgcaagagttaggtaacaatttgacttatgatgagcttgtggaattccaccaagagttttgtacacaagcgcttgcgaagatgattatcattgatgaacttccttttaaatttgttgaaaataaaggatttggagaatttgttactgcttttcaacctcaatttaaaattcccagtcagataaccattgttgaagattgcatgaatttgcacagggtggcaaaagcgaaattgaaattcaatttgtctcaaaacaaacaaatgatgtcattgactactgatacttggacttcaatccataataagaattatctgtgtgtgactgcccactgtattgatgaacggtgggaattaatcaagatgattttgagttttgtattgattcctgaccataagggagacaccataggtaaagctttagagaaatgcttgaaagagtgggaaattaccaaaatttgtactattacagtacataatgctgatactgagaatttggcttcatcgtatttaattcaaaatatgtgtggttggaatggcactaccttactgaatggggagcatgtgcacttgaggtgttgtacccatatattgaactcaattgtgtctgatggattacaagaaatggattgttgcattgcaagaataagggctgcatgtaagtatgttaggtcattttcatctagatatgcgtgttttaagaggtgtgccaatttggcaaatataaactgtgatcaaatgattgtgcttgatgagccaacaaagtggaattccacctatttaatgttggtggttgctgaaaagtttgaaaaggcctttaacctccttgaatttgaggatgattcttatgtgaaatctcttgataatgaagggggacctccaagtgctgatgattggaatcgtgcacgtgtatttattaaggttttaaaggttttttatgaggctacactttctttctctggttatttgaatgtaagttctaactctttcttgcggatgtgggtcaagattcaaaatgcgttgagatcatggatggagaatgatgattttgggctgcaacagatggcaactactatgaaattgaaatttgacaagtattgggatattgatgggaatattaataatctgttgtttgtggctatttttcttgatccacgattcaagtttaaatatcttgaattctgttttgggagaatgtatggtcctgaaaaatgcaaggacatgcttaaaaagttggaagatttcataaaagaattgttcacacagtatagttcatcgcatcctattattcctgatatttgtgagtctagtggcctatcctttgatgttacctcccaaacaattgtgagtaatgatgatggtggtaatatggatatggatgaggagtatggaataacagtgaagaaaatgctagatgaacttgagaaaaatgagctagagagatacatgaaggatcatgtagaggttaattatgatggatttgacattttgagatggtggaaaggcaagtccactaagtattatgttcttgcacacatggctagggatatattagccattccagtgtctagcgtgtcttttgaggatgcatttagcacaggggatcatgtccttgatcgataccatagttgtttggatcctaccacagtcgaggctttgatctgttcaaaaagctggttgagccacaacttaagaaagaactgggattcacatcaaacatttgatgtggtgcaagctgaaagagatatgttagaagattcagaccttgaggagtatgatgctaccacacttgaggctttggtctgtttaaatagctggttgagtgacgacataggaaagaatggggattcacattaa

SEQ ID NO: 10656 - DNA, 522 bp, Glycine max
  Peptide Sequence Number=SeqID_127434
atggaaggatacatatccgtagactctggagtattctcttcattggaacaggaacaagatccttatgaacaataccatgtctccaactaccaacaagttgatgataaaaaatgcatcaaccccaagatgggtggagaaatggtgcaagagatcaacaaatataccatcactgagaacaatactgttcctgaatgtgtgattgaagttgtggtgcaaaatgaattgccaaaggaaattagtgaaggatactccaataatgtgaaaaggccgttacttccattggaagtacatgatagtgatagagcatgtaaagagaaacatgtccctgccagatttaaatgtgatagaccacatagaattaagcgtgtgaatgatgagagcatgaagaggagaaggtcagcaacaacgaagatagaagcagaagtagatgaagagaatgagtttaatagtatgacaaatgaggagctcaataggagagttgaggagtttattcagaaatgcagattagacttcaggcaatga

SEQ ID NO: 10657 - DNA, 219 bp, Glycine max
  Peptide Sequence Number=SeqID_127435
atgagcactcaccgaaggagcagttacagggaacaacaccaacaagaaggatggaaagaaggtgtaatttcaagttcaaggaatgcgatatttgggatagataacgtacattacatggtaagagttggagtgtcgaagctgaacatgaagctagtgagcgcaacgcctggaagtaaggagaaggaacgcggcagaggcagaggcagtgcagtaaggtag

SEQ ID NO: 10658 - DNA, 1536 bp, Glycine max
  Peptide Sequence Number=SeqID_127436
atggcatccatgtctcttattcttctttggttcctcttttttgctagtgaaatgatgtcaatgggaaatagtttacacaaggggcacatggtaatggaagaggaggaactgttgggattgtttgaagtgatggatgctcttctggaagacccttactgggcccaagcacatccaaagccatgcactgatactccatggccaggtgttgagtgtgaacttggcagcaataaccaacaaatctttcatgtcaccaaaatccacattggtcctgatatagtcttcccattctcaccttgcaaaccctcagcttatctctcacactccttgctgaaactcaagtatataaaaaccctttcaatttttaactgttttgttgcttcaccagttactctacccaaaactctctttggtcctttctcttcactagaacacttagctttggagaataacccttccctctatggtgaaatacctacaagtttgggaggtgttgctggtcttagggtcctgagcctctcccagaacagcttacaaggaaacatccctagccagattggtggtttggttagtctagagcaacttgaccttagttataacaacttgagtggtcaaatcccaaaggaaattggaggtttgaaaagcatgaccatattggacctaagttgcaatgcagttgaagggtttctgccttgttctcttggaaagcttcaacttctccagaagatggatttgcactctaacagactcagtgaaaacattcctcctgatataggaaacctcaagaggttagtcttgcttgatttgagtcataattttattgtagggcctattagtgaaaccttctcaagtttagaccttttggaatatttactcattgatgacaaccccattaaaggagggataccccagttcatagggaagcttaagaagctcaaatcattgagtttatcagggtgtggattaacaggttctataccctactctttctcttccttgaaaaatcttacagctctctccttaggtaacaatagtcttattggacaagttcctccaaatttgggttcactcccaagcctagatcaactgaatatcagccacaacaagctgagtggggttctagagctacctggtgacttcattcaaaagttaggtaaaagattggatttaagaggaaacagtgaactctgcatcaatgatcagtcaaagaagaagaacctctcttcttacttggaaatcccttcttgtttgaacacacgacagagaaatgatgataattattttgccggtggaccacttcaagatctttcaggactaaagccgtcttggtatgatagcaacccaacctttagcaaaagtaggaggcaggagtgtcggttctgtgacattaatgagagcatgctgcattgctgcaacaccctggttactggcaccatgaaaaaagattcccacctcagcacttgttttgatgtgttgggagagacagagaatcttatgagaaattctcaatctttttaccttcaacttgcaaagttttaa

SEQ ID NO: 10659 - DNA, 2414 bp, Glycine max
  Peptide Sequence Number=SeqID_127437
agcggcaccatggtggcgatctcgttgacctcacgcatcgctgcccatgcgtgcggaatgcgtcggctttccttgatcacctgttcgactgcggcaacgccttcgcccaccggcaccacgatgtcgaccaggcccatctccttcagctggctggcggtgtagaggttgccttccagcatgatcttctcggcttggcgcgggctgatccgctggcacaggaaggagtaggcgcccatgcccgggaacaggtcgaacagcacctcgggcaggcccatcagcacgccttcctcggcgacgatggtatggcagctgagtgcggcctcgaagccgccacccagtgcattgccctggaccagggcgatgctgtgggcacgggtgcccaggccggcatggaaggcatgcacgccgcgcacgcagcgctgggcatagtcgagcaggcgggcgcggtcgccttcgcggatcaggcggcagaacagttcgaggtcgccccccagggcgtgcgaggcgctgaggcggtcgcccaggtcgcgctggtagtcgacgatgtcatcgaccaggcgcgaggcgaagcacggccggcccggctggttgaccaggttggcgtgcatgtggatccagtagacatcccgctcgggctcctcggtgatacgcagggtagggtgctgcgaggggcgggtgatgatggggcgtactgcggacatgggagttctccgtgtgaccgtccggccaaccgcagagcggacggagaggaaaagaccccgccgtctccggcggggtccctgtattgtcccgttgcccggaaacccttactgggcgggcgtatcacgcagctcgcgacggagaatcttgccgacattggtcttcggcagctcttttcggaattctacgattctggggtgcttgtaaccggtcaggtttgcccgcgcatgttccttgaccatttccgcggtcaggttcgggtccttcttcacgatcacgaccttgaccacttcgccggacttctcgtccgggacaccgacggcggcgacttccagcacgcccggcatcatcgcgatgacgtcttcgacctcattcggccagccgtcggcgtcgatggcggtggcggtttcttccggccgctgccagtagcccttcattacctgcgggcccttgatgcacagctcgcccacttcgcccagcgccaggatattgccgttgtcgtccttgatgcaggcatcggtggacgggatcggcaggccgatggcgccgttgtactcgggcagggtgagcgggttgatacaggctgccggcgaggtttcggtcaagccgtaggcttcgaccagggtcacgccggtgaccttcttccagcgttcggccacggcacgttgcaccgccatgccaccgcccagggtgaacttgaccgaagagaagtcgatctcgtcgaagcccggggtgttgagcaggccgttgaacagcgtgttgacgccggtgatggcagtgaagcgggtgcccttgagctccttgacgaagcccttcatgtcgcgcgggttggtgatcaggtagttgcagccaccgaacttcatgaagaccagaccgttcgcggtcagcgcgaagatgtggtacagcggcagggcggtgatgatcacttccttgcccggctcgatgcccgaggtggacaaccacgccgacgcctgctgcatgttggcgatcaggttgcggttggtcagcatcgcacccttggccacgccggtggtgccgccggtgtactgcaggaaggcgatgtcgtcgtggtcgatctcgaccggcggaagcgcgtggcggctgcccagcttgagcgcctgcttgaagcggacggcgcccttgatgtggtagttgggcaccatcttcttgacgtacttcagcacgaagttgacgatcgcgcccttggcgccgagcaggtcgcccaggccggtggtgaccacgtgcctgaccggcgtgtcggcgatgacctgctcgacggtgtcgccgaagttgtcgaccaccaccagcgcactgacgccggcatcaatcagctggtgcttgagttcgcgcgcggtgtacagcgggttgacgttgaccacggtcagtccggcgcgcagcacgccgaaggtggccaccgggtactgcaggcagttgggcatcatcagggcgacgcggtcacccttcttgagcttgagctcacccagcaggtaggcggcgaactgggtgaccagcgcatccgtctcaccataggtgaggaccttgccgaagctggagtaggcgggacggtcgcggaatttcgcgacggaagcgtcgaagaccgaggcgaccgaatggaattcgttgacgtcgatttcggcgggaacgcctttcggatagctctgcagccagggacgatccagactcatattccccctccaggaatcgtgatgttttag

SEQ ID NO: 10660 - DNA, 512 bp, Glycine max
  Peptide Sequence Number=SeqID_127438
atggtccgcggcaccttcgccaacatccgcatcaagaacctgatgttcggtggcgaggaaggcggcaacaccctgtactacccggccggtggtggccagccggaaaagctggcgatctacgatgcggccatgaagtacaaggccgacaaggtgccgctggtggtactggccggcaaggaatacggcaccggctcgtcgcgtgactgggcggccaagggcaccctgctgctgggggtgaaggcggtcatcgccgagagcttcgagcgcatccaccgctccaaccttgtcggcatgggcgtgctgccgctgcagttccgcaacggcgaaaacgcgcagtcgctgggcctggacggctcggaagtgatcgacatcaccggcctgcaggacggcgccagcaagcgcgccacggtcaccgccaccaaggccgacggcacgaagaagaccttcgaggtgtcggtgatgctgctgaccccgaaggaagtcgagtacttccgccacggcggcctgctgca

SEQ ID NO: 10661 - DNA, 657 bp, Glycine max
  Peptide Sequence Number=SeqID_127439
atgtttgcaaattgcaatgagtatgttttatacagcagaatattgctgaatgctccaaccttgacatcattcaactattgtggtggagaattagctactgctagagcagcatcagcagctggcacaatcatggtgtttaaagacagaaatgtggttgctcagcttgtgagaagagctgaaagagctggtttcaaggcaattgcccttactgtcgactctccaattcttggtcgtagggaggctgacatcaaaaacagatttacattgccaccaaacctggttttgaagaatttggaaggattggatcttggaaagctggacaagactagtgactccagtcttgcctcatatgttgctgaacaaattgatcagtcactcaactggaaggatatcaaatggcttcaatcaatcacttcattgccaattgtagttaagggtgtacttactgctgaagatactaggatagccatacaagctggagctgctggaatcattgtttccaatcacggagctcgtcaacttgactatgtccctgcaactattatggccttggaagaggtagttaaagctgcacaaggaaaaattccagtttttctggatggtggaattcgccgagggacagatgtttttaaagcactagctcttggagcagctggt

SEQ ID NO: 10662 - DNA, 258 bp, Glycine max
  Peptide Sequence Number=SeqID_127440
atgagaaggaaaagcagaagaagaacaaaggcaacaccccaaggggaaccaccagctctgtggatggcactaggctcagatcctggcatggggaagcttatttgggttgcagtggagagccaaaagccacagatgagtgctgtggctactatcaagagccagatctctgagaagctgaagcctgaggctgctcttgtccctgaagaagccatgaaactgggagggagagttaagagtcaagagtgtgctgtaaagtag

SEQ ID NO: 10663 - DNA, 546 bp, Glycine max
  Peptide Sequence Number=SeqID_127441
atggctcaccctgaaggtatgccatcagattttttggtgttgaaagacaaaaatgtggttgctcagcttgtgagaagagctgaaagagcaggtttccaggcaattgcccttactgtggacagtccagttcttggtcgtagggaggctgacatcaaaaacagatttacattgccgccaaacatggtatttaagaattttgaaagattggatcttggaaagctggacaagacttgtgactctgttgttaccacttatgttgctgtactatttgatcggtcactcaactggaaggattgttttctcaatcatgaagccaattccatatactatgctaataatgtagcaaggatagccatacaagctggagctgctgggatcattgtttccaatcaaggagctcggcaacttgactatgtccctgctactattatggctttggaagagattggtagacctgtgatgttttcattggctgctgatggcaaggctggtgtaagaaaagtacttcgaatgcttgttgatgagttagaagtaactataaattga

SEQ ID NO: 10664 - DNA, 435 bp, Glycine max
  Peptide Sequence Number=SeqID_127442
atggatatgataactaatgttaccgagtatgaggcagttgcaaaggaaaatttgccaaagatggtttatgacttctatgcatcaggggcagaggatcagtggactttgaaagagaaccgaaatgcattctcaaggattctgttccggctgcgtattcttgttgatttaagcaagatagacttgactacaactgtattgggcttcaaaatatcaatgcctatcatgattgctccaacagccaagcaaaagatggctcaccctgaagcgtctagaggggtttccaaagatgcaaaaggtttctttaaaaatctgggggcttgcactgtttcgatggcagaactcggtgctatattgactgctcttgaattgccatggcagagaggagcctcctatgattttgtagggatcaaattcccacgtagagtttcgttgtag

SEQ ID NO: 10665 - DNA, 912 bp, Glycine max
  Peptide Sequence Number=SeqID_127443
atgtatgcggaatgctacgctgttatgtccgcgcgcatggtgttcgatgaaatgactgatagagatgttgtctcctggagctccttgattgctgcctacgtcgctagcaactcccccttggatgctttttacgtctttcgtgaaatggggatggagaatgaacagccgaactcagtcacgttggtgagcttgctatctgcttgtactaaaacgctcaatctcagggtcggcgagtccattcattcgtacgttacaagcaatggcatagaaatggatgttgcgttgggaacagccttgtttgagatgtatgctaaatgtggggagattgataaggctcttttggttttcaattcaatgggtgacaagaatttgcagtcgtgcactatcatgatctcggctctcgcggatcacgggcgagaaaaggatgttatctctttgtttacccagatggaggacggtggattgcggctggatagtttgtcttttgccgtgattctctcggcctgcagccacatgggacttgttgatgaaggcaaaatgtattttgatcggatggtgagagtgtatggcataaaaccgagtgttgagcattatggatgcatggttgacttgctaggaagagctggcttcattcaagaagcttatgatatcatcaagggcatgcccatggagcccaatgatgttatattgaggagttttcttggggcttgcagaaatcacgggtgggttcctagtttggatgatgattttctgtctgaactggagtctgagttgggggccaactatgtgctcactgctaatgttttttccacctgtgcttcatggaaggatgccaatgacttgagggtagccatgaaactgaaagggttgaagaaagttcctggttgtagttgggtggaggtgcaaaattga

SEQ ID NO: 10666 - DNA, 132 bp, Glycine max
  Peptide Sequence Number=SeqID_127444
atggcaattgcccttactgtggacactccagttcttggtcgtagggaggctgacatcaaaaacagatttacattgccgccaaacatggtatttaagaattttgaaagattggatcttggaaagctggacaag

SEQ ID NO: 10667 - DNA, 348 bp, Glycine max
  Peptide Sequence Number=SeqID_127445
gaatcgcacccacaaagacacccagtgggcccggagaagtccaacagggccctggggtttcctgctctgggatcgcgcctgcaagacacccagtggacccgaagaagtccaacagggtcttggagttgtcaagctctaattacgggtctctgtcagttctacggagtacctgtcacctccagcaagggcatcaggccccctactaatcgagctttcatcaagaagtactgcgtctccaggcaggcgcagggcgaaacaccacagcagcctggggatggctggcagcaggcaacagacgcaccgccatcacctctagagttcaccttagcccatccacaaaaaggttag

SEQ ID NO: 10668 - DNA, 138 bp, Glycine max
  Peptide Sequence Number=SeqID_127446
atgaaagcaaaagtgcacaatggaagcttggggctgctgccaagtgtggctcctcgttatcgtgttcaattttacttaaatgcttatggcaccctattgatcaagccgaatgactccggattcagtgggcaagattga

SEQ ID NO: 10669 - DNA, 333 bp, Glycine max
  Peptide Sequence Number=SeqID_127447
gatatcaaatggctccttacaataacttcatcgccaattttattaaagggtgtacttactgttgaagataccaattccatatactatgctaataatgtagcaagggtagccatacaagctggagctgctgagatcattgtttccaatcaaggagctcggcaacttgactatgcccctgctactattatggctttggaagagattggtagacctgtgatgttttcattggctgctgatggcgaggcgggtgtaagaaaagtacttcaaatgcttgttgatgagttagaagtaactatggcactaagtggttgtcattcactcaaggagatataa

SEQ ID NO: 10670 - DNA, 1107 bp, Glycine max
  Peptide Sequence Number=SeqID_127448
atggatatgataactaatgttaacgagtatgaggcaattgcaaaggaaaaattgccaaagatggtttatgattactatgcgtcaggggcagaggatcagtggactttgaaagagaaccaaaatgcattctcaaggattctgttccgaccgcggattcttgttgatgtaagcaagatagacttgactgcaactgtattgggcttcaaaatatcaatgcctatcatgattgctccaacagccatgcaaaagatggcccaccctgaaggagaattagctactgctagagcagcatcagcagctggcacaatcatgacactatcttcatgggctacttccagtgtcgaggaggttgcttcaacaggtcccgacattcgtttttttcaactttatgtgtttaaagatagaaatgtggctgctcagctcgtgagaagagctgaaagagctggttttaaggcgattgcccttactgtggacactccaattcttggtcgtagggaggctgacatcaaaaacagatttacattgccatcacacctggtattgaagaattttgaaggattggatcttagaaaactggacaagactagtgactctaatgttgcctcctatgttgctggaccatttgatcagtcattcaactggaaggatatccaatggctccaaacaatcacttcattgccaattttattaaagggtgtacttacagctgaagatacaaggatagccgtacaagctggagttgctggaatcattgtttccaatcatggagctcgccaacttgactatgtccctgctactattatggctttggaagaggtagttaaagctgcacaaggaaggattccagtttttctggatggtggaattcgtagaggtacagatgtttttaaagcactagctcttggagcagctggtgtattcattggtagaccagtgctgttttcattggctgctgatggtgaggctggtgtgagaaaagtacttcaaatgcttcgtgatgagtttgaactaactatggctctaagtggttgccgttcactcaaggagataactcgtgaccatgttgtcacagagtgggatcgcccaagatttgctcctaagttatga

SEQ ID NO: 10671 - DNA, 219 bp, Glycine max
  Peptide Sequence Number=SeqID_127449
atgaggaagaattgcaacttggagcttcgccttttccctccttccctctccgatcttcgccccatgatggaagcagaagttagtgagagaccccaacaacaggtcgcccaccatcaacagcaacagcaaccacaaccacaacatccgctgaccattttctatgatggcaagatttcagtttcagatgtcacagagcttcagacacctgggaaaaaataa

SEQ ID NO: 10672 - DNA, 147 bp, Glycine max
  Peptide Sequence Number=SeqID_127450
atgaatgtgtatgcagtcccaatagcttcagttacggataagaaggaccgggaaacaatgaggttagagacccaaattgctgtggatgccattcctccacatactcctctaaaccttaaagggtgtgaattctccacctctctgtaa

SEQ ID NO: 10673 - DNA, 1629 bp, Glycine max
  Peptide Sequence Number=SeqID_127451
atggcagcactcaattcaagcacttgtgccaaacctcaattccctcaccctctctcctcctctttctcttcttcttcatcattaacaagagatttgggcttccccacaaggtttcagaagaagcccattagaaaggtggtggattgtgctctacactcccccccagtgatccatttcccaaaccagccctacaacaaacctgaaattaccaaagaacccaccacctccaccgcggaaaggcctcagtggaacccattccaaaaagccgcagcaaaggccctcgacatgttcgagagcgcgttgctctcacgcgagctcaaccaaccctttcccaaaaccactgacccacgcgtccaaattgccggtaacttcgcccccgttccggaacaccccgtcgaacattctctccccgttattggcacaatccccgacgccattaacggcgtctacctccgtaacggcgccaacccattgttcaagccaaaagcgggccaccacctcttcgacggcgacggaatggtccacgccgttaaattcaatgacggcaccgccagctacgcgtgccgcttcaccgaaacgcagcgtctcatgcaggagcgcaaattgggaaaacctgtgtttcccaaggcaatcggcgaactccacggccattccggcatcgcgaggttgatgctgttctacgcaagaggcttgtgcggcatcgtcgaccaccgcagaggcgccggcgcagccaacgccggcctcgtcttcttcaacggaaaactcctcgccatgtcggaggatgatttcccctacgaactccgaatcaccgcctccggcgacctcgaaacaattggccgctacagctttcacggccagctcaattcctccatgatcgcgcatccgaaggtcgatcctgtctccggagagctttttaccctaagctacgacgtcacgagcaagatcctcaaatacttccatttctcgcccgaggacgagaggaagtcgccggacatagaaattccccttgacgcgccgacgatgacgcacgacttcgcgatcacggagaatttcgtggtgatcccggaccagcaggtggtgttcaagctcggcgaaatgatcaaaggaggatcgccggtgatctacgacggcgagaagaaatcgcggttcggaatactgccaaagtacgcttccgacgcgtcgagcatcgtgtgggtggactcgccagacacgttcttcttccacttctggaacgcgtgggaggaacgcgacaaagacgaagtggtggctgaacatgagaagcgggaaggcgaggaggagggtgctggtggaggaaatgaacctggaggcagggatggtgaacaggaaaaggttggggagaaaaacacggttcgcatatttgtgcatagcggaaccgtggccgaaggtgtcgggggtggcgaaggtggacctggagagtggggaagtgaagaggcacgagtacggagagagaaggatgaagggtacgtgatggcttttgtgcatgacgagatgacgtggcagtccgagttgcagattctgaatgcacttgatttgaagttggaggccactgtcatgctgccttcaagagtgccctatggcttccatggcacgtttgtggaggctcattga

SEQ ID NO: 10674 - DNA, 156 bp, Glycine max
  Peptide Sequence Number=SeqID_127452
ggaaagggaggatttgaattgcttcaaacctatcgccccaccaaaaccctcacgcagtcttacaccgctgctcttaggagagatcaaattcggtccattttaagatcaaaaaggtttaaaacaacaggttcgattcaatcaactatgcgtctgcgg

SEQ ID NO: 10675 - DNA, 434 bp, Glycine max
  Peptide Sequence Number=SeqID_127453
acctagagcacgatagcacgcagagactaacgtcgtatcctgcaccctttgtcaatcgcgacccagagcacgatagcatgcagagactaacgtcgtcttctgcaccctttgtcaatcgcgacccagagcacgatagcacgcagagactaacgtcgtcttctgcaccctttgtcaatcgtggtccgagcccgttgacacacccagagcacgatagcatgcagagactaacatcgtcttctgcaccttttgtcgtcttgacccgggcaaacaagctcattgacgcgaagagactaacatcgtctcctgcaccttctgtcgtcctgacccgtgaagtcaggtggcaggcaaagatacctgatggtcatccgcgcctttcgtcaactgaggggaacgaattcgacggtatgaggatgatgttggtcgttcagtgctga

SEQ ID NO: 10676 - DNA, 423 bp, Glycine max
  Peptide Sequence Number=SeqID_127454
atgccgataaacaatggtccccgggcgaaattagggtatgacacctaccaagtaatgcaacatgaatttaacataaatccatggttatatgctttagatttcgttcgatcacaaggacagctaaatgctaatgacatacctcacgggacaccgttagggtccattgattatacttttgatcgtatacctttaacggaccttaaatgcttaaccaagactttcactcccggttatggggtcaaccgtttccttttatcagttcctgggccaccccctgatattgaggggcgaccaactgtgctagcacaaccagagagggaggctatcgcgcagctactatgcataccggggcaagatttcacccgtgccgctgtaaagagacgagtgcggatcatgcgcgccaacatgaccactcttacatag

SEQ ID NO: 10677 - DNA, 363 bp, Glycine max
  Peptide Sequence Number=SeqID_127455
atgtcaaaaagtagtggttcaaaaatagccaaattttggcatgataatcccctatatgcgctttcaaagatttattaccctccaattgctgcagtttccatatcctatccaaaagaagctattagatcagaatgcttgatggatggtgagttgaaggggtttggtcaattgcatccatgtaaccaaggagtggaaacattagcggaatggagaaggaagagagagaggagacgccacttcaaggagaagataagtctagaagaagctcaccaccataggaggccatggataagagcttggaggaaaaaggagatgaatgaagggagagggagagaagagcacgaaattttgtgctctaaatga

SEQ ID NO: 10678 - DNA, 552 bp, Glycine max
  Peptide Sequence Number=SeqID_127456
atgggaaagttggatcatctagaggaaaggctcagggccattgaaggaggtaaagattatgcatttgctaacctagaagagttgttcctagtacccaatatcatcacccctcccaagttcaaggtgctggactttgacaagtacaaggggactacttgccccaagaaccatctaaagatgtattgtcggaagatgggggcatacgcaaaagatgaggaactgctgatacatttcttccaagaaagtcttattggggtagctgttacctggtacgctaacttggaaccttctcgagtccattcttggaaggacctagtggttgcctttgttaggcagtgtcaatataatgtctcgggtaggaggaaactacagaacatgtgcaaaaacggggcacagatctttcaaagaatacgcccaaaggtggagggacctggcagctcaagtggcacctcaatgacggagaaaaaaatgatgacaatgatagtagacacattaccagtattctactatgaaaaatggtgggttacacaccttcaagctttgctgatttag

SEQ ID NO: 10679 - DNA, 999 bp, Glycine max
  Peptide Sequence Number=SeqID_127457
atggagcctagtgcttataatttgatgattgggtatttgtgtgagcatgggcggactggtaaggcagagacttttttccgccagttgatgaaaaagggtgtgcaggattcggtttcttttaataatttgatatgtgggcactcgaaggaaggcaaccctgattctgcctttgagattataaagatcatggggaggagaggggttgctagagatgcggattcctacaggttgcttattgagagttacttgagaaaaggggagccggctgatgctaaaacagctttggacggcatgcttgagagtgggcatctaccggaatcatcgctttataggtcagttatggagagtttgtttgatgatggcagggttcaaactgctagcagagtaatgaagagtatggtggagaagggggtgaaggagaatatggacttggtttcgaaggtattggaggcccttctcatgaggggtcatgtggaagaagctctgggacgaattcatttgcttatgcttaatgggtgtgagcctgattttgaccatcttttatctgttctttgtgagaaagaaaagacaattgctgctctcaaactgttagattttgttcttgaaagagactgtatcatagatttttcaatctatgataaggttttagatgctctcttagcagcagggaagacactcaatgcttattccattttatgtaaaattctggagaaaggaggatcaacagattggagcagccgtgatgagctgatcaagagtcttaatcaggaggggaacacaaagcaagcagatgttttgtcaagaatgatcaagggaacagatggaggtcctccaaagagaggaggaaagagaaaaactacttgtttgcttgttatactgactgagattctaagatctgccacttcccagaatcagctatgcccttggagagcaagatgggattcattttttagtcctgctttctacagctactggacttctgttttgcaggttctataa

SEQ ID NO: 10680 - DNA, 183 bp, Glycine max
  Peptide Sequence Number=SeqID_127458
atgtgggcaatgaaagaatacaaagtgcagtcgtcttggactaagagtattgttatttctgttgatggctttgctattcggtccttctttccggtatgctctacaaaaagtggtgatattgttggaacaaatgtcatacctggattgatgaaattaagtgagcaagttgaagaagatgattag

SEQ ID NO: 10681 - DNA, 1407 bp, Glycine max
  Peptide Sequence Number=SeqID_127459
atggaggaggaggatgagattcttcaagcacgggcgtgtaagttgccaagaagaagaggcagtgatggggagagcacgaacagcaggttccacagcagcagctggcaccaccacaactcttcgaggatcataagggtgtctcgagcatctggtggcaaagacaggcacagcaaggttatgacttcaaaagggttgagagatagaagggttaggctttctgtgaacactgccattcagttctatgaccttcaagatcgcttgggttatgaccaacctagtaaagctgtggagtggcttatcaaatctgcttctgatgccatttctgaacttccttctttgaacaatttccctgacactccccaaagtgatgatcatgagaagagggaaaacaccgctgatgttgctgttggggtagtagatggtgagaatggcaatggccagaacttgagtttggctaaatctgcttgtagtagcaattctgagactagcaaaggttctggcttgtccctctcaaggtctgatattcgtgtgaaggctagagagagggcaagggagagaacaacaaaggaaaaggagaaagagaaagagaaaaatgatgagtctcatcgtcatcatcacaatgttgttgttgttcctcatcacaaccacaatgtgaacctcgtttcacaaacagcttctttcacggagctactcactggcagtgatcccaacaaagggtgtgatgaggctaataacaacatgatgttcaacaaagcagcaggtagactgcaatggtgttcatcaacaacacctatggactactttctggggctttcctcttctagaacaacgacacacaatcacaatcaccttcatcatcatcaatattcttcttcttcttctagtgggttctcattggcacaaatccaactaggacattctcttcctgaggcaatgaatcatgtttcagcattcaacaacaatgtgagtggtgataaccacaaccactcatcatcagatcctcatctgcagcagcaacacttgtcattgataccggatcatcttatgtcagctgtggttacttcttctgctgcttcttctcatcatcatcatcatcatcagcccagcgggaacgattacaatctgaactccaccatgtcttcgggcctcgctggttacaatagggggacccttcagtccaattctccgtctctgctgcctcactcgcagaggttttcgcctatagacggatccactgtacctttcttcattggagctgcttcttctgctgctgcagttgctgctcctgccatggagaacaacaacaacaacaaccatcaccagcatcagttctcttctgtttttgatggcagccgcttgcaactttactatggccattctgaccagaaggggaaagccaagaactga

SEQ ID NO: 10682 - DNA, 1137 bp, Glycine max
  Peptide Sequence Number=SeqID_127460
atggctgccacgagaccggtgcagtgtttgttacgaagggtttgcagaggaagtaggactattggggttgccacagaagttaatgcttcttcttcttctcagaaaatcatcgacaaggaatatgaacacagtgctcacaattaccatcctcttccgattgtatttgctcaagcaaagggaacctctgtttgggatccagagggaaacaaatatcttgattttctatcaggttactctgctgttaatcagggacactgccatcctaaaattctgaaagcattgcaagaacaggcagaaaggttgactgtgagctctcgagccttctacaatgatcgcttcccagactttgctgagtatgtgacaaacatgtttggttatgatatggtacttcctatgaataccggtgctgaaggtgtggaaacagcactgaagttagcacgaaagtggggttacgaaaagaaaagaattcccaaagatgaggctattattgtctcatgttgtggctgcttccatggtcgtacactaggtgtcatatctttgagctgtgacaatgaagctacccgtggttttggtcctttattacctggcaatcttaaagttgattttggtgatgcagaagcccttgaacaaatttttaaagaaaaaggagagcacatagctgcatttattttagaacctgtccaaggtgaagctggggtgatatttcctccagatggttatttaaaagctgttagagatctttgctccaaatataatgtcttgatgattgctgatgaaattcaaactgggttagcaagaacggggaagatgctggcttgtgagtgggaagaagttcgcccagatgttctgattcatttccaaaacaatgatataaacattacctgtcatcacagggttaacaaaatctataggcaactcttagacaatgtaaattgtcattgcactttgcaaatactagggaaagcattgggtggaggagttataccagttagtgcagttcttgcagacaaagatgtgatgctttgtatacaacctggacagcatggaagcactttcttgcctacagttgtcaaacttctgggttatgacgggcatctgttttcatccttaaagccctttattagtcagatcatgtga

SEQ ID NO: 10683 - DNA, 516 bp, Glycine max
  Peptide Sequence Number=SeqID_127461
atgagaattgatgctcatttaggaagtcaacacttgtacttgttagcagcattccggaaagaaacaagagggaaaatgaaacaaaggtcgccaagtgatctgaagtccatggcagttgaagctgttctgctgatgcaagggaagataaatgatgaagacgataccactgtttcaatccggcttctagttccatccaaggtgataggttgtattattggtaaaagtggttcaatcataaatgaaattcggaagagaactaaggctgatgttcgaatctctaaaggtgataagccaaaatgtgcagatgcgaatgatgaacttgttgaggtgggtggctcagttgattgtgtgagagatgcactaatccagattatcttaagactcagagatgatgtactgagagaaagggatactggccataatccttcaataggtgctgaatccttgtacccaggtagcgctggtctttcattgccatctatgatgcattcagttcctcctgttgctgctccgatg

SEQ ID NO: 10684 - DNA, 130 bp, Glycine max
  Peptide Sequence Number=SeqID_127462
ggatggccgacagcgggcaacaaacgcattgccactacctctagagttcacctcaactcatccacaaaaaggttagagcgttgcctacaacccgtggccgaccagcaggcgaccaagcccaaagccaaag

SEQ ID NO: 10685 - DNA, 614 bp, Glycine max
  Peptide Sequence Number=SeqID_127463
atgcagctggcacgacaggtcgacggtatcgataagcttgatctcataagggtggacccttgggtacttgtacctatcacttttagaggactacacgtccttgccaacagagggctgcacgccttcaccttcagaggactacatgtcctcgccttgagagggctacacgccctcaccttgggtactagttaccctcaccgtcagaggactacacgtcctcaccatcagagggctgcacgccctcacctcgagaggactacatgtcctcgccttgagagggctacacaccctcaccttggaggactacacgtcctcaccatcagagggctgcacgccctcacctctagaggactacatgtcctcgccttgagagggctacacgccctcaccttgggactacacgtcctcaccatcagagggttgcacgccctcacctccagaggactacatgtcctcgtcttgagagggctacacgtcctcaccttgggtactagttaccctcaccgtcagagggctacacgccctcaccttgaaaggactacacgtcctcgccagcagagggctgcacgccctcacctccagaggactacacctcctcgccttgagagggctac

SEQ ID NO: 10686 - DNA, 459 bp, Glycine max
  Peptide Sequence Number=SeqID_127464
atgtccagtgggccgatgaacaagtctgtgatttgttctcaaggtagaagagtagatgttggattaccttgtactgctatagaggagaaggaaacaagcatttatccttcccaacttcatccaaatgcttggggctttattcttgcattcaagaggctatgtcatagacataagacgatccttaaagcttacgaggaatcatattcaaactttaaggaaatttacttctggctaagacattctaaggactgtagggatgacctctttattgttgatgacaatgaggaaactttcatggggaagtcaaaggataaacctatgtcgattgctactctttttgttgccaacggaagtaataagaaaaagtcttcaaataagattggtttgtccgacaaagggaagggttctattatggaaacccactctaaagccattcatgacatgcctcccttaccttaa

SEQ ID NO: 10687 - DNA, 228 bp, Glycine max
  Peptide Sequence Number=SeqID_127465
atgttgttgctgggaaattctgtgtttggattgatggaaactgccaatgtggacacaccagatgacatgatggctgatggatttatgaatgccccagaggctaactttgatggtagggttgcagaagcttctaatgctaatgccgacctctttgaagagccggtatcccggttttacatgtattggaacaaatttgtttgcttgttgaacaagtatttctacttttaa

SEQ ID NO: 10688 - DNA, 195 bp, Glycine max
  Peptide Sequence Number=SeqID_127466
atgtcggataaaccagaaaggtgtggtctacgaattttaagtgtgaaaggttcgggagttgtatttatgcacggggaaggtgtttcccttgcttctacgtattcctcgattgtgataaggaaatcagacctacgtagttcttcgagaactgaacgttggttaagttgtttttatcctttgcaagatatattttga

SEQ ID NO: 10689 - DNA, 237 bp, Glycine max
  Peptide Sequence Number=SeqID_127467
atgggaagtgacaagattgaggggataatgcttgatcctccccagcgagcagtagtagattggagtggttttgcttttgagaaaatggaatggctcagaattctcattgttcgaaacacatctttttcatatgagcctaaacatctgccaaatcatttgagggtgcttgactgggaagagtatgatggaaataaatttgtatgtccacgattcaaatcatcatataatcaattctaa

SEQ ID NO: 10690 - DNA, 312 bp, Glycine max
  Peptide Sequence Number=SeqID_127468
atgggggggctatatttctgggagcgaactccagtcgaatatgaagcgcctggatacaagttatgccttggaatggaagagaattccgaatcagctttgtctacgaacaaggaagctataagtaatgcaactaggaatctcatggagagttcgatcctggctcaggatgaacgctggcggcatgccttacacatgcaagtcggacgggaagtggtgtttccagtggcggacggctggaaacggctgctaataccccgtaggctgaggagcaaaaggaggaatccgcccgaggaggggctcgcgtctgattag

SEQ ID NO: 10691 - DNA, 959 bp, Glycine max
  Peptide Sequence Number=SeqID_127469
cattagctctccctgaaaaggaggtgatccagccgcaccttccagtacggctaccttgttacgacttcactccagtcactagccctgccttcggcatccccctccttgcggttaaggtaacgacttcgggcatggccagctcccatagtgtgacgggcggcgagttgcagcctacaatccgaactgaggacgggtttttggagttagctcaccctcgcgggatcgcgatcctttgtcccgtccattgtagcacccatgcaccacctgtgtccgcgttcccgaaggcacccctctctttcaagaggattcgcggcatgtcaagccctggcgggatacttaacgcgttagctacagcattgcacgggtcgatacgcacagcgcctatgtcggcccagcagagtgctttcgccgttggtgttctttccgatctctacgcatttcaccgctccaccggaaatccctctgcccctaccgtactccagcttgacgctttacgcccaatcattccggataacgcttgcatcctctgtcttaccgcggctgctggcacagagttagccgatgcttattccccggataccgtcattgcttcttctccgggaaaagaagttcatgaccctcccagtgtggctgatcatcctctcggaccagctactgatcatcgccttggtaagctattgcctcaccaactagctaatcagacgcgagcccctcctcgggcggattcctccttttgctcctcagcctacggggtattagcagccgtttccagctgttgttcccctcccaagggtaggatcgaactctccatgagattcctagttgcattacttatagcttccttgttcgtagacaaagctgattcggaattctcttccattccaaggcataacttgtatccaggcgcttcatattcgactggagttcgctcccagaaatatagcccccccatccctcgt

SEQ ID NO: 10692 - DNA, 225 bp, Glycine max
  Peptide Sequence Number=SeqID_127470
atggatgcagaattcccaaagagatgtctacctaggagcctacttgaatgggaaaacaatgttgtcgtctggttctattcattgcacgataagcctgacaactattcgaaaggaattattaatagtgctttgaaaggattcaacgatattcaaggaagtaaatccaaggctactgctaaatggattatagttaaaaggaagctgttgaacaagtggcctcagtaa

SEQ ID NO: 10693 - DNA, 324 bp, Glycine max
  Peptide Sequence Number=SeqID_127471
atgacttccttaagcaatgtttctacaagcatcggttcaatctacaacaatgttcaagttccttatttgaaggagaaaattatgatgtttaggcatgattcaaagaggagtctcaatagccaaatttccaagaattataagagcaaaaccagtaatcaagcatgggaaattttgcagcaagagtttaaaggagattcaaaggccgaggaagaggtagaaactcttgtggaaatggaagaggcacctatggagggcaaagaagcgatgaaggatcaaatagatggtgtggaatttgcgaaaggagctctcatgaagagaaagatt

SEQ ID NO: 10694 - DNA, 239 bp, Glycine max
  Peptide Sequence Number=SeqID_127472
tcccgaacccgtcggctgtcaggtggactgctcgagctgcttccgcggcgagagcggttcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 10695 - DNA, 225 bp, Glycine max
  Peptide Sequence Number=SeqID_127473
atgtcttccgccggatcgacggcgaagccgacttgggtccaaaaagaggggcagtgccccgcttccgattcacggaataatcggattccccttgtccgtaccagttctgagttgactgttcgacgcccggggaagaggccccgaagggcccgttcccaatccgtcccccgaccggcacgcgacgaaccgctctcgccgcggaagcagctcgagcagtccacctga

SEQ ID NO: 10696 - DNA, 114 bp, Glycine max
  Peptide Sequence Number=SeqID_127474
atggacatgagtagaggctacgcccatgatcgacggatcgtcgtcccatgtccagctctggacaagcgagaagctctattgggaggtgatggtcagatgcctaatttaccctag

SEQ ID NO: 10697 - DNA, 600 bp, Glycine max
  Peptide Sequence Number=SeqID_127475
atgaccacaatgatggaagccatgatgagtatgaggaaaatcatggaggttaacacgactatagtcgttgccgcaagtaatgccactgaggtggacccgactcacccatctggcctcaatccagtaaatcattcaatctcggatatggtaggtcagggaggcaaagcattgggaagtataggtggcccccattttatgcagagccaacaactccaatctggtcatgcacaagtccctcaacccatgggggaggcacatgaagtacctcgagatcacactctagccgacttcgagcctcacctcagatatgccactgaggggcaagcattcgatggcatacccctgccaaacactttggggggacctcagtatcgcccacaaatacaacccttgcattttgcattggaaagattgcctcctgccatggtggaaacagagaaattggatcatatagaggaaaggctgagggctattgaaggagggggagattatgcctttgttgacatggcagaactatgcccgacaccgttatccctccgaagttcaaggtgctggattttgataagtacaaggggactacttgccccaagaatcacctga

SEQ ID NO: 10698 - DNA, 324 bp, Glycine max
  Peptide Sequence Number=SeqID_127476
atgactaatgccaattgtttgcaagaatcattgcattcagtcttaaacgggaatctaagatacaagggaggacatgctataatacactggaaagagacgcagcattgctattccctagaagtggaaaccaaacgagcttgggattatgtgggagacaactatgttcatagacttattcaatccaaaactgatgggaagttggttgagctgaacactcagtgtgcacatgcagacaatggatgtggaagttgcagtagtgaagataatgccatgaatgaggctatacttaatagcaaacttgaagctgtaatgttgcaagattaa

SEQ ID NO: 10699 - DNA, 177 bp, Glycine max
  Peptide Sequence Number=SeqID_127477
atggggcaaatctccctagattgcaagttcttggactctcagcataaaattgattacagccttctgttgggattacatttccgagctccagagaatttgaaggccttcgtggaacatcatgaatcagtgcagcgtcaggagagtttaccttctggagatggtaaatacctccactga

SEQ ID NO: 10700 - DNA, 273 bp, Glycine max
  Peptide Sequence Number=SeqID_127478
atggcgacggaaatcccatttgttgggtttcatgacggggttgtggttgagatcacactggggtttgcacgtgacttactatgggtttcacgagccgatggtgaaaataaagttgctaacgacaagtgggagctccgagacggagttgatgcgatggctgtcgatgaggatgagggaggggatggaggaggcaatgatggcggagacgatggtgtagggcttctggttcacgttgattttcctatgctagcggcatcaaatcttgcacggtga

SEQ ID NO: 10701 - DNA, 1431 bp, Glycine max
  Peptide Sequence Number=SeqID_127479
atggcttctcacaacatcaaaatccacgaccacttaagggtttcccctccctcagcaacagaaatatccctctctctcactttcttcgacctgttctggctcaggttccaccccgtggaacgcatcttcttctacaccctccctacaccccattcaaatccatccattttctattccaaacttgttccaaagctcaaaacatctctctctcgcactctccaacacttcccccctctcgccggcaacgtcgtttggcctgataacaccccaaaccccaccgtccaatacaccccaggggactccgtttcacttgtggttgctgaatccgaagctgatttcaaccacgtgttagataactcacctcacgaagcatcagagttacgttgtttagtaccccacttggattcatcggattctcatgcttctgttgtctctttccaaatcactctgttccctaacagaggcttcagcataggaatcagcacccaccatgccgtccttgatggaaaatcttcaactattttcgtcaaggcttgggcttctctatgcaaaacgtacaatgatgatgagtcttcagagtcatcatcaccatctttggctccagagttgaagcctttctttgatagaacagccatcaaagacccaagtgagataggacttaacttcactgtcaattggactgagatcttaaccaaatttttccccaatgaaaacagcgacgggagatgcttgaagctcctacctttccctccaagactcgaggatcatgttcgagcctcgttcgcgctcacaggagcagatttggagaagctaaggaaaagggtgttgtccaaatgggacatcgttgatagaggagcagaatcagagccacctaggttgtcatctttcgttctcacatgtgcttatgcgctagcttgcattgctaaggccattcatggagttgaaaaggagaaagagaaatttgcttttgcgttcacagtggattgcagggcgaggttggagcctccaatccatgataattattttggcaattgtgtgtgggggcatgtggtggatgctgaaccattggacttcataaaggaagaagcttttgctattgttgcaaagagtattcatagtaaaataaagatgatattagatgaggggatttttcatgggatggagagtgcgttttctagatatgagtctttgggaaaagacggagttgaaatcatgggaattgcagggtctaaccggtttggagtttatggaactgattttggttggggaaagcctgctaaggtggagatagcatcggtggatagagccttaaccattgggtttgcagagagcaaggatgggaatgatggtgttcaagttgggctcgtgctgaagaaacatgtcatggatctcttttgtactttgtttcgtcaaggaatgttagatgattga

SEQ ID NO: 10702 - DNA, 3006 bp, Glycine max
  Peptide Sequence Number=SeqID_127480
atgaacgaatcttctgttagtaacatggagagttatctctacctccatccaagcgaaaacccagctatcgctcttgtttccccagtcctagactcaaccaactaccactcatggagcaggtctatggtcactgcattaagtgccaagaataaagtggagttcatagatggcagcgccccggaaccactaaaaacagatagaatgcacggagcatggcgtagatgtaacaatatggtcgtctcgtggatagttcattcggtggccacctccatacgtcagagcatactttggatggacaaagccgaggaaatttggcgcgatctgaaatcaagatactctcagggagatcttttacgcatatccgaccttcaacaagaagcttcgacgatgaagcaaggtacgctcacagtaactgagtatttcacacgattacgcgtcatttgggacgaaatcgagaattttagacccgatcccatttgctcatgtaatataagatgttcctgcaatgcattcaccattatcgcacagcggaaactcgaagatagggccatgcagtttctacgcggtctgaatgaacagtacggaaatatacgatcccacgttcttctcatggatcctatacctgctatctccaagattttctcctatgtggctcaacaggaaaggcaattactgggaaacgttggaccagggattcatttcgaacccaaagaaatttctataaatgctgctaaaaacgtctgcgacttctgtggacgtgttggtcacttagaaagcacatgttataagaaacatggaatgccctctaatcacgatactagaaacaagaatagtggaaggaaagcttgcactcattgcggcaagatggggcacactgtggatgtgtgttatcgaaaacacgggtacccgccgggttacacgccgggttacaagccctatggaggaagaaccactgtaaacaatctcgtagccgttgaaaacaaagctaacgaagatcaagctcagcatcacgaggctcatgattctgttcgtttctcccccgagcagtacaaggcactcctagccttaatccaggaaccatccgcaggaaacacggcgatctctcaatccaaacaaatggcttcaatctcatcatgtatcaatactccgacaaatccaggtatgtccctttctctcagaacaccatgcgtctcctggatattggattcaggagcaacggaccacgcgacttactccctacgcaaccttcattcctataaacaaatcgatcctatcacggtgaaactcccgaatggccagtgtgtttgtgcaacccactcaggaattgtcaagctttcatcaaacatcattttacaagacgttctttacattccttcctttacattcaatatcatttcaatatcaaaacttgtgtcttccgttaattgtgaattaatattctcctctacatcgtgtgtattacaggaagcgaacaaccatatgaggattggtatagttgaagcaaaacacggtctctaccatttaatacctgctcagctgaccaccaaaaccgtaaactccactattactcaccctcgatgtaacgtaatacctattgacctttggcactttaggctaggccacccatccactgaaagaatacaatgtatgaaagcttactatccccttctcagaaataataaggattttgtttgcaacacgtgtcatcatgcgaaacaaaagaaattgcctttttctcttagccattcacatgcatctcacatttttgacttactgcatatggacatatggggtccgtgctctaaaccatccatgcatgggcacaaatacttcttaactatagttgatgattgctcacgctttacatgggttcatcttatgaaatccaaagctgaaacccgacaaataatcatgaacttcattacattcattgaaacacaatacgatggcaaggttaagatcatcaaaagtgataatggcattgaattctccatgcatcattactatgcatcaaagggcatcatacatcagaccacgtgcattgaaactccagaacaaaacggaattgtagaacgcaagcaccagcaccttctcaatgtcacacgtgcacttttgtttcaggcaagcctaccaccaagcttctggtgttacgctttgccgcatgccacttacttgattaattgtattcccacgccgtttttgcataatgtttcaccctatgaaaagctgcataaacacccttgtgacatttctaaccttcgtgttttcgggtgtctatgttacataaatacactcaaggcaaaccggcaaaagcttgatgctagggctcatccatgcatattcatcggttttaaaatgcatacaaagggatatcttgtgtatgatttgcactctaatgatgttagcatctctcgaaatatcacattttatgaggatcattttccttatctctctgaaactcagcctacacacttagaatatccagctccctcaccggaatccttctccgacaaaaacggtgacccacaaacagagagtctctcatcacaacctatgatctctatcccaccatcaaatgaacctgaacataatcatcctccttcacaccttagacgatccacaagaaccaaaaacgccccaacgtacctccaagattaccacagagagtttgcttcatctacaccaagtacttcaacggctgttcgttatccacttagttccgtactctcttactcacgcttatctcctgcacacaggaactttgtcatgaatatttcctccgtaacagagccaacctcatatgccgatgcttctcgccatgattgctggattaaggccatggaagccgagctacgagctcttcagtcgaaccaaacatggcgcctcacacctcttccttctcacaagacggctattgggtgcagatgggtctataaaataaagtatagagcagatggatccatcgaaaggcataaagcgcggctggttgcaaagggatatacctaa

SEQ ID NO: 10703 - DNA, 1278 bp, Glycine max
  Peptide Sequence Number=SeqID_127481
atggcgactatcctcgttcctgttcctgttcgtgttcttatctctttccttgaacaaaattctctcaacctagtggagaaccgcgaattggttcgttcataccaattcacgttaggagccacacctgtgcctgcacctgcaccatcgcagtttctatccgaagcatatgctatactcaattgtggatggtggaatcaatcgcattcaaatccaggcgatatctgttcgtgggaagcagggattcaatttgcaacactaaacctctctgctttaaagaatttagaaaggctagaggtctcatacaggggactaagaggaacaatcccgccagaaattggtaatctctccaaactcactcatctcgatttgtcaaacaattatcttgatggtgagatacctccttctctgggaaatcttacccaattagagagcctaatcatctctaacaacaagattcaaggtttcattcctcgcgaactattgtccctgaaaaatcttagggtcttatatctatctatcaacaagattcaaagttccattcctagtgaattggtgtccctgaaaaatcttactgtcttatatctatctagcaatagactaaatgggaccttgcccatttcacttgtaaagtttacaaaattagaatggcttgacatttcccagaatctactcagtggttctctaaaatccttgctagttggaagccatgcacagttagtaaccgctatcaagctcaatcaccacctcacttatctcgatatgtcctacaattctcttgatgacgagattcctcctttattgggaaatctcacccatttaaagagcctaatcatctctaacaacaaaattaaaggttccattcctcgtgaattgttgttcctgaaaaatctgacttcattagatctatctaagaatagaattagtgggacattgcccatttcactttcaaaactcacaaaattacaaaatcgcgacatttccaataatctactagttggttctctaaaactgttgtcagctggaagccaccattcacagttaaccactatttacctcagtcacaacatcattagcgatgaaataccaccaaagctaggatatttcccatccttaaaaagtctcgatctaagctataataatcttaccggaatggttcctctatttctgaacaatgtctcttattatatggacatttcctataataatttgaagggtcccgttccagaggctttccctccgactttgctaataggcaacaagggtgtatgtagcgactaa

SEQ ID NO: 10704 - DNA, 627 bp, Glycine max
  Peptide Sequence Number=SeqID_127482
atggcttctcaatctcacaacatcaaaatccacgaccactttagcgtttcccctccctcagcaacagcgacatccctctctctcaaattcttcgaccttttctggctcaggttccaccccgtggaacgcatcttcttctacacgcttccaacaccccaatcagacccatccattttctattccaaaatcgttccaaagctcaaaacctctctctctcacaccctccaacactttccccctctcgccggcaacgtggtttggcctcatgactccccaaaccccatcggccaatacaccccaggcgacgccgtttcagtgctggtggctgaatccgaagctgacttcaaccacgtgcttgataactcaccccacgaagcatcggagtcacgttgtttagtaccccacttggattcatcggattctcatgcctctattgtctctcttcaaatcactctgttccccaacaaaggattcagcataggaatcagcacccaccattccgttcttgatggaaaatcttcgacccttttcatcaaggcttggtcatctctatgcaaaaccaacgatgatgaatcttcagagtcatcatcaccatctttggcgccagagttggttctctttctttga

SEQ ID NO: 10705 - DNA, 1440 bp, Glycine max
  Peptide Sequence Number=SeqID_127483
atggcttcttccgacaagtccatcaagatccatgagcactgcctcgttcctcctccctctgcagctgcaacccctttctctgtccctctaaccttctttgaccttcattggctaaggtttcatccagttgagcgcatcttcttctactctcttcctcttcctcactccgaccattcttctttctttgacaaagtggttccaaagctcaaaacctcattgtctcataccctccaacactttctccctttagccggcaacatcgtttggccttctgattcacccaaacccatcatccaattcaaccctggtgatggtgtttcgttggtcctagcacagtgtgatgatgcactattcaatcacatgttggacaattcaccccgtggcgccacagaatctcacactttggtaccccacttggagtcatcagattctcttgcctcagttatgtccttgcagataacgctgtttccaaacaagggcttttgcatagccattagctctcaccatgctgttcttgatggaaaatcttcaaccatgttcatcaaggcttgggcatatgcatgtaaatccggtgaagaggaatcaccaccatctttggttccggaatatttagagcctttatttgatagagatatcatcaaagatccaacaggtcttgaaagtgtgttcataaataactggacacaaatcgcatctcaaatgaacccttctcacaccagcaacgggcgaagcttaaagactgtgccacaaccaatcaaggaaaactcagttcgagccacgttcgagctcgcacgaggagatttggagaagataaagaaaagggtgttatccaagtgggagttagtggaggaattagcagaaccagttttagcttcttcaaagccaactactttgtctacctttgtcactaccttagcatatgtgtctgtctgcattgctaaagccattcatgaagcccaaaatgtacagaagttcgttcttgggttcactgttgattacagggctcggttagaacctccaatccctgagaactactttggcaattgcgtggcttctcatatggtggatacacagccacatgacttcataaaagatgatggggtggccattgttgctaagaggatttggagtaaaataaaaacgttagataagggagctctaaatggattggatacaattttctctaggtttatgactatgagaagtgagggaactatggcaattggagttgcggggtcgaaccgatttggtgtttatgaaactgattttggttggggaaggccttccaaggtggagataacatccatagatagaggtttaaacattggcttggcagagagcaaggatgggagaggtggtgttgaagtggggcttgctctaaacaaacatgtgatggatctctttcatactatttttcatgcaggattaagttttgactaa

SEQ ID NO: 10706 - DNA, 114 bp, Glycine max
  Peptide Sequence Number=SeqID_127484
atggcttctatagacagaactggggcactttgtttatcagatagcaaaaatggtgatggggttgaggtaaataaatactcgcataaatactctgattttatgaagcattactga

SEQ ID NO: 10707 - DNA, 568 bp, Glycine max
  Peptide Sequence Number=SeqID_127485
actcgaggatcatgttcgagctacgttcgcgctcacgagagcagatttggagaagttaaggaaaagggtgttgtccaaatgggacattgttgaaacaggagaagaatcagagccacctaggttgtcgtcctttgttctcacatgtgcttatgcggtagtttgcattgcgaaggccattcatggagttaaaaaggagaaagagaagttttcttttgggttcacggtggattgcagggcgaggttggagccaccaatccctgacaactattttggtaactgtgtatggggccgtttggtggatgctgacccactggacttcataaaggaagaagcttttgttattattgcaaagagtattgataggtcaaatcgatttggggtctatgggagtgattttggttgggggaagcctgctaaggtggagataacatcggtggatagagccttaaccattgggttggcagagagcaaggatgggaatggtggtgttgaagttgggcttgttcttaataaacatgtcatggatctatttgccactttgtttcgtcatggagtgtcagatgagtag

SEQ ID NO: 10708 - DNA, 666 bp, Glycine max
  Peptide Sequence Number=SeqID_127486
atggtttgtgatctgaaacccccagaagatgcaaccagaggctcatttcaattgtctcgttcagatgttgaaaagctgaagcaaagtgtggtgttcaagaagaaagggagcaccaaccttcacttgtcaacgtttgtgttatctcttgcctgtgcatgggtttgcagggtgagagcagaggaaattaccaacaaaagtgttgcgttggctctaactgttgattgcaggggtcgtttggagccacctcttccttcaacatattttgggaactgtgttggattcagacttccaattgctgaaacgagagatttgttgggggaagaaggactagttgtggctgtggaagcagtgagtgatgcattggaaactctgaaggatggagcagtgagtggagcagaaaattggtcatcgtggttgctttatggtgtgggagctgaagctgatgtgaagacaattggtgttgctgggtcaccgaggtttgaggtttatggtagtgactttggttggggaagaccaaagaaggtggagatggtgtctattgaaaaaactgcagtctttggtctttcagatagcagaaatggagatggaattgagataggttttgtgtccaagaaaaaaacaatggagacctttgcttctctttttgtcaatggccttcaatcttga

SEQ ID NO: 10709 - DNA, 1353 bp, Glycine max
  Peptide Sequence Number=SeqID_127487
atgaataaagtggtagaagttttgagtgtagcaccaattttggaatcagaagagttaccaactcaaacatcgcttcccctcaccttctttgatatactatggttaaggttaccacctgttcaacgcatcttcttctatgaatttcctcacccaacccatctcttctttgatacccttcttcccaaactcaaacactctctttctcttgcacttgcccacttttaccctcttgctggacacctcatctggccccttcactccgccaaacccatcatcaattacaacactggtgacactctttcactcattgtagctgaatctgaagctgatttcaaccatttagcaggcacagatctttatgaagctaaagaaattcacaatcttttaccccacttgaccatatcccatgaaaaagctactcttttggccctgcaagttaccctatttccaaactctggattttccattggaataacctcacaccatgctgttcttgatggcagaacttcaacatcgtttatgaaatcctgggcttatctttgtagagaatcacaatcacccacttctttaccaccagaactttgtcctttttttgacagggaagtagtcaaagaccccaatgaactagaagcaaaatatgtcagtgattggttgaagcatggtggacccaacaacagaagcctcatggtttgggatctgccagttccagaagaagcaaccaggggcttatttcaactgccacgttcagctattgaaaaaatcaagcaaattgtggttatgtccaagaagaaagggaataacaacaccaaccttcacttgtcaacgtttgtgttatctattgcatatgcgttggtttgcagagtgagagcagaagaagtaaaaagtaaaagggttgttttgggtgtgagcgttgattgcaggcgttggttggagccacctcttcctccaacatattttggaaactgtgttggtggcagagttgtgattgttgaaacaagaggattgttgggggatgaaggagtgcttgtagctgtggaagcactgagtgaagctttggaaactctgaaggatggtgtgctgaatggagcagaaaattggtcttcgatgctgtttgatggtctcgccactgatgacaagacaattggcgctgctgggtcaccgaggtttgaggtttatagtagtgactttggttggggaagaccaaagaaagtggagatggtgtctattgacagaactgcagcgtttagtctttcagagagcaaaaatggagatggaattgagattggttttgtgtccaagaaaacaacaatggagacctttgcttctctctttgtcaatggccttcaatcttga

SEQ ID NO: 10710 - DNA, 306 bp, Glycine max
  Peptide Sequence Number=SeqID_127488
atggttgaaatcagcgtcagattcagctactatgagagaaacggtgtcaccattgttgtaattgatgatggggttttgggagtgaagtggccaggtgaggtgtccagcaagaggaaaaaagtggccaagtgcatgagaaagagagtgtttgagtttgggaagaatggtaccaaagaagagtggggttggatgagggaattggtacaagaagatgcgttgaataggtggtgtcaattcatagagaaaacttctgcacgtgtcaatacaaaagcaaaacttttcccgctcaatgtacatgttcggtaa

SEQ ID NO: 10711 - DNA, 192 bp, Glycine max
  Peptide Sequence Number=SeqID_127489
atggaagcaaaaaggaatttgaatggtgaaggtgactcagagtcagaacaagacctggtcacaagaattaaaagcttcaaaacaagatataatgacaagaatttgcatgttatgtgctggaatatgaagacttggtcacgcaaatttcatgatgtggaggtgcagaggccagagtgtgctgtgttgggttag

SEQ ID NO: 10712 - DNA, 2925 bp, Glycine max
  Peptide Sequence Number=SeqID_127490
atgtctggaaaggctttgaaatccttgaaggatgaaaacccagatttgcagaagcaaattggttgcatcactggattttttcagctctttgaccgccatcgtttcctcacaggccaacgctctgccacctacgttcagcacaggcctacttcaggtggaagcagtaatgaaatccaagagctcaatggtacaatgcagaaagctaaggcaaagaatctgaagtctgctagagaaaagcaacaattctccacagaatcatccataacttctttgtcttcgtcatcttgttcatctagcatgtcatcccatgagtttaacaaaacaattcagatacaatcaccgtcaagaaatcaaaccagaattccagaaaacacaaattcaaaagcagcaaagaagcaacctcataagccgcaccagcaatcccttcatttccatcatattgtcaatgactcaatgcataaagaagctagacgattgtcagtgaaaactggggctaaagaggaaaagaagggtcagactaatgccttgaaacacatagattccccccggcctttgcggtcacacaaatctgtcaatggaggagaaacagttgccaatgaacctttacattctcttgccaagtccaaaaaaaaaccttgggactcaccacggctctcttatgatgaaacattcaaatctgccacaaagcataaggaacttccaagactttctttggacagcagagaagggtccaatagaggtttcaatgaaggaaacaagtctcagaaccagttgaagggttcaccgagatggtacgggagaacctccagcacaatgattaaccaattgaaagaaccagaaacttccaaaaggtcttccagtgttgtagctaagttgatgggacttgaagccctccctgagtgtacacaaacttgtgggagtccaaagggaacttctagtagttctaccaaaaagaatgagctcttgtcaagatcttgtacaagtgatgaagacaagcaacgccaaagattcaccttgccacactccaaaaaggctgattcaatcacaaatatgatgccatattcacgatttgcgatagaatcaactccatggaggcaacctgatacgattcaaagttctcaattacaagcttccaagggaagtgaatctgatataaaagcctcaaagtcctctctcactgtgtatggggaaattgagaaaagggtagcagaacttgagttcaaaaagtctggaaaggatctcagagcccttaaacagattcttgaagcaatgcagagacataagtattcagtagacattgctagagatcaggcttcaaattctccatctaacaataggaataatactaatctcaacgaaagctcaaaaatacaaagcccacgagtaagacaaaaagacacagcatctgtaacggctgagatgtcaaattcaacccagggtagtaaattgccaattgtcatcatgaaaccagcaaaagttactaggaaacccaataatctgtcgtctacagaattgtcaattcatggtaaatctggtctcagcaagtgttcccctagtaatcccacaaatggaagattggttgacaagcaaattgctagaggtatcagttcaacaacaaaaaatatcaaggatccttttggacaagaagtttgttcatccgataaaaacaacatgagaacttcaaagttgatgcaatccatgaaagtttctcaagacagcaatggagaatgcaccaccaactatggttatataaatgtgactgggagccccagacctcaaaagaagtttggtttggagaggtgttcgcgaccaaccagtccatcatcagattccagaattaaccgaagagagcacaataggcaacctgtggaattgtcttctccaagttcaacaccaagacataagttctccactttgcagcaaagaaatgaacgcttcagtgagatcagctgtcactggagggattttaagcatcatgtgaacatcatttcggattttgatgacaaaagcagctcggccagtcatagtgacattgaagtcattcgcattgatcaatctggaaagatcattagctcctccatccagctgagtggcatgagtcaaaataatgcatttgaagagttgaggaaggctgagaccatgattactgcagaacaaccaagccctgtgtctgttcttgatgctgcattctataaggatgacccaccatctccagtgaaaaataaatcagacatctcaaaaaatttaggtgaagctctaagcactgatgaggatagtgaagagagctcagtggatcttcttcaagaaattgactggattgatgagaaactcttcaatttcaataataatagggatcctgaccataagtatatagcgcaaatactgttagcatcaggtctgctcagtggccacagctatagccagatatttcattcgccgggtcatttgattaatccaaagttgttttttgcacttgaacaaatgaagagaaagaggcctttgaacattgaaggcagtgccaagaagattcccaggaatattaaccctgagcaaatgcaaagaaaactcatatttgatgttgtcaatgacattttagttcaaaagctgatattggatagttcttctgcattgtggtgccaaccaaatgagttagcaggcacaacattaaaagggaagcagcttttggatgagctatgcacagaaattgatcagttgcaacctcaaaataggaatgtcagtttagttcatgaggaggagaatttgaagcatcaccaagcaatttggactaactgctgcaatgagatgccaaatattgtgttggatgttgaacgtttgatctttaaagatttgataactgaggttgtgagaggtgaagtagcaaaccatcctggtacacattgcaggcaactggtgttttacaagtag

SEQ ID NO: 10713 - DNA, 624 bp, Glycine max
  Peptide Sequence Number=SeqID_127491
atggccgatgggttcgacgaggaggccattgcccagctgttatgcacaccggggcatgatttcgcccggaccactgcagggaggcgggtgcggatcatgcgctccagcatgaccaccttgacccagatgtggatgacattgctgcttagcaatgtcttgcctagggatcataactccgatctccctctaccgaagtgtcagctggtgtatgccatcctgacacggatgagcatccacgtggctcagttgattgctgatgccatctatttgtttgcagtcgttcggagttcaggtcacccccagcaaagtgatccgaccaccgatcacccgagccttcatgagaagtactgcacgcctaggcaggcacaaggtgacgtacctcagggcgccagtgcaccgccaccacctcgacaggctgatctggctgagccgctgggcgtggagcggtatctacagcatttggttcgccagcaggcggccaaccaccgcggacagtttgcggctgaggtcgcatggccaggagactggcccgatgcccaggcaggggaagagcctgcaggatcccctggtaggatggatgaaccccgcatggatgaggatatgactaacctgtttgatttctag

SEQ ID NO: 10714 - DNA, 372 bp, Glycine max
  Peptide Sequence Number=SeqID_127492
atgttgaatccaactcagtttcaggtcaaagaagagaatgttcaagtagttgatgactcgctcagtgaggcaaatccgctcagcgagtggcatctgcttagcgaggcatacaactcgcttagtgggttgagaaaccctaaaagaggatcagtcagagatgtgctcgcccacacgaccagtctcgctaagccaaaattcacttactttcacttagcgagccttcggaagctgaaaggtccaagagcctttaaaacactgaagttggcggaaataaagcatagagttagagagagagcaccagaggaagctgagaagatagaaaggaagcaactaagagagcttaggttagaaggagtgaagtctagggtttag

SEQ ID NO: 10715 - DNA, 285 bp, Glycine max
  Peptide Sequence Number=SeqID_127493
atggtgctaaggtcaaattcacttactcgcgctaagcgcaagaatggcgctaagcgtgacatcgagagtctgaatagactgagaaaagggcctgaggtgtggattgcagagagcacaagaacagagcaaggagccaagttttcatctttttgggagattagagagttttggagtgattgtgagattcctagaggtggaggagacatacccactccatatgtaaaaggagcttccttgccatggaaggataaaaccctcagttgggaattcttactgtgtagttga

SEQ ID NO: 10716 - DNA, 132 bp, Glycine max
  Peptide Sequence Number=SeqID_127494
atgtgtaagggcactaactatgttgaacccaaaaagatatgggtaccaaaacctcaaatagtgtttgttgtagatatccttgagaagatgaaagatggctttggcataaaggacttgggcatgtcaacttaa

SEQ ID NO: 10717 - DNA, 159 bp, Glycine max
  Peptide Sequence Number=SeqID_127495
atgaccagtggcaatctctcaaagagcacagaagcaacaaggttgtcggagcttgtgctgaatcctcgcctgagggagagggagaaaacatataaagcagagataaaacagaagcaaatagcgagatgggttataggatgccgttttcatgtcacttaa

SEQ ID NO: 10718 - DNA, 582 bp, Glycine max
  Peptide Sequence Number=SeqID_127496
atggacaactctcttgagctaatcaagatgaaaactgcagtgatgatattgagaaacctggaggcacttgagcatattattaaagcaggatggaggatttctaagttcttctgttttgtacacgttacccaaacctatctgatcgcccctgctgtgatctatggtcctagcatgcttcctacaatcgatttgaaaacagctgtgttcttaatggaaaagatctcaccctggtttggtaaagttgcttgtggagatattgtagtcttgcgcaatcctcaagaccctaggcgcttcatgaccaaacgtgtggttggattggagggtgatagcattacatacatttccaatcctgagacctatgaattggagggtgatagttttacacacatttcctctcttgataacagtgataagtctaagactattttggttccaaagggggccgtttgggtagagggagataataagtataacagcaattattcaagaaaatttggtcctgttccttatgaccttattgatggcaagatgttctggaggataacaccacttaaaaaatttggacctttctggaataaatga

SEQ ID NO: 10719 - DNA, 237 bp, Glycine max
  Peptide Sequence Number=SeqID_127497
atgggagagcaccatcttgtcactggatcaaatgcagcacagatgggggcgcctatgggtgctccggctcctgctgcctacggggaagtttttagggattatagaccttcttttattggtagtttctctttcaatttggctattgagacaacttttgataaagggtggagaaagctttcgatagaatatgattccgtgcttgctatccaagctttcaaattggtcaaagagacttag

SEQ ID NO: 10720 - DNA, 898 bp, Glycine max
  Peptide Sequence Number=SeqID_127498
atggaccctaatccccgcactatccgcagcctagtctcgaagctcagctccgtctccgaagccgcccgcatcgacgccctctcccagctccgcctcatgtcaaaacaatcccccgaaacgcgccccatcatcgcccaagcaggcgcaatcccctacatcgcagaaaccctctattcctcttctcacccctcccaagaagacgccgctaccacactcctcaacctctccatcaccctaaaggagcccctcatgtccacacgtggcgtcctcgacgccatcgcccacgtcatctctcaccaccacaccacctcctctccccctgcggttcagtccgccgccgccaccatccacagcctcctctcctcggtcgactcctaccgccccgttgtcggctccaagcgcgagattgtctactccctcatcgacatcctccgctgccacctctcgtctcctccccgcactatcaaggattcgttaaaggcgttattcgccatcgcgcttcatccgattaacagatctacgatgattaaccttggtgcggttcccgcgcttttttcgctggtgttgaaggacggtagggttgggattgtggaggacgcgacggcggtgatcgcgcaggtcgcgggatgcgaggacgccgtggatgcctttcgcaaggcctccggtggtgtcggcgtccttgccgacctcctcgacctcgccaccgccgccagcatgcgcaccaaggagaacgccgtctcggcgctgctcaatttggtgcggtgcgggggcgacaaggtcgccgccgacgtgcgcgacgtcgtggcgtctggagcgctagatggaattgcggatgtgagggatgggggtagtgtaaaggggaagaacaaggctgctgaattgatgaagcttttgctcg

SEQ ID NO: 10721 - DNA, 291 bp, Glycine max
  Peptide Sequence Number=SeqID_127499
atgatgccacaaaccaagctgcggatgatccaaaaagattatctcttatggaggagcaattcaacatcttacgtggatgtgatggtgagaaagattcttccttcatctctgatgcttggaaaggctatatctcttcagttttctacttctagtgaatttgtgtatcatgctagagtaggtgctgaaaaggctgctaaaagtgatgagagactaatttatgaggcatcattacaggttaacatgggcttgcggtttcttcaagatgttgcttgtgtaggaaacttgaagtag

SEQ ID NO: 10722 - DNA, 252 bp, Glycine max
  Peptide Sequence Number=SeqID_127500
gtcgacgcaacatacgagacttggaaggaagtccctgctgctcagaaggatttgatatgggaggatattcagaaaaaggcacaggccatccagaagcaaaacactgccctccacgtgttgtctcgtgggggttatgaatatttagaacagaagctgatggctgagaagacaaagaaaaaactggagaagctgcttagttcggaagcactgagggcgtcattgaccctccatctcccatcagacgacacgtga

SEQ ID NO: 10723 - DNA, 1879 bp, Glycine max
  Peptide Sequence Number=SeqID_127501
cccgctggtgcctggcattggctgggttaaaggcgtatagcgaaaaataccagttgcaaggcaaaaccatgattgctgtggcctcgggtgcaaatatgaactttgaccgcctgcgctttattgccgaacgtgctgagttgggcgaacaccgtgaagccgtatttgcggtgaccattccagaagcaccgggcgcattcaaggcgttttgccgcctgttaggcaaccgtagtatcaccgaattcaactatcgattctccgatgccaaagaggcccacatttttgttggtgttgccgtgcataacccggcggaggcggctgagattgccggtaagctgcagcaggcagggttgccgacactgaatctcagtgataacgaaatggccaaactgcatttgcgccatttggtcggcggacatgcgccgcaggcgcaaaacgaagtggtgtatcgttttgagttcccggagaaacctggcgcattaatgaactttctggaatccatgggtcacaattggaacatcagtttgttccactaccgtaatcatggcgcagattttggccgtgtgctggtggggatgcaggtgccgccagaggataaagtggcctttgcgcaatttctgcagcagctgggttacccttgttgggatgaaagtcagaatccggcctaccgcctccgttttggtcgtaatgtcgcgtggaatgctcgaatcaaagggcttgcgccgcgtcgtacgcgcatgagcttcttattgctggcgttggttgcgacggtggccgcttgtaacaagcaggaagagcctgcggcagaggctgcggcacctgccaccgaaagtgctgctggtgcagtggcatatgtgtctacacaagatgcgggtgtcaacgtgattgacctggcgaccatgcaggtcaccaagcagttcgatgtcaaggcgcaggggccgcgtggcctggcagtcacagatgatggcaagcaactggtggtagccacccgtgaaaatggcagtgtttctgtgattgataccgccacaggcgaagtggtgaagcaaattgaggtgggcaagaaccctgagtttgtgcgcgtcagtggtaattatgcgtttgtctcatccgagcctagcgcaaaagcaggcccgccgccgaagccaggtgccaagcctgaagaggacgatgatgacgatgatgaagagaaaattccggccaaaattgcggtgatcgatttaagcaagggtgaaaaaatccgtgaaatcacaggcggcccggagacagaaggtttggagttctcagccgatggtaaacagttggtgattaccaatgaagccgataacacggtgactgtgcataacattgagaccggtgagctggtgaaaaccattcctacgcatgagtatggtgatcggccgcgcggcattaaagtgtctcctgatggcaatacttacctggcaacgctggagttcggtaacaaattcatggtgatggataaggacttcaatgtagtgcgcaccgttgatacggctgagacgccatatggtatctcctatgacagcaagggtgagcgtatttttgttgcgaccaataaagccaagttgctgcaagtgtttgatgccaagagctttgaaaaaatcaaggaagtgcctactggcaaccgttgctggcatttcagctttaccccggacaacaagaacgtcctgttggcctgtggtaaatctgacgcggtatttgtgattgatgccgacaagctggaagtcactaaccaagtggaagtgaaaaacatgccatggggtgtggtgactttccctaaagccatgggcagtttggaaagctttgctggaggccatgccggcaagtctgtcagtcaggttgagtccctgagtgtgctagcttc

SEQ ID NO: 10724 - DNA, 360 bp, Glycine max
  Peptide Sequence Number=SeqID_127502
atgagagtgaggcttagtagtgtcatcagatacacctctgtggtggagggtgaaggccatgaggatgatgtagacgaagaggcacttccagttgttgtcgccgttgagggcaacagaggcggtggcatggatgaagagggcgtgtgtgcagaggagcgagacaaagtggagattgtgagggtgaaggttaggaaggagaaagtgaacgtcatgaaacagaggatggaactcaccgtggtgtccgccatcatcagcattgttcgtggcacagtgcaacctaaggctgccattgtgcttgcattggggaaggagttggaagcagctgatagagcttcttgctccaagttccttcacctttaa

SEQ ID NO: 10725 - DNA, 984 bp, Glycine max
  Peptide Sequence Number=SeqID_127503
atggagatgacaatgtcagcagcaacttgttccaacatgactagattcagtggcattctccggacaacatgtgtatcatcatctcccaagaggaagcatgcaaaaggaatcttgagaaattttaccatatgtgcctcaccatttatatcttcagttgaccctataattgttaattccccttcctttcaagttttggcttccaatctttcgcttgccgatgtcccccaacggtcagaggagtggtttgcccttcgcaaggacaaacttactaccagcacatttggcactgcgttgggcttctggaaagggagtcgtcgccctgagctctggcaagagaaagtgtttgcatcagaggcacaaatcatgggagcaaataatgccatggcatggggaacactcaaagaagcagtagctgtagaacaatataaaaagatcacaggtaatgaggtgagctcaatggggtttgcagttcattcaaagcagtcttgtgattggcttggtgcctcccctgacggtgttcttgggtgccccccacaacttgggatactggaagtcaagtgtccatataacaagggcaaacctgaggctggcttgccttggtcgaaaatgcctttctactacatgcctcaagttcagggccagatggaaataatggattgtgaatgggttgatttgtattgttggacgccaaacggaagtactatatttcgcgtgcttagggagcgtgagtattggaacttgatacatgatatgctacgcgagttttggtgggaaaatgtggttccggcaagggaagctctacttctgggtcgtgaagaagaggtgaaatcatataagcctgcatctactcaccaaaagacaggggtagcaattgctaaaaacggatttggtgctttagctactgcctttggcgccctattgtattcaaagctaacagcatttgtacagtgttcttcaaagctaactggcattttacactcttag

SEQ ID NO: 10726 - DNA, 1356 bp, Glycine max
  Peptide Sequence Number=SeqID_127504
atggcgttgaatttctcgcatcgaccgattttttctgaggataatttggtttcgccgatgaggatggggattccagagaagagtgttgttgagaattgctttgattatgggagagataggagtggtggtggtgcgagccacgatgacattctcgatcttttgccgtcggatcccttcggcatggacatcagcaccaccgtcacggccatcaccgggtggctcgaggatttggagattgttgattatggtgggtaccgtagggatgagcttggggcgagtgatggcaattaccagctttttgctgggttgaatttcatttggaacaatgctatgagattccatgcctcatgtgttgaggagaagagagggtttggcgagagctgttctgtgagaaatgatggggctgctgctgcatcgaacaattttgggtttggatctgttaataattatgatgaagtgtcgggtttgcctgctactagcgggtctggtgatgttgtgagacggggtggaggaggaggcgggggtgatgagcttgctcctcacccggccttgagtttttctcttggttacctgggtttgtctgatctgcttgttgttgaaagggtgtgtaaatctttacattccacggttcgtggggatccgcttttgtggaggagtattcatgtggatcagcctttgaacgagaggattactgatgatgttcttttgcaattgaccaacagggctcaaggtcatctccagtgcttgagcctggtcgagtgtaccaggataacagatgatggtttgaagcggattcttgaaggcaatcccaagttaaccaagttgagtgttccaggatgtacaagactcagtattgagggtattgtgactattttaaaagcttacaactctatggatacccaaggggtgaagcatttacacataggtggtctttatggtgttacacaaaagcattttgaagagctgaggttcttgttgggggctgatagtccgctgctcccacactctcacaaatcacactattatcgcaggggaaacttgtacctgtcctgtgatgatgatcaagccatagatattgaagtttgtccacgatgccagaatttgaggcttgtatatgattgtccggcagagagttgtcaaggggtggagcacactactcaggtgtgcagggcatgcactctatgcatacccaggtgtagccagtgtggtcgctgcatcaatgacagtgaatatgaggaaacattttgtctggaattgctttgttcttcttgttctaagcagctagtcaaatgttcagaaaggggagataggaagattggatcagataaatccgttgttattcatgagcaaaactag

SEQ ID NO: 10727 - DNA, 199 bp, Glycine max
  Peptide Sequence Number=SeqID_127505
cttattttctttactctccattggcaaaccgcccaggtggcttgtctttgcttatcgccctctaccacattccttacttgtgatttgtcatatagggaattggaaaggaggattgatgtcataccttgaagaatttgagtcaagaagcaaggggtcaaccaccttaagagctattggactaagaagcactccaaattga

SEQ ID NO: 10728 - DNA, 468 bp, Glycine max
  Peptide Sequence Number=SeqID_127506
atgttttctctcattgagcaaccacagccatcaaggactcaagctgaggagaacaatgagcactctcagaaaatcacccttgggttggtgttggatggtgactttccattgctgaaaccaccttcttcacatgatggattaatagtccctgatatcaattcaaatggtcgttccttcagcgagaggcataaatctgtgaaggaattctaccgacaacaacacatagggcaaacttatgaatttgctaagaagatgacggaggagtatgggaaattgaatagagtggaaatgagtatacgggaatgttctgaagctgctagaaaggactaccctaatgaagattggttacatttgactgctctcattcatgatcttggaaaggttcttctccttccaagctttggtggacttcctcaatggactgttgttggtgagagttgtccactaattaatcctattcgtgattga

SEQ ID NO: 10729 - DNA, 390 bp, Glycine max
  Peptide Sequence Number=SeqID_127507
atggttcagtcatggagtagacaacataagagttggtcaggaaaaagacagatcaggaagctgagtccaaagaaggtcaacttggttgctgctctggttcgtggtatgcttgttaaagatgcatcgatgcagttggaatcgacaataaaacgagcagcaaaaactgtatatcaggttaaagagttccatagaagagatggttttgaggtagcaagtgctgacaagatggctaagtcatgcatggtttattttgaaatgcatctatccctaaggaaaaaagtaattacaaaagcttttaatggtacaataattgttgttgaagatgacaagggacctgaaagaggaatgccgagctttaattctgagttacccaattccaattcatggtaa

SEQ ID NO: 10730 - DNA, 2784 bp, Glycine max
  Peptide Sequence Number=SeqID_127508
atggccgttttggatgctctgttgggaacggtcaatgtggcattcttgtatgccattttgatatggcttttggtggatagtttgagacaaagcactcgtaataaccatgctcgtgttgtactgcattatttcaaacgaggaggaccaatggttttcgctgtattcactgttctatcctgtgctgttatttctgttatgaacattgctcttgccttttaccaatacagctctaggagaataatcggatttaactctgtttccttggttctaacttgggttttggccactatagtttcgttttattcaatgaggactaaagtgagggagaacaagaggttcagggaaaacagtgatttggaacaagaacagatgttacttcaaaaagaggaggaatcttctatggaggaagaagacgaacaggcctttacaaatgcaagcatgtggagcaaacttgcatttcgatggttgaatcccatttttaaaacgggtcggattcaaaaacttgaacttggtcacattcctcctgttcctccttctgaaacggcagaaaatgcttcttcagtgttggaagaatcacttcgcaaacagaaacttaaaggaggttccttgacaaaagctattgcctattctatatggaagtccttggccttaaacgcagttttagctggtgttaacacaggtgcctcttatataggtcccttgttgataacaaattttgtgaattttttactgggggataatggtgattcaagcatccaatatggattggttcttgcatttatttttttccttgcaaagactgcggagtcactgagtcaaagacaatggtactttggtgctcaacgaattggaatccgggtgcgtgcggctcttacatctctaatttatagcaagtccctattgatgaagtgtgctggaccaacacaaggtaaaatcatcaatttgattaatgtggatgttgaaagaattggggacttctgctggtacattcacggagtttggttgcttccagttcaggtcattttggccttggtaatcttatacataaatctgggtggtactccttcttttgctgcatttggtgtcaccatattggtcatggtgtgtaacacacctttggccaataagcaagaaggtttgcactccaagattatggaagctaaggattcaagaattaaagtgacatcagagaccatgaagaacattagaattctaaaattgcattcatgggaaacttcattcttgcagaaactcctccaacttagggaaactgagaggaggtggctgcagaaatacctctatacatgctcagcagtagccacactattctggacatctccaactttagtttctgttgtcacctttggtgcttgtatactggtgaaaacagaactgacgacagctacagtactctcagctttagcgacttttcgtattctgcaggaaccaatctacaacttaccggagcttatctccatgatcattcaaacaaaagtctccgttgatcgaatccaggagttcattaaggaagacgatcaaaaccaattcataaacaggcatagttcaaagatttcagcagttgctattgaaattaagccgggcgaatatgtatgggaaacaaatgatcaaacccacaagaatccaacaattcaaattacaggaaagttagtgataaagaaaggtcagaaggtagcaatttgtgggtcagtggggtccggtaaatcaagtttgatatgctgtttgcttggggagattccattagtttctggggcagtaaccaaagtctatgggactagaagttatgtgccccaaagtccatggattcagtctggaactgtaagagagaatatattgtttggcaagcaaatgaagaaggacttttatgaagatgttttggatggctgtgctttgcaccaagacatcaacatgtggggtgatggagatttgaacccggtggaggagaggggcataaacttgagtggtgggcagaaacagcggattcaattggcaagggctgtttacaatgattctgatatttatttccttgatgatccttttagtgctgttgatgctcataccggaactcatttgtttaagaaatgtctcatgaaacttttatatgataaaacggttgtttatgctacccatcaactggaattcttggaagctgcagacctcattttggtaatgaaagatggaaaaatagtggagtcaggaagctataaagatcttatagcatgtcccaactctgaacttgttcaacaaatggctgcttatcaagaaacattacaccaaataaatccatgccaagaagatgattctgctagctgcagaccctgccaaaaaaatcaaattgaagttgctgaagaaaatattcaagagatcatggaggattggggaagaagtaaagaagaggaagcagagacgggtagagtgaaatggagtgtttactcaacttttgtcatatctgcttataaaggagtgcttgttcccgttattcttctctgccaaattctctttcaagttatgcagatgggaagcaattattggatttcatgggctacagagcagaaaggcagggtcaacaacaaacagcttatgggaacatttgctcttctatcttttggtggcaccatcttcatactgggaaggactgttttaatggcagctgttgctgtggaaactgctcaacgcctttttcttggaatgatcacatcagttttcagggcacctgtttcattttttgacaccacaccttcaagccgaattatgagtaggctttaa

SEQ ID NO: 10731 - DNA, 1203 bp, Glycine max
  Peptide Sequence Number=SeqID_127509
atggttgggattcgaaaggcaccaatctggcatcacttctcagaatcaattgccggggctgctacaatccgctgtttcaatcaagagaaactattcatgaccaagattaaggctctaattgacgattattctcgggtagcctttcacaattttggcaccatggaatggctgtctgtccgaatcaatttcctcttcaatttggtcttctattttgtacttgtcatcttggttactcttccaaggtctaccattgatccaagcttggcgggtttggtagctacttatggtttgaacttgaatgtccttcaggcttgggtgatatggaatctttgcaatgttgagaacaaaatgatatcagttgagagaatattgcagttctctagcataccaagtgaagcgccattaattattcaagattgcagacctgaaccagagtggccaaaggagggaaaagttgaactacgtaaccttcatatacggtatgaccctgctgctcctatggtcctcaaaggtgtcacttgtgtcttccccgcacaaaagaaaattggtgtagtaggcaggacagggagtggaaaatctactctggtgcaagccctctttcgagtggtggagcctttggaaggatgtatacttattgatggtgtagatatttccaagattggtctgcaagatttaagatctaagcttggtataattcctcaggatccaaccttgtttctaggtactgtaaggactaacttggatccactagaacaacatgctgatcaagaactttgggaggttctcagcaagtgccatcttgctgaaatagtgaggcgggatccaagacttcttgatgcaccagtggccgagaatggagagaattggagtgttggacaaaggcagcttgtatgccttgctaggttactactgaagaaaagaagaattttggtcctagatgaggcaactgcatcaattgacactgccactgacaatttaattcagaagacaattagggaagaaacaaatggatgtacagttattacagtagcgcatagaattcctacagttattgataatgatcgggttttggtccttgatgaagggacaattgtagagtatgatgaaccagctcaattgctgcagaacaattcttcttcattctcaaagttagtctcagaatttttgaggagatcatcccaaagtagcttccagaaaagatag

SEQ ID NO: 10732 - DNA, 342 bp, Glycine max
  Peptide Sequence Number=SeqID_127510
ttggatcatgccaatgaattatcaaactccctgaaagaaagtgccaatattaacactgtttgggcatcgcttattgttgaagaatgcacaagacttggtttgatgtatttgtgtattgctcctggatctagaccttcccctgttgctgttgctgttgcaagtcacaaattaatcacatgtatttcatgcttcgatgagcgttcacttgcatatcatgctgttggatatggaagaggatctcacattccagcagtagccattacatcatcaggcactgcagtttccaaccttcttcctgctggggatcaaaattgcggattgagcattataggggaccaatag

SEQ ID NO: 10733 - DNA, 327 bp, Glycine max
  Peptide Sequence Number=SeqID_127511
atggtcctcaaagatgttacttgtatcttcccaggacaaaagaaaattggtatagtagacaggacagggaatggaaaatctacgctggtgcaagccctctttcaagtggtggacccttatgaacgatgtatacttattgatggtgttgatatttccaagattggtctgcaagttttgagatatcaagaactttgggaggttctcagcaagtgtcatcttactgaattagttacgcaagatcaaattgaagaagaaattgattcggacagacaaccattccatggtgccaatattgtgaaaggctacccgagaatgatcgtcaattag

SEQ ID NO: 10734 - DNA, 768 bp, Glycine max
  Peptide Sequence Number=SeqID_127512
atgcatagttactcaaccattgcttgggtggcttccattggcaagggaaaactaccagatgtggactatggctacaaagcccacagcactgccgatggtgtattcaacttcatgttggccttgggagaggtggcattctcctatgcaggtcacaatgtggttttggaaatccaagcaacaataccttctactcctgagaaaccttccaagaaagccatgtggaaaggagttatatttgcctatttaggagttgccttttgctatctccctgtggccttcattggatattatatatttggcaactctgtccaggataatatcctcatcacactagaaaaaccaacttggctcattgctgcagccaacatgtttgttattgtccatgttattggaggctatcaggtattctcaatgccggtgtttgacatcatcgaaacctttttggtgaagcatttaaagttttctccttgttttacactccgctttgttgctcgcactgtatttgtagcaatgtcaatgttaattgccatatgcatcccgttcttcggttctcttcttggatttctaggaggatttgcctttgccccaacatcatactttctaccctgtatcatctggcttaaactctacaaaccaaagagatttagtttgtcttggatagtcaattggacatgcattgtgcttgggatgctattgatgatactagctccaattggttcgttgagaaaaatcattgtttcagcggcgaattacaagttcttttcgtga

SEQ ID NO: 10735 - DNA, 255 bp, Glycine max
  Peptide Sequence Number=SeqID_127513
atggtgaaagcaaaggactccattgatgaagaagatgcaaggcctacaagctccacatggaactacatcacaaggaaggtttgtgagaaccctagggccttcttcagcagctctaacccaatcctcttagagcctcttgctcatggctcaagtgactggtcccttcctagggaggattgcatcaccaaatgtcacgtgaaggagagcttagtgtgtggtgcatgcttagctcgtggccacttactcctcgtttag

SEQ ID NO: 10736 - DNA, 2096 bp, Glycine max
  Peptide Sequence Number=SeqID_127514
atggccgataacgatcactcccactcccaccctcaccaccaccaccaccaccaccgtcctcatcgcctctcagtgccgccgcgcagcaccacattcggcggcactccgggaacccagcccgccttctggtactcctcaagcacaaccccaaccccaaccccctccaaaacccgccgttcattgtccttcccgaaatcgaaatcgaaatcgagatcctcagtcttcctcctcctcttcttctccctccgctccctctactccctccttcccttcctccgctcctctccttccttctccctcttccccttctccttcctcgtctccctcctctccttctccctcaccctctccttctccctcttctcttcttcctccacctcctccaaagacccctttctccaccacaaacccaaacaccctcttctctcaccttccctcacaccctcccagcagagaatcttggtcaccaaatcaatcctccttgccctcgtcttcctcctccgcttccaggccctccgctactgcggcaccgcctccatgatcctcgccgagttaatgggctccatcgctgcccggcccagaaacccttacaggcacaacctccgcggcttcctctccctctccctcggcctcctcctgctctccttcggctgggaccggatcgaatgcttcccgttctctcccgcttgcctcacccgccggatttggcccttgatcctccctttcgcctccggctttctcgcccactaccggctcgtggactccgggactactctcaaacagctcggccgcaaacgggttcggttaattactctccttttcactactgttattctatttgttcccgcagttgttagtttcttcgtgtttgaggcagaagaagatagtgttgcctttgggaatttggcgtggccattggtgaatactgttgttttcggtgtgcttttgagtgagagttatagtggtgatgataatgatgatgatgatagtttcgcgagttcgagggagtttctggttacttttgtttgcactttggtgttggagcttttttatttccctgaactttccctctggggtttgttgctttgtggtttgttgctatatgttggtgttagagacttggatccttttcattcttccaatgaaggggagttctcgggtgacatgattatgaagcctatcagacatgttttgagcgagaggaagtcgcggaagattgcgctttttcttctaatcaatgctgggtatatggttgtggagtttgctgctgggttcatgagcaatagtcttggcctgatatcggatgcgtgccacatgttgtttgattgtgctgctttggccattgggttgtatgcatcgtatatatctcgtttgccggcaaataatcactataactatggtagaggaagatttgaggttttatcagggtatactaatgctgtgtttctggttcttgtgggagcactcatagtggtggagtcctttgagaggatattggatcctcaggagatatcaactaatagcttgttggttgtctccataggagggcttgtggtcaatgtcattggcttgatattctttcatgaggagcatcatcatgctcatggccatgtattatctggatcatcatgctcccattcgcacacacacacggagtcgcatagtcaccacacccaccatcatcatgatcatgatcatgatcatgatcatctgcatagccatggtcacgaaacaacaatccatggaagcaatcaagaatatatatcagtttcaagtgattgccgagacgattcatgccctggtgatcatggccatcatcataatcataaccactgtagtcatgagaggaagcatcatggtgagtgtcatgatcatgaagacaaacacagcattccgagctttaagcatcatgatgctgccgcccactgccatgaccatggtgaacatcatgatcaaactgggcactcttgtcatgaagatgctccacttgttcgtaaagagcatgaccatcgccatattgatcacaatatggaagggatatttttgcatgttcttgctgacaccatggggagtgttggtgttgttatatctaccct

SEQ ID NO: 10737 - DNA, 618 bp, Glycine max
  Peptide Sequence Number=SeqID_127515
atggaatgtctaagctctgattccgttgataaatcagaaactagtgaggattcgtatttccaatcaattactactgaattccttacttcattgaacacatccagtttgccaactcattctatcaaacttaaaattggaagtcctataatgctgttaaggaacctcgaccaaaatcaaggtctatgtaacggtactagattagtggtaacaaagatggcaaaacatgtaattgcagctgaaattatcttaggtaaaaacattggcctcgctgtttatattccaagaatgtcaatgtccccttcacaatcaccctggccgtttaaactattaagaagacaatttccgattatgctatcttatgcaatgacaattaacaagtcacagggacaatcactatccatggttggactttatttgccgaaaccgtttgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttcttagtgaaaggttcgggagttgtatttacgcacggggaaggtattag

SEQ ID NO: 10738 - DNA, 342 bp, Glycine max
  Peptide Sequence Number=SeqID_127516
atgagaactttgaaggccgaagaggggaaaggtccatgtgaacggcacttgcacatgggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 10739 - DNA, 534 bp, Glycine max
  Peptide Sequence Number=SeqID_127517
atgataggaagagccgacatcgaaggatcaagaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccgtttgttccacacgagatttctgttctcattgagctcatcataggacacctgcgttatcttttaacagatgtgccgccccagccagactccccacctgacaatgtgttccgtccggatcgaccggccgaatccgaccttgggtccagaaagagggacagtgccccgcttccgattcacggaataactcccacgtatcctacacctctcaagtcatttcacaaagtcggactagagtcaagctcgacagggtcttctttccccgctgattccgcacaagcccagttccaattggctgtggtttcgctggatagtagacagggacagtgggaatctcgttaa

SEQ ID NO: 10740 - DNA, 318 bp, Glycine max
  Peptide Sequence Number=SeqID_127518
ctggtgaggaagaagttgcaactgagtgagttagatgagatccgcctagaagcgtatgagaatgccaagttctacaaagaaaagaccaagaagttccatgatagcatggtaattaagaaggacttcatggttgggcaaaaagtgttattgtataattctaggcttggactcatgagtgttgagataaaaagcgactccacaaataagagcttcaaggtcaatggacaccgacttaagccattcctcacaaacccttctttaatggacgcagtggtggaagagacctccttactccacccgacttctctttcgccatga

SEQ ID NO: 10741 - DNA, 411 bp, Glycine max
  Peptide Sequence Number=SeqID_127519
atggagccatcatttggagtcactcagctaaaggaggcaacctttctaaagatgggaattgttgacaatttcccagattatgggaaaaaacacataaagaagaaagtggagaaggagccccaaccatcatctaaactttcaccaccctctcctagacttgttagaatccttaaaccatcccaacctaaacctgcctcaccatcatttaagttagaagtccttggaacctctaccccttttccttccccatccttagcccttccttctcaacccactcccaaaccagcttcaccccttcctagaaaagctgaagttgctaccatagccaaggctaaacattgttctcttacatatgctaagaagaaggcaagggttgaaaaagccttgcagaagcataagaagaaagaatag

SEQ ID NO: 10742 - DNA, 3812 bp, Glycine max
  Peptide Sequence Number=SeqID_127520
atggaaatcattgggaatctacgaggcattggtaacggcaagaaaaaaagaatgaaaaggaagctgaaaagaaaagtttgttggaaccgttggatcacactggttctgatctgtacttttggttgctctgaagaagccatgaatgctgctgtatatccgggggtatcttcaacattggttttggatgcttattgcatgagtgttcaggagtgttactcattgcgttttgaatggtacagagtaatgaaacctgagcagagagttcatgatgaacgaaagtggggttttgctgatattgttgtttttgtacttggattgtatagagaacttgaggtggcacttgttgttggacactgcattggtcttgaaagcggattgccctcaagagagaaagatgatgatcttgctttgttcagtgaaatgcagtccagagaagaagagagttttttgcttcaaccatctgatgacttggaagactcattttcgtcaaagttgagagattttcctgatatcaagcttgggatatccattcctggtcgaggagaaaccagtgaattgcttaatgcagatggtgacgagaatgactatgactggttattgacacctccggacacaccactgtttccttctttagatgatgaaccacgagaattaaatgttgtaagcagaggaaggccaaggagtaaacctatttccatatcaagatcatctacgacagagagaagttacaaaagcagaaggggtagtgcaagtccaggtcgtttaagttcatcccctcattctgggaataatacattgcaatcgaggggaatgtcttcatcaacaccaaattctagtccaactcaagttttacgacatgctactccaacaagaaggtcatctcctccaactaagcccacgacacctgctcctagaccttccactcctactcctcggcgaatcagcactggctccagtagtcctgcactctcattggggattaggggaacttcccctgttaagacaagccgtggaaactctgcttcaccaaagataagatggcagactaatattcctgttttctcttctgaagctcctctcaatctccgtacctctttggctgatcaaccagcatcatatgtgagaggttcatctccagcatccaaaaatagtagggattctacttctaaatttggtaggcaatcaatgtctcccactccttccaggagcagcagttatattcatagtcatgatcgagcccaatctagttcacacagcaaaggttctgttgtatcttcaagtgatgatgatctggactctcttcagtccatcccagtgggtagtctagatcgatttggttcaagaagggatggttcattttcaaacagcaaatctccttcaatttccaagaagtcagccaagatggtgtccccaagttctgctcctaaaagatcttttgattctgctatccggcaaatggatagaaaaagtcctcagaacatgttcaggcctctcttatctagtgttccaagtacaaccttatatgtcagaaaagcaaattctgcacaacattccctggtatctaggaactcctctgtcacaacaagtagcaatgcaatctgtgatcatggtacaaattttgtgccagatgctgaagggagtgaccacaatcaagatgatatggcttgtgaatctaagatattatacactgatattcgtgaagaagtattttcctttgataaaattggtggattaaatgcaaacattgggcatgagatcaatgatgaatcagttgatgtcctgcacaacaaaactagaggccctgtgattgctttagaccctactgaatctgaagcttctttttatcatggtattgacaaagaattcaatgaaagcttagaaacttcccatgccataggggacatttctgaaactggtggttttgagaatacaacaatttgttccaattgtggttgccctcttgaggccacagatcaaactgagaagaatcttaggctgtgtccaaaatgtagcaggaaaaccacattgttgagacatgtaatcccggaggcaaatttggctgtttccagtgaaaattcagtgaattccacagacattcttgcagaagatagaccatcagccaaaacagaccaactaaccgttgtgtctgaactgcctcaagagactgatgtgggtaacatgaggtttccccttggtgaaccagatgctgtggaaattcaaacttttcccagtgaatttattcaggaccactcgcaacaaaattctctctcgagttcactggtggagggaagtaggcagatgcctgccaatcagcttgaagtggaccagtcaggggttgatgacaagaagcccgataatcattctagcagtcagcagttgtatctttccaacgacagctcaaatttgaaagtggacctcttggaaggcactggcatttctgtactactgaaaaggtcaagcagtagcaaaggacatgtaattcagggcaggacttttactgccacgacgctatcttatgatgatctgtcttttgcaagaagcagcattaacagtattagaagctcaactggacgtagcagttattctaccacttcatctgccgatttcagctcagcaagacattctgattttcgtgtccaaaggcagtcaagtggcaggaaattggatgtagactatggatatgatgttaggatcaggcctccaagccctggtttatctttttctggaatgtcaaaccattcttaccatggattaggttttgctacacaagaaacttcctctggcaatacagaatgcagcatcctggaagagataccccaagatctacgagaaatgcaagcttcagaaaatgcagtaacagatgtaattgattcttcctctatgggtttgattgttgtcagggaagataatcttgaatatcatgattgtggtagaacaactgatgcctgtagctcaggattagtaagccaagctactggtgttcagcatgatgacaattcagtgtcagcatttccaaatcatgggagttttatttcaaatgatagtattgaagaccagccgaataatgtaagcagtgtctcaaatacggaaacaacagttaaggatccagagtcatcctttgatgagaaacatgatatggagaactcttgtgttgatggactggatgctttggtaactatcaacacttctacaattgaagaatcagaaatagaaggggaaaactgttgtcagaaggatactggtgtggtggatgttgatccatcgctggtatcaaagtgccccattgcagactttcaggaacattctgttccaaattcttccagtgattgtcttgcagcttctgtttccgagctccatgcctctgagtactcccttggcatagagggatccacagttacggtggagtgtcaagatggaggaaatgctagaaacctgacacttgaagaggcaacaaatactatacttttttgcagctctatcatccatgatcttgcatatcaggctgcaacgatagcaatggaaaaggaacactcggaaccattggaaggttctgagccaacggtgactatattgacaaaacccaattccgatataaaggattctcgcagccgaactgctggcaagcgtgctatgaaaccccagaaggcaacaaggccaaagatggtggaagttgatgtaaaatccccttccaagattgagaatgacgaaaatattgacgagtctttgacacgcaatgttgggcttcctaacaaaatagacaacgtgaagccccttccaaataagcttgaatcaaagtgtaattgcgtcataat

SEQ ID NO: 10743 - DNA, 345 bp, Glycine max
  Peptide Sequence Number=SeqID_127521
atggcaggagggcgctgccggagcgcgccaggtgtttgcgctgctggccgactcaggtatcgattatctgcacctgaccgaacacgatgcgttgcagccagcgttcgcggacgcggcagagtcgctgctacagctggcgcgccaggctgcgccacagttgccggtggtgatcaacggatcgctgtcagatgccgaacgcgccggcatggcgttgtatcagggcgcagattatgtggcgctgggcaaaagcgcgctggccaatccggactggccacagcgcgttcgccacggccagccgctgcgcgccttcgatcaaaacctgctggcaccgtccgcggatgttaa

SEQ ID NO: 10744 - DNA, 201 bp, Glycine max
  Peptide Sequence Number=SeqID_127522
atgacgctggccatcgccaacctcgcgtcgatcatttcaccgatgctgtgcggctggctggcgcagtactacggttataacgccatgtttaccgtcaccgcctgtatcgcctttggcagcatgctggccatgacgctgctgcagccggagaaacgcctgcaagccgatgcgccgccagccgccgcgcagcaggctgtgtaa

SEQ ID NO: 10745 - DNA, 798 bp, Glycine max
  Peptide Sequence Number=SeqID_127523
atggcggcctgggtgggatgcagctgcgccagttcgacctgcacaatttctccggctttgatgtcgggcggcagggcggcaaaggcgggggcggtactgaatagcaaggctaataacggcagggacgctttcattccattttctcctgaagatctcctggtggagcaacacgatagcattcctcatcccgctaaactgcaacacaccgcgatcgatcccagcgtccgtctgcgcgacacgcagattggccagcagtgtgaaattctggcgcacagttatctggaatacagcgaactgggtgatttttcctaccttggggaacactgctgcgtggcggatacgcagattggccgcttcacggccatcgccaatcaggtgcgtatcggggcaccgaatcatccgatggatcgcgcctcacagcatcgcttcacctactgcccggagtattacgacagccacgcgcagcgcgatgccggtttcttcgccggacgccgtgccgatcgggtgatcattggtcacgatgtgtggatcggtcacggcgtgattgtcctgcctggcgtgacggtcggtgacggcgccgtgctggcggccggggcggtggtgagtaaagatgtgccgccttacaccatcgccggaggtgtgccggcgaaaccgattcgcgcccgtttcagcgctgacatcgcagcgcagctgcaggcgattgcctggtggaactggccgctggagaagctgatggcgcacctggcggattttcagtcgccggatatcgccgccttctgccagcggcacgggcgataa

SEQ ID NO: 10746 - DNA, 903 bp, Glycine max
  Peptide Sequence Number=SeqID_127524
atgaaagcgtccctgccgttattagccttgctattcagtaccgcccccgcctttgccgccctgccgcccgacatcaaagccggagaaattgtgcaggtcgaactggcgcagctgcatcccacccaggccgccattggttatcgccagctggattacaagcagcatcgttatcaggccgatccggaaaagctgttcgatgactattgcgaaagcatgggacaaaaaggggtgaaaagtttcacgccgcgctccaccctgcgcgatccggccagtttcagctgtaaggcgccggtcggcagcgaacccggcccgatgaaaaccgcggtgatcggcccggataatcaactgtacctgactgatggccaccacacgttcagcaactttgctgacatggccggcctgtcaacgccggtgcaggtgcgcattaccgatgatttccgcccgctgaaaagccaggctgctttctggcagaaaatggcggcggcacatctggtgtggctggagacgccaaacggtaaaatcgcccccgaagcgctgccgcaggagctgggtcgccagcatatgcaggatgatgagtatcgttcgctgatctactttgtgcgcgatatcggcttcgataagccagacaatccgccgccgttcctggagttcttctggggacagtggctgagccgggaactgccgctgaaagcgttcaacctgcgcgaccgcgacggctacgccgcagcggtgaaaaaggtggcggagaagatggtgagcgtgcctaaggatacggtgattgcgcagagtgataatggtccgctgacggcgcaggcgctcggtgccagagacgcggtgaaccagaaggcgctgaacaagttaagcgccgataacggtaagctgagctgggcgtttaaacgttaa

SEQ ID NO: 10747 - DNA, 246 bp, Glycine max
  Peptide Sequence Number=SeqID_127525
atgttgagcttcacgaagttcccttcgccggctccggatgttcgcggcttcacgctcggcattggcgcactggagccaatcaggttgggaagctggctcttcccacgcttcctcaagtcggcgccctcggcgcgtgagtcagacgcgccggaagtaaaaaccggttgttcgacttcagaaggttctagattgaggagaggtcttcgaattttcgagaaggaagcagaatgggaggaggagaagtag

SEQ ID NO: 10748 - DNA, 279 bp, Glycine max
  Peptide Sequence Number=SeqID_127526
atgtgtcaacctggtaactctcgagacttaaatgtgttggaccttggggttttcaatgccattcaagcattgcaacacaaagaagcacctcacactattgatggcctttttggtgttgtggttaaagcattcaaagaatttccaacttctaaatgtaacaaggttttcttgacactacaatcatgcatggtggaaatcatgaaggcaaaaggatgtaacaattataaaattccacgtattaaaaaagaactatgcaaaaaggaaagtatggaggactaa

SEQ ID NO: 10749 - DNA, 1221 bp, Glycine max
  Peptide Sequence Number=SeqID_127527
atgacgctatttaagaatattggctttcagtcttttgatgaacgcctttccattcgcctgaaagagatcatgcgccgtggcacgcagagcgataatcgctgtctgctgtgtatgcctgatgccttccgcggcaccgggaatatgcgttttggctcagcgcttttctggttttttcataaagcgtttttctttcgccactatgagcatttattaaagaaaggctatcgctatggtaatacgtcggtaacgcgtccttatcatgattataaagacaaacagccggcggcacgtatttttgccaaatttaaacagctgtttcacgataaaaaaattctgattgttgagggtagcggcacgcgccttggtctcggtaacgatctgctcgaaggtgcccggcagatccggcgcattaccaccctcaaccgtaacgcgttttcggtttataacgagctatacagtaatgtgctggcgcacgcgcgcgagttcgacatggtattgatctcccttggcccgacggcaaccgtgctggcttacgacctcagtcagcacggcattcgctgcattgataccggccatatcgatattgagtatgagtggatgcgcagcgcggcacgcactaaggtgcaggtcgcgggaaaaaatgtgaatgaggtcggagccactgcgcagtgccgcagtggtcacgcagccgatagtgtgatgcagcgcaccgtaaccgatcgtgccggcgatcggtttggtgcagcacgctcagatagcgggagtcgcatgatgaaagcgtcctcaacccgctacaccattttctcgctgctgtttctcatcgcactgattaactacatcgaccgcggtgcgctgtcgttcgccgccaacgccatctcgcaggaatttcacttcagtaaagtgcaactcggtgccgtgctgggctactttggctttggctatctgttcgggtcgctgtgcggcggtttccttgccgaccggctgggcaccaaaaaggtctggctgatggctggcattctgtggtcgctgctggagatcgccaccgcctgggccggagagctgggcatggcgctgtttggcggctcggcgatcatggggtttgctgcactgcgcgtgctgtttggcttcagcgaagggccggcctacgcgttgatgaacaaaaccatcgcccactggcaccggataacgaacgcggtttcgcgctgggaattggtctgctga

SEQ ID NO: 10750 - DNA, 1104 bp, Glycine max
  Peptide Sequence Number=SeqID_127528
atgagatacgtggaagacaaagggtgctataacaacaatggaccaacacaagagaccccaaatagcagtgccatgtactcagagtttcacaaaggaaaagatgctactagtgtctccaaccaccaccatcgagcaaccatgggaaaaccaacaccttctaagtgggacgatgcacaaaaatggcttgtggggttgtcaaaaggtggtggagagaaaagccactccaaaagcaagccaagaaactcaaacgcagatgatttgagactcatagcacctgtgccacagaaggagaatgattactcaagtagcgagaaggaagaggaggaaaatgatgcatgccatgatttcatcatgactaataatattattagtgctaatgctactgctgctcaatatgaagctgaagccaaaagggtggaatgtgatgagtcaaattggagaagcaataataacaataataaaaggtcttcagaaaattacacaatccaagtgcaaccaatatgtttcagagacatggggactgagatgacaccaattgctagccaagagccttcaagaactgggacaccaattagagccacaactcctgctactagaagcccaattcattcaggggcttcaactccaatgaggggtcaaaatgggtcacaacatgttgctgagactactaggaaatgtggaaatggagaaggatcaacaagcccttgcaagaggactcatgaagatcatcaagctagaaagttgagtcctctagaaagccgagcaatggcttgggatgaggccgaacgtgccaaatatatggccaggttcaagcgtgaagaggtgaagattcaagcctgggaaaatcatcagataagaaaagctgaaatggaaatgaagaaaatggaggtgaaggctgagagaatgaaagcattggcacaagaaaggtttacaaataaactagcttcgactaagaggatagctgaagagaaacgagctaatgcacaagtgaagctgaatgacaaagctttgagggctactgaaagggttgagtatataagaaggacaggacatgtgccttcttctttctctttaagctttaagttgccttccatttgctggtag

SEQ ID NO: 10751 - DNA, 2120 bp, Glycine max
  Peptide Sequence Number=SeqID_127529
tggaggaggctgcgaccgcagcacgcaaggagccttcggaggagaatttggtgaagctgttgagattggttcatggttatgattgctttcgagatgggcaggttgaggcgattaaaatggttcttgccgggaagtctagtgtggttgttttgccgaccggtgcaggaaagtcgctgtgttatcagttgcctgctgtgatcttgcctggtgttacattggttgttagtccattggtagctttgatgattgatcagttaaggcaattgcctcatgtgattatgggtggtcttctatccagcactcagacacctgaagaagcctctgaatcactcaagcagcttcgtcaaggggggataaaggtgctttttgtttcaccagagcggtttctgaatgaggagtttctgtctactatttcttctttgccagccatctcacttgttgttattgatgaagcacattgtatatctgaatggtctcacaatttccgaccatcttttatgagacttagagcatctctgcttcataagacacttaatgttcgttctgtgcttgctatgacagcaactgctacaaccacaactttagatgccatcatgtctgctctagacattccttccacaaatcttattcagaaggcgcagttaagggacaattttcatttatcagtgtctttgagttatcatagtggtatctctgcaaaggaacgtagctatgtacaggagttgtttaattccaacaagatcagagtggttgttgcaactgtggcatttggcatgggactagataaaagagatgtcggagctgtaattcattacagtttgcctgaaagtctggaagagtatgtacaggaaataggacgtgctggaagggatgggaggttgtcgtactgtcacctattttatgatgatgagacatatttcaaacttcgtagtctaacgcacagtgaaggagtagatgaatatgcagtgaacaaatttctgcgtgaagtgtttcctgctgacaaaaactcctgtgggaaaatctgttcattaatcaaagaatctgcttcacgcagatttgatatgaaagaagagaaacagcctctttacatatgcaagggtaaggctgcgtacaacatccctcccccataccttcgcatagcgaagagcctctgggcaatggggttatatctgtgtttgtacaaaaaatctggttttgttttatctttctttgctaagtccttgagtccaaagagatcaagattaactttaaaccagataaagctaagatataggggtcagtcatctctatccatttatatgacatttaacatgctactaatgaaacctgttcctgtgatgcttacacttttgacacgcttggagttgggtgatgtacagtacttgcagttacatccacagataaatgtaactggcactttgaattttcacaagtctcctccgccattacttgctcagaaggtttctgctatagctgtaattctaaaaagatctgaaaccaagcatgggcaatatatttttgacattccaactgtggcaaatgatatgggggttacagcagtggaattaataaatcagttgtacgacctgaagttgatgggagaaataacttatgaaatgaaggacttggcctactgttataggatcattgaagtcccaacagacttgttatctctatcagcagatattacccgatggttatcagaagttgaaaattgtaaggtacgaaaaatggatgcaatgtttaatgctgcatattttgcattaaatctatgtgatacgatgcaaggttgcagtggtgccaatcatacaccatgcttgcaaaggaaaatattggattacttttctggagttgataatgctgatttctgcaagaaaattggtcaaagcagccctttcctgcgggcagatataaaggtctttctgcagagcaattcacaggctcgatttacaccaagagccgttgcgagggtaatgcatggaattgcaagcccagcttatccttcaacagcatggagtaaaactcatttctggggaaggtatacgcatatagactttcaggtagtgatggaagcagcaaaggaagaacttaagaattttgttggaaaagatacactctag

SEQ ID NO: 10752 - DNA, 717 bp, Glycine max
  Peptide Sequence Number=SeqID_127530
ggattctcaaacgtccccttgatgggaacaaggggttgtatcaattataaccccgtccttgccataagacaacttggctaccccatgagaggagcactgtcagaagaaagtatcgtacctttcatcgcgtggggtttcagtaaccccaatgcaaggatattacaaggagtccacaaagcatggagcacggtgcaaagaaaagataaagagcttaggggaagcaacaatgggatcatcggcagctatcataagtggctgaaggcttggacgcaagagttggattggctcctaaagctaaaggtttcaagcgaggaagaggctgaaacccctgaggagagtgaggaggtgaaagccttaaaggcgaaacttgaaagagcacaagcggtcaaggaaaagttcaagacgacgaccatcatggtccggaaagaatgcgacggattgagagacgtcaatgttgccactcttaagcttcgaaggtccgagagagaccagtcaagagtcgaaggcatgatattggaagacaagttgaaggcatgtcagaggttaaagaagaatttgtccgagcaattgagtaggaccggagaaaacatgtgggccatcattgaccaatacaaagagaagctaagtctagctgcaacctatgaacaaaggctagaggacgagtatgcaaagtgtcgcaacctacccttcggtgggagggcgatgagaggcccatgg

SEQ ID NO: 10753 - DNA, 1194 bp, Glycine max
  Peptide Sequence Number=SeqID_127531
atgcgcttctccaccgtggccggcgagcgtggcagcccggacacctggcgcgatccgcgcggcttcgcgatcaagttttacaccagcgaaggcaactacgacatggtgggcaataacacgccggtgttctttatccgtgacccgatgaagttccagcactttatccgctcgcagaagcgccgtgccgacaacaatctgcgtgataacgatatgcagtgggatttctggacgctgtcgccagagtcggcgcaccaggtgacctggctgatgggcgatcgcggcatcccgaaaagctggcgccacatgaacggttactcgagccacacctatatgtgggttaacgccgccggggaaaaattctgggttaaataccacttcaaaaccgatcagggtgtggagttcctgacgcaggataacgccgatctgctggccggccaggacggcgattaccatacgcgcgatctgtttaccgccatcaaaaatggtgatttccccagctggacgctgtacatgcaaatcatgccgtttgccgaggcggaaacctaccgcttcaacccgtttgatctgactaaggtctggccacacagcgattatccgctgattaaagtcggcaaactgatgctcaaccgcaacccgaccgacaaccatgcgcagattgaacaggcggcgtttgaaccaaacaacctggtgcccggcatcgggctgagcccggataagatgctgattggcagggtgtttgcctatgccgatgcccaccgcgcccgtcttggcgttaactacaagcagattccggtcaacgccccgcaggcaccggtgcacacctaccgcaaggatggcgcgatgcgcatcaatccggtcagcgatccggtctacgcgccgaactcgaaaggcggtccggcggcggacggagagcgctacccgacggattccacctgggaagcgcacggcaacatggtgcgcgcgccctacacgctgcgtcaggatgatgatgactttggccaggccaatacgctggtcaataaagtactggatgaggcggcacgtgatcgcctggtaaataacgtcagcggtcatctgctcaacggcgtggaggagccggtgctttcgcgcgcgtttgagtactggcgcaacatcgaccagacgattggcgatcgcattgcccagcgggtacaaaccgagcgcgccaagcgttaa

SEQ ID NO: 10754 - DNA, 1236 bp, Glycine max
  Peptide Sequence Number=SeqID_127532
atggcggctagcagacatggcggttaccgcgaaaacgagttcaaagagcgcgaatcaaagttagaagtttccagacgcggattcgcgaattcgaaagaggattacgatcgtgttaggaatggtggtggcggtgaagttgtgaggggtgggtcaagggatagggttagggtgaggcagaaggatattaaggagagggaaggtgttaatggtggtggttatcgatcctcttcgagtaggagtgactctggcagcagtggccttggtcctcgccggtgtggtttctctgtcaaggcagttgatagagagcctggtgagctttccagtgagagtggttctgatgatgctattgaatcggaaccggggttaaaaggctccgaggttgcaatgttggaagaaaccaggactctgtctccgccagtgccggagagaaaaaggaagttttcgcccatagtgtgggatcaggatgacaaggaagtcaacgagctatccaaagttagggtttccgcctctgcggtgaaggtggctgcgcttcctcctccacctccgttgcctaaggtgttccgtcagtcacagtcgccgaatgctccgaatagtggagttgaaatagttcctgtcaagaacagggaaactgaggaacttcagttgaatgcagcatctaatgttaccttgtcctctccttcaggtttgcattcattgcccccaaaagggaagtgggataatgatcaggaagctgagcatccagaaggcgaagattatgttccaactcgcaatatatcgtcttcaagatgggcagctggagataactctcctgttgatgagggtgagatcctcaatgatgaggaaatgcccaaaagtaggtggagggtgtctcctgatttattggatggtaggctaaggaacaagctattgagccctgaggaatctaaggtagaaggtattgaaagagctagagccagatcatctgaatctgaagaaagaggtgcccgtgggagaacttccagtggtgatgattaccccgggtcagagaaggatgactacatggaggttgatgttcaaggtgggaaaagtgaaaccagtatcagtcactcagacacggattctgaagatgaagatgatggccgggagactccagaacctactgctcaacctcaaagaacattcaacatgcttcagggttgtagaagtgttgatgagtttgagagactcaacaagatagatgaaggaacatatggtgtt

SEQ ID NO: 10755 - DNA, 186 bp, Glycine max
  Peptide Sequence Number=SeqID_127533
atgtctcttgatcaattagccttgacccttaagatgcttcaagtattcatggtcactatgtgtcataccctaatttcgtccaggaaatgggcaagatactcaaaatgggggcaaaatggtcattttggggatattttccagtccctgggtccacctgggccattagaaaacttaaaggttaagtaa

SEQ ID NO: 10756 - DNA, 218 bp, Glycine max
  Peptide Sequence Number=SeqID_127534
atgggatcaaatcaagcacccttgtctaagaaaaggttctatcaagtcaaaattaaaagcctagaggttgctagtttgcaagaattggggcaattgatggatcagctccaacttcaagctttccgcaagacctatgggaagatttgggatctagctatgatagaagtctctatcgaagccattgcatccctcactcaatattacgatcaaccactaag

SEQ ID NO: 10757 - DNA, 1626 bp, Glycine max
  Peptide Sequence Number=SeqID_127535
gaactccacaccctgatcggttttgaagtggtatttaacccagaatttttccccggcggcgttaacccacatataggtgtgactggagtaaccgttcatgtggcgccagcttttcggaatgccgcggtcgcccatcagccaggtcacctggtgcgccgactctggcgacagcgtccagaaatcccactgcatatcgttatcacgcagattgttgtcggcacggcgcttctgcgagcggataaagtgctggaacttcatcgggtcacggataaagaacaccggcgtgttattgcccaccatgtcgtagttgccttcgctggtgtaaaacttgatcgcgaagccgcgcggatcgcgccaggtgtccgggctgccgcgctcgccggccacggtggagaagcgcatcaccacatcggttttggtgccgggctgaaataccgccgctttggtgtaacggctgacatcttctgtcacctgaaaatagccaaatgcaccgctgcctttggcgtgcggctgacgctctggaatacgttcgcggttgaagttagccatctgctcaatcaggtagtgatcgtgcagcatcagcgggccgtctggaccgacggacaaagaatgttcgtcgctggctaccggaatgccagcatccgtggtggtcggcttgcgatcgtcattgctcataatatctccagcttttgtgaggataatccaaccactaagcgtagcagcgaggcgcaggcttgcccgaataattgcgccgtctcatctgagataaatatggtgatgcataaggctaaaaccgcgcgcctggcgctggctatcgcggggatgatggtgggtggcagtgcagcggcacagtcattaacgctggagcagcgtctggcccagctggaagagaaaatcgcgcgcgatgagcagcagcaaaaggaggcgagcgccggaacaaccaacacgttccgcttttccggctacgcccgttccggcctgctggttaatgataaagggcgcggtggacgtgccggacctgctatttcgcctgccagttcgatcggcggcgatgcgcatattggccggttaggtaatgaaaaagatcactacatcgagctgggctttcataaccaaacccggttcagtaatggttcgtgggccaatttcaaagcgctgctggcagatggctcatccagtccggacccgtgggtgcagaataacgacaataatctgaatatccgccaggtatatgtcgaaatgggggatctgcccagctttgggggcgccgcgcaacatgcctcgctgtgggcgggcaaacgctttgacggcgacaattttgatctgcacttcaccgataccgatatcgtctttcttggcggcaccggcggcggcatcagcaacctgcaatggaacgagcaatggcgcagcgatttctccatttatggccgcagttttggcgacctgggcagcagccgctacgacgataacaacgtgcaaaacctgctgctgacctcgaaccagttttacggtaactggcagtggatgctgaccggcatgagcgcaaacggcaacgacgagctgaaagggcgcgcatcgaccaccggcagctatgcgctgcgcagtgacgatacggcaaagcatggc

SEQ ID NO: 10758 - DNA, 576 bp, Glycine max
  Peptide Sequence Number=SeqID_127536
atgccacatctgctggcagaagcagagctcagcggtggcatgacgccggtccagcagcagcgtctgcagcagctgttactcagcctgacgccgtggttcgacgcgatactgattacctgctctaccttaggtgccgccgcagacagctttcgcgatccacaacagcgctgtgcggtttatcgcactgaccgtatgctggcggacgaagtgcatcgccgtggcgcacccgcgctggtgctgtgtgccgcagagtctacgctgcacagcacacgccagctgttttgcccggagagtctggcacccgaccagcgtccgcaagtcaggcttatcccggatgcctgggccgcattcaaagctggccggctggacgactattacacgctgatagccgatgccgtcgctcagggacagcagcagggcgcggttcaggtggcgttagcgcaggtgtcaatggccggcgccgcgtcgcgttttcctgcgctacagcggccacttaccagcccgcacctggcgctcagcttcgtactgcagcaggctaaaggcgcggacgaaggtcattcaaaaccactgatttaa

SEQ ID NO: 10759 - DNA, 207 bp, Glycine max
  Peptide Sequence Number=SeqID_127537
atggctgatttgctgaggcggaatgccgagcgactgcgcggcgtcatcaaaaatagcaatattactggcggcggtatgcaggcaggcaatggtcacaacgattccttatcgcttcaggttcactttaccgctggctggcaggcttcgccggatgcggtgccagcgtttcgaacctactacagcccatacggatcacggaatgactaa

SEQ ID NO: 10760 - DNA, 249 bp, Glycine max
  Peptide Sequence Number=SeqID_127538
atgcaaaacttggaggccataactagatcttttttggatcaatggaggcttttagtgctgctcaaattgatagagctgctgcgagatggggttgctaagagatgtaaagcatccacttctcattcagcatcaatttactggatgggcgataacgcaattgccagtgttttacgtgagaatgaacttttggtaaatgaagactggagtatgttgaaggatttagagagatggttaaaatgggctggttga

SEQ ID NO: 10761 - DNA, 609 bp, Glycine max
  Peptide Sequence Number=SeqID_127539
atgggcaacagccgcgtgtggatgttgtgcctgatctacttcggctttatttacggcctgtacgcgctggcgttcttcctgccgaccattatcgccggcttccagcagcagtttggcaccaccttcaacgtgatgcagaaagggctgatcaccggcgtgccgtacctgatcgccgccgtcgtgatgtttttctggtcgcgggatgccgcgcggcgtggctgtaaaacctggcacatcgcgattcctgcggtcgcgggcggcgtcagcgtaccgctggcgctctacatggattcaccgtttaccaccatcctggtgatcgccgtaacggccagcgccatcttcgccgcgttgcccaatttctggacgctgccaacgcagttcctgaccggcgcatcggcagcggcggcgattgcgctgattaacaccctgggcaacgtggcgggtttctccgccggttacatcaccggcgcactgcatgatgccactcacagttatgtgttaccgatgttcgtggtcggcggttttatggtgctctccgctgtattgatgctgttcctcaatcgccgtcgcgcgcagcctctgccagcctcatttgtacaggagcaataa

SEQ ID NO: 10762 - DNA, 780 bp, Glycine max
  Peptide Sequence Number=SeqID_127540
atgttccgcttccagttcggctatcagccagtttttctcgtcgtcattcagccacttcgcctgacgcggcgagtccaccagccagaacagcgccacaatcccgatgaggattgctggcagcgatacgcccataaacattacgcgccagccctccaggccaaacaggccgtgctgctcaatcagcgaggcagccagcggtgcgccaaataccaccgtcagcggttgtgccaggtagaacagcgagagaattttgctgcggtggcgcgccggcacccacaggctgagataaaggatggcgcccgggaagaaaccggcctcggcaatccccagcagcaggcgcagcgtgtacagcccttcgacactgctgacccaggtaaacagcagcgagacgatgccccagctgatcatgatgcgcgccagccagcgccgcgcgccgaacttatgcagcgccaggttgctgggcacttccagcaggatgtaaccaataaagaagatgccggaggcgagaccaaactgcagcgcactgaggccgaggtcctgcgtcatgccgtttgggccggcaaaggaaatggcggtgcgatcgaggaagttgataaagaacatcagcgccacaaacggtaccaggcgccaggagattttgcggattgcggtctgctcaaccgcgctgacagcagagtgattcataacgcacctccgaaacgtgcgcaggtagacggtgttggccaggcgcaaaaccggcgctggcgacagacaaaatgcgagggtcatgcgaacaagtga

SEQ ID NO: 10763 - DNA, 2058 bp, Glycine max
  Peptide Sequence Number=SeqID_127541
atgaaactgagtccaagagaggtggagaaactaggcctgcacaatgctggctaccttgctcagaaacgtcttgctcgtggtttaagactcaattatactgaagctgtgtctttcattgtcacgcaggttttaaatattggttgtggttgtgttgcggtttcgtggcgtttgttgatatcgtggacaaatgcaattactgcgattatggaatttgctcgtgatggtgaaaagactgtggcacaactaatgtgcattgggaaacatctattggggagacaagttcttccagaggttcaacatctcttgaatgctgttcaggttgaagctacctttcctgatggaactaaattagtcacagttcatgatccaatttcatgtgagcatggagatttagaacaagcattatttgattcttttcttccagtaccttcacttgacaagattgctgagatcatggaagataatagaataccaggtgaaataaaatatggagatggaagtctagttcttaacccaggaaggaaagcagtgattctcaaagttgtcaacaatggagaccggccaattcagggaagccactatcattttattgaagtgaatccctacttgacttttgatcgaaggaaatcatatggcatgcgcctcaatatatctgcagggactgctgttcgctttgaggtgcaattctacattggggatactaagagcgttaatcttgtaagcattggtgataacaaagtcatcagaggaggtaatggcattgctgatgggggatttggacataaggaagaggaaaatgcaagtgaaggtattactggtgactctgacagtccattcaccacaatcattcctcgtgaagaatatactaacaagtatggtccaactactgacaaaatccgtcttggcgacaccgatttgtttgctgaaattgagaaagattttctctatggtaatgagtgtgtttttggaggtggaaaagttttaagagatagaatgggccagtcatgtgggcatccacctgcaatctccttggatactgttataacaaatgctgtgataattgattatagtggaatcatcaaagcatatataggcatcaaagacggccttattgtctcaattggaaaagcaggaaatccagacatcatggatggcgtattttttaatatgatcatgggggctaacactgaagttattgctggagaagggttgattgtaacagctggggctatagattgtcatgtgcctttaaatattgacgaatggtcaaggaagtgcagggcagatatcatcagcctatatatgcagatgaatttgatggagtttaacgagtccttatttactttgtatgtaggcatcacaacattagtgggagggggaaccggaccgactgctggaacacgcgccacaacttgtacaccagcaccatctcagatgaaactaatgctgcaatcaactgatgacctgcctctaaactttggtttcactggcaaagggagtagttccaagcctgatgaactgcatgaaataatcaaggctggagcaatggggctgaagctgcatgaggactggggaagtgcttccgcagcaatagacagtgcaggtggtggtcatgctccagatataatcaaagtatgtggtatgaaaaatgtcctgccctcatcaacaaacccaacgcgcccttttactgtcaatactatagatgagtatcttgacatgctgatggtctgccatcatctgaatagggaaattccagaagacttagcttttgcatgttcaaggataagagagggaacaattgctgctgaagatattttgcatgatattggggcaattagcattatatcttctgattcacaggctatgggtcgagttggagaggcagaacttaatgctttatacggactgaacaagagggtggaagcagtaggcaatgtgaggaagctcaccaaactagacatgaaacttaatgactctcttccacaaatcactgccgacccagaaaagtacactgttacagcagatggtgagaacctcaccagctttgcaaccacctaa

SEQ ID NO: 10764 - DNA, 1278 bp, Glycine max
  Peptide Sequence Number=SeqID_127542
atgaccaatctgcaaatacaaacagaggaaccccctctgagtcaaacaccgcttttaatttcaattcagcaacaactacagaaccagaatgagggaaatagtaataataacaataacaataatgtgaataagaagaacgaagacgttcaagttgacgctgacggagagattgaggaggatcagagtaaagtggaggcgagcctggtgcggttggaccggtttcttacggtgttagggttcaaccaggactcgccgttgagcttcgtggtttcgtggagcgtcttcgcggcggtgggagtggtggcgccgctgctggcgctgtccatgtgcgactgtccggagtgcgacaggtacgagattcagagcttcgagatggcgatcgtcgcgtttcaggccagcctcgccgccgtctccttgctctgcctctcccacaacctccgcaagtacggtctccgacggttcctcttcgttgaccgctactccgggaagatgcattgctttcaccgcgactacgtcgctcggatttcgggatctatgcgcatgctttttctgtgggtgttgccgtgtttcattctgaagacagtgcgagaaatcattcgcattttctatgtacaacatgggtcctggtggctctcgcttgctattttatcagctttgattatttcttggacttatatgagtacaatctctctgtcagcctgcattttgtttcacttggtctgtagtttgcaagtgatccactttgatgattatgggaagctcttgcaaagggaaagtgatgtgttagtttttatggaggagcacattcggttgcgctatcatctctccaaaataagtcataggttcagaatctatcttcttctagagttcttggtcgtcacagcaagccaggttgtgacgcttttgcaggtcactggatatggtcaaatgcttaccttcattaacggtggagattttgctgtatccacacttgttcaggtggtgggcatcattatttgtctgcatgctgcgacaagaatttctcacagagctcaaaatattgtttccgttgcaagcaggtggcatgcaatgctaacatgcacatcgtctgatgcaccctctcaattgagaagctcagctagtgcagggagcttggaggctgcaaaccatttaaatgcaatacaagtagactattctgaaagtgatctagagtcaatggattatgctggaatgtttacaaatacccaatggacttcctatgtgtcttcacatcacaagagacaagcttttggtgtgtaa

SEQ ID NO: 10765 - DNA, 2361 bp, Glycine max
  Peptide Sequence Number=SeqID_127543
atggatgttgctgaggttgaggaaaatctgtttgccgcaagtgatgccaagttacatggacagatgtgcaagactctttctataatctattgcaaagtactgtctgtatttccttctttagaagctgctaggcctaggagtaaatctggtattcaggcattatgttcattgcatgtagccttggagaaagtcaagaatgttcttcagcactgctcagagtgtattttatttgctgattatgtttctaaatacagtttttattttagcttatcccgtgaagcagttctttcttgttggcaggctataactggagattctgtcctcctaaaatttgagaaggctaaatgtgctcttgaagatagtcttagacgggtggaagatattgttccacaatctattgggtgtcaggttcaggagattgtgaatgaatttgcaacaatagaatttgcacttgatccatcagagaagcaagttggtgatgatttaattgcattgctccaacagggaagaaagttgaatgactctaatgacagcaatgagcttgaatcttttcaccaggctgctactagacttggaattgcatcttcaagagcagctcttgccgaaagaagagctctcaagaaactcatagtgagggctcgatctgaggaagacaagcggaaggaatcaattattgcatatcttttacatcttatgaggaaatactccaagttatttagaaacgagttctcagatgacaatgattctcagggttctgcaccttgttctcccagtgttcagggatccattgaggatagtgttcctggtagtcattgtcaagcctttgacagacagctttcaaaactcagttgctttaatttcaaaccaaataatagtaggaaatcagggcagatgcctcttccgcctgaagagttaaggtgtccaatatctctgcaacttatgtatgatcctgttaccattgcttctgggcaaacttatgaaagggtttggatagagaaatggtttagtgatgggcacaacaactgcccaaagacccagcagaaactttcacatctttgtttgactcctaattattgtgttaagggccttgttgctagttggtgtgaacaaaatggagttcctattcctgaaggccctcctgaatctcttgatcttaactactggggaatggtattatcagagtctgaatctacaaattcaaaatctatagatagtgttagctattgcaagttgaagggtgtccttgtggttcctttggaagagagcggtatctcagaggaatatgtggaaaatggaactgaaagtgtttctgcacaagaggaagactctgagcagtattttagctttctgaaagtcttgactgaggggaacaattggaggaagcaatgtgaagtggtagaacagttaaggctgttgctgagggatgatgaggaagccaggatttttatgggggctaatgggtttgttgaagcacttttgcagtttttgcaatcagctttgcgtgaaggtagtttgatggctctggaaagtggagcaatggctctcttcaacctggctgtgaataataacagaaataaggaaattatgttatcagctggagtattatcattgttggaggaaatgatttctaaaactagttcttatggttgtacaactgctctttatttgaatctctcttgccttgaagaagccaagcctatgattggcgtgactcaggctgtccagttcctaatccagcttcttcaatctgactctgatgttcaatgcaagcaagattctctccatgctctctataatctttctactgtgccctccaatattccatgcctcctttcatttggcatcattagtggcttacaatcccttcttgtaggcgagggggatagcatttggacagaaaaatgtgtagctgttttgataaatttagcaacttctcaagttggaagggaggaaatcgtatcaactcctggactcatcggtgcattggcttcaatattggacaccggggagctcatagaacaggagcaagctgtctcttgtctcctaattttgtgcaatagaagtgaggaatgtagtgagatggtcctgcaggaaggggttataccagcattggtttcaatatcagtgaatggaactccaagaggtcaagaaaaagctcagaaactcttaatgttgttccgagagcagcgacgggacccttcaccagttaagacacataagtgcccacctgaaactgctagtgatttgtctatgccacctgctgaaatgaaaccgatatgcaagtcgattttgagaagaaagtccgggagagcttttagctttttctggaaaaacaagagctattctgtataccagtgttaa

SEQ ID NO: 10766 - DNA, 2490 bp, Glycine max
  Peptide Sequence Number=SeqID_127544
atgttggcgctcaagcctctcccctcagatctctccctccgcccatctccggcgaccctcgccatcaaccgccgccggaggatccagttcccagcctccgtgcggcgaagcgtggatgttaaagcggcggtcagcggcggagacaagagccagacgacatcgacgacgacgacgtctccttcgttggacagcaaagagaggaaagggaagagttcagtggcatcatctggctctggcattgatgaagaaggaatacaagtgaaggcagtggtgacaataaggaagaagatgaaggaaaatatcactgagaagcttggggatcagtgggagaacatggtcaacggcttcggtcaagggatccagattcaactcatcagcgaggaaattcaccctgttactaattctgggaaaagcgtgcaatcctacgtgagagggtggctaccgaagccgtcgaacgttgcttacattgtggaatactctgctgaattcagcgtaccaagtgactttggatgccccggtgctgttcttgtcaccaatcttcatggaaaagagttctacctagttgagatcatcgttcatggcttcagcggaggacccattttcttcccagcaaacacgtggattcattcgcgtaacgacaaccccgaaaccagaatcattttcaagaacaaagcatacttaccgtcgcaaacaccggctggcatcaaagatcttcgacgcgaggacttgctaagcataaggggtacccaacacgggcaaagaaagcaacatgatagaatctatgattatgctacgtacaatgacttgggcaaccctgataaggatgaggaacttgctaggccagtccttgggggtcacgaaatgccttaccctcgtcgttgtagaactggaagacctcccactctctctgcatgtctaatggggtgtgtaattggtgcaatgtcaatgcaattagatccactgtctgagagtagaattgaaaagcctcatcctgtttatgtgccacgggatgaaacttttgaggagatcaaacaggacactttctctgctggaaggttgaaagctctgttccacaatcttttgccatcgctcgcagccactctgtcgagttcagacgttcctttcaagtgcttctccgacattgacaagctttatatcgatggtgttgttctgagagatgaagagcaaaaaggggtaatggaaaatctcttagttggcaaggtgatgaaacaagtcctgagtgctggggagagtttgttgaagtatgagatccctgcggttataaaaggggataaattttgttggttgcgggacaatgaatttgcaagacagaccttagctggggtcaatccagtgaatattgagctgttgaaggaatttcccatccgcagcaagctagatccttctctctatggcccttctgaatcagcaataacaaaggaacttctagagcaagaacttggtggaatgaacttggaacaggctattgaggaaaagagactgtttatccttgattaccatgatatgcttttgccgttcatcaagaagatgaactctttgcctgggaggaaagcttatgcctctcggacaattctcttcaatacaaagactggtggtataattgaggcatctttcagtccaggaaagtatgccatggagcttagttcagcagcttacaagaaattgtggcgatttgacatggagtcactgccagcagatcttattcggaggggcatggcagtagatgacccttcaatgccctgtggtgtaaaacttgtgattgatgactacccttatgctgcagatggactcttgatctggtcagccataaaagaatgggtagaatcttatgtagcacacttctactccgatccaaattcagtcacatctgatgttgagctccaagcatggtggagagaaatcaagttaaagggtcactctgacaaaaaaaatgaaccttggtggcctaaactcgataccaaagaggacctatccggtatacttaccacaatgatatggattgcttcaggccaacatgctgccataaactttggacaatacccctttggaggatatgtgcctaaccgccctaccctcatgagaaaactcatccctcaggagaatgatccagattatgagaagtttattcaaaatcctcagcttgttttcctatcatcactacctactcaacttcaagctaccaaagttatggctgttcaggacacactgtccactcattcacctgatgaagagtacttgggtcaacttaaacctctgcagaatcattggatcaatgatcatgaaatcatggaattatttaataaattttctgctagactggaggaaatagaggaaataataaatgcaagaaacaaggacccccgtttgagaaacagaagtggtgctggtgtccctccctatgaactgttgcttccctcgtcagggccaggggtaaccggtcgtggaattcccaacagcatatctatatga

SEQ ID NO: 10767 - DNA, 162 bp, Glycine max
  Peptide Sequence Number=SeqID_127545
atgaactctcactccgacattcaagccggtatttacaggattgctaaggaaatatcagtcggccaacaagtacataaacacatatttaagtttatgccttataaagctgatcagtttttaagcaatggaggaaatcttggtcgtaaagcttcaggtttttga

SEQ ID NO: 10768 - DNA, 1140 bp, Glycine max
  Peptide Sequence Number=SeqID_127546
atgaccggaagcggaagaagtagcgttcggagcagggcgagatccctctccgactccgacgccgacgccgattctcttcgacaaaagaggcctccgctgaatcgccatagagagagaagcaaatacggaagctacattccgatatacagcaatgccaatctcaaagtgctgctcggtatctgcttcgtcgcattcttcatcatctggtttatgattcaccacctctccaattccgtaacggagccgaagcttcctcgcgccgttacgccatttcccgcgccaaagataatggaccttcctcagtttgaaggtgagcacaaggagagtttgtattggggaacttatcgtcctcacgtgtatctcggaattcgcgccaggactccaaaatctttgatggctggattaatgtggattggtgtgaaggatggaaaatatcacttgcggcatgtttgcagacacgaggatgacctaagtacttatggttggacaaggcacaatggacgtgattttggacatcaagtgctggttgatcatggcatgaccttgactactgaatttttaaaatcaaaagaggaaggcagtggctatggtggggattgggcagttcgaattaatatgcaaattgataagtccaagtggaatgagggatttgggagaggtgcccagctctttttctatttggctgatgaagctggtaatgctctagatgtaagtagagaaaacttgaacattcatgaagattctttgcttgcatctggctctcgagcagatattggagattggcagctacatttgaaatcaacggatgatttgcagctgcattatgctggatttcgcatacctcacttgcacaatttatctgatcccgtagaggaaaatcttgcatcacaaatacaaaagcatgctcgactgcagctatctgactcattagatgattctccaaatgtgttagtttttcagattattggtggatttcctttcacaacagatattgtactaatctctggaactgatttggaaacttctagagaagaagagcgtgtcagtatgcttacaggtacctcactgtccaataaactgaaatataaagaacaagaatttgatgagaagtttgagaagatttttaatttgaccgagaag

SEQ ID NO: 10769 - DNA, 342 bp, Glycine max
  Peptide Sequence Number=SeqID_127547
atgtcgtattggtctgctgagctttacacagctgtaccaagtcgatctttctttccaagaggatttttatgggatgaaggttttcatcaacttataatctggcgttgggatattcatatttcgttggatatcattggacattggttagatttgattaatgttgatggatggataccacgtgaacagattttaggggctgaagcactaagtcgggtcccagaggaatttgttcctcagcatccaacaaatggaaatcctccaactctgtttttagcattaaatggttacaataagcaaagccatagcttgagccttgagtccaggactccaggctgcatgtga

SEQ ID NO: 10770 - DNA, 501 bp, Glycine max
  Peptide Sequence Number=SeqID_127548
atggcacattctaagatggttttgatcccaaaaaccatcttagaatgtggcagcttcaaagacaatttcttgacctatggtgatcttgatgatgatgggaatccaagagtcgatcttgagtcttcttttttggattccatcaaacttggtgatgactctcctggtgcaccttcatgtgccaaggttggttctattgtaaatggcaaggctgagggcagcactgcaagtgacactcaagttttcgttcccaatatttcatccaagaagatgctcgaccttaagaaaataaaagttaaaaagtggttggttacctattgcattaaggtcgtggttgtcatcgtggagggtgttgcggtagaaacggtggagaaaagtctccctcacccactctccgtcatgccctccgtcaaccactctccgccatccactccttattcccttcctcacgcagctagtctactcacttgtggtggtggtctcactccgttcctaactcactga

SEQ ID NO: 10771 - DNA, 174 bp, Glycine max
  Peptide Sequence Number=SeqID_127549
atgtattcatacaaaaggattcttatagtattaaacaattactgcatttcacactactttcaatcaagcctcagagtcacacttgaagatggcagagatggtggtcgcactatgggaacacgcctcactactgaaaatgcttcattaagacgagcaacacgacccatgagctga

SEQ ID NO: 10772 - DNA, 682 bp, Glycine max
  Peptide Sequence Number=SeqID_127550
gtgggcaactggggatggtgtgcttatgcctgggcttgtggaaatgggatatttgttttgcgccatcgcccgatcgccacctagtaccacatatgaaagagtggtacctgaggatatgtcgcgggggtcaggagaccttggggacgttaggtggggtgctattgcccaaaaccaagcttggccaatcccgacccaacccgggcatagtcagccagtgagaacctgtgacgtacctcagcaggcgagctcctggcagtcaaccaatacaggaacaaaagtccacgaagcaaggaggcttggtgtttgggagaccctcgaaggcaatgagaggtgccgattccgtggcacagttcaactcactgctacttcgctagtacatccggagcaacccgcatgcacacttcagcagcttatggagtggatactacctacgcctactccatatcgactagttgagcctgttcaattgatagagatgtcatcctctgaagaggatcttgaagaggacccagaggagttacctcctgaacctgctatggatgcccctgacttaccaaaggatggtgaggacccgctccctgatgttgattctccaaaggatattatgtcagcatatgaggcagactctacagaggagagtggccctagagggacagggaatagtgatgactcttcatcatag

SEQ ID NO: 10773 - DNA, 2622 bp, Glycine max
  Peptide Sequence Number=SeqID_127551
atggcgttcgggtcttccgaggatgtctcaggtgtcaaattacttgtccttctggcggtcatgtacggactcttgtcggcgctgacatactccgtcatccacatgaagttcgtcaaccctctcgggaacgacgcgccgtttgatcgattctccgaagccagaactgtagaacatgttcgaatgttgtcgcaagaaatcgacggccgtcaagaagggcgtcctggattgaaaaaggcagcacaatatattaagcgtcagttggaagtaataaaggagcgagctacctccaatgtcagaattgagattgaggagacaactgtgagtggctccttcaatatgttgtttttgggccataacatagctctgggatacagaaatcatactaatattcttatgaggatatcatctgtggattccaaagagactgatccatccgttttagtgaatgggcattttgatagtccccttggttcccctggtgctggtgactgtggttcatgtgttgcatctatgctggaaattgcaagactaattgttgactctggttgggctccctaccgcccagttattttcctttttaatggtgctgaggaactttttatgttgggtgcacatggattcatgaagacacataaatggcatgacactataggagcttttataaatgtggaggcatctgggactggagggcctgatttagtttgccaatctggacccagttcttggccttctaatgtctatgcagaagcagcaatataccctatggctaatagtgcagcccaggacgtttttcctgttattcctggagatacagattaccgaatattttcccaagactatggggatattcccgggcttgacattatctttctccttggtggttatttttaccatacctcctatgatacagtagagagactattacctggaagcatccaagcacgtggagaaaatctgttcagcataatcaagacttttactaattctgctaatatacagaacacctataaaaaaaaatctagtgaagttactgctagcacattcaacgatgagcgggctgtattctttgattatttctcatggtttatgatattttatcctagatgggtagctaaaattcttcacagtattcctgtcttcttctttcttgtcatgcccttcactcatggtaggtcacattcttggtcagcagctttgtgtgattttataaaaggatttatgttccatgcggttgggattatattggccgttggtgttcctgttgcattttctattctgagattactgttctcttctcaaacaatgaattggtttgctcatccatacttggctttcgcaatgtttgtaccttgtgcacttgttggacttttaattccaagaataatctggagacactttcctctttctcaagatatttccattgtcaagacatcaaaagaggcactatctgatgaagcaaggttctggggagcatttgggttctatgctgtattaactttggcttatcttgtagctgggttgagtggaggttttgtgaccttttttgtttgtgcttccctgcttcctgcatggatatcgttctgcttgtcagtcaaattctttggacaacggtcactcaggtcaacaatgttttacatactacctctagttccatgccttgcgtattctgtttattttggtggctttcttgcccagtttctgatagagaggatgggaatgatgggttctcttccactaccatatgggcactatgttcccgatgttattgtggctgcattaattggaactgtaactggttggtgcacaggccctctaatgcccatatgtgggcattggttagccaggtcatccatcttgcaatttcttctgcatcttagtgtgtttgctttggcattatcatctcagttctttccttacaccatgtctgcacctaagaggattgtttttcagcatactttccatactgcaggctcaagtcagattttggaatccacttatgatttttctgtaactgactccaattctttacttttccttttcaaacattcacctgaagtggcaaaggaattgaatattacttcagagttttcatttgaatctgcatcattgtctaaacacaatgattggatggcaatttttccactttcttttctcttctcaaatagtctcaagttccctgcgaaaaaggatgatattttgaaacagtatgaattctttccgaaattgtctgttcaaaatccatctttaaattccaaaaagggacccagaagagttcacttggagctttatttaggttccttggaagaggtctgggttgcggtcctcaacatcactggtcctttatcaagttggtcatttgcagataatttgcttccagcctgcatttgcacaggaactgaaacctatggtgatggtccacaatcatatatatgtcgtcttagtggacctagcgatgggaattggaccttctggttagaggctaacaactctgaagcattacgagtggacctagcaattttagaccaaaagttggttgatccaataaagagattgaagaatctttttccagattgggttgatgttgttgcatattctagttttatgtctagctatatcttctaa

SEQ ID NO: 10774 - DNA, 1167 bp, Glycine max
  Peptide Sequence Number=SeqID_127552
atgcctagttttgtggctgaaaagaagatatttgtagagccaaatatgtgttttaccaatttggccaaccatgatagaccaactcttacaaaaaacaatcattatgtgaggtctgaggctctggatgatgatgatgatggtactagccccatcctacctgggctgcctgatgatgtttcaaaacactgccttgcactcgtgcctcgttcgaacttcccagccatgggtggtgtctgcaagagatggaggggctttattcgaagcaaagaatttataaccgtgcgaaaattggctgggatgcatgaggaatggctctatatcttgacagcaggcagtgaaggaaaagggagccattgggaggtcatggattgtcttgggcataatcgccgatctcttccaccaatgcctggtccagcaaaggctggctttggggtagtagttcttaatggaaagctccttgttatggctggttattcatccattgatgggactgcttctgtctcagcagaggtttaccaatatgattcttgcctcaacagctggagcagattgtcaagcatgaacgtggctcggtatgactttgcttgtgctgaagtcgacggcttggtttatgccgttggaggctatggcgcaaccggtgacagtctctcaagtgcagaggtgtatgatctggataccgacaagtggacgccaatagagagtctccgtcgcccgagatggggttgctttgcctgtggattcgaggggaagctctatgtcatgggtggaaggtcaagcttcacaattggaaactccaagtttgttgatgtctacaaccctgagaagcacgggtggtgtgagatgaaaaatgggtgtgtcatggtcactgcttatgcagtgctggaaaagaagttgttctgcatggagtggaagaaccagcggaagttggcaatattcaatccagaggacaattcatggaaaatggtaccagtccctttgacagggagttcaagcattggttttcggttcgggatattggatggtaagttgttgcttttctcactggaggaagagccttcatataagactttgttgtatgatccaaatgcagcaccaggatctgagtggcacacctctgatataagaccatctggtttgtgtttatgcagtgtaactattaaggcctga

SEQ ID NO: 10775 - DNA, 111 bp, Glycine max
  Peptide Sequence Number=SeqID_127553
atggaggtgttgaatgaatgctcacccacgacgctggatccttcggaacccattacgatggtgaaaacttggaagactcaaaagggtaggttgaagaacattgtaaattga

SEQ ID NO: 10776 - DNA, 507 bp, Glycine max
  Peptide Sequence Number=SeqID_127554
atggatgctgtagtcagctgggtttcagggcatagctcccttaacacaagggaaactgcctttgcaatcaggaagttgcccttggtcaaggctaaaaggtacttggaagatgttcttgcccacaagcaggcaattccattcagacgtttttgtcgaggtgttggaaggacagcccaggctaagaatagacactctaatggccaaggacggtggcctgtcaagtcagcaaaattcattcttgatttgctcaaaaatgctgagagcaatgctgaagtgaaaggtttggatgttgatgcactgtacatttcgcatatccaagtcaatcaagcacagaagcaaagacgccgaacataccgagcccatggaagaatcaatccttatatgtcatctccgtgccacatagagttaatattatctgaaaaagaagaacctgtgaagaaggagcccgagactaagttaacaacaagcaagaaatcccaagctcttcgaagtggcgcttcgtcatag

SEQ ID NO: 10777 - DNA, 168 bp, Glycine max
  Peptide Sequence Number=SeqID_127555
atgattgccttcatcagtcattttcctaggaatttcagattattggaagagcttgagagaggtgagaagggaattggggatggaactgttagctatggaatggatgatgctgatgacatatacatgcaatcttggactgggactatcatcggtccccctagtacatag

SEQ ID NO: 10778 - DNA, 213 bp, Glycine max
  Peptide Sequence Number=SeqID_127556
atgattatttatatccctgaagattacgagaggcatgctcacacaggcaacatgcccctgctttttcatcagttacaaacagagaacagaggttcacccaataacaatggttattatatccctgaaggttacgagaggcctgctcacacaggaaacatgcccctgcttttttcatcaggatttgtgatttcccagaacaagttatctaagtaa

SEQ ID NO: 10779 - DNA, 604 bp, Glycine max
  Peptide Sequence Number=SeqID_127557
gggtcagtggatcccgtttgatgcagatgctatcggccagctcctgggacatcctttagtgctggaagagggtcaggagtgcgagtatggccagaggaggaaccggtccaatgggttcgatgaggaggccatcacccagttgctatgtataccggagcaggattttgcccggactactgccgggaggcgagtgcggatcatgcgcaccaacatgaccactctgactcagatctggatgactttgctgctcagcaacatccagcccagcgatcataactccgacctccccctgccaaagtgtcagctggtgtatgccatcctgacacggatgagcattcacgtggctcagttaatcactgatgccatctatatatttgcaggtatggcgcctaccaggcaccctctggacccggataagtccaacagggccctgggatttcccgccttgatcacaggactctgccagtcgttcggagtccccgtcgcacttagagaggcacctacagaggcaccagcagaggctcccgacgaggcaaatgaggcccgcaaggacgaggagatggccgatttatttgatttcttaggaggaagcggggccacatga

SEQ ID NO: 10780 - DNA, 393 bp, Glycine max
  Peptide Sequence Number=SeqID_127558
atgtccacccagaacttgatagcattaacatcacccaaactgaaagaaatcagtcgtacaaagaaagcattcccttgggaattaaatttccaacttccaagagttagcatggatagctgtggtgcttgggattatccagacaatcctccatctgttagatttcaaacaaggattaacatgacatgtgtcaatcaagaaactggagtggtaagaggcaattcttgcagaggcttcattgctgtggttgagccacatttgtttcctatgcttgctaattggaaacgtgagcgtacaatggaagacattttgattcaattgaagagagaaatgatgtctccccaaaataggaagctaactcagcctcctgaaggtgtgtctatctcatttttatag

SEQ ID NO: 10781 - DNA, 816 bp, Glycine max
  Peptide Sequence Number=SeqID_127559
gttgatttaatggaattattaaagaaatctaaatactggcagaggtctggaggtagagaccatgtatttcccatgacgcaccccaatgcctttaggttcctacgaggtcagttgaatgaatcgattcaggttgttgtggattttggtcgctatcccaggggcatgtctaatttgaacaaagatgtggtgtccccatatgtgcatgttgtggactcttttacagatgatgagcctcaagatccatacgagtctcgctccacattgcttttcttccgagggagaacttacaggaaggatgaagggattgtccgtgttaaactagcaaagatattggctggttatgatgatgttcactatgagagaagtgttgctacagaagaaaacataaaagcgtcatctaaagggatgcgttcatcaaagttctgtttgcatccagcaggagacacaccatcatcttgtcggctttttgatgccattgtgagtcactgcgttccggtcattgtgagtgatcaaattgaactcccatttgaggatgatattgactactcccagttctcggttttcttctctttcaaagaggcattacagcctggctacatgattgatcaacttcgtaaatttccaaaggagaaatggactgaaatgtggaggcaactcaaaagcatctcccatcattatgaattcgagtatcctccaaaaagagaagatgctgttgatatgctgtggagacaggccaagcacaagcttccaggggtcaaactttctgttcatagaaaccggaggttaaaaatcccagattggtggcagaggagatga

SEQ ID NO: 10782 - DNA, 579 bp, Glycine max
  Peptide Sequence Number=SeqID_127560
atggatgagttattttcaaatagggagggctcatcagcacagaagggccttctcaaaagtccagcactccttaagtacatctttgaaaggagtggctatcccaaagagcacgagcaattgaagcaactccgagagataacagtgcagaaatacggggttaaggtcctacaagatgatggtttacctactaaattgacccttgctaacattggcattataacaatcactatctgtcctattatatgtaatagacttgatgaatctctctcccacatcttttggaattgtgttgctcttactcttgctcaactttggaaatccctcaatgtcccccctcctgatttctaccaactagacgtgaaggaaaggatatttaaaaatattagattcccttcacatcctcccttgcttgacaccattttttcttggccaagtctgtttgtagctgctgtatatgagatttggcacatgaggaattatattgtgtatagtcaaatgcaatataatgttgaaaggatctctaaatcacatgctgcaccacctagcctcattagattggtaccccctccaattgggtga

SEQ ID NO: 10783 - DNA, 291 bp, Glycine max
  Peptide Sequence Number=SeqID_127561
atgacgagtccctcagtaaacaagaacatcctccagagtccagcatttcttaagtacatccttgaaacgagtagctatccaaatgagcacgaacaactaaagcaactcagagagaccaccgaacaaaagtaccaggaaaatatgggttatttgttgagtattccagcggaggaagcgcagttcatatctattttgcataaaatcctgaatgcgaagaaaacactcgaaattggagtattcagtgactactttcttcttgccacagctcttgctctgcctcttgatgacaag

SEQ ID NO: 10784 - DNA, 276 bp, Glycine max
  Peptide Sequence Number=SeqID_127562
atgaggattttaaacataggggcgtgggtaagtgggaacagggttgagatagccgagggtgcagcaaatgagaaaagtattgagtttgctccttcttccctttctggaaacatggaagccacgagcacatactttctttttaaaatacaaacttcaaaagacggccaccacggtgcatcgaaggggaaaagaaaagagaaacaattatatgctactttctccttctcttctgaccctattcccactcaattacccatactaaccgtgctctcataa

SEQ ID NO: 10785 - DNA, 693 bp, Glycine max
  Peptide Sequence Number=SeqID_127563
atggacgcaaaacgcgaactcgaagtggaagactgggaactgctccacccaaacgacgacgattcaatcgtgttcggtgggcccccactcgactctatcctccccgatcacttctcccttaatcccaattccagttgcagttccaattccaattccaattcctcctccgaggtcgatcgcaacttcgacgattcctatgttgccaatcagatattcccaaattccaccctcgcaccctggaacggggattccgattccgacaccaccgccaccaacgcccccgtggtggcgatggccgaggccgaggccgaggttgtggtggaacaagaagaggaacagaaaaaaatggaagaagtggaagagaaagatgatgatgaggaggatgagggggaggaggaggaggaagaagaagaggagaaggagaagagattggtgtggtggaaggttccttttgaggtgttgaggtattgggtgaaccctctgcctctgcctctccctgtttggtctctctctgtcgctgccgccgctgcttttctgggactcttcttcctgggacggaggttgtacagaatgaagcgcaagactcaaacttttaacctcaacctcgctctcgatgataagggattgccttgtattgtatacgtggagactttagaggacgaatgcaacacaaataacttctttttggaataa

SEQ ID NO: 10786 - DNA, 267 bp, Glycine max
  Peptide Sequence Number=SeqID_127564
atggtgacaaaaagggagagcatcatccacagaagatggttcaaggcaaatttatcgcaaatttgggggaggtattatcaaggtatgaaagctaagtgcctaagaaagagggcaagtaaagggaaggttattctacggatgaatgctctcctagaacctaagcttttgaatcctagaaaaaccatgaattgttggcatcctaaccccattacaagcctagaaagtccttcggattcatttttgtgtgttcattactgtatgatatga

SEQ ID NO: 10787 - DNA, 342 bp, Glycine max
  Peptide Sequence Number=SeqID_127565
atgttgggcagttggaccaatcttagagtttttgctgcttatgagaatgatttcaatggaaggattccagggtcctattctaggaagctaaaagttctgatcctcactcagaacaatttaagtggttatcttcctaatgaaattggggattgtcaagccgttttcaatgttcgaattagcaacaataatctagaaggtaacattcctaagattgagagtgttggaaatctttctagccttgcctactttgaagctagccataataatctttatggtgagctggtatcagaattttctatgttcaaatatgatcttcttgaacttggcttcaaatgtatgtaa

SEQ ID NO: 10788 - DNA, 1527 bp, Glycine max
  Peptide Sequence Number=SeqID_127566
atgaagctttgcttccacactctgctcttcatgtggtattgcaagggtgggttacctcctcaatgcccttactatcacaccattaatttgttaccatacttagggccagtgggtgcacacctttacaggaatgttcatcaccataaagatgaaattgagaagcaagtgaaggagttgctcttagaaggcatgattcatcattttgttagtcctttttctagcccagttattctagtgaagaaaaaagataattcatggagaatatgtgtagattttcaagcactaaacaaggtgacagttctgggcaagcaccccattcccacaattaacgagctattggatgaattacatgttttctccaaggtagaccttaagttcagcttcaaccaaatttgtatgaagaggaaatgcgtgtttgtgttctttgatgatatcttggtctatagcccaacttggcaaacccacctcaacaatctggtagctatcatttctttgtcgcagcaacatcagttcaaggctaactgcaaaaagtgcagtttcagtctaacctccgatgattatctcaacaatattatctctactatggatccctccaaggtccaagcggttctcaagtggccaaagctccaaaacacaaaggaagttagaggatttttgggactaactgggttttattgtcgttttatccgggactatggaaaaatcgcagaacctgtcactcttctcactaagaaagacaaattagccctaccagattttactaaagaattcttcagtgaatgtgacgcttctggtcacgacattggagctgtgctgatgcaagatcgccaaccaatcgggtattttagcaaagctctgtctcatggcacaatatctaaatttgtgtatgaaaaggagatgatggctcttgctttatccgttcaacattggagacattacctcctaggtcacaatttcaaatttgaagtcttgtacaaaccagggctagagaacaaagtggcaaatgctctttctagcaaaaccctcaacttggagctcaacactattttgatgaatccttattgggttgattttcccaagttgtgcaacgatttgaacaacaaccttaccctcaactacatcagagaagcgcttcagcatgacccagccttaatgcctaaatatttctctcgagagggtttgcttttcttcaaggagagattggtgctctctcccaatttcactcttattccattcttccttactaaatttcatgatacaacaactggcgaccattcaggatttacaaagacctataagaaattggcagcaaccttttttttctggaaagggatgaagaaacacatcatggattatattcaaggtgcaatacttgggtatgaagtcatcttagttgttgtggaccatttctctaagtacacacatttcttggctttgaaacatccttttactgtgaaaaccgtggctgagtgcttcatcaaggaaatgggaaccgcattgcgaatgagtatatcctaccactgctaa

SEQ ID NO: 10789 - DNA, 141 bp, Glycine max
  Peptide Sequence Number=SeqID_127567
atggaagctctcgacaaattcaaatggagcatcatgtttgagatggtcgaaattgagcatggaaactcatggcaaattcaaatggccgtaacttttgacttggatgtccgattcaggccaataatatatcgagacgcttga

SEQ ID NO: 10790 - DNA, 300 bp, Glycine max
  Peptide Sequence Number=SeqID_127568
atgaaggaagggtgcagcaaagtatgcgtcacaggagctagtggttgcatagcttcctctctggtgaagaagctcttggccaagggtcacagcgtccatgcaactctcagagacttgaaatttgcaatagcagagaatgagtcaaaggtgagcctcttaaagagccttccacaatcagaagggaaactagtgttgtttgaagctgatatttacaacccaaatgactttgaccttgcaattgaaggctatgagtttgtctttcatgttgctactcctatgatccatgatcctggctcctag

SEQ ID NO: 10791 - DNA, 408 bp, Glycine max
  Peptide Sequence Number=SeqID_127569
atggtagggaaaggcaaaaagagtacaataggccaaataatagctacagcatgcagctggctagcaacatggtggccaaactctcagacttccaactttccttataaggaccgcattatgcatcaaagcaaaaactatagacaatatcaacataaaggtatatatggctatgctgctccagagattccacaaaacaatacattaacagaaaaatgcgatgtctactcttttggtgtagttctactagaagtggtgtgcaaagacaagctagtaaatgttgaaaacaggcagaaacaccctgttgaggagaatattgatcctaatctcaaaggcaagattgccccagagtgttggaaagcatttattgatatcacagaaatatgtttgaagtttgatccaaatgagtga

SEQ ID NO: 10792 - DNA, 237 bp, Glycine max
  Peptide Sequence Number=SeqID_127570
atggatgccgcgatgaaatgcacttggctcaaggaagctcggcttagcgcacggctatcaacaaaaaatttgactatgttacctgggcttagcaattcagcctcacttagccataaccatttcatcaagaggatgagtgttcatcctcaaaagatgaactggcttagcgtgataggcgcgcttagcgagttcttccgagaacatgtatattcaatgaatactgatgaactcgcttag

SEQ ID NO: 10793 - DNA, 330 bp, Glycine max
  Peptide Sequence Number=SeqID_127571
atggacatgaatttgggagctctcatctctggtcagattacatctatggcacagtctaactcttctagacttgggttccccgctcttatcactgctttatgtaagtccagaggggttgcttctgacagcctgatcttcgaacgcctgagctcggtcattaacttggcctatatcagaaaaaattattggaaccctgatgatctgacagttactatcagaggggccaggaaagtgaggacaaggctagttgaggccccttccacatctacagctcctcctctagcacataccctaacagttccttttgtcacagcttttgcagattcttag

SEQ ID NO: 10794 - DNA, 306 bp, Glycine max
  Peptide Sequence Number=SeqID_127572
atgactcagtgtcgccaagcgctattccttacggccataactgaggttcatgaagctaagcgccattcatggcagctaagcgagattccttgcggaaataggcttgaaaagtgcaagaaaacaaactgtgttttctacattttctggaaaaacgcaatgaactcgcaaagcgagcatgctacactaagcgagttcatcaatactcattgtatagaggcgttctctgaagagctcgttaagcgatttcatactttgaggatgaatactcatcctcttgctgaactacctgcggctaagcgaggctga

SEQ ID NO: 10795 - DNA, 141 bp, Glycine max
  Peptide Sequence Number=SeqID_127573
atggaacgcttagcaaacattagtgaatttttgcttagcgcgctcttctcactcagcggatggactgaagcgcggatgctcgctaagccagcagattggcttggcgagaaggtgaaaaacaacacttcaaaacttgcctaa

SEQ ID NO: 10796 - DNA, 849 bp, Glycine max
  Peptide Sequence Number=SeqID_127574
atgaagcacttcactgacaccctcatcagtgccaacataggaacaaaagctggtaccgggccccccctcgaggtcgacggtatcgataagcttgatgtgtggggattagggctggatacgctgcgcgaccgcaaggtggatttactctaccttgggcagcaacacctgtacttagtgttctggtcgatgttatgcgctttactggttggcatcccgagcgggattttgctcagccgtcccttcgcccgtcgctgggctgaatatgtgatgcaaatcttcaacgtcggtaacacgctgccaccgctggctgtgctggcgctggcgatggtgattgtcggcattggcgatcgcccggcgctgatagccttgttcctcgcctcgctgctgccgattgtgcgcaacacctatgccggtctgagcgcggtgccgccgtcgctgattgaagccgccaacggtatcggcatgaccaaactatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 10797 - DNA, 1687 bp, Glycine max
  Peptide Sequence Number=SeqID_127575
atggatcaaatgagtcaacaaaggcatggctattttcattcagaaagtatccatttcagaggcagcaacatctctcaacctaatgtatgcacactcgtgacagcctcagggaacggaactaatctagattcccattatttactagatgcttatgacaatggtatggtgtatggaatgacacaatacaatggagttcaacatcaacataatcttgatatgggtgttccagctgcggccaacttatattattctagcatgaatccttcatctggtgcggctgtatctctaaatgctgaagttatgagaggaaattatcaatatttcaatgcctcggctagttcttcagttgctccccctaatgcaagacacactgaaaatggcatcccctcgctaccacattgcacttcatggagcagatcaggcgagtctatgatggtgcgtgaccctaaccgtataactcgagtaaattatttaagtcaacactttcaaccagcagctcctcctccctggctggaccagcagttgaatagcaataataatgatggtcatgctttgccttggcatcagtctcttctaatgccatatgtacaagctcccagtgctaatggaagttcattagagaatgcaagaatgggcccccagagatatcatgatacagctggcagcagaagtggccacagatttccccatcctccccttgtcaacccacactaccatagctttcatcatcaaacacagcctgtccaagagatgagaggtcactccatcaactttcaccctcctcctccagtaactgcaccttcatatagagttccaacaaatccatcacgcagttcttcaatcttcatacaagattctattgagatgggtgctaggcatgttggtgctgcaccatttgcagtcatgatggactggattatgggccatacttatggttgctttattatcacaatacagttccatgggatctatgctaagcatttccaattcatccatcagcctctcactggttccttgagcaagagctctgagttctgcttctgcactgctgcgagctacaacagattattgtttcttgcttctccaagtgttttaactagcttactacagagcatccatgtttcgtttgacaagtctaaggtgtacttcctttgggagatgaaaaatcctcttttcctttgggctacctccattcccgagaaatatctaagtttttgcaaccaaacgtgccttgtacctttctatatcaccatccgacttgtacttgatggtgaaaaccatttgcaccctgcggacctttttccttcagtgcagttaatgagttacagcttgtacctcttaaaggtcttttgtccctttgctgaaaaacaaggtggaactgtttttcaggttgaagaggctgtttttctccccctccttttcaatctccctctgtctctagatccagctgcaagaaatgccattgcggccaccttgcttgtcgtgcatcttgcgtcacagattgggtatggcagagcagtgaggtttcaaccatcatttgcaaagcagagtcaggatgttactttactggttgaccatcataatgatatgcgcttggacattgaggatatgtcttatgaggcaatctttggagttggaaaacaggagcttcttgcattaggggagcggattggcaaagtaaacacag

SEQ ID NO: 10798 - DNA, 553 bp, Glycine max
  Peptide Sequence Number=SeqID_127576
agcgtacatttacttgggttgttatactgagaacaagagagggtacatctcttgtggatcagttcaagtggagtgtacatccagttggttgttcaaagagaacaagggagggtacatcccttgtggatcttttcttgtaaaggattttacaagaccacttgatccaacagaatcgccatgctctagcacctcaacctctttggtgagcctcgtcgccctctcccacctcaaaacgctcatccttgttagcaacctcctcaccggaacaataccctattccctcagcaaccttacttcattaaaacaccttcaactcgctaacaacccgttctcgcggagttgcatactgagtcaactacgtaaccttaggaacctcgaaatgttgttcctcactggctgcaacttcattttatgcgagttgactgggacgattccaaccgtgttatgtgagttgccactcgcttcgttgaatttatacgagaacaagctcaaaggggttttaccaccgattcttgtgcgttctcaccaacctctacgagctttaattgtttag

SEQ ID NO: 10799 - DNA, 384 bp, Glycine max
  Peptide Sequence Number=SeqID_127577
atgtggatgaaagaagaagagggatggatagaggaggagaatgggataatggatatagaaagagggtttcccctatttgagatactcaagcttaggatgtattcattagaaatctctaagtctcgcgagtatggtagcgattgtgcacttaacgtgagattcgcgctaagcgtgcctttgggcttctttgggggtcttcttcatgctaagcttgagctggccactaggcgaggagacatgtcaggcctgtcttgggcgctaagcgagttgtcccaatcttcaactttttcttcaaggctttttcttcaagtttttgcatcaattttcctccaaagcacttgtaattttcttcttttgaatcctgctagtcataacttaacatga

SEQ ID NO: 10800 - DNA, 273 bp, Glycine max
  Peptide Sequence Number=SeqID_127578
atgaaagagaaaccggatagcatagagaaaacactagaagtgagtgtagagagaatcaaatcccttgagaacaacactctgagtacaagtatagtccatgtggaattcaatacttggttgtacccttttatactagttgtgcaacttggtacgcttgccaaggagtcaacaattatagccaagagaagtaaaggttgtaacaatatatggcacatcactactagaataggctttttacatcaattattaagaactttgaacatcggttattaa

SEQ ID NO: 10801 - DNA, 1842 bp, Glycine max
  Peptide Sequence Number=SeqID_127579
atggtagactccacccgttcgaaaactaccttggaccgtctagaagaagctttagccaagctcacttcgagtcacctgcacattaccggcaaactcgatgacctcctcaatcgcgttgctgttctggaaaatacccctcaccccaccccttcaccttcatcttcttctgcgaaccctgtaataccaacccacccacttcagccccacagactcaagctggaggtccctcggtttgatggcacggatccatcaggctgggtattcaagatttcccagttctttgaataccattccgtccctgatttagaacgcctaacgatcgcgtccttttatatggacggacccgcgcttgcctggttccagtggatggcaagaaatcatcagctacccacatggacaggattcctgcaagccattgaagctaggtttgctcattccccttacgaggatcccacaggccagttattcaaattaatgcaaaagggctcagtgcgcgattaccttacgcagtttgaagccttggcgaatcgaatcacaggcttatccccttcctcacttctgagttgctttatttccggcctcgaccctgctattcgtcgtgaagtccaagctttgcagccattgaccatggttcacgccgccggcttggcccgtctgcaagaggaaaagtttcaggacacccaacgcaacccccgcatccgcccatcctttccatcttcaccatcaaccccgctttctttctcgaccccctcacctccttcgcctttgcccttacttccttcccccgcaaagcctccccctctacccgtcaaacgtttgagtcccgaagaactcgcgagtcaccgtgagcgcggcctatgtttttattgtgacaataaattcacccgtggccaccgctgctcctcgcgcttcttcctcctgattgcagatgatgatacaggggacgctccattgaaacctaatatagagggtctgccccatttacctaacccgcctcttgacccaataccacacgaacctccccaagcccagattagcctccatgccttatcgggccagaccgtgccggagacacttcatttgactggccggattgctcaccacacggtggttatcttaatcgacggcggcagcacacataattttgtgcagagccacctcgttaagtcccttggcctcactccccaaccaacacccaccttaagggtcctcgttggtaatggtagtgaagtggagtgttctcagatttgcgtggcagttcccgtcatcacccaaggccgcaccttcacggttgacttgcacgtcttggccttatcaggtgctgacatcgtcttaggggtccagtggttaaggtctctgggcccggtgctcactgattataatcagttaacgatgaagttcattcacgaaggccaattggtcgagctccggggcaattccgacatgaattcattggccgtgagtcctccccaattacgacgtttacttcaaacccagagtgcgagtgagctcttccacattcgcatctcctcatcgcaaccatcatcacctacacatcacccagccatcgtctccattattgaccaatttcaagctctgttccaaccacccactaccctccctccctccctcccgcaccacaaaccactcaattcacctaataccaaacacttccccggtcaatatccgcccctacagatatccccatttccagaaacaggaaatcgagactcaggtgtcgaccatgctccgacaaggaatcatccgtccgagcaccagtcccttctcttcacccgtgctcttagtaaagaagagggatggttcatggtgcttctgcgttga

SEQ ID NO: 10802 - DNA, 350 bp, Glycine max
  Peptide Sequence Number=SeqID_127580
atggtgcaacatgcgggtttagcaccatcaactattagtttggcaccttctgcggcaattttgttgaatgaggctattgctggtgcatgtgcagaagctgctacatacccatttgaagtgagtcctttgtcgagaaattcacctcgtggaatattctgcacccgaacactgaatctacggtcaattagagccgttagatatgacatggacaataccttggtgcattataatgtgaagatctttgggatttatttgataaaagaagacaatgaaccaactattgaagatgttttgcaaactgggaagaacatgttggcagttggttattgcattatggaagctcttgcacg

SEQ ID NO: 10803 - DNA, 1215 bp, Glycine max
  Peptide Sequence Number=SeqID_127581
atgggagtaatgaagacgttagctcacgttccggaaaattttgtctggccctctatgaaacaagacattcatcagttcgtcacgagctgtgttacctgtcagcaaattaagacagatcaccgccgttcaccaggcctcctatctcctcttccaattccggcgcaaccatgggaggacctctcgcttgactttattgtcggccttccatcttatcacggtcactcagttatcttggtggttgttgaccgtttttcgaagggtcttcacctcgggtcactcccacagcaccacaccgctgccggtgtagctcaattgttcatggaaatctccggcaagcttcacggaatgcccaaaagcctggtctccgacagggacccgctatttttcagccatttctggcaagaactgtttcggctcagtggcaccaagctccagatgagctctgcctatcacccacaatcagatgggcaaactgaggtcatgaatcgcattgttgaacaatatcttcgtgcattcgtgcacgaccgaccctccacctgggggagctttttgacctgggccgaatggtcatacaatacttcggttcattcggccaccggcatgacaccctacgaaatcacatttgggaagaaaccaccctgttttcgacaatacattgaaggtacttccaagatcgaggcaattgacgaatggttcattcaacgtgacaggatgattggcagcttggaagtgcaatatgcagagggagatcaggtattagttcgcctacgtccccacaggcagacttcagcctcaggaactgctcattccaaacttgccaagagattctatggcccttttcagatcaccaaaaggattggtagcgttgcctatcaattgcaacttcccctagattctcgcatccacccagttttccattgttccctcctaaagccataccttccttcgaatgacttagtacctctctctctccctcctaagtctattgataaccaaccatgcatttccccacttgccattctagatacaaaatgggaagagactgcttcagggaaacaattgatggttcttgtccagtgggtaggactatttccagaggatacatcgtgggagctatgggatacaatcaaacaagattacaaccttgaggacaaggttgttttggaagcctgcagggatgatatgaacagagaagcaacaagggacaatgcataa

SEQ ID NO: 10804 - DNA, 258 bp, Glycine max
  Peptide Sequence Number=SeqID_127582
atgtcggctgaaaaatatcagtcgcggctgtttaccgcgccgatgtcggctgttgttttgtctattcaatccctgaataatatttggatgatgtcgattaggaaatgttcgatcggcgtcaccaggaaatgttcgatcggcgtcatccggcgatgcttctttttcaaacctcgatcggtcacctttcctggccgaagtcggctagcatttttttcgatcagtgccggtgaatcatgtttttctgccgaggttggctaa

SEQ ID NO: 10805 - DNA, 519 bp, Glycine max
  Peptide Sequence Number=SeqID_127583
atggacatggacctggggaacatgatctcatgtcagatcacccagatagcccaatccaactcatcccgactcgacatccctactcttatcatgaccttctgtgatgccaaggaggtccactctgataccttgacctttgagtccttgaaccttgtaattaagttggcatacatatggaagaactggtggaacctaacagacacttctgtagtatcccgggagactaagaagactcaggggaaagccacccaagagaggaattcctccagtgcattacagggctcgaagactgacctgcttatgctaagggggggggggggtgagcctactactgctgctacttctatagaggaggcaaagccaactattatttatgctgctaagattgttgaggcggagctagccactgctaccactgttgagatagaccctgttgatgaccctgctactaatgttgcggagcccagacttgataaagactatattgatgatgtctcagtggctcaaactccaacctag

SEQ ID NO: 10806 - DNA, 216 bp, Glycine max
  Peptide Sequence Number=SeqID_127584
atggggcgaaagttttcaatcgtatcagcatcaggaaactttggaataagagctatcaagttagaattaagacctagaagaatccaactttgtaagaagaattgcaagacagagttgaaaacattagtgcctataatgtcccaaatgcaccataaattaggtgctttattctacctagagataacagcaaaaggcttgagaccgagactagactaa

SEQ ID NO: 10807 - DNA, 888 bp, Glycine max
  Peptide Sequence Number=SeqID_127585
atggcagcggaatggagaaggaagagagagaggagacgccacttcaaggagaagataagtctagaagaagctcaccaccataggaggccatggataagagcttggaggaagaaggagatgaatgaagggagggggagagaagagcacgaaattttgtgctcaaaaagagctctgaaatctgaatctgctcggctttcatttggtgttaatggggcctcggttggttatcttgcttgcaagaggggagttcgtcagggtgccctatctccacttcttttctgtatagtggaggatgtcttgagcagagggattatgtatttggtggagaacaaatatttattgcctatggctagtcctaaaggtccgaagaaatgtaagttcttttcgggttctatgcctcataacaggactatcaaagttcagcaatgtcttggttttggacagggtcctttgccttttacttatcttggtgttcctatttttatagtagcttggagtcaagtttgcaagcctttggtggaaggtggccttggattgaaatccattgtcaagttgaatgaggcaagcatcttcaagtcatcctctatttggacatctatgaaaagtaagtggcatatggttttggacaatgcaggttgggttgttaatagaggtgattgtgtcaacttttggcttgacacttggtgtctagattcttctttggctgatgcgttaaatattcctgagcagcatagatgtgctttaaggtctttagtcagctattttgtgatgaatcaacattggaatgtgcctgaatctttgctgcatcatctacctcagctatgtgcaacactttcttctatccctgcttctttgttggataatcaggcaccaaatcaaccaatctag

SEQ ID NO: 10808 - DNA, 621 bp, Glycine max
  Peptide Sequence Number=SeqID_127586
atggcaggagatgagccacagagagttaccttagaggactattccaactcctcaacaccacaatacttcacaagattaccaaatgaagatccttacgccctcttggtcacttacatggagctatgtaatacagtcaagatagttggtgttctggaaggtgctattcacctccacctattctccttttcccttgctcgtgaagctaagagatggcttcacatgtttaagggaaatagcctgagaacatgggaagagaaacttctagatgctttcactggtggtaaggtaaagttaaaagcatccgacgaagctatggagctgattgaaaacatggcagccaacgacaatgcaattcttcgagatagagcttacacttctgcaaagaaaagtcggcttgagctcacttcccaagatgcattactagctcaaaacaagtttttagcaaagcaactggaaaccttgacagaaaccctaagcaaacttcctcaacaactacatttaggtaatcctactaatgtttctgtaatgaagggaccaatcactagaaccatgagcaagaggccccaagaagattgggctagagctgctgaagaaggccctagggttctcatgaaccttagg

SEQ ID NO: 10809 - DNA, 216 bp, Glycine max
  Peptide Sequence Number=SeqID_127587
atgacatcttcgtcaaggagggttacttccatacttcaacttgactcgatgaaccttttcgtaaaagcacgagcttggttcaaccccataacccagggaatggcaattttgatcgccaatacttcatcaacatttcatagggatgaaagactcgggaatacgcatgctatgcatggaaaatgggaaaacgcaagggtcacgcatgagcaaacatga

SEQ ID NO: 10810 - DNA, 454 bp, Glycine max
  Peptide Sequence Number=SeqID_127588
gtatatcatgaattcggttattaaagtgttgtatttcaacggaagagtatatgaagagaatgatggtgtaatatttgaaggcagaaaatatgttgccttgcaaatttgtgatgacgaagatgttgaaactatgatcgatagttttcaacaacaacaacaaatatcagttctagaattgtacatagaaaaggatgatgctggtggttctatgtttcattctgcaaactctgttacgtcatgtggacataatttatctcataatgagtcggaactgccaagaaatataagcaatttacatgatgatgatgatgattatcttgcgtctaactcatacgttgaagagtctttggatgaagatgatagtgttgatggaatatctgatacagacgatgaagtcaccgacatcattgaactagttttaattgttcacccaacagaagatatattttattaa

SEQ ID NO: 10811 - DNA, 887 bp, Glycine max
  Peptide Sequence Number=SeqID_127589
atgcgatcaaagaagaaaccatggtcgccactcctctgtgacaaactcatcgaggaaatcttgtctcgtcttcccgtgaaacctttgatccaattcaagtgtgtgtgcaagggatggaactccctgatgtcagatccctatttcatcaaattgcacctaagcaaatctgctgcgaaggacgatttggaacaccttcaactgatgaaaaatgtctgcctcggatccatccctgaaatccacatggaatcgtgtgatgtaagttcgatattccattccctacaaattgaaacgttcatgttcaatttcgcaaacatgccaggttaccatctggtcggttcatgtaatgggttgcactgtggggttagcgaaatactagaagaataccgtgtttgtttctggaacaaggcgacaagggtgatatccagagaatcgccaacgctgtctttttccccaggcattggtcgtagaacaatgtttgggtttggctatgatccgtcaagtgacaaatacaaggttgtagcaattgcattgactatgctctcacttgacgtatttgaaaagactgagatgaaagtttatggcgcgggtgacagtagttggagaaaccttaaaggttttcctgttctttggactttacctaaagttggtggagtgtatctgagtggaacccttaattgggttgttattaagggaaaagaaaccattcattctgaaatcgtaattatttctattgacctggagaaggagacttgcagatcactgtttcttcccgacgatttttgcttttttgatacaaatattggagtttttagagactcgctgtgcgtttggcaagatagcaacacccatcttggcttgtggcagatgaggaagtttggagatgacaa

SEQ ID NO: 10812 - DNA, 165 bp, Glycine max
  Peptide Sequence Number=SeqID_127590
atgagaggtaccatgcatgagcctcaagcaaacctaggggcagataagaagttctcacccgagaatcctcaaggtttcacacttgcacatttgagaagaaaactcattcgaccagcagctcgtggaaaatgcccaaagacaattgtgatagtagggtacatttga

SEQ ID NO: 10813 - DNA, 394 bp, Glycine max
  Peptide Sequence Number=SeqID_127591
tggaagaattcggaagctgctgttagatgcaaaagattcaaaagttttacgcataagtctccaaatgtggcaggtggtgcaaaggcatttgaggtagcttccaagtttttccatggaatcaatgttgagttcaccctctataaacaaagctcaatcataaagggtgagacaatatatccatgggttaaaactgtcataacaacagaagaggaaatcaaagtgcaccggagagaagttcctatggagaaaggtacaagtcttcctatggagaaagttctcaagaaggttttggccaaatctcaacatgaaggggatggagctgttgttagaagagggattggaaggagcgagttgaagaacttggatcccttcctaatgttggatcacttctcag

SEQ ID NO: 10814 - DNA, 849 bp, Glycine max
  Peptide Sequence Number=SeqID_127592
atgatgagtgcattaaacatctatggctatgtcgttgcggctgttgttgtgttccttatattattgctttggcagcggaacagatttttcttcgcttcatctccgtcgtctccatccgcttccttactgctttccgattctatcaattcaaactcaagctccagaagcagaacctcaaattttgtgacagatgcagatttgaaatttttaatggagattttggatgagaagctcgacagtgataaatgggaggatgttctagataaaagaaaccatcatctatgctacagtgtgaaatgctgcaagcctaaggaatgcccaggtacagacacaaatgcagagtcaaaccatcctctgaatggtcccctgaaatatttgagcaagactgtgttcaatgacatttcatctgagatgctaagaaacttctacatggacaatgattacagaaagcagtgggataaaacactggttgagcataatcaactgcaggtagacaaatctgatggtactgaagttggtcatacaattaaaaagttccctcttttaaagcccagagaatatgtgctagcttggaagttgtgggaggggagtgatgaaacattttactgttttatgaagaagctattaaccattgcaagacttggtttggtagaactttcgtatgccttgttggtattggcaaacagttcagcacgagtgatgcatcctattctccattcctttcacctatctgttcataatcttcctgttgatatctttcagattgtgtctgcatatttagacaataggcaagatcctatcttgaacttttcccttttgtcaatgatacttccaagggaaatacagtga

SEQ ID NO: 10815 - DNA, 429 bp, Glycine max
  Peptide Sequence Number=SeqID_127593
gtgaagttgacacagggggttgaaatgttgaccatttttaaaaactatgaaactgatgtgtccatcctggatgattttgatttctatgaagaccggcagaaggctatgcaagaacggaaggcaaggcagcaaagcagcatggtggctactggattggttggagaaaatgaacatcggagttctgctaacactaccggtgatttcatgaagcagatgtcgaagagctttgctctagttgtccgcttagatgagaataacaaggaagttgttgttgcagatagagatagtttagtctctcatggtcatggccccattggtaatgtagttaaacctgatgatggtcaatcagtgactgcctcttcaactcaaaccagtagcgttgctgttgttattcaattcaagtcgatggagtccggggtttctaaatga

SEQ ID NO: 10816 - DNA, 144 bp, Glycine max
  Peptide Sequence Number=SeqID_127594
atgacacccttcatcatcaccgtcgtcaacatccaaatgccgcttggagcagcaaccacatgttggaatagaggaagggttgttgggaagaggaagagacggtggtgcggagggtgcactgcacggatggacctttctagctaa

SEQ ID NO: 10817 - DNA, 258 bp, Glycine max
  Peptide Sequence Number=SeqID_127595
atggcggtaaggagggtaccgctagtcccacttgcgggacatgtgctgagtaggagagagctgcgggacgtgtgcggcacagctggtgccgccagcagtggttgcgggatggggagaagtgtcccgcccttggagatggcgggacaggtgagagagtggtaccgccaaccaccactgcgggacagggggagagagagagagagtgtgtgggtaccgccaacagtggctgcgagacagggcagagaggatttgttctga

SEQ ID NO: 10818 - DNA, 864 bp, Glycine max
  Peptide Sequence Number=SeqID_127596
atggtagtgtttgatagagctttccccaactccatggaggttcaggtggacctaggcaagttgttggtaattcctgacagtgcaaaagcatgcagtccaagacctaaagctcgcctagtagcaaaatggatggatgtaatgacaacctttcttcacggtgatctagaggagcaaatttacattaagcagccacaggggtttactaaaggtggaccagatcagttgggttatgttgagaaggtgttagacatgttcattatgaacaatgtgaagcctgtgattggttgcttgatgtatgcaatggtgtgcactagaccgaatttggcagatgatgtaagccaagtttgcaagtctatgtgtaacccaggcatgcgacattgggaggcaatgaagggtacaatcggtcgtggtattatgtttggtagtcagcaaggtgatcctttggtcataaggtatgtggattatgactatgttggtgatctagatgataaaaagtctacaataggatatgtctttactcttgcaagtggaccagtttattggaagttcattattcaatcacttgtggaaatgtcaacaattgaagtggagtacatgtcagtagtagaggctagcaaggaagttgtgtggttagtagagctagtgaaggaactaggcattgaggttcatacattagaggatgcaattgatatgttaaccaagacgatcacaactgatagggctgaatattcgccaaggttgagggtacagtggagcagtcacggatttggtggcaatggcgacaaagcaggtggcgcagtcattgttggagaggtagttcctgcattggaacacggcgtagacagggttcagctagttgattga

SEQ ID NO: 10819 - DNA, 156 bp, Glycine max
  Peptide Sequence Number=SeqID_127597
atggatacaaatgatagagagagaagagaggaagagttctcaggcttaagctgtgctgcatgcttagcgcgagcctcgagcttaacgcctcgcttagcgcctgtgccacctgtctcgcttagcgcgagttgtgcgctaagcgtgagtctgggctga

SEQ ID NO: 10820 - DNA, 747 bp, Glycine max
  Peptide Sequence Number=SeqID_127598
atggaagctttggattgggaggagttggaagagagggttatgacaactatacgcttgtgtttggcagatgaggtcctctatcacgtgatggagttgaagtctctgggggaggagggtttggatttccaacaacatgtgaatgccttcaataaccatatcgacgatttggcaaggttggagatgaagattaaggacgaggataagacattggggagtacgcaagacgatggtctgtatgtgaagaggaaacatgaatgtcgaaggacacaaggcaagtgttctggtgagttgaagaaatctggtgaaatggcatcccacttagcaaatgtgggagagactgacaattcaaactactacactgagggagatgtctactatagtgagggagatgttctctctgattcatgcagtaacgataaagcgtgtgttgttgttagaatgggacaagtgaagattgctatggatgatagtggagtgagaatgttgtgtgatgtccgacacattcctgagttgaggaagaatttgatctcatttggtaccttgtatgtcaatggtttcaggataaagattgggataccctctgatcctctcaatgagcgtgggatgataggtcttcataagcgagaactcttgaaaggagttcggagttgcaagttagacttagattcatccttgggtggtactcactactttgtgacattcattgatgatttttctcgcaaggtttgggtgtacttcatgaaatag

SEQ ID NO: 10821 - DNA, 369 bp, Glycine max
  Peptide Sequence Number=SeqID_127599
atggtcgtcattttgcctaaggaaaatgttgtcatttggttttgttcgttgcataataagtcagacaactacctcaaaggcataattaataggtcagtgttgtttttcaatacatttgcattaacattagtcagtgctttgaaaggacttgacgatactcaacaaagtaaatccaagcctcctgttagactaatttgtactgaacgttgcatatctaaatttcataatgcatttagtgtaatagacaaaaaggaagcactgagttatttcactgattctagaccattggaatcagaaagattgaatgcgcttcgcaaccagtggacaaagtactatttgaaagttaaaaatgaaacttacaatgtttag

SEQ ID NO: 10822 - DNA, 309 bp, Glycine max
  Peptide Sequence Number=SeqID_127600
atgtataacaagttaattgagggtctcaagtacattgccaatcttgcaatatttgctagactttacattaactacatggttagactatacaaccatgaaaaccttggggatgaactattaaatggcagtagtccttgtacaaaggatgtgtctgttggttcttttagctattggacctgcactagatcgaaaaagaaaaaacaagaacaagcacagcaaaacaaacaaggacctacaccagttttacgtggttcagcagtgtgcctacatccacgagaaatggtagttcatcatcatctcgttcgataa

SEQ ID NO: 10823 - DNA, 294 bp, Glycine max
  Peptide Sequence Number=SeqID_127601
atggcagcacagttaatccatgatcgcatggtgatggagtgcctagagggagtttgggagaccctcgaaggcaatgagaggtgccgatttcgtggcacgattcgactcactgctacttcattagtacatccggaggaacccacacgcacacttcagcagcctgtggagtggatactacctacacctactccatatcgactagtggagccagtccaagtgatagaggtgtcatcctctgaagaagatcctgaggaggacccagaggagctacctcctgaacctaatgtgggatga

SEQ ID NO: 10824 - DNA, 129 bp, Glycine max
  Peptide Sequence Number=SeqID_127602
atggagagagttagtccaacaagaggaatctgcggacgatgcttgatcaggattaggttagactatcatgaggaatcggggtttagcatttcaggagacaccatagaacgcatgagcattgttaagtag

SEQ ID NO: 10825 - DNA, 207 bp, Glycine max
  Peptide Sequence Number=SeqID_127603
atgtctcttccacctctagaacctcacaatcactcacaaactcatctcaagttctcaggacagcttcctcttcaagctcggttctctgtaggtggctctgttcgtgctcatgcgcttagcgcaattctaaaccgcttagtgcggcttttctcgttcagcggatggactgaagcagtgcacttagcgggatggcccttcgctcattga

SEQ ID NO: 10826 - DNA, 153 bp, Glycine max
  Peptide Sequence Number=SeqID_127604
atgagtagacgctcgagcagaactgtctacgttgggaatctacctggtgatatccgtgaaagagaagttgaagatttgtttctgaagctggtcacaaaggacctatttcattggcttcctggagttttcatttccaacaatagaacaaattaa

SEQ ID NO: 10827 - DNA, 195 bp, Glycine max
  Peptide Sequence Number=SeqID_127605
atggccttctgttcgcttccgacaagtgcaccgaattgcacaagtagtataaaacggaactcacaatcactcacaaactcatctcaagctctcagaacagctcctgcttcaagctctagtctctgcagatcttcacacagcaaaatctctcaacactctatagaacttggacctttctctctctacaatctctag

SEQ ID NO: 10828 - DNA, 165 bp, Glycine max
  Peptide Sequence Number=SeqID_127606
atggagtccatcatcagtcattatcaagttatgaacaagtccataattcaagattataattatgtaaatcatcgtgagcatcctaaccacgatcctttcaagtgctcctctacctttcaggctccctcacattccttcttggtagtgactttcccaacattttaa

SEQ ID NO: 10829 - DNA, 369 bp, Glycine max
  Peptide Sequence Number=SeqID_127607
atgctgctgatcttcttgagtttcatgcaatatttgactctgatggttaagaagttcagggatgttatgggcaaaggagcaatgaagactgtgtatagggcatttgataagttactagggattgaagtggcttggaaccaagtcaagattggtgatgtctttcactcaccagagcaactccagtgcctttattcagaggttcatctccttaagcacctcaaccatgactctatgatgatcttctatggttcttggaagtatgtcaacaacagaaccttcaacttcgtcactgaattgttcatctccgacacccttagagagaattggcagaactacaaaagagttcatatccgagtagttaagaattga

SEQ ID NO: 10830 - DNA, 363 bp, Glycine max
  Peptide Sequence Number=SeqID_127608
atgcctcctcgcggccagcacatcctcaaagaatctcaatcatcaaccgctatacgcaccgccacacatttcctgagtcttcagtgcgtaacgtcaccactgcttaagtactccactgagcatcccatactactcgctatgggagtccttgaccgcatgggaggacacaagggtaaaattgcggcagaagatacaccgtccctcaacctaaaaaaggacctggaaaaaggcgttgccctcctatcatcaagcaaacctagaagtttgggtagcttcccaaaattggcttcaactcacattttagctaacctggatgagccaaattggctcactttgacagctcacaacctacctattagctag

SEQ ID NO: 10831 - DNA, 816 bp, Glycine max
  Peptide Sequence Number=SeqID_127609
atgcccgaagcaagtcaccttttaagtgtgcaagatgtgcctctggctccacttactgttgaggctcctactgttgctactcctgctccttcacctccttctgttgtaccttctcaggaagccactcctactatttttgttaatgtgctagccactttgcctggtcctgtcatgagaagtttggcgattctggaggaaaacgaacaacaacaccaagaggctttgcacaaggtgacatcatcggagggggaggtttccaaatggagggctattgcttgcactgattggagagtggagctcccaaatgtggctaatgccaccatcacctttgttgatgtcataaagttgaaccgccaactatcttcccaagttagaggtgtgttggccaaattactacgtatcacgttggatggtgatgaattattcaaacactacaaggatttgaaggaagataaaaaggacttggctagcaaggtggatgatgtcatgatagagaaggatgagcttgccaagaaggtggcgaatcttgaggctagactcaagaagttggagtccagggagaaggaagcccataaggagcttgaggaggagctgctcatatacaagaaagaggctgtggagcagcatgaaaagggcttcaacaaggtcttcaggctgatcgggttttttgccaagaaccttgacttgggtcactttgagactttcaaggatgtgaaggatgatgttctgtttgatgaggaggaaatagctactaaggaagaggctattgatgaggagcagggtgctaaggagcctggtgatgatgaccaagtttag

SEQ ID NO: 10832 - DNA, 999 bp, Glycine max
  Peptide Sequence Number=SeqID_127610
atggtggaaaatagacttaggtggtttgggcatgtagagagaagaccggtagactctgtagtgaggagagtagaccagatggagagaaggcaaacaattcgaggcagaggaagacccaaaaagactataagagaggttataaaaaaggatctcgaacttaatgatttggatagaagtatggcttctcatcaacagcaatcattgtatgggtttggatctgcttcaaactcctatggtagaggctacctgccgaaccagggctctagctttggaggcacttctatttccaatcttaatgataggaggtttgcttctcttgaaaatagcaggcggcaagggaggccaactgcttctctttgcaattgtaatggtactcttgatatccttagtgagcagaaccgaggaccaagggcctcgaagttgaaaaatcaaatttcagctgaaagtaattctgtggatggcagtaaaaatagtggatctactgctaagttccaaaatgaatcactcaattggtcagattttgccacagattacaaggatgccaaattttttgtcatcaaatcttacagtgaagataatgttcacaagagcattaaatatggtgtctgggctagtacaccaaatggaaacagaaagttagatgctgcatatctccaagcaatggagaagcaagatgcctgtcctatatttctttttttttcggtaaatgctagtgctcagttctgtggggtagctgaaatggttggacctgtcaattttgacaagagtgtggacttttggcagcaagacaagtggagtgggcagtttcccgtgaagtggcacataattaaagatgttccaaacagtcagtttcgtcacattgttcttgaaaataatgataacaagcctgtgaccaacagtcgagatactcaggaggtaggaatcattgggtctttcactgtctacgaatatatgaatcatgcttttagcagtttttactctagtttcctagcatgttag

SEQ ID NO: 10833 - DNA, 537 bp, Glycine max
  Peptide Sequence Number=SeqID_127611
atgggtgtttacaatgaaaacccatctcttattttccattctggttatggcttcaaccctcaaatgccttatggaccatattccccagttaccacacctttgccttctgtaggtggagacacacagttatactcccctcagcaatttccatacactgggccaccttattatcatcagctggttcctcctagcttaccatatcttaattcacctactccagtttcacagccagagctcaccagcctggtaggtattgaccaacaagttgataacatgttttttggaccaagagcgggctatccgtcagtgggatcttttggtagaggcaactttcctgtagcacctggttcctttggctttcatgaatcccaacaaggatttgaaggatcaagatctggtggaatctggtcagactgctcaaaaccatctgaaagacagagatctttgatgcctctatcgccatctgtttctccacagccaatgggctcacttgggtcatttgggccgagtgttggaatggtttgttctataacttga

SEQ ID NO: 10834 - DNA, 1186 bp, Glycine max
  Peptide Sequence Number=SeqID_127612
gaaaggattccttatcacagcgatagttactgctttggctggttttcttagtgcatttgctcctaactatatattattaattgccctccgttctctggttggtcttggtttgggaggtggccctgtattatcatcttggtttctagagtttgttcctgctcccaatagaggtacctggatggttgtcttttcagcattttggactcttggtacaatttttgaggcctcacttgcatggattgtgatgccaaaactgggttggagatggcttcttgcactgtcgtctcttccctcatctttccttcttctgttctacaaagtgactcctgagtcacctagatacctgtgcttgaaaggtagaacagctgatgcaattaatgttttggagaaaatagcaagagtaaatggaagagaacttccttccggtaaccttgtttctgaccatgaaattgagttacacaaaattgataacccttcagaggacacacgcttgctctcaccaagaacaaatgaagttgaacatcctaaaggaacagtctccaatttaggtggtatttcatcattgttagtgcttctctcaccaaaattggcaaggccaacccttctattatgggctgtgttctttggtaatgctttttcgtattatggccttgttttgttgaccactgagttgaacggacatagtaaatgcatgccagataaattgcagacagagaagtcccaggatgttaaatacaagagtgtttttattgctagttttgcagagctacctgggctcctcttgtcagctgcggcagtagataaactcggtcgtaaactctcaatgtcaaccatgttcttcatgtgctgtattttccttctcccattattattctatctgcctgaaggcctaacaacgagctttttatttctagctcgcatatgcatcacagcaaccttcacaattgtgtatatatatgcaccagagatgtacccaacatcagtcagaacaactggtgtgggaattgcaagttcggtgggcagaattggtggaatgatatgtcctttgatagctgtgggtttagtacatggatgtcatcaaactgcagccgtccttctgtttgagatcgtagctcttctttcaggaatatgtgtcatgttcttcccaattgagaccatgggccaagaactgcgagatagtgtgcaa

SEQ ID NO: 10835 - DNA, 1677 bp, Glycine max
  Peptide Sequence Number=SeqID_127613
atgaacgccgcaacagcagctaacagcagtgtttactcacagacacagtgcagaccactttcctcggatgttcgaggttcgattccttacttgaatgaacggaagtctcggttggtggtgagggctggtggcggtggtcgtcctcccaaggaggatggtgaaaagcaacagcaacaacaacaacaacctgtgtctcttaggcttgacgacgtgaaccctgtgggactgggtcgaaggtcgcggcagttatttgatgaggtttggagaaagttctcgggattgggtcagatttctggcactatccggtcggatgatcaggaggctttggatgcccttctggtccgcgaaggtccgatgtgcgagttcgcaatccctggcgctcagaacactactgtactcgttgttggtgccaccagccgcatcggtcgcatcgtcgtgagaaagctcatgctcaggggctacgctgtcaaggctttggtgaggagggcagatcaggaggttgtagagctccttccaaggtcagtagagatagtcattggggatgttggtgatcccgccactgtcaaggctgctgttgaaggttgcaacaaaattatatactgtgccactgctcgctctgctattactggggatctcttcagggttgatcatcgaggagtttctaatctaactaaagcttttcaggatcacaataataaattggcccaatcgcgtgctgggaaaagcagcaaaagtaagctcttgattgccaaattcaaatctgcttcttcactcaatggatggcaagttcgtcaaggaacttacttccaagatgtagttgccacaaaatatgatggaggaatggatgctaaatttgagttcaatgagaatggagatgctgttttctcagtatcggttgcggccgcattgcggttgttgatatcgcggataaatgcagtcgatgcagtcccaattgtggtcacaaacaggtatgtcttcaacagaggaggctatgtggaactatcaaaaaagctttctctgccactaggttatactcttgataggaaattctatcatgcattcaagcataatgagttcatctgtaatgataggtatgagggtttggttctttctgttggtggcaatggaaggtcttatgtattaattctagaagctggtccttcggcagatccaagtcagagtagattgtattttgcaagaattagtacaaaagtgggattttgtagggttagagtaccattttcatcattccgcccagtgaaaccagatgatccagtgttagatccttttcttgtacatactttgaaaatacgctttgagcctagaagacagtgcctacatcctaagctgactgctaggtattacggtccctacttggtgctgataaaggttgagcgagctgtgggtcaacaacatctagtggaggcagaactacagcaggagttacagctagatcctattatttacttgccagctaaggtttttgctgagagtgtggtcatgcagaaggatgagcagatacctcaagactatttccctgaggacaaggttatagttggggaggaggcattactagagaaattggccgagatgagagagacccaacctaggaaaaggagtggaaggaatgctgcacctgtggacaagaattatgctttgttgttatggattaactga

SEQ ID NO: 10836 - DNA, 147 bp, Glycine max
  Peptide Sequence Number=SeqID_127614
atggctcttcactttcgtgcggtagctgtggctaatggaacttgctctatgcagtttagctgcttgggatgggtctggtttgcctgcactggtatctccttgtatgcaattggaggtttgtataaaccaagatgctggtttcggtag

SEQ ID NO: 10837 - DNA, 507 bp, Glycine max
  Peptide Sequence Number=SeqID_127615
atgggttgtcgtatcttgggagaggagcgcaatcaaattttcctaccagtgcagtggggcgttttctctctaaggatagcgtttacgcgcttcaacccaggctatatctttctttctctaatttattttttccttgtgcttattaggcctgttgaaggaaatgcaacaatgaaacaggatttaagaagctttaagcttatattggaatatattaaagtcttgcctactgggcaagaaaccgattttgtattagtttcatgttctggactaggaattgagccttccaggcgggagcaggttcttaaagccaagagggctggtgaagattctctaagaagatctggccttggatacacaatagttcgtcctggtccattgcagtggaccaaaaaatgtcttagggaggcaaattggcgtgtcaacatcattgatgacagaagcctctatggcttacattgtatccataactgctataatattcacattctcatgctattatcaacataa

SEQ ID NO: 10838 - DNA, 1026 bp, Glycine max
  Peptide Sequence Number=SeqID_127616
atgacacccagtgcagatactgatgagtcagaagtattaagtctaaggagaaatcttaaggaagaatatttgacctacgaagccaaggagagagttaaagagttgtttgatgccattgaaaagttacgaactcaatttaagtctattgagagaccaattcttgaaatagagatccctgcaaaagttgaaacaccacctttggagaaaaagtttgatgctactctttcagtttatgttccacctcaaggtgttgcagctcaagcgaaattagctaagctggaatatgagtttgggaaggttagtaaggattattcagcagaggaaattggtgattgggaatttgatgagctcctacttcttcccatggcatatcccttctcagatttcaagtactcatcagatggcctcactatagtgggtatctccttctgcacaactattgtctgtgaggctatctcatggacagacaacaataaaatcaacatcaagaagtccaagaccataaaaattgaccgtgttgagacaagcctcaaagaatcgagtcgcgacttgtctctcttcaagttcaagtctgggggtgtggtggctctagttctctttgtggtctttgggttgctgaattcactctacgaaggcaaggggaagcctgtgaatgttgatgctaacgaagatgcggccagaggtagcctctttgacggcggcgatagagaagttagagatgggggcaggcaagggattgggtggaggagacgagggaagggatttctcaacaacccactacccccaaattcacactataatccggcatatgagaattggttactctcccacaccaccgagtccgaggatgctaatgcgaataacggcaacagtaacgacgttgccgttccagttccggaaacgttaacgcaagacatcgaatcccaaaacgatgccgtggaagacgcgccaaagcagcaaaacgtcaacgctgacccagtcttacctgaacctgaagttatttccctggatattcgaaaaggttag

SEQ ID NO: 10839 - DNA, 996 bp, Glycine max
  Peptide Sequence Number=SeqID_127617
atgcaaatggaagagctgaaggtcggtggtggcatgagggtggctggagagtgtcggcagcccccaaagaggacacaactaaggtgggctatagggatgaccacaattaaggcgactttccaacactccacctcatgcccaagactactagcctggagcatgactaccgtggatattttggagtacctctggtgttacgaagcagaactaaagcgtgaagagagagaaagacatcctattaaccagagggagaaacatactctttatcctgttgaaattactgatgttccttctgatacaaaggacaaagatgatattcttgagagcgaattctttgacactagacaggcatttctgagtctctgccagggaaatcattaccagtatgatacactaagacgggccaagcattcctcaatgatggttctctatcatcttcataatccaacggctccagcatttgtgacaacttgcaatatatgttatcttgacatagaaactggtcaaggatggcgctgtgaggtttgccctgagtatgatgtatgcaatgcttgttatcaaaaggatggaggtattgatcatcctcataagttgacaaatcatccatccatggtggatcgtgatgctcagaacaaagaagcaaggcagcatcgagtatcgcagctacggaaaatgcttgatctccttgttcatgcatcccaatgtcgttctgcacattgccaatatcccaattgtcgcaaggtgaagggacttttccgccatggaatgcactgcaaaacacgagcttctggaggttgtgttctttgcaagaaaatgtggtatttgcttcaacttcatgctcgtgcttgcaaagaatctgaatgccatgtaccacgttgcagagatttaaaagaacatctaaggagacttcagcaacagtctgattcacggcgtagagctgctgtaatggaaatgatgaggcagagagccgcagaagttgctaacaatgctggatga

SEQ ID NO: 10840 - DNA, 390 bp, Glycine max
  Peptide Sequence Number=SeqID_127618
atgtgttgtggacttgtacgtaaaggcttgttggttattggttgcagttctgtaatcacgatccatggatggagttccaaagtgatcaagaatgctctgggaagtagaattgacgtggcagggaggaaccatggtgtttcaaatgatggtaatcctagaaaaatcaacgaatgtggtaaacttgaccctgcaagaaagattaatgaaaaaattaagggagatgagggaggaccaaggcccaaagaaaatgaggaagatggtgagaaaggatacaaagcaataagtggtgttattcccttcaatgtgacaaagagtgaagaatttgacaagaagtttgaattggttgctcaacatggattaggatttaagccatcatcctacatggattag

SEQ ID NO: 10841 - DNA, 351 bp, Glycine max
  Peptide Sequence Number=SeqID_127619
atggttaaggctcgaagaatggaggataagaacagagttttagggatattacccttgagtaatagccaggggtataatttgcagaaacccagttatttgggatccagtggatggcaaggtagaagaatcttccataatttgtcatccgcggaagtaaatgagaaaatgaggaaaggagaatgtttcacctgtgaagaaaagtataatcccgctcgcgtgtgtaagaataaacagttcagattgatgattatggaagaagaggatgaaggggagacccttgcttatgaaatgcaggctgttttcctcaacttgaccttgaggacaaggtccatcttgaatggggggtattga

SEQ ID NO: 10842 - DNA, 2943 bp, Glycine max
  Peptide Sequence Number=SeqID_127620
atgaaactgcaggcacatattccgggggagatgtcaggacaggtacctaatcaagcagggtctcaattgtctggtctgacccaactgaatgggaatgcactcactcatcagatgccacctttagggggtgtaccgcgttcaacaattaatatggatcctgaatttcttagagctcgcacttttattcaagagaagatctttgatatgttgttgcaacgacaacagctgccagttacagatgtacagagaaggaagcttaaggatcttgcaaaccgcttggaggagggcatgttaaaagctgctctctctaaggaggattacatgaacttggatacactggagagtcgtttatctaatttcctccgacgagcatctatgaataatcacaaccaacaatatccgcagcgtgttaactcttctccaattggtacaatgataccaacccctggtatgtcacatgttccaaattcaagcatgatggttgcatcttctatggatgcctctgtgatttctgccagtgggcgtaatagcatagcatcaacatctttcaatagtgtaaacatgttaccagctggtggtatgcttggcagtaccttaaatagatttgatggtttgtctaatggctatcagcagtcttctaccagcttttctgctgcctcaggggggaacatttcatcaatgggggtgcagagaattgctagccagatgattcccactcctggattcacagtcagcagtaatcactcacacatgaatatagattctaataatactaatggtggtgccttttccagtgtagagtctactatggtaccactgtcacagctacagcagcagaagcagcatgttggtggccaaaatagtcatgtattgcagaacctcagtggccaaatgggtagtggaatgagatctggtttactacagaagccatttgcaaactcaaatggtgctataagtagtggatcaggcttgattggaaataatatacagcttacaaatgaacctggcacttcttctgacagctatgcctcaacttatgctaattcccctaaacacttgcagcagcccttcgatcaaaaacagaaaccagtagtgcagggtgatggatatggaatgaataatgttgacaattttgcttctggaaacttttatacatctgcgacatcctctgggtctatgatgaacaatcagaacactaattcagttaaattaccatcaatgcccaaaattagctcattgatgaatagtcactcaaatttgcacggtatgcagcaggctgctcatataaagtcccaaccaactaaccagctagaaaagttgaattttcagtcttcattgacttcaagagatggccttctgcattctcaacagcagtatcagcaaaggcctcaacaattgcagcagccagatcagtatgcacaacagcaatttcaatctatgcaaagtcaacagcctccacatgtgatcaacagtgacacattcagtcagtctctgctatcttccaatctagaaaaccgagtgaagcctgaacctggaattgaacatcataaagaagtgcctaattctcatgtctctgaacagtttcacatatctgagatgcagagtcagttccatcagaactcatctgaagattgctctaggggtgctcaatatcttccattcccatctggtcaccatgatttattgtcatcaacacctcaaatttcacaacaaatgttgcaccagcatcaattggttgcagagtctcaaaataatttcaacaaatctgtaattctaaaccaatggcctcaatcacaagattgtaaccacatacctgacagtatttcacatgatcaacatctccacatggattttcatcaaagaatatctgggcaagatgaagctcaatgcaataatttatcgtcagatggatctattattggtcgagctgttctttctagaggctcagctgagcaactggactctggaaatgctataaaaaaggcgcacaggaatcaacagaggtggcttttatttctacttcatgcacgacggtgttctgcccctgaaggacgatgcaaagaacgcttttgttctaatgcacagaagttatgcaagcacttagatagatgcaccctgcgccattgccaatatcctcgttgccatcataccagggtgttgcttcatcatttcataaactgcaaggatccatgttgccctgtttgtgtttttgtgagaaagtatcgacgtgcatttcaactcaagcctcagattcagccggaacctgaatccagcttgccaactgcagtgaatggatcctgtaaaccttacaatattgtaggcacatcgcctagattgatctcgaagcctccattagttgttgaaacttccgaggacttgcacccatctataaaacgtataaagattgagcattgtgcccagcctattaatcctgaaaatgaccattctgcttcatcttttacagaaaattgtgaatctgttgtttccagggatgctcagtctcaaccccaagcttatcccaatattgagaagtctatctcaatcgaatctgagcttacagaagttaaggctgaagctcctgcacatgtggtacatgaaaaattaagtgagatgaaaatggataacaataatgcagatgataaaatgcctattgctgaacctgtcaaatatgatgaacctgctaatttagctaggcctgaaaatataaaaactgagaaagaaactggacaagacaggaaagaaaatgttgtgcagacatctgaaaatgcagctggaaccaagtctggcaagccaaaaataaaaggagtctcattaactgaattatttactccagagcaagtcagggaacatatcactggcctcaggcaatgggttggccaggcatgtaattcttcagtgacctcaggttttattgcacgtcctttactcaaaggacagcagtaa

SEQ ID NO: 10843 - DNA, 279 bp, Glycine max
  Peptide Sequence Number=SeqID_127621
atgggttatgacgaacctaaaacggtgaacaatcgagtgcaaaccaagcacgagttcgatatcgcaatttggaattggaaaggaacccccaaattatcgacgaccacgccgacgaagattcacgatgcttcagccgtggagaaagagaaaggaataagcactaaagaagtgtttgagagccttcacgatgacctagaaggcacatacacggtagttggtggtgttgaaggtgaggttgctcttttggatccacaaagatcaaagcagatggtggactga

SEQ ID NO: 10844 - DNA, 345 bp, Glycine max
  Peptide Sequence Number=SeqID_127622
atgaggaatgagagattccctgaacaaaggaagtccaaacttcaacatagaggagatagacctttccaagtactagagatgatcagtgacaatgcttacaagatagatattccaagtggtgattctgaagattttaggacaaatgctttccaagaagcagggaatggtgagaatcccaaagctatccaaatacaaggacctatgaccaggagtaggaccaaactgttagaagataccctccaacaaatagtatcagtcatacttgacaagacccaagtggagaaggatgaaggcctaaaagcactatcaagaatcatcttgattattgttaaaggcccaaactaa

SEQ ID NO: 10845 - DNA, 303 bp, Glycine max
  Peptide Sequence Number=SeqID_127623
atgttgacgagacagaacacatgcacaccatgtagaatagcaacgaaaaacttaaggaagaagcgagagcgcaccaacaaagccgctggaagtgtccagacaaagaggggactctctttcagaaaccaaaatgggatggagaacgggggttctatcattccttccctcttttcttttcttttcttccactaccgcaacaagcaccattctcccattctctctcctttgccgtcgacatggaagatgaagagggtcatggacaaggaagccaaagacgccaataatgacgttcttgtcacgtaa

SEQ ID NO: 10846 - DNA, 270 bp, Glycine max
  Peptide Sequence Number=SeqID_127624
atgaacagatgtttggctgctggaaacttgagagagcaaagtgcacagagtgagaaacaggcatatgcggcttcacgatgcaaaaacaagggtgaagtagtggcaatcttctgtagcaaggggtgggctatgcaatttccttgtttttatgagaagaagcctgctaatcctaaaatgcctcactgcatggatgggtataggacaccaaaaatcctcttaacgagtaatagggatgggcaaagaagatatttcaaatttttcaatatctag

SEQ ID NO: 10847 - DNA, 189 bp, Glycine max
  Peptide Sequence Number=SeqID_127625
atgcctgatcttccattccaagttggggatttggctgagtcaagatgctttgaaaaggtggttatcttggtgcttggtttagatgcaagtgatagcaagaggtatggttgggaaagcagtacttattctttctttttaacacaacagattctgattgttcagacttcagtgactattcctttgcattga

SEQ ID NO: 10848 - DNA, 168 bp, Glycine max
  Peptide Sequence Number=SeqID_127626
atggaatactatgatgatagtgtctttttagccttggcaatagtagtggctagactgttgcggtggctatgggcatgctgtttcatcttgctgaaaggtagtccctacaaatctagcgatctaggtggctttgccgccaccaatgacagaggcaaaaatggagcatga

SEQ ID NO: 10849 - DNA, 570 bp, Glycine max
  Peptide Sequence Number=SeqID_127627
atgtgttcttttgatgctgatcgccttcaaaaggtcttgcaatgcgtgaatgaggtgcattctctttgtagtgtgcttgggttggattttggtcaaaccgtgggtgatgttcacccaagtttgcatgggactcaggtggaacaatcgactaatattagcaatagcacattggaaggtctagagcaggccattctcaagttaaaaatagaaagaaaaactagaatttcagaagcctcagaatcagaaatcactgaacggggtattctttcaatagaaatgatagagaaggcttcagcagaagtggacaggcttgccaaactaaaagcaagcagaatgaaagaacttgtttttaagaagaggtcagagttagaggaaatatgtagattgactcatattgaaccagatccaagtactgtggccgagaaagctagtgcattaatagattctggactagtggatccttctgagctattagccaaaatcaaagaacagataattaaggcagaagatgaagttttgagtagaaaagaagtaacagataggattgataagtgggtttgctgcatgtga

SEQ ID NO: 10850 - DNA, 354 bp, Glycine max
  Peptide Sequence Number=SeqID_127628
atgggccccgacgggtgcagagaaacgcgagaaactgaaaccagagaagtggcacgcaaactgaggcaggattttagcattcaaaagccacattctctctcttcactcaacagattttcagaagctttttcctcatctcccacgttgtttttcttctccctttctcctccaccattgttccccattaaagctccaaactttgctcatcatttctactccaaattgcaaagggaagccattttcggagttgtgaagcgcacctctacgttgtcggacttcgaatttcaggtttgggtggacttcttctcacatgaatttcgtgggtattgggtttttgggagatatgatgggtag

SEQ ID NO: 10851 - DNA, 443 bp, Glycine max
  Peptide Sequence Number=SeqID_127629
gagatgctgttggcggcggtgccggcgctgggcttcgccatggtgttcaacgtgccgctgcgcgcgctgcgctattgcgcgttgctcggagctatcgggcgcggctcgcgcatgctgatgatgcatggcggcatgaacatcgagtgggcctcgctgctggcggcgatcctgatcggtatcatcggcatctactggtcgcgctggctactggcgcacccgaaggtgttcaccgtggcggcggtgatcccgatgttccccggcatttccgcctataccgcgatgataacggtggtggagatctcgcatctgggctacagcgaagccctgatggagaccatgatcaccaacttcctcaaggccagttttatcgttggcgcattgtcgatcggcctgtcgttgccgggcctgtggctgtaccgcaaacgccccagcgtgtgaaatga

SEQ ID NO: 10852 - DNA, 531 bp, Glycine max
  Peptide Sequence Number=SeqID_127630
atgattatcagcctgatcgctgccttggcggcggatcgcgttattggcatggaaaacgccatgccgtggcacctgccggcggaccttgcgtggtttaaacgcaacacgttgaataagccggttattatgggccgcaagaccttcgagtccatcggccgcccgctgccgggccgccacaatatcgttttgagcagccgcccgggcaatgccgccggggtgacctgggtgacctcgctggatgaagcgctggccgccgcgggcgaggtggaagaagtgatggtgatcggcggtgggcgcatctatacccagctgctgccgcgcgccgatcgcctgtacctgacgcacatcgacgccgaagtcggcggtgatacccacttcccggattacgagccggacgagtgggaaaccaccgccgctgatttaagcgcgttagccactctcccccggggcgggcacccgttgctgcagaccgccgccgatcctagcgggcgcaaggtgctgggcactttcggcaactgcgccaacggctag

SEQ ID NO: 10853 - DNA, 174 bp, Glycine max
  Peptide Sequence Number=SeqID_127631
atggcagggacaggatcactttcagtgatggtcaaataccgcgccaaatccaagacagagatgaaccgaggtgctcggaaacgggtacgagtagacgctaggcccttgatcagcagatcgtcgtcccacatccggctccggatgatcaagaagcactactgggaggcaacctag

SEQ ID NO: 10854 - DNA, 426 bp, Glycine max
  Peptide Sequence Number=SeqID_127632
atgaagtttgatggttcacgtattatgcatgaacatgtcattgagatgaaaaacattgtagcaagaattaaaaccttaggaatagctgtgaatgagaacttccttgttcagtttattctgaactcattaccgtccgggtatgacccattccaaatgtgctataataccatgaaagataaatggaatatgcatcaatggcacaggattcaaggagctagaaagaaatttgtgaagaagcatgataaaggcaaatggccattaaagatcaatgacagtcctatacaaatccagaataagacatcaaagagcaataattgtcatttctatgggaaatctggacacttccagaagaattttccaaaatggattccttataatccaaaccataagcccaagagaacttcgtcttcatggggaatagagtga

SEQ ID NO: 10855 - DNA, 225 bp, Glycine max
  Peptide Sequence Number=SeqID_127633
atggctgagaagacaaagaaaagactggaagaagctgcccagtctggaagcactaagggcatcattgaccctccatctcccatcagatgccacgtgaaatggaagatggctcgcacgaagaaaactggacagatgacgtttgaggcagcaaaggaaatagctgacaaaattgattctttggacgagcaagcgtcacaaggatcgttcgtcccctatggacgctag

SEQ ID NO: 10856 - DNA, 780 bp, Glycine max
  Peptide Sequence Number=SeqID_127634
atgctcgactgcgcctctggaaagcccgtccctgtgacgggctttctgcgttatgggcctgggggtcagatcccttttccatgggaaaaggatctggccccgaaacagcggacgccgatgtcggcaaacgtcatctgcacggcggatcggaagggggatccgctggctcgccggacttcgaacctcgccaatgcaagccagcccagggttcgggccggtgcttctgccgattccggcattcacaccacaagaaagggaaatacgatgtcccaggtaacgcaaccgcgtgtgcgtcgagtgtgggtggtccttggtgcgtccgttctgtcatcgctgctgctggccacgcctgcgctggccggtgatgtccagctcagcggcctgcagtccgcgccgacgcaccagcgcttcatcgtgaagtaccgtgacggtagtgcgccggtggccaacaccaccgcactggcctcttcgctgaagagtgccgccgccggcctggccagcagccagggccgtgcgctgggcctgcaggaggtccgcaagctggccgtcggcccgaccctggtcaggaccgatcgtccgctggaccaggccgaatccgagctgctgatgcgcaagctcgccgccgacccgaacgtggaatacgtcgaagtcgaccagatcatgcgtgcgacgctgaccccgaacgacacccgcttcagcgaacagtggggcttcggtacctccaacgcgtcgatcaacgtgcagccggcctgggacaaggccaccggcaccggcgtggtg

SEQ ID NO: 10857 - DNA, 150 bp, Glycine max
  Peptide Sequence Number=SeqID_127635
atggagagaaacttggtgtttgttacacgtgatgatgttttgcattggactcactctgttacgtatgatattggttttgtgatggtgattatgaggtcagacacagatactgaaaagagagaaatgacctcatgttttaattggttgtga

SEQ ID NO: 10858 - DNA, 558 bp, Glycine max
  Peptide Sequence Number=SeqID_127636
atggaaatgttaactaaaaacaacttgccaagtgctaaggaattccttcgtggaaagtatcttatggataaagaatatcccggcagaatgaccatttatgcagaaagtcgaagtggtgatagtctagaaaccagcggctcagagctatccgacgaggagaataaaaatctaagatgtgtactatctgaaagtgataagtcgttgttggtagagttaggcgagcactccattgagtgcctactggttcacaccctaggccatctgtttaatctggaaaatattgtcagtcttgctagtttggttgatcgtatagaacgcaatgtaagggattatgcctcatcgtcaacattgtattataatagtagggtatgtaatctaagtatggatgctgctgataaaggagcctctttagtatatgccgaatgcttgtttaaccccgcattacttcctataaagttaaacctacctatggtatttccacctaaagattgggagccccacaaacctgaacagaaaccaaccctacgggccaaatctacagcactcaacggagtatga

SEQ ID NO: 10859 - DNA, 279 bp, Glycine max
  Peptide Sequence Number=SeqID_127637
atgggtttctcttggctatatggttcatccgggggagagatcgagcttcaagaaatagtgaacggtcttatcaatacacaaatgtataactccccaggaattttaattgcacttttattcatcactgtaggaattgggttcaagctttccccagccccttctcatcaatggactcctgacgtatacgaaggagtgcgatgctacatagttggttctcatccttcagagactacgagtataataggagcatccgtcaacaaaaggatcaccctaagatga

SEQ ID NO: 10860 - DNA, 210 bp, Glycine max
  Peptide Sequence Number=SeqID_127638
atgatttcttgtttagtcaggcctcgttacaagtcaataaaagttcttagtgatccgccaagtgtaagtcgtagaatttcaaacactcaccccagacacttgtgcgcaaagagaaacactaaccttgtgaggaaagtgaggcaagtcaacttgattaatttccggatactaactattttcatctcgatgttgtttgtgcttccattgtga

SEQ ID NO: 10861 - DNA, 572 bp, Glycine max
  Peptide Sequence Number=SeqID_127639
atggcccgcacgaagaagacaggggagatgacgactgaggccgcaaaggaaatcgctgagaagattgtaagtcatgttcaactaaccattacaattatgtttgaatattttgagaatgccatgtaccactgtgtgttttctgtgcaagattcgtttgaggagcaggccacacagggatcgttcgtcccccatggacgtcaggatgttctggccgctgctattggacgtccagagcaccctggacgtgtctgtgctgctggagccggtgtcaccaacaagcaatactttggatcggctccacggacatcccgcagcgcttcctccctgcctcctgacgaattacagcagctgacccagcagatcagggaccagctagaggagtccatcacagagaaagtgacgaggcatgtcatggcatccttcagccaccttcagtcgcagatgcaatctcagggagttgcagtgcctcctgagcctgtggttggtcctggtccctccggtcctcgagtgagcacaaaggggagttgtgttgatccctcaggaaacgatcctgagaccggtgactctgacag

SEQ ID NO: 10862 - DNA, 180 bp, Glycine max
  Peptide Sequence Number=SeqID_127640
atgtcggcagaaaaatatcagtcgcggctttacaacggccgatgtcggctattgaaatgttcgatcggcgtcatccgtgatgagaatcatgaaacaggccaaatacagtctaaaggcccaagtggagaaggacgaaggcccaagtggagaaggacaaagcccccgagtggagaaggatga

SEQ ID NO: 10863 - DNA, 255 bp, Glycine max
  Peptide Sequence Number=SeqID_127641
atgtcggatagagttgctctgaggtggcctccattagacctcaggaagaagaaacgcaaggttcctcctagtctcgtgtccacatccgagtatgacaaggaagacatctccaattatattatgtgcatggtgcaaatcttgcgtccaacaaagatttatagattcaatgattggcatatatgcttcctgaggcaagagggagaaaacgagttcaacatttttctaaagataaacgaagtttctcgtacatattga

SEQ ID NO: 10864 - DNA, 840 bp, Glycine max
  Peptide Sequence Number=SeqID_127642
aatttccattgcgcccttcaagactgtgaccacgctttggaactcgacgccacacattcgaagacccttttgtgcaaaggtaagatcttgctctgcctcaatcgctattcttccgctctcgagtgtttcagaagcgccgcgatcgatgggaacgctgaaaacgcaagtgggtacttggaaagatgcaaaagtttggagcttttgtcgaaaacggggtgtttggatctttcagattgggtttcaaatgggttcaaagggaaggttccggagctcgctgaacacattggtgctgtggagattagaaagtctgagatcagtgggagagggttgtttgcaacgaagaatattgatgccggggctttgattttggtcaccaaggcaattgcaatggagaggagcatcataatgggaggggttcaggatctttgtgaggatgcacagttggcaatgtggaagaatttcattgacaaggtttttgaggttgttgggaagtgttacaagacaaagggtttgattactaggttgtcttgtggggagaatgaggatgagcttgaggtgcttgatgtaggtctctttaggcctgagagtgtggagaaggatgatggtgatgcagttgttggggttgatatggttaagttggttgggatattggatgtgaattctctcactgaggatgctgtttcagccaatgtgttgacgagggggaatgattgttatggtgtagggttgtggctgttgccttcctttgtgaaccactcttgtgttcccaatgcgaggaggttgcatgttggggactacttggtggttcatgcttccaaggatttgaaggctggtgaggag

SEQ ID NO: 10865 - DNA, 240 bp, Glycine max
  Peptide Sequence Number=SeqID_127643
atgctccaaccatatgggatcaacataggcttaaaggagcactcaaaccgggtgacccccaaggcctacacgctgaagagtccatcagggtctctccctcctgattcagtttacaactcaatgcacacaacatctcaatactcacaacatctcaatcacgtgcatactcagtttatcacatacactcaatctcaattacaatggtataatctcaaaatagcatgtcatcacacctcatga

SEQ ID NO: 10866 - DNA, 234 bp, Glycine max
  Peptide Sequence Number=SeqID_127644
atgagaggccccctcaatgagtcaatctcttgctttcttataagattggaccccttgagggctacacgtcctcgcctccacgagggttgtacgtccttgcctccagagggttacacgtcctcacttccagagggctgcatgtcatcgcattcagagggctgcacgtcatcaccttcagagggctacacgtcatcgccttcagaaaactcaaggtcctctgccattattgcttaa

SEQ ID NO: 10867 - DNA, 294 bp, Glycine max
  Peptide Sequence Number=SeqID_127645
atggaatcagctatggaggagtcgattaacaaaacacaactctctcccaaaataatcccaacgtcatcatgtcgacttggcgactccagaaaagaatctcgcttctcgtactctactgttgtcattctgttcccacgaaccaaggtgaaagtgttaccggttggtggtcattgttgcggtggttggttcgtcatcggaggtacaccagaagcaagatattttgatgttttgatgatgccaaaggatcaagtgcttctcaagttttattcaagacaagaatccaagaatccatga

SEQ ID NO: 10868 - DNA, 213 bp, Glycine max
  Peptide Sequence Number=SeqID_127646
atggcaacaactaacggaagagggaatgcacctttaccacagggcaatggaaagaatccacgtaaaacaaagcggtggcctatgcccaaaaaaagagggagagagatctctcgtcaggtcttgggtagtttgctggaggtatggggtggaggaggagagcgtgtatgcgggcttcttatactggattactttactgacattgaaaaccggtag

SEQ ID NO: 10869 - DNA, 807 bp, Glycine max
  Peptide Sequence Number=SeqID_127647
atggcggaaccatcaaagaagcgcaagggatcttcgagtcgaagccaacgacattccaaggctcaagaaatgcagattccctcctccatttcctcttcctcattgttctcaatagaagaacaacggatacagtacaaaaatcttttctcttctcattccattatcgatccaaaattcattgacatggatttcttttccaatgagagttttgaatgcattcaggcatttgagaactccaatctcattcttttcatgtctttaaaattgtctttttattctgaattagttaaagccttctattctaacctcgaaattcaagaaaacactttgatttctgaggtttatgggataaaaatggtcattgaccaatccctattctatgacttgacccaattatctagtgaaggtgtaccatttgaaggtacactaaatgatgattggaaatttgatttctctgtgcatgatgcccgccggttggtttgcaccaaccaaacggatatgaccggaaggcttcttgctggttctttggcttttgaaagtcgcatccttcgttatctcattgtgcgtattttgctttcaagatcttcaaaccttgcacaggcatcgcgattaaatgctccattgccatatccacacctaataactctcttccttcaacactttaatatccctcttgattctgaaccttatgttccaatcaagagatccttcttaatcggtgtcattgtgatttcatcttttggttaccgtaaagagcatgatggctcttgggtaaaaaagggtgctcaacccattgatgaagaatga

SEQ ID NO: 10870 - DNA, 967 bp, Glycine max
  Peptide Sequence Number=SeqID_127648
accttcggcgattcccgtgcgcgcgtgggcggccacgctcaccgcgtcttcggccgcgagcgggccgtgcctgacgtatccgccgctgtccgaggcgctgaaccggatgccgcttacccggccgacgacggcgtggagcgaggagggtgacgccctgttcgtctcacccgacggcaagctgatgccggtggccctggcggcggccaaccagaccaagaaaaccagcatcgtggccggcgaatccggcggcggtaaatcggtactcatcaaccgtcagccgatcattctggccatgtcagcgcagaagcagctgccgttctactccggcatcgacaagggattcagctcgcagggaatggtgtcgatactgcgcacggcgctgccgccggagcgtcaggacgaggtgctgagcatcgtcctgcgtaacgatccggagtactgccgcaacctgtttgatatccagctggggctgcagaagccgctcagctacgaagccgagtttattgagaatgcgctgacggcgctgtgcattgaccccggcaccggcgaaccgcctaacggacgcgatacgcccatcatcctgcggcggctggtgagcgattcattcaaggcctcccgggaggagccgcgccgctacgagccggggctggtgccggttgtcgacgcggcgctgcaggaggccgctgtctgggagaagcatcccgaatatcaggacaatgcgacctggtatgaggtacgcgacctgctgcaggacgcgggcaggacggacgcggcgcagcgggcgcagttccaggcggtgccggagctggccgacatggccccccgcctgctcagcgaggattaccggagcatgtacggcaatatcgagcgcgacagcagcagcgagccgctgatcgaatacattgcccgctgcctgcgcgacgcctgcgggcagtaccgcatgttcgccggcgcacgcgctttatga

SEQ ID NO: 10871 - DNA, 622 bp, Glycine max
  Peptide Sequence Number=SeqID_127649
gcatggttaagtgatcctactcacattaggcctagtgctcagatttggagagcatctggaataactagtgaattacaactctattgtaccgcaattggtgcattggtctttgcagccttaatgctttttgctggttggtttcattatcacaaagctgctccaaaattggcttggttccaagatgtagaatctatgttgaatcaccatttgacagggctcctggggttgggatctctttcttgggcaggacatcaaatacatgtatctttaccaattaaccaatttctaaatgctgcagtagatcccaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggaggtctatggctgaccgatattatacaccatcatttagctattgcaattcttttcttgatagcgggtcacatgtataggactaactggggtattggtcacagtataaaagacattttagaggcacataaaggtccatttacgggccagggtcataaag

SEQ ID NO: 10872 - DNA, 394 bp, Glycine max
  Peptide Sequence Number=SeqID_127650
atgtcatcggacttgccgtctctagatgacaaaggtgcagatgacgatgtgcggataaccataagttatctctgcatgtcatcagactcgctgtctttggatgacaaaggtgcagatggcgacgtgcggataaccataaggtatctctgcatgtcatcggactcgccgtctctggatgacaaaggtgcagatgatgatgtgtggataaccataaggtatctctgcatgtcatcggactcgccgtctctggatgacaaaggtgcagatgacgacgtgcggataaccataaggtatctccgcatgtcatcagactcgccatctttagatgacaaaggtatagatgacgatgttagtcattgcatgctatcggaccctcgagtcacgatagcagaag

SEQ ID NO: 10873 - DNA, 615 bp, Glycine max
  Peptide Sequence Number=SeqID_127651
atggctaccattgcattatcaagtagatatgggaccaagttagcatatgacactggaatttgggggatggcctttgtggataattgggtggtgggtaaggagaagggttgttattggctaagtaatgacattgttggacccactttgatcttttcaccggtgaagaccaaatccgcaaagcttgaaggctcctccaaagtgatttgcaggggtataccaccaactgcttgtccgtcagtggcatatccgaggcaaggctcgaagttggctagattgtgtatgggagcggagttattaacaccctcactgggagtgtatgccatattgggtggtgtacagttgggaggcaagccatatggtgggaaggcatgcttgtttttcgcactaaatgagggccgcccgtccacctcaacaatggtgctggtagcggctattgcaaccgctttgacctctattatctcctttatgctcatcatggcttccatcattgtggccattttctccttcaaggcctccatgtcggccttcatctgctcttgtagctccgctacttcacacattactctaatttgtctctgcgtgccatcgaacacgattgtgtcgggatggcaaaag

SEQ ID NO: 10874 - DNA, 243 bp, Glycine max
  Peptide Sequence Number=SeqID_127652
atgaattcgacagacacaatcgcactatttattataacagagactcaatccccacttgaaacacccagaccacctgaaaggctaaacatttaccgtgttctcacgtcatggctgcctgataaatctatcaatgttgatcctatgacctatgtgccgatgttattcactttacaacacatcttgcacatctatgacaactcctttgattttattgccacacgaatcaatgtggcaagaatatga

SEQ ID NO: 10875 - DNA, 867 bp, Glycine max
  Peptide Sequence Number=SeqID_127653
atgattggtacctcaaagccttacactggggcaatgagggtacctatcttcttcagagggctacatgtcctcgccattagaggattacaagtcctcaccttcagaggattacaagtcctcaccttcagaggactgcacgtcctcgccttcagaggactgcacgtcctcgccttcagaggactgcacgtcctcgccttcagaggactgcacgtcctcgccatcagaaggctgcacgtcctcgccatcagagggctgcacgtcctgaccttcagaggactacacgtcctcaccttcagaggactgcacgactacacgtcctcacctccagaggactacatgtcctcgcctttagaggactacacgtcctcgccttcagagggctacacgccttcgcctttagaggactacatgtcctcgcctttaaaggactacacgtcctcgccttcagagggccacacgccctcgcattcagaggactacacgtccttgccatcagaggactacacgtcgccaccttcagggggctacacgtcctcgccttcaaagggctgcatgccctcacctttagaagactacctttcctcgccttcaaagggatacacgccgtcatcttcaaaggggctacatgccctcaccttcaaagggctacacgccctcatcttcaaagggctacacgccctcatcttcaaagggctacacgccctcaccttcagaggactacacgtcccctttttcagaaggctacacgctctcgcctttagagggcgacacgtcctcaccttcggagggttgcgctctccctcgccttttgagggctacgtgtcctcactttcagtggctccatatccacaccttaagaggatttaa

SEQ ID NO: 10876 - DNA, 561 bp, Glycine max
  Peptide Sequence Number=SeqID_127654
atgcaccgtcttctcgggcgccaaggcgctcaggccggcttcggtcggcagttccacgttgatggacaggcggtcggcatagcgcccggcactggccagcagttccggcgaggcctcgggaatggtcttgaggtggatgtagccggcgtaacggtgttcttcgcgcagctgccgggcaacctccaccatctgttccatggtgtagtccgcattgcggatgatcccgctggacaggaacaggccctcaatgtagttgcgcttgtagaagtccagggtgagcgcgaccacctcgtccacgctgaaacgtgctcggggcacgttgctggaaacccggttcacgcaataagcgcagtcgtagatgcagaagttggtcagcaggatcttcagcaacgaaacgcagcggccatcgggtgtgtagctgtggcagatgcccatgccctcggtgctgccgataccgccactggcgcgcgaatcgcgcttgcccgagccgctggaggcgcaggaggcatcgtacttggcggcatcggccagaatggccagcttgcggatggtttccattga

SEQ ID NO: 10877 - DNA, 425 bp, Glycine max
  Peptide Sequence Number=SeqID_127655
atgaattcattgcctagcgctattcatgtgtcctccaccatcgagtctggagccccgcgaattcattgcctagcgctattcgccaattctccattctccacttttattcggagacccatgaattcatttcctagcgctgttcatgtgtcctccaccatcgagtctggagccccgcgaattcattgcctagcgctgttcgccaattctccattctccaatcttattcggagacccatgaattcattgcctagcgctgttcatgtgtcctccaccatcgagtctggagccccgcgaattcattgcctagcggtgttcgccaattctccattctctacttttattcggagacccatgaattcattgcctagtcttgttcatgtgtccttcgttatcaagcgtggaacctccggtgactgggaaatatg

SEQ ID NO: 10878 - DNA, 165 bp, Glycine max
  Peptide Sequence Number=SeqID_127656
atggatgaacatcaacaaacctggaaggaaatgactaacataatgataaagattaacaaagaatcaaatgaaatgttcaacactgttcatgttattgatcagctttatggtgaagtgggtaggtcatttgctataagatggaaggatgaactagagcctacgtga

SEQ ID NO: 10879 - DNA, 825 bp, Glycine max
  Peptide Sequence Number=SeqID_127657
atggactacacgtccttgcctttagaggactacgcgttctcatcttcaaagggctacaccccccccttcagaagactacatgtcctcccgttgagagagctactcgtccatgcctttagaggacttcacgtccttaccatcagaggactacacgtcctcgccttcagaggactacatgacctcaccttcagagggctgcacgtcctcgccttcagaggactacatgacctcacctttagagggctacacgtcctcgccttcagaggactacacgtcctcgccttcagaggactacacatcctcgccttcagagggatagatgttctcaacttcagagatctgcacgtccttgccttcggagggatacacatcctcgccttcagagggttgcacatcttcgccttcagagcactacacgttctcccctttagagagctacacgccctcgccttcagaggactacacgtcctcaccttcagagaactacatgtccttgccttcagaggactacacgtcctcgcctttagaacactacacgtcctcaccttaagaggactacacgtcctcccctttagagagttacacgccctcgccttcagaggactacaggtcctcaccttcagaagactacacgtcctcgccttcagaggactacacgtcctccccttcagaggactacacgtgctcaccatcagagggctacacgccctcgccttcagaggactacacgttctcctcttcagagagctacacgccctcgccttcagaggactacacaccttcaccttcagaggactacacgttctcgtctgcagaggactatag

SEQ ID NO: 10880 - DNA, 411 bp, Glycine max
  Peptide Sequence Number=SeqID_127658
atggccaacaatataatcagcaacagggatagtggagaactcaccctagcaatcagttcaataaagaccagggtggaccatctagcaggtcacaacaacaagggcctagtctctatgacagaacaacaaagctggaagagactcttgctcagttcatgcaagtatccatgtccaatcaaaagagcacagaaccgaccgtcaagcagctttggagccaacacagagaagaatcctaaggaggagtgcaaggctgttatgactagaagtagaatggtgagaatgaatgaaggagaaatgaggataggtgaagaaaaacaacagctggtgactgagccaacaattgatccagtgatggaacctttgagtgagactgaggaagaagtggaagtagaagatgatcaacagaaatag

SEQ ID NO: 10881 - DNA, 410 bp, Glycine max
  Peptide Sequence Number=SeqID_127659
gtgatgatataaagctcaaaggttcaagaatacttcatgatgatctcaagaatcaaagaataagttcaagatgcttaagattgaatcaagaacacttcaaggttcaagaggaatttgatttcaagaatcaaaaatcaaaaatcaagcttcaaggttcaagcttccaagaatcaagatcaagattcaagactcaagattcaagaatcaagataagtattaaaaagttttttcaaaaactgagtagcacatggattttttctcaaaacatgtttaccaaagagtttttactctctgtgatagtgtcgcaacctacccttttgcgggtgagcgaggcgaggctcacgggtacgtctttcaaaggaggaaaatgcacagagtcgcccccaacgtttattgaaagggaaacgtaa

SEQ ID NO: 10882 - DNA, 516 bp, Glycine max
  Peptide Sequence Number=SeqID_127660
atgatatgctactttcaaagacagttttccaacaaccgttgtcaaaaagttatacttaatttcaaaaatgcacccgtgttttttctaacatcgaatttgagaaaaccatcagggagcaagatagtctacttgaagcctcagaaaggttgcaatagattagcagaagttgtccacaccttgacattactcaacaaagatatgtgctcttacccttataaaaactcaggggataggaggattgtgaagagaagcatcaatcaggtggagaaagatgattcccaaattgaattgggaaagcaaatgcaagagaaagaagttattggagtctcaactgaccaacatataatctctcttgtccaaaagagggaggatgtcaatgttgtgatgactagaagaaagaggattcaagaggactccgaggagacagaaaattccttcccaaaagttacagatgacgtccttactgagaaggaccaagcacctaagaaagttgaggttcctactgatggaatctaa

SEQ ID NO: 10883 - DNA, 615 bp, Glycine max
  Peptide Sequence Number=SeqID_127661
atggcacttcactcttgtgtcctcactgtcatcgtgacaacaccctcaccatttgtttccaccgcgatagtgcttcagtcttgtgcccttgttgtcaccacgatgacacttctctttgcatattcagtttctcttaccttgaaccctttcattctatttttgttacccttgagccttctcttagtccctgtgaattcctttgtttctgcaaggtttgggtttctagaactcatgctcacagtgattttcgtcgagcggcaaaaggtttgggtttctggaattggggtttgggagagatggattaggattttgttgccaatcttgttccaagcagcaacaacgacaatgcgtgcagcaaatcctgctaggctctatggcccttggaacctctttttcatgaggatggccatatgccttcagtcctccctcaaatctttcgggtttattttccttggtcacggtgacaaggctcaagtaatacaaacactgctctttgtgattgacattagcacacttctccaagcactttttcgaacaagacttcctgctgtagttggaggtttatttgcatatatgactagtagggtcccatggtattatgcatcatggtactag

SEQ ID NO: 10884 - DNA, 2365 bp, Glycine max
  Peptide Sequence Number=SeqID_127662
atgaagaagaataaatcacccttctccgccgccaccttcactctcttcatcgccaccctcttaatcctctcttcactatcaccatcgcatgccctcggttccgccgccaccctagccgtcacctcctccgccgtctgcggcgtggtggcatcggagccgacgcggcgcattgcgtgctaccgccacggcgaagtcgtcgccgtcgcccccaacgtctccttctcgaccatctccggcggccggagctacttctgcggtctccgctgcggcaactacagcctcctctgctgggacaccctctccgccttccaaagcaagaggctttacaacaatggcactgttctattcgagaatctcgccctcggagactcccaggtttgcgccaccgtggtcggcgccggaaaggcgtcgtgctggagaacgaacgccgcgttcgaatcgccatctggctcggaccggtttgattccatttcatctgggtcgggcttctcttgcggagttttgaagggtagtgatcgggttcggtgttggggtgttgggtctatagcgagaaaaatggagagtgaatttaggaacatgtctatggtgagtcttgtggctggggagtcacatgtttgtgggttgaattcaagtgggtatttggtttgcagaggaagtaacaactttggtcaaattgatgttcctgaaggaggtgctttggagttttctggtttggcgcttggggttgagcacacttgtgctattcggagatccaatggttctgtcgtttgttggggtgggagagggttgtttgaggataatgttacaaaaggtgtttcttttgaggttattgtttctgggtccaattttacttgtggattgactactaacaatttttcagtcatttgttggggtcctggttgggataatggttcaggttatgagattcccttgcctcctattcttccagggccttgtgttcaatctccttgtagtgaatgtgggatatatcctcaatctgcgtctctgtgttcaggctatggaaacatttgtaagccaaagccttgtttacctgaaatgctggtgccagcgccacctgtggtgatgccggcaacaccaccgagtcctcctccggcttctcggtcgaaggccttgactaaggggttattggcatttgccattgttggatgtgtgggaggtgttgctgggatatgcactgcgatttattctttgtggactggggtttgttttgggaagaagaaagttcacaattctgtgcagccaacaatcactagaggtggcagtgtaaatggtgtgggcggttctaataacagtattagtcctccttctagatcatccaccataaggcgtcaagggtcgcggataatgaggcgtcaaaggagtggaacatcatccacaaagcatcctgagagggctgaggagttcactttggctgaacttgttgcagccaccgacaatttttcccttgagaataagattggtgctggaagctatggtgttgtttataaaggcaaactcgccgatggtcgcgaggtggcaatcaaaaggggtgaaactagtaccaagatgaagaagtttcaagagaaagagactgcatttgagtcagaattggccttcttgtcccggttacaccacaagcacttggtcaggttggtggggttctgtgaagagaaagatgagaggctcttggtgtacgagtacatgaagaatggggcattgtatgatcatttgcatgacaagaacaatgtggacaagagtagtagtgtcttgaattcttggagaatgaggatcaaagtagcgctggatgcttcacgaggaattgagtatctccataattatgcagttccatctataattcacagagatatcaagtcttccaacattctcattgatgcgacttggacggcgagagtatcagattttggattgtcattgatgagtccagaatctgaccatgattaccagccgatgaaggcagcgggaacagttggatacattgatcctgaatattatggtctgaatgtattgacagcaaagagtgatgtctatgggcttggagtggtgctgctagaactattaacaggaaagagggctatattcaaaaatgatgaaaatggaggcaccccagtgagtgtggtagacttcgcagtgccggtaattatgacgggagaattggcgaaaattttggaccccagggttaaaccaccagagatgaatgaaacagaagcagtggagctagtgggatatactgctatgcattgtgtaaatttggaggggaaggacagaccaacaatggctgatattgtagcaaatttggagcgtgctttggctctctgtgatagtagtcatggcagcatttccagtg

SEQ ID NO: 10885 - DNA, 216 bp, Glycine max
  Peptide Sequence Number=SeqID_127663
atgaacatcaaagagaagcagagacagatagatgacactgaaaggggaacatgtagtggtgacgtcgtcgccgtctcgttcctcttcacagacttggcatctatgttgggattgtatctaagaggggccgttagagaatgggagggggaggtggtagttgttgttgtagacagaggagtcttcatggagaatagagaggaggtgggaggggtctga

SEQ ID NO: 10886 - DNA, 2133 bp, Glycine max
  Peptide Sequence Number=SeqID_127664
atggctgtgtccaacggcgtcgaagcagtgttagagtttctgcgcaagaatggcttgtcggaagctgagtccgctctccgacaagacatcatcgagaacaacgacctcggaaacttcgactacgagaagttcttcttccccatggtcccaccgccgccgccggtcagagtccgatccttctcccggctatccgagctctccgccgacggcaactgctccaaatccagctccgatgagttcgtcagcatcggttctcccacttctcgtgtttcttcttcagtgattggtgatcactctctgttcgaagtaacggagacgactcagaatgactccgcatcttcgtctgaaagattatctcagtttggcactgcacgtgattatcatgattttgaaatgcagaatgaaccatattggtataatgaaaaagatgatgactatttcatgactcctagttttgaagggccggatttctttgcgtgtcaaagtgaagataagtttgtcatgacagcagaaacggaaaatcagcatgacaattctctggaccttgtttacaactctgaagaatttctattaaagggaaatggtaatggtggttacatggacaaggcatgcctttataatcattcctctgtaagggatggaaatgctacttattcaaaagagtattgtcatgttgataacaacaacttatttgaaggggaattagagggcaaggctgagaaacacactgttgcctgtagttgtgaagttccattttgcaaaagcagtccaggtggttcttgcagtttggatcctacaaacttcggataccctaatttgaaggaaatccatctgaagtttggggacattaactcttttgactctacttcagagctaactgtgaatcaaagttttgactactacactaaaaatgacagcagtaaggagtacaacggtccatatgacttaactatcaaagttaatcaaaaagatctaccaaatggacttgacacctataaagcacgagatggtggagaattagctgaagagtgccaagatcctgagattactgcagatggagaggatactactgatgatgagctcttaaagtatactcaagaggaagaatacgaagtatttgatctgagaattatacatagaaagaataggactggatttgaagaaaacaaggaactgcccattgtgctaaatacagtcttggctggaaggtattatgtaacagaatatcttggttcagctgccttcagtagggttgttcaggcacatgatcttcagacaggaatagatgtttgcttgaagatcattaaaaacgacaaagacttttttgatcaaagcttagatgaaatcaagcttctgaaacttgtcaataagcatgacccagcagatctacaccactttttgcgcctttatgattatttctaccatcaggagcatttattcattgtaactgaacttctgcaagcaaacttgtacgaatttcagaagttcaagcaagaatctggaggggaagaatattttacgttgaacagattgcagctcattactcgccaatgtttggaagcattgcaatacttgcatagcttgggaattgttcactgtgacctgaagccagagaacattctaatcaaaagttacagaagatgtgagataaaggttattgatctaggaagcagttgcttccaaacagacaatttgtgtctatatgtacaatcccgatcctatagagctcctgaagtgatgttgggccttcaatatgatgaaaagattgatatatggtctctcggctgtatcttggcagagttatgctctggtgaagtgctatttccaaatgatgcagttgtgatgattctagcacgcatgattggaatgtttggttctattgatatggagatgttggtaaaagggcaagaaacgcacaagtacttcaccaaagaatatgatatttattacgtaaacgaggagactgatcaactggagtacataattccagaagagtcatcattggagcagcacctacaggtcactgatactacgtttatcgactttgtcagatacttacttagcatcaaccccaaaagaaggcctactgcaagacaagcactgaggcatccatggctttcctatgtttactag

SEQ ID NO: 10887 - DNA, 555 bp, Glycine max
  Peptide Sequence Number=SeqID_127665
atgtcatttcctgctttcaggtacttggggatgggcacgagtggaggcgaggcccatgatcaacagatcgtcgtcccacgtccagacaaacgagaagcgctactgggaggcagcctagtgatggttggatgcctaatttaccctagcggcttcgaggttagctcgcctgggcgagcaccccctgcacgaaatggtttaaaaggaaagggggagtgcagttttcacccaaggaacttctcccccttacttaagaacgcaagcactcatgggattctagctttttctgaccctaggccaccattgtgtgctttttgcttccattttagagtccttgccactccatacaagaaatggctccaaagaaactctccacgaagaggtctagaagagatgccacaggagaaggatccagtgctacctcaaagtttgatagtcatcacttccggagtgccgagcaccaacaacgcttcgaggccatcaggggatggtcattccacagggagaggcgtgtccagctcagggaggataagtatacggacttctcagaggagatag

SEQ ID NO: 10888 - DNA, 498 bp, Glycine max
  Peptide Sequence Number=SeqID_127666
atgcttccagagaagaacatagatgtgaccttggtgaaggagttttactccaacatttataatcagtgcaaggtccgaggaaaggtcatcaagttcgatgctcagacattgaacaccttcctggagacgcctgtagtcctacaggagggcgagagatatcaggagaacgttcatctccggaacatccttccagagaggaacgtacaactagcctactctgattatgatgagttcctggaggagctcgagcgagggcattgggataggaagctcatcaggcttctagagaagaacatatatgtggccttggtgaaagagttttactccaacatttatgatcctgaggacgactcacctaaacagtgcaagaactctcttgtgcgcttagcgcaactctcgcgcatgtccacttggattaagtggtcacgtgctaagcgcaagatgccgcttgttcgtgatagttgtcttccaatgtggctccttgtgctaagcggttaa

SEQ ID NO: 10889 - DNA, 651 bp, Glycine max
  Peptide Sequence Number=SeqID_127667
atggcgtcttcagctcaagtgccaaacctcttcggcagtgccacctcagctctgccgccaaccccggcggcgcaccacgacaacatcatgtcctcctccgacgccgccgacgcgctctcctgcctcctccaccgcctcccgcccacgctctcccttcccacgcgcctcccctcgccttcctccgcagccgccacgtctcccccctccctctccctaaacgacgtattctcctgcgtttcaaaactcggttacgcgcaactcaccgatcactcagtcccctccgaactcgccaactcggccgagtcggaagcgcttgccctctttgacctttccaaagaacagaagaactctctctttcccaaaaactggcctctcggatacggcggcgacgacgaagacgaagacgagctcgccgagtcgttccgcttcgactcggcgtgttcgaccgagtcgaacgagttggcactcttttccctgcgcaagtttgcgcgcgaactggagatgctgggtttaaagatcgttgatgggttaacaaaaggacttgggtaccagataaggaatctgaaatactcattgctgtcggattcgggatgggtttctgtgctgccacacgtggactcgattttggacactgttggtgacattgctcag

SEQ ID NO: 10890 - DNA, 1401 bp, Glycine max
  Peptide Sequence Number=SeqID_127668
atgcgtctctcgtggcagcaagcaggtcatggacaaaggtggcttcgcatcaccgtccatttcgatgggaaaaaaatcggaaggagcaagcgtgcacgatgcaccatactggtgattcacgcggcacctgaagatgaagcactgcacgaagaaacagaaaatcggaatacaaatttggccagcagaggaaccaaacaaacaaaagccagaagaagaagctcttggattggatcatcttcaacaatgttctctcgattctttcacaaatctccaccgcaacagcgccctcagcaacaggacgtggtgcaagatagttttccgtcgccgaatttcgatctgcgagttgttcttcaccatggcgttccatctactgcgtctattctcgcttttgatcacattcaacgcctattagcagtgggaacacttgatggaaagataaagttgtttggtggtgacaatattgaagggactcttatctctcccaagcaagcatccttcaaaaatttagagttcttggaaaatcaaggttttcttgccagcgtctcaagtgataatgaaatacaggtttgggatttgaaaagcaaacaaattgcttctgccttgcagtgggaatccatcataacttctttctctgttattatggcaccagttacatgtaaatgggtattttacatttttgccctcttaatgagattcaagtatattggaactgagcatgggatgcctctttgcatatgcaagggtaaggctacgtacaatatccctctcccataccttcgcatagcgaagagcctctgggcttcgggagaatgcttctgcgaattgttggatgcaagtctgcgtggcagatttgggccaaaatccacactcacttgtgccaaagcttccaaatccgtaatgagcttcatgatctctcttatccaaacactggttaattctctcacggctgttggagagaccgtaacgtccactgagcatcttgatcttgtgcttgatggacttcctcttgagtacgactcatcgatttcactgattagtagatgtgttgccaattttacgattgatgaggttgagaccatgctcttggagcatgaatctcgtattgacatggccaaaaagcgttccctagtttctgttaatctaactgaaggaaattttagggctaatgattcctttcaaccttcaaattctaatttgcaaggcacaatcttggtggtcggagctttggacgcggtggtggtggtcgagatcattttgttgatgtccaatgccaagtgtgtcacaaatgatgagaactatgttgctactattcctatggcttctactacttctgctgcttcctctgcggtttcgactgtggcttctcctgttgcatctaccactactcaagcaccagcttag

SEQ ID NO: 10891 - DNA, 417 bp, Glycine max
  Peptide Sequence Number=SeqID_127669
atgtccctatgtcagggtgtgtctgttcttcatttttcatttagaaaaatcttcaattcagctcagaaaaagtggactaggcaaaagcctcaaatctcaaatatgtggagcaatggcaagttaaagaaagtgagaggcagaccaatggccacagtgggagatgaaaatggttcacgctgcataacaatgtcattgctgataactcttccaacagatagcagagtggctccactccttcccaaggcaacctgcaacaaggaacaaaaggaagaagaagttgatgaagaaagcaatgatggtggtgaagaactagagaagagggtgttcaactcttttgattttgaggactatgcttggagagtgtaccatgaacgcatcattttcaaagatccattggataggtaccgtgttgcttag

SEQ ID NO: 10892 - DNA, 1542 bp, Glycine max
  Peptide Sequence Number=SeqID_127670
atgcagcctcttcgaagaaaaactcctctattcaccacctcagaaatgggggcaatgaagggtcgcaagaacaacaacctctccatcttcgtggtggtgttctccatcttcctctttgggctcttcatgtacaacgaggatgttaagtccattgccgagttcccattctcgagtcccaaagcgcatgaaacacaagaaggaggagaacctaataaacatgttgattctgttcaagaagacaatgttgttgttgttcaaagggagagtgagaagaaggacgtggaagacagtgtcacagtgaaaatttctaagagtacttcaagggctcagctagagaagagtggtgctgaggatgaggattctgatgagcgtgttgatttgaaaactgttgtggagaaagagaagaagattgaaatgccacgtgcggaggaagaggaagaggtggaagaagaagaagaagatgagaaagttgagttgccaccagaagattgtgacttgttcactggggagtgggttttggataacgtgacacaccctttgtacaaagaagacaagtgtgagtttctcacttcgcaagtgacatgcatgaagaatggacgacctgattctttgtatcagaattggaagtggaagccaagagattgttctctgccaaagttcaaaccgaagcttttgtttcagaagattagagggaagaggcttatgtttgttggagattcactgaataggaaccagtgggaatccatggtttgtatggtgaattctgcggttccttcatataacaagacctggtacaagactggttctcttgccatcttcaaaatcgaggagccagagcacgttaccaccgtggaattctattgggcacctttcctcgtggagtcaaattcagatgatccaaacatgcacagcatattgaaccgtataatcatgcctgaatcaatagaaaagcatggaatgaattggaaggatgtggactacttgatctttaacacctacatatggtggatgaacactttctctatgaaagtcttacgaggatcatttgatgaaggttccacagagtacgatgaggttcctcgcccaatagcatatgggagagtcctcaagacatggtcaaaatgggtagatgacaacattgactcaaatcgaactaaagttttcttcagcagcacgtcccctcttcatatcaagagtgaggattggaacaacccagatggtataaaatgtgctaaggaaaccaccccgattctcaacatgtcaaccccattagatgtgggaacagatcgtcgcctttttgcaattgtcaacaatgtgatccagtcaatgaaggtgtcagtgtacttcattaacatcacttctttgtcagagttgagaaaagatgcacacacttctgtctacaccatacgccaaggaaaaatgctaactccagaacaacaagctgatcctactacttatgctgattgcattcattggtgtttaccaggattacctgatacttggaatgagttcctctatacacagatcatctctcaatcttga

SEQ ID NO: 10893 - DNA, 240 bp, Glycine max
  Peptide Sequence Number=SeqID_127671
atggctcgctctctcgacgcggctttgtctctcgtctgctctccctctccctctggtggtcaccactcaccgccgacaatgaaaggagtccagaggagacaaagaggttacgtcgaagccagcggcgaaggcttgttggttggtctgcatgccgacgctagcgcggtgtctgcaccaatgattgcgacaccatctgtgcacaatggcaacacaagatctgcatctcaggtttcgcgatag

SEQ ID NO: 10894 - DNA, 1281 bp, Glycine max
  Peptide Sequence Number=SeqID_127672
atgtcggaattgtcacctgaattgtcagacttcaccccctcatgcttaggaatagatagacaagaaaatatgggtgacccaaataatgagtcgaggataggttctgatatcattttagaatttggatttagggccttgggtatcccactactcgatacactttattttcatattcctgtacgacatccatcttcctatccagagttagaggttccaaccttgctccagtcagccgctttaatgtctttggggattttatatgaaggttcagctcacccacaaacaatgcagggtgaaattgggtgccgaagtggaggtgataatgttcttgagcgagagggtcatgctgtttctgcaggatttgcactgggtcttgttgcattgggacggggagaagatgcacttggtttcattgacacatttgtgaatcgtctgtttctctacattggtgaaaaagaaagatctcatttttcgacagtctcaatggatgaaagtcgtggttctgcacagatgatggatgggacaacagtcaatgttgatgtcactgcacctggagccatcattgccattgctttgatgtttatgaagacagaatctgaggctattgtgtctaggctctcaattcccaatacatgttttgatttacaatatgtgaggcctgactttataatgcttagagtcattgctcgaaatttaataatgtggaacagggttcacccctcaaaaaattgggtttggtctcaaattcctgagattgtcagatgttctgtagaagggattggagttgatgacaataatattgaagatatggatgctgaggcttttatacaggcctatgttaatataatagctggagcttgtatatcacttggaatggtgtttgctggcacaagaaatgaaaatgcacaggaattactttatgaatttgttatttactttcttaacgagatgaagcctgtttctcctacatgtggaaaggttttcccaaagggactgtctcgctacatcgatcggggcacattggaaacatgccttcaccttattgttctttctctatctgtgattaagatcatgactaaaattctatggttaaacttctgcataccaggttatggctgggtctggacatttacagacctttcggttgttgagattcctaaggagcagaaattgtgcagatgggcagtcaagttatggtattcagatggcaggggttggggattgaacttccctaccttaagtggccggaggtggcttggtaccattatgctaagccactaa

SEQ ID NO: 10895 - DNA, 424 bp, Glycine max
  Peptide Sequence Number=SeqID_127673
cttagttcttctgctccactctcgtcaccaccgagaagaacttgaagttgaacttgctctgagctccgagaaaatgtccatcggagtccgttgcttaacagtgctgggcgagttcaagccatttggcctcattgccgaagctctcgacggcaagccccccgacaccgtcaccgacaagtacgattacttcctcttcgatcccgaaatcgctcgtgaccgtgacgccgatgacgattgcgacgacgtcgcttctgcgccgagcaatcgtggggatcacgagctgttcatccgaggcaatcgaagttgcactgttgctgcattgcttttatctaacgttgtgatgttttgtgataggattatatggtcgacgggtgcgagagtatttaagagatttaccttgtcatctgacatcgttaaggtttga

SEQ ID NO: 10896 - DNA, 1059 bp, Glycine max
  Peptide Sequence Number=SeqID_127674
atggttggtgaaagatttggacttcaacagctggactcactaccttctggtgtatctcttccactacgccatgcattagataagtgtcgagattcacctcccaatgactggccagctgctgcttatgtacttctaggccgacaagatttggcaatgtcaactttggcacgcgaatgcaaatataggggcatggaaacaccaaccaatgtgaatgttatatctatgtccacaccttatatgttaaatctgcatcctgtgacaatatcttctactatttctgatgcaattggattggaaggaacaaagtttgaggatacagattcagttgatgggtctatgactgatggtatggagcatatattcaactctagcacacagttgcgttatggtcgtgatcttaggttgaatgaggttagacgccttttgtgctcttcaaggcctgtggcaattcaaacatctgttaaccatagtgcttctgatcaggacctccagcaggctcaattgtggcaccttgcacaaaggaccacttcacttcctgttggacgtggggcatttacccttgcaaccatatatacactcttaactgaggcttttagtgttccaaagctcgtactagctggtcggttgccagcccaacagaatgctactgttaatcttgatccaaacatcaggaacatacaagaactcaggtcgtggcctgagtttcataatgctgttgctgctggacttagactagcccctctccagacaatgaaaatttctcttaacggcttcaatgagcttctgccccttgctgacaccccagaccaagaacttgaaaagcggaagacctttttcatactcaacttccctgaggcaccaaggctggtggttggcaaatacaaccttctgcggtttgtggttgatgctaagcttgatggtatttgtcaaagctcagatgaaatgcagaaacaagggaagccaaagaaggcggtgagggttaaccaagaagtcaaagcaactattaggtgggtcttcattgccgttgaggtagttcaggcaaggagaaagcttgtttag

SEQ ID NO: 10897 - DNA, 936 bp, Glycine max
  Peptide Sequence Number=SeqID_127675
atggccactgatgatgatacagctcctgttgtctgcttttttcaccaagaacaaagaaagttgttgtctgttagtcttcagattgttgaaataaataatgagattgtgtttgatgtcaaacctgatatgagctggaacatatctgcaattgcagcttcacctgtgacggtaacccgcccaagggtcaaagtaggactacttccatattcagacataatggttttggctccagaaaatgttctgcttctctattctgggaagcaatgcctgtgcaaatatgtgctaccttcttgcttaaataaagataagattttgcatgatttggagctttcagaagaatctcctcttcccaattacttaaagattacaggcctggctgatgctgttgaggggcgagtcaatgtgatagtaaataatagacagatctttagatgtgcattacgacaaagtccttcatcaacattagctaatgattgcatcgcagcacttgctgaggggcttcgttctagttattacagacatcttcttggtcttctctggaaagatagtgatccagctcatctgtcggaaactgaatctattgttgattcagaatgggactctttttgtcatgtaattatgcaaatctgcagaaaatataacattatatgtcaaaagcgttctgattcagtaccacattctgcttgggacttccttgttagtagccaatttcattataatttttgcaaagtaaactccatgttcggaataccttgtgcagtgtcacttgatcagcaggaattaaatttccaaaggtcatctgtagatgacgcacaaagttttgacaagcctttttatactgatctgttatgggaaagtctggaatctcttcatggactctatgaaagcttgaaacttgacaatctccgcaaaaggtatgtctctgatcctgtgtaa

SEQ ID NO: 10898 - DNA, 276 bp, Glycine max
  Peptide Sequence Number=SeqID_127676
atgtcaagaacatgggttttgtataacaaacctgaggagccaaattctgttcatgctggacttctacttgcactaggattgcatggatatctgcgtgtattagctgttactgacatctaccagtatttttctcaggaacatgaaagtactactgtgggattaatgcttggccttgcagcttcttatggaggcaccatgcatccagctatatcaaaggtattatcaagcacaatttttctggtggaattgttgcagatctctgccctcagatactag

SEQ ID NO: 10899 - DNA, 4833 bp, Glycine max
  Peptide Sequence Number=SeqID_127677
atgtggaaggcaccacttcagcaatggaagatgagccaacagaagatgccacaagggagatggacggtccctgataaatccgaacagggactatccatcaacccttgtggcgtcttcctttggcttatcttccattgctggacgtggcgccttccacttgtcatcaagcgatccgtaactagacccgtgtcatctggctttgccgaaaagaccagggtttggttagaaacaacattggtaagcactgagtgctggtggtttgtgtcaaaacagagggcacaattggtaaagggaaacatgcaacttttctcagtggatcaacaacgtagtcaggctcttgaagctcatgctgcatcatttgcccaatttaaagttcctgggaatgaaaatccttctgttttgatttcttttgcctcgaagacacttaatgctggtcaagttatatccaagttgcatgttattgaactgggagcacaaccagggaggccatcattcacaaagaagcaagctgatcttttcttccccccagattttgctgatgattttccagttgccatgcagatatcccacaaatacaatttgatttatgtgattacgaaacttggcctactatttgtctatgatttggagacagctactgctgtatataggaacagaatcagtccagatcctatatttttgacctcagaagctacatctgtgggaggcttttatgccatcaacaggagaggccaggttttattggctactgttaatgaacaaaccattgtgaattttgtcagtggccaactaaacaatttggagctagcagttagtcttgccaaaagaggaaatcttcctggtgctgaaaagctggtagtggaacgttttcatgaactgtttgcccaaacaaaatataaggaagctgcagaacttgcagctgaatctccacaaggaatccttcgaactcctgacacagttgccaaatttcagagtgttcctgtgcaagctgggcaaactcctcctctgttgcagtattttggaacacttttaacaaggggaaagctgaatgcctttgaatcattagaattatcacggttggttgtgaaccagaacaagaaaaatctgttggaaaattggttggcagaggacaagcttgaatgcagtgaggagctaggagatctcgttaagactgtggacaatgatcttgctttaaaaatatatatcaaagccagagctactccaaaagttgttgctgcgtttgctgagaggagggagtttgacaaaattctgatttactctaaacaggttgggtacacacctgactacctcttccttctgcaaacaattctccggacagatcctcagggcgctgttaattttgcattaatgatgtctcaaatggagggaggtagcccagttgattacaacacaataactgatctctttcttcagagaaatctgattcgagaggcaacagcttttctcctggatgttttaaagccgaatctaccagaacatgggttccttcagacaaaggtgttggagataaatctggtgactttccccaatgttgctgatgcaatattggctaatggcatgttcagccattatgaccgtcctcgtattgcccaactttgtgaaaaagctggcctttatgtgcgagctttgcaacattacacagaattaccagacatcaaacgcgtgattgttaatacacatgcaattgaacctcagtcactcgtagagttttttggtacactgtcaaaagaatgggcattagaatgcatgaaagacttactgctggccaatcttaggggcaacctacagatcattgtgcaggttgctaaagaatattgtgagcaattgggcgttgatgcctgcataaaactttttgagcaatttaggtcatatgagggactgtactttttccttggatcatacttgagctccagtgaggatcctgacattcactttaagtacattgaggcagcagcaaagactggtcaaatcaaggaggttgagcgtgtgacaagagaatcaaatttctatgatgctgagaaaaccaaaaactttctgatggaggctaaacttccagatgcacggcctttgattaatgtttgtgatcgttttggatttgttccagatctaacacactatctatacacaaacaacatggttcgctacattgaaggctatgttcagaaggtgaacccagggaatgcacctttagttgttgggcagctgctagatgatgaatgcgcagaagattttatcaaaggcttgatcctttctgttcgttcattactgccagtggagccccttgtggaggaatgtgagaagaggtggaatcgacttcgtatgctcacacagttcttggaacaccttgtaagtgagggaagccaggatgtacatgttcacaatgcactgggtaaaattatcattgatagcaacaacaacccagaacatttcctcacaaccaacccatactatgattctcgagttgtgggcaagtattgtgagaaacgggatcccaccttagcagttgtagcttatcggcgaggacaatgtgacgatgaacttatcaatgtcaccaacaaaaattctttgttcaaactgcaagcaagatatgttgttgagagaatggatggtgatttgtgggctaaagttcttgatcctgataatgaatatagaaggcaacttattgatcaggttgtatctactgctttgcctgaaagctcaagccctgagcaagtttctgcagctgttaaggctttcatgacagccgatctgccccatgaattgattgaacttcttgagaagattgtgcttcagaattctgcattcagtggaaactttaatttgcagaatcttcttattttgacagcaataaaggctgatccatccagagttatggattatgttaatagattggataattttgatgggcccgcagttggagaaatggctgtagaagctcagttatatgaggaagcatttgccatttttaagaagttcaacttgaatgttcaagcagtcaacgtgttgcttgataagattcatagcattgatagagctgttgagtttgctttccgagttgaagaagatgctgtttggagtcaggtggccaaggctcaactcagggatgggctagtaagtgatgcaattgagtcatttatacgagctgatgatgctacacaatttttagatgttatccgtgctgctgaagatggcaatgtttaccatgacttggtgaaatacttgctaatggtaagagggaaagcaaaagaacccaaggtcgacagtgagctcatttatgcatatgcaaaaatagataggctgagtgacattgaggagttcattcttatgcctaatgttgctaatcttcaaaatgttggtgaccggttgtacgatgaagcattatatgaagctgcaaaaatcatatttgcttttatatctaactgggccaagttggctatcacactggtcaaattacaacagtttcaaggtgctgttgatgcagcaaggaaagccaacagctcaaagacatggaaggaagtttgctttgcttgtgttgatgcagaggagtttcgtttggcccaaatttgtggactaaacattattattcaggtggatgacttggaagaagtcagtgaatattaccaaaacagaggttgcttcaatgagctcatatctctcatggagagtggtttagggttagaacgggcacatatgggcatctttactgagttaggagttctgtatgctagataccgccctgagaagcttatggagcatatcaaactattctcaacccgcctcaatattcctaaactcataagagcttgtgatgaacaacagcattggaaagaattgacctatttgtatatacaatatggtgagtttgataatgctgcaactaccatcatgaaccattcacctgaagcatgggatcacatgcaattcaaagatgttgttgttaaagttgccaatgtggagttgtactacaaggctgttcacttctacttggaagagcatccagatcttatcaatgatgttctgaacgtccttgcacttcgtgtggaccatgcacgtgttgttgacatcatgcggaaggctggtcacctccgtcttgtgaaaccgtatatgattgcagttcaaagcaacaatgtatctgctgttaatgaagcgttgaatgagatatatgtcgaggaggaagattatgatagattgcgcgagtcaattgatttgcacgataactttgatcaaataggccttgctcaaaagattgaaaagcatgagcttcttgagatgagacgtgttgctgcttatatttacaagaaggcaggtaggtggaagcagtctattgctttgtcaaagaaggataacctttacaaagatgccatggagacagcctcccaatccggggagcgtgaacttgctgaggagttgcttgtttatttcattgatcagggaaagaaggaatgctttgcctcatgtctatttgtttgctatgatctcatacgggcagacattgttcttgaactagcttggatgcacaatatgattgactttgccttcccatatctattgcagtttattcgtgagtacactggcaaagtcgatgaactagtgaaggacaaaattgaagcacaaaatgaagtgaaggctaaagagcaagaagaaaaggatgtagttgcacaacagaacatgtatgctcaattgttgcctcttgctttgcctgcaccaccaatgcctggaatgggaggctttgctcctccccctccaatgggtggactggggatgcccccaatgcctccttatggtatgccacccatgggcagcagtttttga

SEQ ID NO: 10900 - DNA, 147 bp, Glycine max
  Peptide Sequence Number=SeqID_127678
atggagaggggagggcagagatgctcaaagaaggttggagttagcaagaggaaggtgacaacactttccgacgatggcacaaatgtcctccgagcaagaagaaggttggagctagcgagcacagtcgcattaccctaccaatgttga

SEQ ID NO: 10901 - DNA, 238 bp, Glycine max
  Peptide Sequence Number=SeqID_127679
gccgaaacttcctcataatttgctagggtttctcgtaggctataaattgttgcaaccttcacagttcctttcttctgaatcgtcttttacttctcagcagcttcggctagggttcagaaacgaaaaagggttcggtgttctgttcgcgatgagagccaaggcggtggaagaagaagcgtatgaggaggttgaagaggaagcgccgaaagatgagacagagatccaagtagtgcgttaa

SEQ ID NO: 10902 - DNA, 687 bp, Glycine max
  Peptide Sequence Number=SeqID_127680
atgacgacgatgaccggcggcgacaatcgcgtgaagggttcttggagtcctcaggaggatgcgacgttgctgaaactggtgaatgagcacggggcacgcaactggtccgtcataagcgccggcattcccggccgctccggcaagtcgtgtcgtctgcggtggtgcaaccagctgagtccggaagtgcaacaccgtccgttcactccggcggaagacaagatgatcattaaggcgcacgccattcacggaaacaagtgggccaccatctcacgcctccttcccggccgcaccgacaacgccatcaagaatcactggaactccaccctccgccgccgtcgcacggcggagcaatcctcctcctcgtcggcgtctccgccggccaaacgaccctcatccttgtttgacacgcttcaccctctaaaaaagcagtgcattgaaaaggaaaatgaggaagagagtcccgttacgacgtcgttgagccttttccctcctggggaaaaatcagaggaagaagaagaggaggaggagaaagaagagtttgctaatcaaaaggtttcggatcagaattactttatgcagatgatgcagcggatgatagcggaagaagttaggaattacatggagactttgcgcaattgctcccttgagcctgggttagatcttctttctccgacgcttccaaagtaa

SEQ ID NO: 10903 - DNA, 720 bp, Glycine max
  Peptide Sequence Number=SeqID_127681
atgaccaacaattccatggcaatctcaacctctcagaactccgtctccttcgacttagacttgacatcctcttggctcaaccacactagctcctcctcccagtgccctcgttgtccaccatcaccagctacaaaccaaccactagagaatctccctcttacaaacccacccaccaagaagccacatggcaggcccgcaggctccaagaacaagcccaagatcacccccttccaggtggcccaacctgtggaaccctgcatgaaggtcatcattgtcaatgtgacccggagcagcgatatcattgagtccattcttgatgttgctcatcaaggccatgttagcctcactgtcctcagtgcctctggaacgatcaccggagtaaccctcaacaactcttcgcatggtgttgatgccctcacacttcgcgggcccttcaccttgctctccctcaatggctcatacttatacaacaaccactacgcccttcaccctggagccacccctgcccctcccttatcatttgggatcagcttttccacctctcaagggcaagtctttggtggtgccattggtggtagagtcattgccgataatgatgtcagccttacaatttgcaccttcaagaaccctgtgatgtacaagcatgcttctagagacaaagaaagggacaggggtgacaatgataacaacaacaattataacaataactatagcttttaa

SEQ ID NO: 10904 - DNA, 837 bp, Glycine max
  Peptide Sequence Number=SeqID_127682
atggtggatataattctttatgaaagaccacgtccaaaatctgttaacaataagacaatggagggattggtgttcgataaagactgggaggacataaccaaagaaacggtggatataatgctttatgaaagaccaagtccaaaatctattgacaagaagacaatggatggactatttttctggaaaaatccagtaccttgcactattgcccctatgccttattttggggaacaaataggcccgacaaaggttatgtggttgttattgcaataccgaaagaggaatacagagaaggccttgaagactgcaaaagttatttgcatagcaggattcttttggcaaagggcgtccctcctccaagagtttctgatttgcaagccaaagatttggcatcctttgggacgttggcatatggtcccaattggaaaaggctattgcaattcttctttctccttagttcaagatttacgtaagggttaccacaaaagtatagagacaagctatcctattctccatcgcaataggtgttgggatcccctctgcacagatgatgcaatgaatagtcgtgcatttggacgctatgcttggatttttgtagatgtggaccttgatagaaaactaaggacaagtcttagtggaaaggaaaggatatgccttctatgtgggtatcgaagtgcaaaaagaaatcaaaggaatcaaacaatgttctataatcggagcaaggaagaaagaggttcatgtcctccaaagagaaaaataaagagatcattttgcaagacaatgcccttgctagggaaggtccaagctatgttaggaagaatgggcatagctgtgtag

SEQ ID NO: 10905 - DNA, 1326 bp, Glycine max
  Peptide Sequence Number=SeqID_127683
atgggaagttccgtgcgcgtaaaagaagcatcagtgattacaccttccgagcccactccatcaagcgtgttggctctatcagctcttgattcacaactcttccttcgttttaccatagagtatctgttggtctacaacccttgcccaggcctggaccaggctgccaccacggcccgtttaaaagccgcattagcccgagcgctggttctttattatccttttgcgggccgggtcaggcccaggcccgatggccctggcctggaggtggtgtgtggagcccaaggcgcggtgttcatagaagcctccgctgactgttacaatgttaacgacttcgagaaagcgcctaaaacagttacgcactggaggtctctcttgtcgctccacgtggcagacgttctcaaaggatcgccgccgttggtggttcagatgacgtggctccgcgacggcgccgccgcactcggcgtcgggatcaaccactgcatctgcgacgggatcggtagcgcggagtttctaaaccacttcgccgagttagccaacgagaaacgcgagttattattaggtctcaggcccaaacaaaaacctgtctgggagcgtcaccttctgaacccgccgcgtgggaagcagacgcgggttgactcggcgagtcaccccgagttcaaccgagtcgctgatttatgcaacttcatgagcaaggtctcgacggggcttaaaccaacatcggtgaccttcgacaagaggagactcaacgagctgaagcgactcgcgcgttgcacgagtcaaccaggcgagtcggtgtgttacacgtcgttcgaggtgctagcggcgcacgtgtggagaagctgggcgagagcaatagggtttccgccgaaccagaagctgaagctggtgttcagtgtaaacgtgcggaaccgggttaaaccgggtttgccggaggggtattatgggaacgcgtttgttttggggtgtgcggagacgagtgcaaaggagttggaggaaagagggatcgggttcgggtcgggtttggtgaagcgggcaaaggagagggtggggaacgagcacgtgagggaggtgatggagttggtgtgggagagaaaagcgtgccctgacccggttggggtgctgatagtgtcgcagtggtctcggttagggttggagaagattgacgtgggtatggggaagcttcttcacgtgggacccgtgtgctgcgataggtactgtttgtttttgccgctcagggaacactgtgtgagtgtcaaggtcatggtggctgtccccactctcgccgttgacaattaccagcttttcatgcgcgcgtcgcacctgtga

SEQ ID NO: 10906 - DNA, 318 bp, Glycine max
  Peptide Sequence Number=SeqID_127684
atgaatctaagttcaaattcatttgctacagctaaagacatagagagtgagagatcaagtgatgatgaaatgccaccattggaggattgcattgatgttgatgttgctgaacctataaatgaagatgtgcttgttactaggtgtgctcttaacatgaagcctaaggtaggaggttgtcgcaacctacccttcggcgggagggcgacgcgtgactcgcgggtgcgtgttctaagaaaggaatacgcgcggagtcgccaccaacgtttatttgaggaaaacgtcggaaaaaccggaaaggacgtgatctacgaactttaa

SEQ ID NO: 10907 - DNA, 264 bp, Glycine max
  Peptide Sequence Number=SeqID_127685
atgtatcttcttcttctggggacaacggctctcagtctggttacaactccacttttgtttaaattgattcctgctgtcatgaatctgggtgttctcatgcactggttccccaatgaaagtagcacacaaattgaggtgtctctctttatttcaatctctatgccctcatatatatggtcagataactgctccccctcacaaataactagggtgcttcgaaaaccttatttgagcacgttagaaccgtggtatataaccttttga

SEQ ID NO: 10908 - DNA, 387 bp, Glycine max
  Peptide Sequence Number=SeqID_127686
atggtttctagaggtatcatccccttcgaaaaacatattgcggcagtagggactaccaacaacaatatgttatcaaagagaaaaactctagatgagggttcacagttatcaggcaagtcggagacccaacatgaccacagattcacctccactccttatgttcccatggacccgggtatagggccccttttcaactcactgtgtgtgcaaaaaggtgttggtgtttccccagtggagtcgtcaactgtcgcaacctacccttcggcgggagggcgatgcggggctcatgggtgcttcttccaagggaggaaggcgcgcggagtcgccaccaatgtttattcgaggaaaacgtcagaaaaaccggaacgtgtggtctacgaactttaa

SEQ ID NO: 10909 - DNA, 177 bp, Glycine max
  Peptide Sequence Number=SeqID_127687
atggctaagtatgatccaaaactagtcatggggttctacgccaatgcatggaccatggaggagggagtcagagacaagcgctcctggaggagggccaacgctgcgaattcagttagaggaggagccaggcctcgaggtttaatgaggaggccatcactcagcaactgtgtgttctaa

SEQ ID NO: 10910 - DNA, 1542 bp, Glycine max
  Peptide Sequence Number=SeqID_127688
atgacaaacaccgaagaagaagaagcaactcctccgaaccctaagaattacactcaacactccaccaacgacgatgtggaacctcgtgacgacgaagacatcgaagaagaccaagaaaacgatgaagacgacgtcgttcaggaaccgaatcgcggaattccccaatctgcagcgtccaagttgcgggaacagcgtttcaaggtggaaaccctatcgcggcgcttgtcgtcggagctggttccgatccgagtccacgacgtggtcataaacggcaacacgaagacgaaggattgggtgattgaagcggagctgaaaggcatcgagaacgccaccagcatgcaggagcttatgcaagcttcgcaaatcgccattgccaagcttcagggtctcgaaatcttcgattcctgcatggttcgcctcgaggctggaccacgagagcttccaaacactgccaatgtcatcgtcgacgttgtcgaaaccgataacaaagtttccggcgaattcggcatttataccaaaccctcgactagttcgtggactgctgaaggtgctcttaagtataagaacttgttgggttatggtgatctatgtgatgcttctttggcctatggtgccaaccaagcgactgaggtgagtgtaggggtgtatgcccctcgagttaaaggatttttgactcctattgtaacacggatatccatgctttcccaagattggcaggagtcttcctcatataaggagcggttgttgggtgcgtatcttggcttaatctcgacaaagcaccatgacttagcatacacccttggatggcgtaccttaacagatccgtcaaagaaatcatccaggagaaattctactattaggccaacaaaaggatatgtttttctttccaccactcatgttggtggccttacactggaccccaggagcttgcggtttctgcgtcaggagtttgatgttcgcttttctgtcccttttgggttttacaatactgcactaaaccttgggatatctgctggtgctgtttttccatgggggaatggattcaaaaccaagccatctccccttccagaaaggttttatttgggtggtgatttttctccagtttgcaccctaggaggaccaacaacattatggggatttaaaactagaggattaggtcctactgaacctcggaggcaaaatagagatgggtctaatgatgacaatgttgattcctctggatgggacttcattggtggtgattttgctgttactgcttttgcagatctctcttttgatcttccaattatgtggttgagagaacatggaatccacggacatgtttttgcaggttctgggaatgctgctaaattaactaagaatgaatataagcacttctctcctcggaagttcttagaatcctttcgaatgtcagtaggatgtggagtagttattcctactagactcttccgcttagagggtaactacttttacatactcagaaagggtgagcatgatcgtgggaagactgggtttaggtttagcttctcagcgccttcatag

SEQ ID NO: 10911 - DNA, 306 bp, Glycine max
  Peptide Sequence Number=SeqID_127689
atgacaataaacagcatcagaggcctacaacatcaagcttcaatcccatatccattttactccaatatctacacgcccattctcggtatggcccaaaacccaaccaaatatggctttgcacaaactcttcaaggatgctgtgggacagggctattggagatgggtcctgtgtgcaatgcacatgacctaacttgccccgattcgtctaagtacatgttctgtgatgctgtgcaccttactgaagcagggaactacgttcttgccgagagtggtcgacaaaatgtgcttccataccttggtagttag

SEQ ID NO: 10912 - DNA, 1932 bp, Glycine max
  Peptide Sequence Number=SeqID_127690
atggacaagaacaggaaactcagtcggttcaaggatctttctatagctttttgctttgtggcagtttttttcttgtttcaccacttgggtttgtgctgttctttgaatgaagaaggtaatgctcttttgaagttgaggcagagaatagtgagtgacccttttgatgctttgtcaaattgggttgatgatgaggcttctgttgacccttgtaactggtttggagttgagtgctcagatggaagagttgtggtcttgaatttgaaggatctctgccttggaggaactctggcacctgagcttgtgaaacttgtcaacataaagtccattattttgcggaacaactctttctctgggaccatccctgaaggatttgtacagttaaaagaactggaggttttggatttgggatacaacaacttcagtggacatctacctgctgatctagggagtaatatctcactaacaatccttttgctggataacaatgaatttcttgttggtttatctcccgaaataaatgaactgaggatgctttccgaatgtcaagtagatgaaaatcagctgactaatgctgctaaaatgccagcttgtacagaaagagctaccacaaggcatattggtcaaggtaaaggtactcgtcgctcacaacattctaatacttctcctgctgctaatcattaccagtttaatcgtgtggctgctccacctcttgagagcccttcttctccttctgcttccccatcaggctcagcaaaaccaccagtgccaaagctagctcctcataggaaaaatgcttctgattcttctcctccccactctacatcaggttctggaacactatctaaaactaaaagcacctcatcaaaggttcatacagttcctattttggctggagttataggtggtgctgtgtttcttattttttcaagcattggcatatatctttgtaaaacaaaggtagctaatgtcagaccttgggccatgggactaagtggacagcttcagaaggcatttgtaactggtgcgcaaaagttaaagagatcagatcttgaagcagcatgtgaagattttagcaatgtaattggtaattcacccattggtatactgtacaaaggaactttgtctggtggcgttgaaatagctgtagcttttgtttccataacatcatccaagaattggtcaaaaactttagaagctcaatttagaagcaagatagataaattgtcgaaagtgaaccacaagaattttgtgaatcttattggatactgtgaagaagaggagcctttcaccagaatgttggtttttgaatatgccccaaacggaacactatttgagcatctacacataaaagaggctgagcacttggattggggaacaagacttagagttgcaacgggtgtggcttattgcctgcaacatatgcaccaattagatcctcctatggccctaatcaagctgaattcttcagccgtttacctcaccgatgactacgctgccaaactctcagatttaagtttctccaatgacatagcctcagctgagacaagagctatggacaagccactagcaactccagaaagtaatgtttatagcttgggtgttctactatttgaaatggtcacgggtcgtcttccttattcagtagaacataaggattcacttgaaaactgggcatcacactatttagaagttgaccaacccctcaaagaaatagtggatccaattctagtatcttaccaagaagatcagctggaacaagttgcatcattgattacatcttgtgtccaccctgatccacagaagagaccaacaatgaaagatgtgagtgagagactgagagagataacaaaaataacacctgaatctgcggttccaaaactttctccactttggtgggcagagattgagattgcatctgcagaagcacgttga

SEQ ID NO: 10913 - DNA, 357 bp, Glycine max
  Peptide Sequence Number=SeqID_127691
atgggggataagcttcatcgtcgagagggaaacagcccggatcaccagctaaggcccctaaatgaccgctcagtgataaaggagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggccgaagggcgtagtcgatggacaacaggtgaatattcctgtactaccctttgttggtcccgagggacggaggaggctaggttag

SEQ ID NO: 10914 - DNA, 255 bp, Glycine max
  Peptide Sequence Number=SeqID_127692
atggaggcaccagtggaagtgtgcgaacccgcggaggttcggattgagttcgcattgaactgcaaatgtcgagccatgagctggcccaagccttggccccagaggcttaacagtaagcaaccaagcttacctactgattcagatgccaaggacagcaaacgctggtctgaatttgtttcagacgtttatgtgaatggtctttcaatgtcaagtgttcaaaatgtaatggacatgaatgctggttatgcaagtaaa

SEQ ID NO: 10915 - DNA, 810 bp, Glycine max
  Peptide Sequence Number=SeqID_127693
atggctgcgacaatgcacgcaaagattaaccgaagaaagctagacaagctcaacatcatcaaaatttgcgaagagattctaaacccatcgattcctatggctcttagactttctggaattctgatgggtgcacactcgctctctttgatgctctgtgatcttcaatctcattttccatttcaattaattggtagaaatgttgagataaacgaagcctggaaagtaaagactgctccagatcctacattgctccccaagtccaaatccaaggccaaaaaagaggctgttactctgccagggaccggtgaaacgaacatggaagatattgaacagtcccttcagttttccaacacaggcaccacaacaggattccaacataacgcctattttactatgcgacttgataatgtggatgaacccttcactaataatggagcaagagaggaccaagatcaatcagaacttctccatcaagttgacgcagagaatattaccttatttgaacgctttgaaacgttccaagctaacacggatacatacaatcgctttgagaggtttgatattgaagaagatgaggaaacacaggtaaatgtaacttcaggagatcaaattctaaccacgcttgtaccctccccacctcatcaagacgaacccaccaaagcttatatcaatactgggtttttgacgcaagatagtactgtaccatccagaccaaactcagtcatgacccaacctcagtatgatttgacaactccatcaaattccattcctcctcataacttagaagcttggaaatttgtgttggattga

SEQ ID NO: 10916 - DNA, 1176 bp, Glycine max
  Peptide Sequence Number=SeqID_127694
atgaccaaccgaagtgcaatgcaacaggaacctagaaggcgaggaccaaataaaaggaaaagaggacaaccatcggctattgaaatggattatgagcaaaccattattcctgctcacatatatcaacactggcttcagaatgcttctgacattgtctcgcgaaggggaagaaggaaaaagctaggcaccgaagagacagatcatcaaaatgatgttatgtcttcaacaaagatagccagcctcatgaagctgccacccgttgtacaaattgatgatttatttactgctgtaaatgacaatatatattatccaaaacctattcttgacttatggattaagagcattcaaccacctcatgattcaccttcaggtcagcatagagtctctctctggggtgcctggggggtgttaaaatggaggaaatgttgcttacttctgataaaatgtacaaatgtgaagccttctgaagattttgacggtaggccagactaccaggcacctccaatggagaaggctcgggaacatatcctcatggatgaactgacagctagccttttgagagggcatgaagctactcctcaggtctcatctgggaaagctggaggcagtgtacattcctttccaagaccgacgtctgaaaatggtcctgcctcacattcagattttgattcgggaagaactgttcacagattcaaaaataaaaggtattcatcatctgcaaacagcagtggaggccttgagccactagctgaagatgtaaatttcaagttagctagactgtatgaagatggtcccacacctgatcaaggcttctctagtattagaagcagccttgctgtgatggtatattctttatccactcatagcacatacatcagtctcgtaagtttcttttcagaactcctcgtggaaacaggacccactcaaacacaagtaaacatcaatcatcctagtgacaagataaccgattccatccaagcgcagatgaaggcacattttgacacgcctggagctcctccagtggaatcccttcatatcctagctgctggaatgacacggacatcagcagcacaacttttctatcaaatttgtgttcttgcttcccgcgatgcgttgaaggttgaccaaaaggtgccctacggagagattctcttctctagaggattaagaatgtga

SEQ ID NO: 10917 - DNA, 1824 bp, Glycine max
  Peptide Sequence Number=SeqID_127695
atggcaattttagctgaaaatttcttcaaggagagaaaataccctttcattctcactctcttaatcttgctcatttgcgtcacgctcttcctcttcagcttcaaccacaccacctcaaacgccgttgctttctattctgttatccaagagaaaccaccccttaacccttcccaagcatctgctgattatactgcaaatccaaaagaacaagagcttccaccaaacatgaccaatgtgaggttcgattggaagctatgtgaagaaccgcagaatgttgattttattccctgtttggataattttaaggcgattaaggctcttaagtcgagaaggcacatggagcacagggaaaggcattgtcctgagacaagtctgcattgtttgcttccccttcccaaagggtataaagtcccagtcccatggcccaagagcagggacaagatttggtatgataacgtcccttattcaaagctggtggagtacaagaaagaccaacactgggtagtgaagtctgggaaatatctggtctttccaggtggtggtactcagttcaaagatggggttgatcattatattaagttcttagagaagacattacctgcaattaagtggggaaagcatatcagggttgttctagatgttggctgtggtgttgctagctttggtggctatctgctggacaaaaatgttattactatgtcatttgccccaaaagatgaacatgaagctcagatacaatttgctttggaaagaggaattcctgcaacactttctgtcattggaacacaaaagttgacttttcctgataatgggtttgatttgatccattgtgcacgatgcagggttcactgggatgcagatggtgggaagcccttatatgagctcaataggattcttagaccaggcggtttctttgcatggtctgcaacaccagtttaccgtgatgatgaaagagatcagaaagtatggaatgccatggtggatataacaaaagccatgtgctggaaggttgtggctaagggtcatgattcatctggaattggacttgttatataccaaaagccaacctcatcttcttgctatgagaaacgtgaagggaacaatccacctttatgtgaaaataaggatggcaaaaatagctcatggtatgccagactggatagttgtcttactcctcttccggttgatggtatgggtaacctgcagagctggcccaagccttggccccagaggcttaccagtaagccacctagcttacctactgattcagatgccaaggacaagttcttcaaggacagcaaacgctggtctgaattagtttcagacttttatatgaatggtctttcaataaaatggtcaagtgttcgaaatgtaatggacatgaatgctggttatgcaggatttgccacagctctcattgatctaccagtttgggtgatgaatgtagtaccgattgatgtgccagatactctttctattataatggacagagggtttataggaatgtatcatgattggtgcgagtcctttaacacctatcctcgcacttacgatcttcttcattctagttttcttttcaaatatcttgagcaaagatatatgaatctgataatgaacatttttttggtcagatgtgacattgtagatgtggctgtggagattgatcgcatattgagaccaaatggatatcttgtggttcaagattctatggaaatacttaacaagctcatttcaatcttgcgttcacttcactggtctgtaacgttgcatcaaaatcagtttcttgtaggtagaaaaggtttatggcgtcctaagggctcttga

SEQ ID NO: 10918 - DNA, 3267 bp, Glycine max
  Peptide Sequence Number=SeqID_127696
atgaatgaagcttcgattaatagcgcagaaagctacttatatctccacccgagcgagaaccctgctatagcccttgtctctccagtcttagactcaaccaattaccactcatggagtagatccatggtcaccgcgctaagtgccaagaataaggtggaattcatagacgggagtgcacctgaaccgctgaagacggacagaacctatggggcttggcgccggtgcaacaatatggtcgtgtcatggctagttcactcggtggccacctccatacggcaaagtatcctctggatggacaaagccgaggagatttggcgtgacctgaagtccagatattcgcaaggagaccttcttcgaatctccgatcttcaacaagaggcgtctacgatgaaacaagggaccctctcagtcacggaatacttcacccacccgactcaatctgctcgtgcaatatcagatgttcctgtagtgccttcaccatcatcgcacagcgcaagcttgaagatagggccatgcaattcctacgagcaagaaaggcaattgttaggcaacacaagtccaagtatcaacttcgaacccaaagatgcctccatcaacgcggcgaaaaccatctgcgacttctgcggacgtgttggtcatgtagaaagcgtttgctataaaaagcatgggatacctgcaacttatgacggaaggaacaagagcaacaatggaaggaaaacttgcacacactgtggcaagatcggacacacagtggacgtttgctatcgtaaacacggatatccgccgggttataaaccgttcggaggaaaaaccaccgtgaacaacataatggcagtggaaggaagaaccaccgatgatcatgctcagcaacacgagtcacaagatattgttcacttctcccctgagcagtataaggcattactggccttaatccaacagccacaggcaggaaactcgacgactaatcaacccaaacaggtggcgtcaatgacctcaagcactatcaatacatcactaagcccaggagcaacggaccatgtcacttgctctctacataatctacattcatacacaaaaatcgacccaatcacggtgaaacttcctaacggccatcacgttcacgccactcactcaggaacagaaacgaacaaccatgtgaagattggtatagttgaagcaaggcatggcttatatcacctgataccaaaccaaatacccactaaagctgcaaactcgatcatcactcaccctcagtgcaataccatccccatagacctatggcattttagaatgggacatccatcgactgagagattacaattatctagaaatgttactttttacgaaaatcattttccacaattgcctgaaactcaaccttcgaacagaaataactcagcgccatcaccgatacccttttccggcaaagaacttcacccaccggaagagacacaaatcccccaaacctcaataccaacacatccgccttgtaatgatcatttaagagaacaagctccttcacaatctaggcgttcaacacgatcaaaacgttccccagcctatctccaagactatcacagaagccttgcttcgactacatcaacggcttcaatggttgttcgctatcctctaagctcggtactttcatactcacggctgtcacctgcacatagaaattttgtaatgactatatcctcagccatagaacctgtgacatacgtcgaagcttctcgccatgactgttggattaaagctatgacggccgaattacaagctttacaaatgaacaatacttggagactcatgcctcttcctcctcacaaaacagctatcggatgtcgctggatatataagatcaaatatcgagccgatgggtccatagaaagatacaaggcacgcctggttgccaagggttacactcaaacggaggggttggactaccttgacaccttttctccggtagcaaaactcacctccgtacgagttcttctagctttggccgcactcaacaaatggcacctgcggcaactggacgtcaacaacgcgtttctccatggggaccttgaagaagaggtatatatgcaagttcccccgggacttccagttgataacccgcagctggtctgtcgtcttcaacgttccctctacggccttaagcaagccagccggcaatggttcacgaagttgtcaagcttcctcacctcccatggcttccaacgatctgattcggatcattctcttttcttgcgcataaccggctccactattaccatcctcttagtgtatgtagacgacataattcttacagggaacagcttgacggagatacaggctataaccactcttttggaccaagagtttcgaattaaagaccttgggaacttgaagttctttctggggctggagattgctcgaacctctaaaggaattcatctatgccagcgtaagtatgtattagatatcttatctgaatcaggcatgttgggttgcaagccgcattcaacgccaatggattattcagtaaaactacaaaagagctcgggtaaccctcttccgaacgagtcttcttcctcttatcgaagattaatagggaagctcatatatctgaccaacacgcgtccagatattgcctacgcagtccagcaactcagtcaatatatgtccgctcctacaactgctcaccttcaggccgcttttcgtgtactacgatacctcaaaggcacaccagggtctgggctctttttcgcagcaacaggaacgccccaactccgagctttcagtgtctcggattgggcaggatgcaaagattctcgaaaatccaccacagggttccttgtgtatctaggctcttccctcgtttcatggcagtcgaagaaacaatccaccgtctcccgcagctcctccgaagctgagtatcgcgctcttgcatccacaacctgtgaacttcaatggctgacatatcttcttcaggatcttcgcgtaacattcgttcaaccagctactttgtactgtgacaatcagtccgcaattcaaatagcaacgaatcctgtattccatgaacgcaccaagcatattgaaatcgactgtcaccttgttcgtaacaaagtcacttcagggttcatcaagcttcttcccgtatcgtccagtctgcaactcgcggatatctttactaaacccttgaccccggtagttttccagcatctttgtaacaagctgggaatgatcaacatacattcccagcttgaggggggcgtgttaacagtataa

SEQ ID NO: 10919 - DNA, 1779 bp, Glycine max
  Peptide Sequence Number=SeqID_127697
atgaccaccaccttcctctgctccttactcttcctcttgatgacaaccttatcagagtcccaaccagaccgtttcatgagacgcaaaccccttagtggttctcaacaagaatacttcgaagtgagttaccctccaaactcacacgaacccacaacaccttcatgcacccaccgaataatccaccacgccttcgccaacaccatcgattctccaccgtacaccacctcttacacaccgcccccgcggtgcggggcaccgtggtctcgggtggtcctccacttccacgcgcggtgcaagggcgagcagtacgaccgcatcgccgccatctggctcgccggcgccgagatcctccgcaccagcaccgccgagcccagccccgccggcatcttctggaacgtccgcaaggacgtcaccaaatactccgccctcctcgccaagcccaaccaagacctcaccatgatgctcgaaaacatcgtcaataacgaattcaccggtgtctaccacgtcaccgtcactcttttgttctacaacaagtacgccgttagggctcccgttagggttccgtttgtcccgtgccccgaggcactcaattttgatccaattcaatcgagatcacgatctcgatctcttgttcaggaaccgggctccagaggcgtgaacgaatcaccggcggatttgattattccgatctccgacgacggacggcgagggttctggttcaaattggaggaagaaaaaggttcttgttcccggagaattcgaattccgaggaacacttaccgcgcggtgcttgagttatacgtttctttccacggaaacgacgagttttggtactccaacccgccgaattcgtacatcacggcgaacggtttagaaacggagcgtggtaacggcgcgtacagggaagtgtacgtgacgatcgacggccaggttgttggatgggagattccgtttccggtgatcttcaccggcgggataaaccctctgttctgggaaccaatggtggcgattggggcctttgaccttccctcatacgacatcgatttgacgccgtttttggggaaggttttggacgggaaagagcacgtctttggaattggggtggtgaagggaatctcttactggcttctgaacgcaaatttgcatctttggttggatcatgaatccacggtggttcatgcaaaccctgtggttcatcacagtcctgaaacttcaatcgaacggcaagaggactttaaagggcttgatggggcctttggtgtggacgcagagaaggaaacgcagatcacagggtgggttatgaccagtgttggcaacatcaccaccactgtttctcagggcttctcgtttaagaactccataaagtttcaacacaacgggagtatcaagaccgttaagcagaagttcaaggccaagaagaaagttaaggtgatcgatggaaaaggcgaatcgattactaggttgaaggttaggaggaggtaccctttaagggttgtcacaaacactaagcagtttcgggatgggacttataggcttatcactgatctttctcacactcttaaggagaagcatgtgagtgggtgcttcgtcaaatcgattagtaatgagcagaattcaaaggggtggatccaggttaagggtcactctgttgtttcgggtcaagcaagcacctcccagaattacagttactttgataggttcacttgctactcaaggaatgttgctgcgactaatggcagggttgttgcggacaattcaacttttgtctgtgaattgtga

SEQ ID NO: 10920 - DNA, 183 bp, Glycine max
  Peptide Sequence Number=SeqID_127698
atgatgacaattgttggaagtaatgggaatgatcatgccataacaatgcgggatgagaatgatgactataacaatggtggtgtcggtggtggcaacgatggtggtgagggtggaatattgatgcaacaatgcagtggtagtgacaatgataatgttagaatggtgatggtgacaacaacataa

SEQ ID NO: 10921 - DNA, 537 bp, Glycine max
  Peptide Sequence Number=SeqID_127699
atgaatttgctacgcgtgcatgctgcgctaaacgaacttgctaagtgcgcctactgggctaagcgagttcatcttttggggaagaacattcatcttcctgaggagatggcgtctagaaagcgtaagagcattggggcaaggccaattgctcagtatgatactagacgattccattcgcttgatgcttggaaccgttatacagataatgtcttaggaaggagaattttaccaaagaggaaggttgagatataccacacagagtttgatgacttcaagacagagttggagaggcgtaatcttcacaaacgcctcaccaacttggctgatgggactattgatgttgctttcgtgaaagaattctatgctaatctctacagctctgaggatccttcaccaaagcaagccagagttagaggccacttggtgaagatagacgtcgatagcctcaacacatttctagagactccggtagtcctagaggagggggagacattacccacctactctaggtactacaagttacccacaaaccactga

SEQ ID NO: 10922 - DNA, 744 bp, Glycine max
  Peptide Sequence Number=SeqID_127700
atgttcacggaacaggacttccatttcccgcccggtgaggtggaagcacgcctatataagttgcagctggtgtttcgctttcgcgcgcagggcgatgagcatgaagcgctgtttgcgccgttctggcagcaggatgacgcggggcgctatctgcgcttcagtacgctggcgacgcgccagggtaacgaggtcaaaacccgctggcgctttattgacgcgcgtggcgaggtgctgccgctggcgggcaccgacgccgcgctggcgcaattgcgcgcgtactatccggtgctgcgcctgcgtgatgcgcgctttggccggcggtcgcgccataacgacaacgacacccagcggcgcgctgatacgctgagcgcgctggcgcaggagatgcatagcctgacgcgcgatctggtggcgcggccgcaaaccctgagcgacgagctgttgcgccagggattgcataccatgcagcagctgatggcgcactattttctggtacagcaaccggacacgggcgccgcgcgggttgcgccggagctgcgtgacggcagtcagggctggcgttcgctcgatcagctcaatcagctgatcgccggcgcacggcagcgatgcgctgccagcgggcgcgcgccccttgctgctggtggaggatccggaaacgcggctgcatcccatcatgctgtcggtggcgtggaatctgctggcgctgatgccgctgcaaaaaatcgccaccacgaactccggtga

SEQ ID NO: 10923 - DNA, 321 bp, Glycine max
  Peptide Sequence Number=SeqID_127701
gagcaacaagctgagtgggagcaacaagctgagtgggtaaacgcgcagagacagattctgcgccctttgtcattcaggagcaataagctgagtgggagcagcgaggcgggtgataaacgcgcagagacaaattctgcgccccttgtcattcagatttcgcaagttgggctcgatcacgtccaaagacacgcagagataaattatggtcattctgcgcctggtgtcaaccaggaggaaagcattgttgcacaacccgtgaatttccgtgacatgccagaagtcaaaaggaaatgtaaatgcacaatccgtaaagttccgtaa

SEQ ID NO: 10924 - DNA, 549 bp, Glycine max
  Peptide Sequence Number=SeqID_127702
atgatattggggaatctcattgctattacccaaacaagcatgaaacgtatgcttgcgtattcgtccataggtcaaatcggatatgtaattattggaataattgttggagactcaaatggtggatatgcaagcatgataacttatatgctgttctatatctcgatgaatctaggaacttttgcttgcattgtatcatttggtctacgtaccggaactgataacattcgagattatgcaggattatacacgaaagatccttatttggctctctctttagccctatgtctcttatccttaggaggtcttcctccactatcaggcaggcttatatttcttagtttcaataggactccttacgagtgttgtttctatctactattatttaaaaataatcaagttattaatgactggacgaaaccaagaaataactcctcacgtgcgaaattatcgaaggccccctttaagatcaaacaattccatcgaattaagtatgattgtatgtgtgatagcatctactataccaggaatatcaatgaaccctattattga

SEQ ID NO: 10925 - DNA, 504 bp, Glycine max
  Peptide Sequence Number=SeqID_127703
atgtcttccagaaaaagaaagagcattggtgcaaggcccacaactcaatatgacacaagaagattccactccttcgaggcctggaccagatacacagataatgtgctaggaagacatttactagctgagaggaaggtagaaatataccatatggagttggatgagttcaaggctgaattggagaggcataacttccacaagcacctcaccaatttagctgatagcaacatcgacctagccttggtgaaggagttttatgccaacctctacagtcccaaggggcctttaccaaaacaagtcagaattcaaggccacttgataaaaattgatgcagacaacctcaacaccttcctggagacacctgtggtactggctgagggagaatccttacccgcttactctagatactgtagaatgcccattgatatcaaagagattgaggctgctttgtgtatacccggccgagggtttggagtgttctctcatactccaacctgtctctga

SEQ ID NO: 10926 - DNA, 1108 bp, Glycine max
  Peptide Sequence Number=SeqID_127704
atcgctggtgtagaacagcgcaataatcacgatggcaccgagatcgtcaatgatggccagcgccatcaggaacactttcagcgccgccggtacgcgactgccgagcagcgccagcacgccgagcgcaaaggcgatatcggtggccgtgggaattgcccagccgttgcgggcaacctcgttatcatgattgaacagcaggaaaatgagcgccggcgcaatcatgccgcccagcgcagcaatcaccgggaagatcgcacgatcgcggctggccagctcgccgctgatcagttcgcgcttcacttcgaggccaatcagcagaaagaacagcgccatcagcgcatcgttaatccacagcagcaggtttttgctgatatccagcgcgccgaagcgaatctgtaccggctccgccagcaggttttgatagccctgcgcggtggcggcattattggccagcaccatcgccgccaccgccgccagaatcagcaccatgccgttgctggcgtcactttcgataaagcttttcagcaagcttcgaatactacggggccgggcgtattgcagcggagggaggggctgaaagcggacggacgcaatacggcgctggtcgctaagcaggtagcgcgccgtcaggcctggtggccgcctggcggtgagaaaggctcagccatctgggcacttgccagcgcggaaaacgccacaagcgctgttgaaagtaacaacgtttaccgcacgatttatgcattatccgactttgaccggaatgtaaaaggtgccctgcagcagatccggcgtgctgtagcggagatcgagcttaatcaggtccttgcccggccgccgcgccacgccgagcgcaggcagatggttgtagtacacctctgcggtgaacgcattgatctcttccggcgcgccgtgccagtcaatctccgcatacagtccgctttcaccggtccagttctgtacattgccggtcagcacgtcggcgtactggctctccagcgcctgaaacaggctgatatgctgctgatcgctggagttgacgcccggactgaactggaaaccgagccagccacgctgcacatgctgaccagcgaaagcgatgaaatcacgc

SEQ ID NO: 10927 - DNA, 273 bp, Glycine max
  Peptide Sequence Number=SeqID_127705
atgtgggacatccccttttcctcccttggaaaatgcacccgtgagtctcacgtcgccctcctgccgaagggtgtagcttattcagatgatgaggggtctacagatttgaggacaaatcctcttcaagagggaggggatgatgcaatcctcccaaggaggggacccatcaccagagccatggctaggagacttcgagaggataggaccagagatgcaaaagaaggccctaagattctcatgagccttaggatagattttaggcccatgagctaa

SEQ ID NO: 10928 - DNA, 318 bp, Glycine max
  Peptide Sequence Number=SeqID_127706
atgggatttgcagattttcgcccccaggccaccatttttgcgcttttgcttccattcttagtgtttttggtcactccatacaagaaatggctccgaaaaagctttccacgaagaggtctagaagagatgccacagcggaagggtccagtgccacccccaagtttgatagtcactgtttccgaagcgccgagcaccaacagcgcttctaggccatcaaaggatggtcgttccacagagataggcacgtccagctcagggaggatgagtatacggactttcaggaggagacagctcgcagacattagacgttgctggtga

SEQ ID NO: 10929 - DNA, 156 bp, Glycine max
  Peptide Sequence Number=SeqID_127707
atggccggtgtcggtccttatatggccccaacttatatctttcagccgaagttgcgcaatttcttttacaaacgctggccgtcggctaggtttttccgtgcgagctcaaccgagggttcgttccgacagacatggcatgttgttcttctcatttag

SEQ ID NO: 10930 - DNA, 867 bp, Glycine max
  Peptide Sequence Number=SeqID_127708
atgcacgccctcgccttcagaggactacatgtccttgcatttagaaggctacacgccttcgccttcagaggactacaagtcctcacctttagagggctacacggcctcaccttcagaggactacacgtcctcacctttagagagctacacgccctcgccttcagaggaccacacgtcctcgccttcagagggctacaagccctcgccttcagagggctacacaccctcgccttcagagggctacatgccctcacctttagaggactacacgtcctcaccttcagagggctgcacgccctagccctcagagggctacacgccctcgccttcagagggctgcacgcccttaccttcagagggctgctcgccctcacctttagaggactagacatcctcgcattcagaggacaatacatctcaccttcagaggactacacaggactacacgacctcgccttcaaagggctacacgccctccccttcagaggactacatgtgctcgccttcaaagggctacacgtcctcgcctttaaagggctacacgccctcaccttcagaggattacacgtcctcatcttcagaggactacacggccgcaccttcaaagggatactcgccctagccttcagaggactacacgtcctcgccttcagaggagtacacgtcctcccctacagaggactacaagttcttgccatcagatggctacacatcctcacctttagaggactacacgtcctcaccttcagagggctacacgccctcgccttcagaggactacacgtcctcccctttagaggactacacgtcctcgccttgaggactacacgtcctcgccttcagaggactacacatcctcaactttag

SEQ ID NO: 10931 - DNA, 579 bp, Glycine max
  Peptide Sequence Number=SeqID_127709
atggttgccttcattaggcagtatcagtacaattctgatatggctctagatagaatgcagctacaaaacatgtgtaagaaggagggtgaatctttcaaagaatacatccaaaggtggagagatttggcagctcaagtagggctcccaatgatggagagagagatgataacaatgatagtagacacgttaccggtgttctactatgtgaagatggtgggttacatgccttcaagctttgctgatttggttttcaccggcaaaaggatcgaagttcgtctgagaagaggaaaatttgattatcttgctttgatgaatgagaaacctggggcaaatagagagagtaagaatgagggaggaacccatgctatgattgccattcctacatggccaaatttcccaccagctcaacaatatcaatactcagccaatatcaacccttctcattacccaccaccctatcagccaagaacactcaatcatccaaaaaggccacccctaaatcagccacaaagccaccccaaacaccacccttcacacaaatcaaaacaccaaccaggaaaggaattttctagaaaataa

SEQ ID NO: 10932 - DNA, 2721 bp, Glycine max
  Peptide Sequence Number=SeqID_127710
atggagaaattgcaagaaattgcagtgtccttggctgttgattatttgcttccacccttaaagaaagcagtgaattcagtcatggaggttccaaaagatgctgcagacatgaaagacaaacttgatgggattcaagccatgattcatgatgtggacaagatggcagcagctgaagaaggcaactcacgtgatggtctcaaagcaaaggtgaagcagctggtggaaacatctttttgcatggaagatctcgttgatgaatacattatccatgaggaaaggcagcttgctgatgatcctggatgtgcatctttacattgtaaggctattgatttcgtcaaaactacggcctctcgtcttcaatttgcatacatgaaccaggacgtgaaatcagaatttcgtgggatcaaggagaggaacaaaagtgaggattgctaccaaattcattcttctggaggaccccaaaacatcacgtttgacaaccttcgaatggctcctatgtttcttaaggaggctgaggttgtgggctttgacagccctagagacacattggaaagatggttgaaagaggggccggaaaagctcactgttgtctctgtggtaggaatgggaggaagtggaaaaactactcttgccaagaaagtttttgacaaagtccagacacacttcactcgccatgtctggatcacagtgtctcagtcatacaccatagaaggattgctgctcaagtttctggaagcgctgctcaagtttctggaagcagaaaaaggaaaggatccttctcagagtgtttattctacaatggataaagcatcgttgatacatgaggtgagaaatcacttgagctgcaatatttatgttgtcgtgtttgatgacgtgtggaatgaaaatttttgggaggaaatgaaatttgctttagttgatgttgaaaatggaagtaggataataatcacaaccaggcaccgtgaggttgcagagtcttgtaggacatcttctcttgttcaagtgcatgagttgcaacctttaactgatgacaaatctttcgaattgttttgtaaaatggcatttggatctgaattagatgggcattgtccaaacaatcttaagggcatatcaactgaaattgttaaaaagtgtgaaggtttaccactagctattgtggccactggtggccttttatctcgcaaaagtagagatgcacgtgaatggcaaagatttagtgagaatctaagttcagaattaggaaagcatcccaaattaactcccgtgacaaagattttgggtttaagttattatgatttgccttaccatctcaaaccatgcttcttgtatttcggaatatatccggaagattatgaagttgagtgcgggagattgattctgcaatgggtagctgaggggtttgtcaaatctgatgaagcgtcacagactttagaagaagtggcagaaaaatatttgaatgagttgatccgaagaagtttggttcaagtatcttcatttacaaagtgtggcaaaattaaaaggtgtcgtgttcatgacgtagtacgtgaaatgatccgtgagaagaatcaagatttaagcttttgccattctgctagtgagcgtgggaacttgtccaaaagtgggatgattcgtcacctaacaatagtagcatctggttccaacaattctacgggaagtgttgaaagctcgaacattcgatcacttcatgttttcagtgatgaagaattgtcagaatccttggtgaagagtatgcctacaaagtacatgttattaagggtacttcaatttgaatgtgctccaatgtatgattatgttccgcccattgaaagtttgggggatttatcatttttgaggtacttaagcttcagatgttcaaacatagttcatcttccaaaattaattggtgagctgcacaacctagaaacattggatctaagacaaactcgtgtgtgtatgatgccaagagagatctacaagcttaagaagttaagacaccttctgaataaatatgggtttctaatggatagtggcattggagatctaacatccctacaaacactacgtggagtggacataagctataatacagaagaagtagtaaaagggttggaaaaacttacacaattaagggtgttgggcttgagaaaagttgagtcaagattcaaaagttttctgtgctccttgataaacaagatgcaacacctggagaagttatatatttctgcagatggagatgggaacctggatttgaattttgatgtatttgcacctgtacttcagaaggttcgtcttagggggcagttaaaggagttaccaaactgggttggcaagctccaaaatcttgttacgctgtccttgttttccacgcggttgacacatgatccattgccactacttaaagatctaccaattttgacgcaccttagtatcaattatgcatacgatggtgaagttttgcagtttccaaacagggggtttccgaacctaaagcaaatactactgttacatttgtttccattgaaatccatcgttattgaagatggagcattgccttctctcgaaaagctcaagttaaaatttattcgctatctgacagaggtgcctcgtggtattgacaagttaccaaagcttaaggttttccattgtgttgatatgtcagatgaatttaaagaaagctttaatctcaacagaggacaacgtcgtcaatggataatagaatga

SEQ ID NO: 10933 - DNA, 336 bp, Glycine max
  Peptide Sequence Number=SeqID_127711
gataaagctactggacttgaagcagaaaatgcattagatgcagatgatatcatgagcaaagaaataaatgaagaggaagcaattcatagtgtgagttttgacttagagggatcaagttccgccacaagaaaaaacaatcgcccaagtaagagtggagagaaagaagggaagatttcctcaatgaaagaagtagtcgagtcgttgaaagaatttgttgaagtgactaagaagaagatggagaacaaaaaaaagatggagataaaaaaagctcaagaagtggtacatgaagtggtgagtgtgctaaataatatacctaattttaatggtgcactttga

SEQ ID NO: 10934 - DNA, 520 bp, Glycine max
  Peptide Sequence Number=SeqID_127712
atggcggaaccatcgaaaaagcagaaaggaacttcgagtcggagtcagcggcattccgggtcacaagaagctccaattcctccctccattccctctgggtcattattctcatcagaggaacagcgtacacggtacacaaacctcttttcctctcgttccattgtagacccaaaattcatagatatggagttcttctctaatgagaattttgaatgcttccaagcatttgaaaactccaatcttattccattcatgtctctgaaattacctgtctattctgagttagttaaagctttttattcaaatttagaaattcatgaagatgttctaatgtatgaaatctatgggattaagatggtcattgaccaatccctattctatgatttaacaaaattgcctagtgaaggtgtgccttttgagggtgcactgattgatgaatggaaattcgatttctctgagcatgatgcccgccggttggtttgcaccaaccaagcggatatgaccggaagacttcttgccg

SEQ ID NO: 10935 - DNA, 600 bp, Glycine max
  Peptide Sequence Number=SeqID_127713
atggcaaaagaatcctcgtattcccccgaagatagattattacgagctatacttggcattcagaaacgtgaaattaaagtaggagataaagtggctgggagacatggaaataaaggtatcgtttcaaaaattttgtctagacaggatatgccttatttgcaagatggaagacccgttgatatggtcttcaatccactaggggtaccttcacgaatgaatgtaggacaaatatttgaatgctcgctcgggttagcaggaggtatgctagaaagacattatcgaataacaccttttgatgagagatatgaacaagaagcttcgagaaaactagtgttttctgaattatatgaagccagtaaacaaacatctaatccatggatatttgaacccgagtatccaggaaaaagcaaaatctttgatggaagaacagggaattcttttaaacagcctgctataatgggaaaaccttatattttgaaattaattcatcaagttgatgataaaatacatggacgttccagtggacattatgcacttgttacacaacaaccacttagaggaagggccaagcagggaggacaacgggtaggcgaaatggag

SEQ ID NO: 10936 - DNA, 279 bp, Glycine max
  Peptide Sequence Number=SeqID_127714
atggctatgcaaccagctcagttggccgagcttcaaccgccccaaggtgggttttctcctaaaaataggcatgctagggggggtttaaggggttcaaagggtcagcacttgagagaattgagagagaagaagaagaaagagagaaagaagaaaaagaaagaagaggaaaggaagccgaggcgctaccgaatcacgacggtgatcattctctacgtcatttcttgttctgtgttcttcatgcgacagtcgttaagttttgtttttaaggatttaatgtaa

SEQ ID NO: 10937 - DNA, 399 bp, Glycine max
  Peptide Sequence Number=SeqID_127715
atgattgaaaatcacgtcaacatggtacctaatgcattgttaactaggaaaggatggaaacaatgcgttttacggtgcccttatcgaacacgtgccaaagctagagtgatgagcgaaatagaggaggtgcaagagcatatgaccacaatgatggaagccatgatgagtatgaaaaaaatgatggaggtcaacacggatgcaatcgtttccgcaagtaccgccactgaggaggacccgactcacccatctggcctcaatcaagtccctcaacccatgggggagacacatgaagtaccgcgagaccgcactctagtcgacttcgagcctcacctcggatatgccactagggggcaagcatttggtgtcgtacccttgccaaacactttggggggcccttag

SEQ ID NO: 10938 - DNA, 486 bp, Glycine max
  Peptide Sequence Number=SeqID_127716
atggaaaaacactcagttagagtcttcaactcttacttgaaaaaggcccataatgtcacactctcgtttccctcaaaagagcgggataagaggaaaagtggggtatccacattcgttaacttcattcatcaaaaggacgcgcaaattgctatgtctattgccttctatgagaactcatataatatacctctgtacacagttcacgacaacttcataacaaatatacattattgtaaatatatatctaaaatctatctacatgtcataaaggaaatggggccccctcttaaaatcattaaccgctttatttataaaaatattatggagccggctatagcgaagggcctctataataatgtaaaaggctacaatttgaagtcttttgatgaaaggatcataccagagcctattttagatgagttcttaaaaattggactcatttctccagaagatgtcacgaatgcagctggtttagagatgccctga

SEQ ID NO: 10939 - DNA, 1367 bp, Glycine max
  Peptide Sequence Number=SeqID_127717
acgcaaccatagccaaactagtcctggaatcagacccacgcaccctctccgaagccctaaccaagcccagaatccactggaccccagagctagtaaacaaaacccttaagcgcctctggaaccacgggcccaaggccctcctattcttcaaacacctcgaccgccacctcccttcctacacccactccccctcctccttcgaccacgccgtcgacatcgcggcccgcatgcgcgacttcaactccgcctgggccctcgtgggccgcatgcgctccctccgcctcggcccgtctcccaaaaccctcgctatcctcgccgagcgctacgcctccatcggcaagccccaccgcgccgtccgcaccttcctctccatgcacgagcacggcctccaccaagatctccactccttcaacaccctccttgacatcctctgcaaatcgaaccgcgtcgaaaccgctcacgacctcctcagaactctcaaatctaggttcagacccgacaccgttagttacaacattctcgcgaacggttattgcttgaaaaaacgcacgccgatggcgctgcgggttttgaaggagatggtacagcgtgggattgagcctacgatggtcacgtataacaccatgctgaaggggtattttaggagtaatcagattaaggaggcttgggagttttacttggagatgaagaagaggaagtgtgagattgatgttgtgtcttacaccactgtgattcacgggtttggagaggcgggtgaggttaagaaagcaaaaagggtttttgatgagatggtgaaggagggtgtggctcctaatgttgctacttacaatgctttgattcaggttttttgtaagaaggatagtgtgcagaacgcagtggcggtttttgaggagatggtgagggagggggtgtgttcgccgaatgtggttactttcaatgttgttatacgaggtttgtgtcatgttggggacatggagagggcgttggggtttatggagaggatgggggagcatggtttgagggctagtgttcagacttataatgttgtgattcggtatttttgtgatgctggggagattgagaagggtttggaggtgtttgggaagatgggggatgggttgtgtttgccgaatttggatacttataatgttctgattagtgcgatgtttgtgaggaagaaatcggaggatttggtggtggctgggaagttgttgatggagatggttgagagaggcttcttgccacgcaagtttacttttaatagggtgctaaatggacttgttattactggcaatcaggattttgcaaaggatatactcagaatgcagagcaggtgtggccgtgttgttcggcgtttgaaattgtga

SEQ ID NO: 10940 - DNA, 918 bp, Glycine max
  Peptide Sequence Number=SeqID_127718
atggaccagtacgagaaggtggagaagataggcgagggaacatacggcgtcgtttacaaggctcgcgaccgcgccaccaatgagacaatcgctctgaagaagattcgcctcgagcaggaggacgaaggcgttcccagcaccgccattcgcgagatttctcttctcaaagagatgcagcataggaacattgttaggttgcaggatgtagtgcacagtgagaagcgattgtatctggtttttgagtatctggacttggatctaaaaaaacacatggattcatctccagagtttgtgaaagatccgcggcaagtaaagatgttcctttatcaaattctctgtggcattgcttactgtcattcacatagagttcttcatcgagacttgaaaccacagaatttgttgatagatcgccgtactaattcactgaagcttgcagattttggattggctagggcatttggcattcctgtcaggacctttacacatgaggtggtgacattatggtacagagctccagaaatattgcttggatctcgtcattattctacgccagttgatgtttggtcagtgggatgcatatttgcagagatggtaaacagacgacctctattccctggggactctgagattgatgaattatttaaaatattcagaatcttgggtaccccaaatgaagacacatggcctggagtaacttcattgcctgatttcaaatcaacatttcccaaatggccatccaaggacttagcaaatgtggttccaaatcttgatgcagctggtcttaatcttctttctttcaactaccaccatcctcagtctctaaggctggggtgtggtgatgttttcaagaggttcaattctctactagattacctattacattcccattccacgtacttgcctccaatgtttccataa

SEQ ID NO: 10941 - DNA, 876 bp, Glycine max
  Peptide Sequence Number=SeqID_127719
atgggtgtgggccgcgacatagacgatctgcccaagaacaacgccaaccacactgccttgaccccgctatggttcttggaaagagcagctctcgtccaccccaccagaacttccgtggttcacggatcacggcactacacgtggcaccagacttaccagcgctgccgtcgattcgcttctgcactttctaaacattccatcggtctcggccacactgtggctgttattgcacccaacattccagccatttatgaagctcattttggaattccaatggcaggagctgtgttgaacaccattaacattcgtctaaacgcaccagcaatagctttccttcttgctcattcatccgccgtggccgtgatcgtggatcaagagttcttcaccgtggcggaagagtccttgaaaatctggtccgagaaaagcaaaagctttaagcctccaattttaattgtcataggtgatgatgaaaactgccaccccaaggctctcacacatgctttggccaaaggagccgttgagtacgagaaatttcttgaaagtggtgaccctgaattcaagtggaagcctcctcaggatgagtggcagagcattgctttgggttacacatcaggtaccactgctagtcctaagggtgtggtgttacaccaccgaggggcgtatctcatgtctctgagtggtgctcttcattggggaatgaatgaaggtgctgtgtatctgtggacacttcccatgtttcattgtaatggctggtgctatccttggacacttgctgctctttgtgggacaaatatttgtctccggcaggtaacagctaaggcagtatatgcagccattgccaaatacaaagtgactcatttctgtgcagcaccagtg

SEQ ID NO: 10942 - DNA, 234 bp, Glycine max
  Peptide Sequence Number=SeqID_127720
atgacctctatagcaacaggtacaatcctgggtgaaggaatcatcacaaccttagatggtcgaatccttcacaatagcagcaacaacaacaacaaccttatttctagaatgttgttggcccaagcaaactatacgttcctccaccaatccagcagcaacaacaacaacagcaacaaccccagaaacaacaaacagttgaggctcctccacaaccttcccttgaagaacttgtga

SEQ ID NO: 10943 - DNA, 863 bp, Glycine max
  Peptide Sequence Number=SeqID_127721
cctttagaggactacacatcctcaccttcagagggctacacgccctcgccgtcagaggactacacatcctcaccttaagaggactacacgtcttcaccttcagagggctacacaccctcgccgtcagaggactatatgtcctcacctccagaggactacacgtcctcaccttcagaggactacactttcactcctttagaggactacacgtcctcatcttcagagggatgcactccctcgccttcagaggactgcacgtccccatcttcagaggactacacgtcctcacctttagaggactacacgtcctcaccttcagagggctacactccctcgccttcagaggactacatgtcctcgccatcagaggattacacgtcctcgccatcagaggactagacgtcctcgcctttagagaactacacgtcctcgccatcagagggctgcacgccctcacctttagaggactacacgtcctcaccttcagaggactacacgtcctcaccttcagaggactacacgtcctcacctacatagggctacacgccctcacttttagaggactacacgtcctcatcttgatagactacacgccctcacctttagaggactacataggactacacgtcctcgcctttagaggacaacacgtcctcgccttcgccttcatagagctagatgccctcacctttagaggactacacgtcctcgccttcagaggactacatgtcctcacctttagaggactacgtgtcttcatcttcagaggactacatgtcctcacctttagagggctacacgtcctcgctttcagagggctccacatctgcaccttaagagaatttaaggtcctctacccttaa

SEQ ID NO: 10944 - DNA, 282 bp, Glycine max
  Peptide Sequence Number=SeqID_127722
atggggccgttcttcgacgttcttcgttcgttcttcatcgttcttcagtcttcaaccgttgttttgggtgaaaaaaattgtttccatgaagaaaatccaagccaaggtgctttggtaacgcttccgagacgtttccgtgagcaaatctgtgaaggttttccgtcgttctttactgttcttcgttcttctacggctttcatcttcattttgttcattttcggttttcttttcttccattttaaacgagctttaaccgatcgtttaagccgttatctcgcctaa

SEQ ID NO: 10945 - DNA, 276 bp, Glycine max
  Peptide Sequence Number=SeqID_127723
atggatttagctcgtaagaggaacaaagcgataggtgcgatagcagatagcagcgatagggaatttagcaattctcttcctagcaacctatttgggcaaagaaagcttaaaactcctagcacggggaagacggattatctgattctcgtgaatgtgacctccgcggaggttactagtatctcgaccatagggagagggctgaaagttggcaaaaaaatagggctatctctcgagctaagaacatcatcttccctctctgaaagatcagttcagtga

SEQ ID NO: 10946 - DNA, 168 bp, Glycine max
  Peptide Sequence Number=SeqID_127724
atggtgcttcccatagaagacaccaccctgttatgtactttcttttcaattgccttatcagtaaaaggtggtgccacactgaatttcacaggatcccgacgtgcagcggtcaaatcgcgggcagattggcgcaggcctgggggcgccagtcaaccaagtgccaagtga

SEQ ID NO: 10947 - DNA, 894 bp, Glycine max
  Peptide Sequence Number=SeqID_127725
gtctctttgtatgtgttgtctggaaagaggaggactcaatgattattcgttcaccggaaccagaagtgaaaattttggtagatagagatcccataaaaacttctttcgaggaatgggcaaaaccaggtcatttctcaagaacaatagctaagggacctgatactactacttggatctggaacctacatgctgacgctcatgattttgatagccatactaatgatttagaggagatttcccgaaaagtttttagtgcccatttcggccaactctctatcatctttctttggctgagtggcatgtattttcatggtgctcgtttttccaattatgaggcatggttaagtgatcctactcacattaggcctagtgctcaggtggtttggccaatagtgggccaagaaatattgaatggtgatgtagggggagggttccgaggaatacaaataacctccgccttaatgctttttgctggttggtttcattatcacaaagctgctccaaaattggcttggttccaagatgtagaatctatgttgaatcaccatttgacagggctcctggggttgggatctctttcttgggcaggacatcaaatacatgtatctttaccaattaaccaatttctaaatgctgcagtagatcccaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggaggtctatggctgaccgatattatacaccatcatttagctattgcaattcttttcttgatagcgggtcacatgtataggactaactggg

SEQ ID NO: 10948 - DNA, 249 bp, Glycine max
  Peptide Sequence Number=SeqID_127726
atgcattcaagcacacatctagaatcaaggcttcatgcgttttatctattgaatctttgcaaaggcatttgggagacatgtagaactgcagttggagatttagcccttatcaacttggaaattgaagccacttgcaggcgtaacaacgctgcaagaaaaagaagggagcaagaagcacaaggaagcagtcagacctcatctcctccttctccacaaatctacattcaaatggaggaggaacgtgcatga

SEQ ID NO: 10949 - DNA, 1082 bp, Glycine max
  Peptide Sequence Number=SeqID_127727
ggttaaaacctttgatggtaggtggcgcttcggtttttacgcctctagatgggtttgtaactcttgagattatcactaatgggttgagcacagtagaggttgtccttcttgttcctactctattacttccaactccattaggcataggggaagagttagaatcgtcctctgactcttctatttctcttcctttttctgacgaggaaacttcccagaacttgatgaagggaccagaggtaacttctggttttaaagtcattgctagcaacacttccaatgatgacgttaaagtcatctctattgagtctgatgaggaggaaactgaagaggatgtttttgagcaatttagaaaagaaatagatgtagaaaggggagatgtggttgttggcagtggtgcatccgagaatattgtaaggtcttatgccctcaaatctaataaaagaaagggtcctttacgaaggtttgatcatatgactgtatctcatgatctcccttcattatggaatattgacctcaagggatttgagttcatcacaactaacaaattgcttacaaaagttgatgttgagatgatggattatgttggagtcgataactatttggattttattgagttgctaatcatgagaagatggttttttccaaggtttttgagaatgaaaaactggtcaaggctatttgatggccttaatatgaaactcaaccttgcagttaaggatttagtaggaaccaaaaagattgtcagtgctttcaatgatcaattgactactagagaagagaagaaaaagttccttgagttggaaagggataaccttttgaaggagaagaagttgatgcaacaagccttcataatgggccatgaagatggtttccaaaaagctctttgccaaattcaattgcttgcttttgaggtagatttaatgttatttgattgtttgaagaatgtcaagaatggggagttggtaagggagtctcaaatggagacttttgaagaggcttctggaaatgagacgacctccaaggaagaagatattgaggcaacttcaagccttacactgacttccaacattccaactgcataa

SEQ ID NO: 10950 - DNA, 432 bp, Glycine max
  Peptide Sequence Number=SeqID_127728
atgttgctagtatttacaaaaataccaccgcccccaaacaaagacggttttgtgatgaccgactttaaatgcgcgtcgtggaatacactgttattagtggtgaacatcgctttattggccaaacaatggtggaagctaatggtgaatggggaatctttgatgttcaaggttattaacgctaggtgggtaatagacaggagtatttatgtcatcaaggataagtggatccctaatatcactggaaatagaactcaattgagaaatgaagaggtggttctcaaggattttagggtccaaaacctatttggggaagaaaagaaggtaattggttttccaaaatggaaggatggattgcaagcaggtgttgcagaaaatgcgtggtatcttgaaatgaccacaagagaaggtgtcagggctgcaatcaactgttga

SEQ ID NO: 10951 - DNA, 756 bp, Glycine max
  Peptide Sequence Number=SeqID_127729
atggcaatgaatgtaccaagaatgattccggatatgttgaaattggaacctctagatggcataaattataagaggtggtcacaaaaattgttgattttgtttgaagccttagaggttgattatgtgttatctaaagatcctcccactgacattgtttcccctaccaacccttctcctgctactcctgttgtcacatcgttctctgaaggaaccaagaaagctcatgaagaggctaagaagaaatatgaaaaggacaacaaaattgttaggggtcatttattgaatcacatggcaaataatttgttcgatttgttcatcaatcagaaatctgcaaaggctaatttgcttctggagaaattcccaccttcgtggagtgactaccacaaccaattgaaacacaagaagagagatttgtcacttcaagagttgatcaatcatatgaagggaaaacaaaatcagaaccagaattctgttgcaccatttgcacctcaagcacatctagcagaaaatgaagaagtcatagttattgtggtagtggaggaaaacttggtggataacaaggatgttgctgatggagagtgtgtcttcatgggaaattctgctacagctggagtgcttggtaaaggaaagactcttctcaaacttacttctggaaaaaatttatccttgagtgatgttttatatgctccctccctacgtaggaacttaatttcacttaatagagatggactgaaattggtttgggaagctgataag

SEQ ID NO: 10952 - DNA, 831 bp, Glycine max
  Peptide Sequence Number=SeqID_127730
atgggtgatcaagtcacaagcatgctcttggacatttcaacttccgaaggctcgcttagcgagcatgtctcgctaagcaaaatgactttatctttgcttgattcttcctctgctttaaatgaacaagttaatgaacctagaagaacttttttgattaaggaagatcctaaaacctatattgaggtagtaacttctattgatgctaaattttggaaagaggcaattaacagtgaattagattttatcatgtctaatcatacttgggatctggttgatttgcctaagggaagtaaaccaattagatgtaaatggatttttagaaagaaattaaggactgatggaaccattgataaatttaaggctagactggtagttgtgggttatacacaaaagaaagacattgacttttttgatacattttctcctattactaagattgccataattcgttctctagttgccttagttgttattcatggacttgtagtacatcaaatggatgtaaaaatgacttttctaaatggtgacttgagagaagaaatttatgtggaacaacccgaggggtttgtggtccaaggattttgtgatgcaaacttggttacggataatgatgaggtcagctctacaagtggttatgtttttactttgggtggaggaactatatcttggaagtctactaagcagacttgtatagcacgttccactatggaatcaaaattcattgctcttgatttagcaagtcaagaagcagaattgttgaggaacttgttgacagatgttccattgtggggaaaatggtctataccagtttctcttcattgtgattcttag

SEQ ID NO: 10953 - DNA, 600 bp, Glycine max
  Peptide Sequence Number=SeqID_127731
atgtcctacattcgcaagaattgctggaacctcgacgatccctctatcaccttttcagggtcccgcaaggccagggtcagggctccaacagaggcacccccaattgctcatccacctcccaaaccgttggcgtcttctagctcctccacttcctcagaccagcttgtgcccattaagtggcttggcctaaagtccggccttccattgttggggggtgaggctcttgaggctcagggcccagctaatggagcttatgcaggtgttgagatagctcaggagccaactaatgaggcagatgatgctgatccaggtgccgctgatactgagatagatgcagattatgtagctgatgtcactgcagcgcagggagcttgggacccatggcccacccatgactcaagtgcaaaaatgttgcgcgtgagtgaaacggttagcttgcatgacaggaaattatggagtggtagactaattgcttgtaaaccggtgagttgtgtgaaccttaactgtgagagaacaactgactctaaattattgatttggcataaatctctgaatgctgaatggatgcatgatgtggaaatgatcaaggccatgttgtga

SEQ ID NO: 10954 - DNA, 984 bp, Glycine max
  Peptide Sequence Number=SeqID_127732
atgggtggcagtgattctgggggctcgattgagcaacccatgatggatcgagaggtcatctctattggtggttcctcgtcggaggatactcgttgtggtgcctccgatagcgagtcctcctcttcggagagggtgagggcttcgcgccgtactggtgggggcacttctcgccctagcaggagggtgcaaccttccactgctttcggggagcctgtctcgattactatgatccttccctcttctacttcttggggtgtgaagagaagtagtggcagtggagatgtcaaggagtctcccagcgtgcgacgtagccatagagttgggttgtcatcatccacccctgtcgttgttagctatgagtgggtgagggatgacattctcaaatacaagtcctctctcacctcggcggtgagtgttgctactcttcaatgccaggtgaagctgacgagccctgagaactcatgcaatatagtcgttcaggcttgtaggagtgatgacttccctttcttaagggctgtgtgtttgtttgaggtattgggtcttattctcccctcgaccgctttccaatgtattatgcttaagcacttaaatgtggcttgttctcaaccccaccaaaacagttgggcaatgagggttaacaatgctattttagaacagctgttggcctcgttggacgtgtggaccattttgtctcttccttcggcgagcgatcccctcactgccttggatgttgttgctcgttttgcatgtattatgggttacttcgcctggaggccactcatgaagcaggtcgaacctacaggtcacactcgtgaagcaggtattatgggtcaacttgttgatgaggttggccctattgctattgctactgaagtcacccccaacgctctttttgttttggcaaagaggaagcgggataatggtactgtactatctggccataagaagtcgaagacccatatgagccttcgtgccctaaggtag

SEQ ID NO: 10955 - DNA, 966 bp, Glycine max
  Peptide Sequence Number=SeqID_127733
atggagtttgaccttgaaaaccctttagaaaatcttcactctgatgatgtctcttacctcttcctcattgaatctgaccacaccccatcacagaatcactctcagactctcaaagctagagatcttgacatctctgtcagaagagaactcatttccttaatctcacagttgtcctgtgctttggatccggttttgtcttaccttgctatcaactatctggaccggttcctgaccaaccaagggattctgcaaccaaagccatgggccctgaggctcgttgctgtctcttgcatttctctaactgtcaagatgatgggaactgaataccctgccactgatatccaggcccttttgaatcaaagtgatggtggcatcatctttgagacacaaacaatacaaagaatggaagcactcatcttgggagcattacaatggagaatgagatcgatcaccccattctctttcgtagctttctttattgccttgatggggctcaaagagtcgccaatggggcaggttctgaaaaaccgtgcctctgaaatcatattcaagtcacaaagagagataaggctttggggattcaagccatctataattgctgcatctgctcttctttgtgcttctcatgagttgtttccttttcaatatccgttcttcttaaaagcaatatccgattcttcatatgaaatcgtggagcagtgctacaaagtgatacaagacatagccatagaggaagagtactcttctgcgttgaatggggtttcaaggtcagacacaccgattaatgtgttggaccatcattttctgagttcagaaagtgaaaaaaccaacggaatcaccgttgctaatgctactgattctcctcttggggatctcaaaagaaggaaaatcactggctgtggtggaaacaatccaacaatcctcaattcttggattcaaccatgcgagagagagtgtgaaaagtaa

SEQ ID NO: 10956 - DNA, 369 bp, Glycine max
  Peptide Sequence Number=SeqID_127734
atgtatcaccttgaccaaggttttgttttccaccatgttgcagagattgatacaagagaagaatctaaggcagctatggagaacaatgagcctccaaggcgtcttgagggaaaacatgctgcaatggcagtttgctggcttcttggcactgggtgccttttcgcgtggaacagtatgctgactatagaagattactatgtttacttgtttccgaaataccacccgtctagggtgcttactcttgtatatcagccatttgcagttggaacactagcaatactggcttacaaagaggacagaatcaatacaaggataagaaacttatttggatatactcttttcttcataagcactttgtcgatcttaatt

SEQ ID NO: 10957 - DNA, 132 bp, Glycine max
  Peptide Sequence Number=SeqID_127735
atggcttccaccactctatctgcagcaaccccttcacaactatgttccggaaagagtgggatattctgtccttctcaagcactgtttgtgaaaccaatgaagagccaaatgatgggaagggcaagggagtga

SEQ ID NO: 10958 - DNA, 406 bp, Glycine max
  Peptide Sequence Number=SeqID_127736
tctttcctcgctggcttggcagcatcaggtgcactaacatctgctttgaggttgattacaaaagcagcctttgaaaattctaagaatggtcttcgcaaaggagccattatgttctttgccatatcaacattctttgagcttctttgtgttcttctctatgcgtttgtattccctaaattaccaattgtgaagtactaccgttcaaaagcagcatctgaaggatccaaaacagtatcagctgaccttgctgcagtatggcacacagggctggatgataatgttgacatcttttttggggttatccaatggctacttcactgtttgtgttctcacttcagcacccaaaggttacaagggaccggaacaaaatgccttgggaaatttgttggtgttgtttcttctggag

SEQ ID NO: 10959 - DNA, 201 bp, Glycine max
  Peptide Sequence Number=SeqID_127737
gagatgttgtggtcacgcataatggcgtcgtggttgtcgacagcgaggaaggcaaaacaggaatgaagaaggtcgacaagggggcgaactataagaacaaggaaggaattgatagcgacaatagattcttcaagtgggatctgtggtgggtgttgtcgtcgaagaagatggtggctaaggtcgtggtcatgggagaaggct

SEQ ID NO: 10960 - DNA, 165 bp, Glycine max
  Peptide Sequence Number=SeqID_127738
atggcacgcagcgtgttcgctccgtgcccctatttaagggacctacaagggagagaactaactaggcatttagcaataaccccccaagaacatattgcagcagtagggactactagcaacaataagttttcaaagagaaaagctctagatgagggttcactgtaa

SEQ ID NO: 10961 - DNA, 376 bp, Glycine max
  Peptide Sequence Number=SeqID_127739
ggtgtttaatcaagacttcccattatacataaagcatgaagatctgtctgaaattgcacacggtggtcaatgtctctgcatatctgttatacagttatggattctgcatctgactaatacaagtatgcgagcggagaattctgatgtgcatggattcctcgagccacagttcatccaaagatttgggcaatcacaatttgaatcaaaaagttacatgaaaaactggatgcataattcaaaacgtgatgtctacctaggagcctacctgaatgggccaaacaactatcttaaaggaataaataacagggctttgaaaggacttgatgatactccacaacctaaattcaaggctggtgctaggtggattgttgttaag

SEQ ID NO: 10962 - DNA, 144 bp, Glycine max
  Peptide Sequence Number=SeqID_127740
atggcaatggcaaaatatgcatacttctgtactgtacaaaagcatagccaggagaaaacatggaaggtcttgaggaaagagaacgaacggaatggaagccaaacaaatcatccaggtaagaggaatctgaaccaagaactgtaa

SEQ ID NO: 10963 - DNA, 204 bp, Glycine max
  Peptide Sequence Number=SeqID_127741
atgagcacaaacaaggatgccaattccaagatgggagattccagtttcaatggagaggtagatgaacgtgagatttgcgaacacgagaattcgtcaaaccgagatttttcacacaaaacagtatatgttcatttaactcattggacaatatcaagcaagagtatccttcttctttcttttcatccttcattccttaagcagtaa

SEQ ID NO: 10964 - DNA, 354 bp, Glycine max
  Peptide Sequence Number=SeqID_127742
atggcaggagctggtgacaatggtggtgtatatcatcaactagacggatctcaacgcttattactggacgtgatgactacacaaatgcaatgtttgttgaaccgtaacaatgaagagctctataggcgaatagaaagactagagcaacaactaaatccaaatgctgggagaccttatggtggcaacacaagggtcagtgatggatcgaaccgaatagaggggcaagatagaattgagggagtaaaactcaatgtatcctcttttaaaagcaggagtgacctagacacctatgttgactgggagatgaagattcagcatgcattctcatacaatgattatcctgaagagcagaag

SEQ ID NO: 10965 - DNA, 411 bp, Glycine max
  Peptide Sequence Number=SeqID_127743
atgcccccgactgtccctgttaatcattactccgatcccgaaggccaacacaataggatcagaatcctgtggtgttatcccatgctaatcaccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcaggctccctctccggaatcgaaccctaa

SEQ ID NO: 10966 - DNA, 1417 bp, Glycine max
  Peptide Sequence Number=SeqID_127744
ggaaaaagaaggaggtggttgccgcccagctcgcccagaatgttgcggaactttatggattgcgcgaaaatgctccctttcgacttctggcatgccgcggaacttcacgaattacctaacaatgggtgttaagtacctcgaagcggtcaagcaaaggttgcaggccatcaaacaatggtccccggacaaaataaggactccgaaacaacaacaatggttaccaaaatttcttggttatgatttcaacataaagtataaaccaggtaaggaaaatatccctgctgatgcattgtctaaaagcttgttcatagcttggtcaaagcctactaatcattggttagcaaaagttgtagtagttactaaggaggataagttatttagtgaactaatcagtcgctatgctcataggggaaccattgatcctaagtatgatgctaaggtggatcaagcagtacctgcaggattgctgcagccattacctattccacaacaaatctgggaggacattgctctgtacttcatcactaatttaccatcttctcatggccattcgactatcatggtcatagttgacaggctttctaaatttggccattttatagctttaaaagttgagtttaatagcaagttggaggctgatgcatttatcaataatgtgacaaagatacatggatttcctttgtctattgtgtttgatcgtgatagagtctccatcaattcattttggcagcaactgtttaaagctcaaggaaccactttggctatgagttcatcttactatcctcaaagtgatggccagatggagatccttaataagactcttgaaatgtacttaaggtgctttgtgtttgataaacctaagttgtggtaccctatgctagctttggcaaaatattggaacaactcttcttatcatcacaatttgggtatgagtccatttaaagttgtatttggcagagaaccacctgcagttgttccatatcaagtccatcctaaggatcatgtatctctgcaggaaactcttgtgggagatttggctttggtgaaattacaaccatatatgcaacactctattgctcttagaaagaatcagaagctgggaatgcatttttttggaccctttgaagtggtggaacgagaaggacaggtcttgattcaatgggagtcatttgatgctagtgaggcttcatgggaggatttggtagctatgaaacaatcttatcctcgattcaaccttgaggacaaggttgatttcaaagggaagggtattgtagcgagtaatttcgtgggtgacaattatgctggaaattttgttatgaatgatggacacgtggaaggtgatccgcaaaacatggccacaagaaggagcacaagggcccacagggagaatgtgcatttaagaggttatgctcattga

SEQ ID NO: 10967 - DNA, 279 bp, Glycine max
  Peptide Sequence Number=SeqID_127745
atggtggggtacgcaccttcaagctttgcggatttggtcttcgccagcgaaaggattgaagtagagagaagtgagttatcaagaataagagtcattcgacttaacatgtcaactgaaaaaatccttcaactatttctcatccttgaaaaattctttttgcgaggatcaaccgcttttttcattcttccttgctacaaggttgtggaaacaaaacaacgatgggtacctcaaagccttacactggggcaaggaggggcaccgtgcatgagcctcaagtga

SEQ ID NO: 10968 - DNA, 192 bp, Glycine max
  Peptide Sequence Number=SeqID_127746
atgttggtgcgcatgatccgcactcatctctttgtagcggcacgagtgaaatcttgccccagtatgcatagtggctgcatgatagcctccctctttggttgtgctcgcacagaccttgagttctctgaaggcgcatatatggagtcccatgaaggtgatggagtgcaaccctatgaaggcgagggcaaatag

SEQ ID NO: 10969 - DNA, 204 bp, Glycine max
  Peptide Sequence Number=SeqID_127747
atgattataaaatcctctaatatcttcgccctcatttggttccatagaaatatttccatatcaagggcacaccggaatccggcttacaaatcccaggttttcgaaaacaaagaaaccgaagtggcggcagagccacacaggatcggtgtaggttttcgaaaaccaagaaaccgaaacggcggcagagccgcacaggatcggtga

SEQ ID NO: 10970 - DNA, 174 bp, Glycine max
  Peptide Sequence Number=SeqID_127748
atgtcgcctggggtcaggagaccttgggcacgtcaggtggggtgctattgcccaaaaccaagcttggccgatcccgacccaacccgagcaaagtcagccaaacgttcagtagctgctggtaatcgattaccatttgtgtgtaatcgattacacagtgttatatgttgttggtaa

SEQ ID NO: 10971 - DNA, 2368 bp, Glycine max
  Peptide Sequence Number=SeqID_127749
atggggctggaaaacctggcgcgtatgcgcaaacaggacattattttcgccatcctgaaacaacacgcgaagagcggcgaagacatcttcggtgatggtgtgctggagatactgcaggatggatttggtttcctccgctccggagacagctcctacctcgccggtcccgatgatatctacgtttctcccagccaaatccgccgcttcaacctccgcactggtgacaccatttctggcaaaatccgcccaccgaaagaaggtgaacgctattttgcgctgctgaaagttaacgaagttaactacgacaagccagaaaacgcccgtagcaagattctgtttgaaaacctgacgccgctgcacgcgaacaaccgtctgcgcatggagcgtggtaacggttcgaccgaagacctgacggcgcgcgtgctggatctggcatcgccaatcggtcgtggtcagcgtggtctgatcgtcgcaccgccgaaagccggtaaaaccatgctgctgcagaacatcgcgcagagcatcgcgtacaactaccctgactgcgtgctgatggtgctgctgattgacgagcgtccggaagaagtaaccgaaatgcagcgtctggtgaaaggcgaagttatcgcgtctacctttgacgaaccggcctcgcgtcacgtgcaggttgcagagatggtgatcgagaaggctaagcgcctggtcgagcacaaaaaagacgttatcatcctgctggactccatcacccgtctggcgcgcgcctacaacaccgtagtgccggcgtcgggtaaagtcctgaccggtggtgttgacgccaacgccctgcatcgtccgaagcgtttcttcggtgcggcacgtaacgtggaagagggcggcagcctgaccatcatcgccaccgcgctggttgataccggttcgaagatggacgaagtgatttacgaagagtttaaaggtacaggtaacatggaactgcacctgtcacgtaaaatcgctgagaagcgcgtgttcccggctatcgattacaaccgttccggtacgcgtaaagaagagctgctcacctctcaggaagagctgcagaagatgtggatcctgcgcaaaatcatccatccgatgggtgaaattgatgcgatggagttcctcatcaataaactggcaatgaccaaaaccaacgacgaattcttcgatatgatgaaacgctccaaagcggcggttttttcagcaaacgcacgcgctgcgacagaattcagaccagggatatacagcaatggcgggaaaattgcttattgttcgttcctgttttttgctcgtaaagcggctaaaaaaattgggcttgtggacacgccgaattccagaaaacgacaccatggcgccattccgttagtcggcggtatctccgtgtatgcggggatttgcttcgcctttgccatctcaaattattatctgccgcacgccgtgctgtacctcttctgcgccggggtactggtgctggtcggcgcgcttgatgaccgctttgatatcagcgtcaaaatccgtgccgtggttcaggcggcgattgccatcgtgatgatggtcggggcaaaactctatttactaagcctggggtttatcattggtccggtcgagctgatcgtcgggcctttcggctatgtgctgacgctgttcgcggtatgggcagcgatcaatgctttcaatatggtggacggtattgatggtctgctgggtggcttatcctgcgtcaccttcgccgcgatgggcatcatcctctattttgacggacagaccagcctggcaatgtggtgcttcgcgatgatcgccgccactattccctacattctgcttaatctcggctttttaggccgccgttataaagtgtttatgggtgatgccggcagtaccatgatcggcttcaccatcatctggattctgctggaaacgacgcagggcctcagccatcccatcacgccagttaccgccctgtggctgattgctattccgctaatggacatggtagcgatcatgtatcgtcgtctgcgcaagggcatgagcccgttctcggccgatcgtcagcatatccatcacctgatcatgcgggccggttttacctcccggcaggcatttttattgattaccgtggccgccgcgctgctggccgggatcggtgtgctgggcgaatatctggcatttattcccgagtgggtcatgctggcgctgttcctcgctgctttcctcctttacgaacgaactggatgtacgcggcctcggctgcacgctgtggcgcggcaaaggctggattattggcctggcgctgctgtttgcgctgctggcgtggttggcttccatgttaatgaagcaatcctggagcgccacggcg

SEQ ID NO: 10972 - DNA, 2187 bp, Glycine max
  Peptide Sequence Number=SeqID_127750
atggacgctaagaataacaaacctgttgtcagagttatagcgcatcggcggccggaaacccgcaatggcaaagtggccgacgatgcgccgctgctgagctatgcgcatccgcagctgcacgcgatgattgcccagcgcggtatcacctcggcggtgctggtgccctacgccattattcgtgacgatcacgcccagcgtgcgcaggcgttgtctcagtcactgggcattccggtgcgcacggtacacgagttcgagacaccggttgcggccattgagcaggcggagctgattctggtgagcggcggcaatacctggctgctgaaccagatgctgcacgagcaggggctgatcgtggcgattcagcgcgcagtgcgcgagcgcgacgtcccttacgttggctggagcgcgggctgcaacgtggcgacaccgtcgattcgcaccaccaatgatatgccggtacgcagcagcgtggtgctgcctgcgctggggctgttcccggtgcaaatcaatcctcactatcttgatgcgcacgtcagcggccacatgggcgaaacccgtgatgagcgtctggccgaattctgcgcggtgaatccgcaggagtcggtgattgcgctgcgggaagccagcttcctgcacgtcagtgagaaccgtctgcgctactacagcgcgcgcggtgaagatttcaaagtgttccgtcacggtgaagcgattgccgcttatcacgatgtgctggccctgcagtcgctgcgcggcgagttaaagcgcatcactcaggagatcgatcctgtcctcgagatgaccgaaatcgccgaccgcacgctgcgggccggtggcccggcgctgctgttcgaaaacccgaagggctacagcatgccggtgctgtgcaacctgtttggcacgccgaagcgcgtggcaatgggtatgggccaggaagaggtcagcgcgctgcgcgaagtgggtaagctgctggcgtttctgaaagagccggagccgccgaaggggttccgcgatctgttcgataagatgccgcagttcaaacaggtgctgaacatgccgaccaaacggctgcgtaatgcgccgtgtcaggaagagattttcagcggtgacgaggtcgatctggcgcgcatcccggtcatgaaatgctggccgggcgatgcggccccactgattacctggggattaaccgtctcgcgtggaccgcataaagagcggcagaacctcggcatttatcgtcagcaggtgattggtaaaaatcgggtgatcatgcgctggctgtcgcatcgcggtggcgcgctggatttccaggagtggtgcaaagcgcatcccggtgaacgcttcccggtagcggtggcgctgggcgccgatccggccaccattcttggtgcggtgacgccggtgccggatacgctatcggaatatgcgtttgccggtctgctgcgcggcaacaaaaccgaggtggtgaagtgcgtctcgaacgatctggaagtgccggccagcgccgaaatcgtgctggaaggctacatcgaaccgggcgacatggcgccggaagggccgtacggcgatcacaccggctactacaatgaagtagacagcttcccggtatttaccgtgacgcacgtaacccagcggcgcaacccgatttaccactccacctacaccggccgtccgccggatgagcccgcggtactgggcgtggcgctgaacgaagtgctggtgccgattctgatcaaacagttcccggagattgtggatttctatctgccgccggaaggctgctcttatcgcctcgcggtagtgacgattaaaaaacagtatgccggtcacgccaagcgcgtgatgttcggcgtgtggtcgttcctgcgccagtttatgtacaccaagtttgtgattgtgtgtgacgatgacgtcaacgcgcgtgactggaacgacgtgatttgggccatcaccacgcggatggatccggcgcgtgatacggtactggtagaaaacacgccaattgactatctcgacttcgcttcgccggtttccggacttggctcgaagatgggactggatgccaccaacaagtggccgggtgaaacccagcgtgaatgggggacgccgattgtgaaagatcctgcggttacggcgcgtattgatgcaatctgggatgagttagcgatctttgccgagccgccgcagcgctga

SEQ ID NO: 10973 - DNA, 984 bp, Glycine max
  Peptide Sequence Number=SeqID_127751
atggaatcctggtacttactctattgcaaacgtggtcagctgttgcgcgcgaaggagcatcttgagcggcaggaggtgaattgcctcagcccgatgatcgctctggaaaagattgtgcgcggcaaacgcaccaccgtgagtgagccgctgtttcccaactatctgtttatcgaattcgatccggaagcgattcacaccaccaccatcagcagcacgcgcggcgtcagccactttgtgcgctttggtgccatgcccgcgacggtgccgtatgaagtgatcgaagcgctgcaaaccgatgcgccgcagatcctgctggatccggaaacgccgcaggtcggtgatgaagtgctgatcaccgacggcacctttgaagggctgcgcgctatttttgccgagcccgatggtgaaacccgctcaatcctgctgcttaacctgctgaataaacaggtgatgcgcagcgtggacaacaagcagttcctgcgtctggctgttcaccacgccagtgcgccacctgctgaacgatatgcggcagaaagcagggttcgttacggcgcgaggtcggacgcggacgcatatcgcgcggcagcagatagggcgcgtccgtctccagcagcagacgatctgccggaatcagcggcagcatgtcacgcagcgccattccgcgccgttcatcgcacacccagccgtgcaccaccgcgcccaccagtttcggcagccacggctgcagcaccgccagaaaacgttcatgtgcctcacgacagtgtaaaaacaccggcagctgcagttccgccgccagctggagctgcgcatcaaacgcgtactcctgctgctcgtgcgcggaaaggcggcgcagcgtactggcagtttccgccgaccactcgctggcatgatgcgggtgcacgccggcggtcgaccagcagtagcccgcgtgccgggtcgccagctgacgcgcctgctggctctccagggcattggtgccggtaa

SEQ ID NO: 10974 - DNA, 3771 bp, Glycine max
  Peptide Sequence Number=SeqID_127752
atgcgtttttcaaccatatccgttatcggactgggctacattgggctgccgacggcagccgtttttgcttcgcacgggaaacaggtcatcggcgtggatatcaatgcgcgcgcggtggaaaccattaatcgcggcgaaattcatatcgtcgagcctgaactgggcgacgtagtacgtgcagcggtgcacaacggcaacctgcgcgccaccacccagcctgaagctgccgacgcctttctgattgccgtgccgacgccgtttgtcggcgatcatcagccggatctcagctacgtgcaggcggctgcgctgtcgattgcgccggtgctgaaggccggcgatctggtaatcctcgaatcaacttcgccggtgggcgctactgaacagatggcgcaatggctggcggcggggcgcccggatctgcgcttcccgcagcatggcgagcagcctgacgtgtttatcgcttactgcccggagcgtgtgctgccggggaaagtgatggtcgagctgctggaaaatgaccgtgtgattggcggcatgacgccggcctgttcggcgcgcgccatcgagctgtatcgcattttcctgcgcggcgagtgtgtggaaactaacgcgcgcaccgcagagatgtgcaagctgacggaaaacagtttccgcgatgtgaacatcgcctttgccaacgaactgtcgctgatctgcgccgaacaggggatcaacgtgtgggaactgattgcgctggcgaaccgccatccgcgcgtcaatatcctgcagccgggaccgggcgttggcgggcactgcattgcggtcgacccgtggtttatcgtggcgcaaaacccgcagcaggcacggctgatccgaaccgcgcgtgaggtcaacgatgccaagccgggctgggtgctggatcaggttaaacaggcgctggccgagtgcctgacggccagcggcaagcgtgccacggacgtgactatcgcctgcttcggtctggcattcaaacctaatatcgatgacctgcgtgaaagcccggcgatgtcggtggcgcagcgtattgcgggctggcacagcggccgcacctgggtggtcgagccgcatgtggcggatattccgccgcagctcgccgaacgcgctacgctggtgtcgctggctgatgccctgcaacacgccgacatcctggtgatgctggtcgatcatgcgcagttccgcgccgtcacccctgaagagtttttagtcaccggcggcgccggttttattggctccgcgctggtgcgcttcctgattgccaataccgaccaccgggtggtggtggtggataagctgagctatgccggcaatctggcgtcgctggcaccggtcgagcaggatgcacgctttgcttttgagcaggtcgatatctgcgaccgcgccgcgctggatcgcgtgctggcgcagtatcagccggactgcatcatgcatctggcggcagagagtcacgtggaccgctcgattgacgggccaatcgcctttgtcgaaaccaacattgtcggcacctaccagctgctggaggcgacgcgccattactggaacggcatgacggatgagcgcaagaagggcttcatcctgcaccatatctccactgacgaggtgtttggcgatctgcacggcacggaagatttctttaccgaaaccacgccgtacgccccgagcagcccttattcggcgaccaaagccagcagcgaccatctggtgcgtgcgtggctgcgcacctatgggctgcctgtggtggtcaccaactgttccaacaactacgggccttaccatttcccggaaaaactgattcccctcaccattatcaatgcgctggccggtaagccgctgccggtgtacggcaacggcagccagattcgtgactggctgtatgtggaagatcacgcccgcgcgctgtacaccgtggtcagcagcggcaaagtgggtgagacctacaacattggcggccacaacgagcggcgcaatattgaggtggtggagacgctgtgtgatttgctggatgagctggcaccgcaacagcgcgctgccgggctgagcagctaccgggaactgatcacctttgttcacgatcgtcccggccacgacctgcgctatgccattgatgccagtaaaatcgcccgtgaactgggctggacgccgcaggaaacattcgacagcggcatccgcaaaaccgtgcagtggtatctggccaatccgcagtggtggcaggcgattctcaacggcagaggagcaacgatgaaaggtatcatcttagccggtggctcgggcacacgcctgcacccgataacccgggcgatatccaagcagctgctgccggtgtacgacaaaccgatgatctactatccgctgtcggtgctgatgctggcggggattcgcgacattcttattattaccacgccggacgatcgcgcccattttgagcggctgctgggtgacggcagtgaatttggcctgcagctgcagtatgccgagcagccgagcccggatggcctggcgcaggcctttatcatcggtgaatccttcattggcgacgacagctgttgtctggtgctcggcgacaatctctacttcggccagggcttcagtccgaaactgaaaaaggtggccgcgcgcagccacggtgccacggtctttgcctatcaggtcatggatccggaacgttttggcgtggtggagtttgatgacgacttcaacgcgctgtcgattgaagagaagccgcagcagccgaaatcgcgctgggcagtcaccggcctctacttttacgataaccgcgtggtggagtttgcgaagcaggtgcagccctcggcgcgcggcgagctggaaattaccgccatcaaccagatgtatctggagcagggcgaactggcggtggagctgctggggcgcggctttgcctggctggacaccggcacccacgacagcctgattgaggccagcgtgttcgtgcaaacggtggagaaacgccagggctttaaaattgcctgcctcgaagagattgcctggcgcaacggctggctgagcgatgagcagctgctggcagcggcacaggcgttgaccaaaaccggctacggccatattgatccccttgcgtgggagagcgacttcttccgctgcgccacggcgcggctgacgctggacggcgatgtgccgctggccgaggcgctgcagcagccttacacgctgtggcaggttaaggttccagcgcaggacagcgcggcgatagatgcgctgagccagcacggttttcagctggtggaaggcgaagcggatctggcgatcaatatcaaacgcaccgaacggcagaccggcgtgcgcatcgcgcgcgaagcgcagatcccgcagctgcgcgcggcagcggcccaggcgtttagccagagccgttttcgtgctccctggtttgacgctgaagacagcggccgcttctacgcaaagtggattgagaacgcggtgcgcggcacttttgatcaccagtgtctaatcgcctgcgacgagcagggcgcgctgcagggtttcgtctccatgcgcgaagtcgccggtgatgcgcgtatcggtctgctggcggtgctgccggcggcgcagggcaacggcgtcgggcagcgtttgctgctggcggcagccgactggggccgggtgcgccagctcgagcgtctgcgggtcgcaacccagctcagcaatcttacggcgatgcgcctctatttacgcagcggtgcccggctggaaagcaccgcctactggttttacaggaaagcctga

SEQ ID NO: 10975 - DNA, 1623 bp, Glycine max
  Peptide Sequence Number=SeqID_127753
atggcgctgctggaaaaagtgcagatcgccgcgcgtggcaaacacctgcgccatgcgcccctgggcgatacgccgcagcagataaaacaggcggtacttcagcccggcgccctcttcatagagatcggcgccccagacgtgccagaacgcctgctgtcgccgcagcttgccgctgagcagcgccagccacaggcgcggattgaactggccgtgaaagaagaagcgctgacggcgatcggcggcgcgtgcgatcaccgcctgcgccagcgcgcgcttgctgggatacacgtcgatctgcagctgaggataggccagcagggtatccggcgcggccgataccaccataaactgacgcggcgcgtcggctggcgattcaacgctcatgacgtcgttaaagaagcgcagcagcgtgtgattgtgatgcgggatatcggagcccagcacgtatccgaaaacataggcgcctactttaaagacgtcaccgcacaactgccagacaaaaagatcgcgcatggcactgaactgcggggaaaacagcaaccagatggcgacatcgcgcagcagccagacacaaaagctggccgccgccaccgccggcagcacaaagcgcagcgcgcggccaatttcgcgcgcgatgtcggctttatgctccagccgcgccagcgttggcagcagccagacgctgaacgtggcggtgataaattgcagatacgcatcggagatgctggtgacgccctgccacagcccgacctgcgcccagccctgctgctgcgccagcagattacgcatcatcacccaggctaccggcagggtcacggccgtcatcagcgccatcagggtaaatttggccagattacgcgccagcgccggctgccactgcggcatcagccagcgcagcggcagttcctcgcggtggcgtcgcagcatccacagcgccggcccgaccagcagcgccggcaccagcgccagcccgaccagcgcaccggcatagccacccagccaccagcacagcacataacccaccacgccgatcaggctgccggcgatcagcgccagcgcgttaccgcgcgcatcgcgaaaacctttcagcagcgccagtgtgaggttggcccaggcaatgcccagctgcaaaaaggcgacgatacgcaccacgttttgccaggcggcgtggccaaacagcgcccggctgatgggctccgccgccagcaggaacagcagcgccagcagtgtggaaaaccccagcaccattgccgacgcggtgccggtcacggcgcgcagctgcgccggctgctggcggaactgcgcgacataggtggttacgccgttgaagatacccgcgccggccagcacgccgagcacggtaatcagctggcgaaagttacccgcctggccgacgccctcggggccgaagctcaccgccagcagtttcaccaccagcaggccagcgacaatttttaccagcgtggacgaggcggcaaagaagctcagcagcgaactgattaccgtacgctggttgttgtccgacaggttgtagaacagcggcagccgcagcaggcgctcgctctcgcgcgtagtgaacgcatccgtgccgtggaagcggccaaaacgcgtgccggccggtga

SEQ ID NO: 10976 - DNA, 225 bp, Glycine max
  Peptide Sequence Number=SeqID_127754
atgccggagaccgcgatacccgcccctgccgccagtgacagctttaccattctgctcggcaactcgggcgatcgcagcaaccggcacattgaaggattgcaggcgattcgccgccagtttggtgagcaggttaacgtggtgatcccgcttggttatccggccagcaactatgagtacatcgatgagattgatgctgccgcgcagcgcctgtttccgcgcggccag

SEQ ID NO: 10977 - DNA, 2617 bp, Glycine max
  Peptide Sequence Number=SeqID_127755
atgggcgtgctcggcattacgctggggattgtgatttgggccggtgtcgcgctgatgggcctgcatctgattctggagaaaatggcgtggctgcatgaaattatcatggtcggtggcgggctgtatctgctgtggatgggctggcagctgctgcgctcagcgcgtcagcgtcacaagcaacctcatacggaagcgccggtggttgagctgccaaagcgtggcatgagcttcctcaaagggtttctcaccaacctgtctaacccgaaagccatcatctacttcggcagtgtgttttcactgttcgtgggtaacgatgtgggcgcgattgagcgctggggcctgttcctgttgatcgtcggtgaaacctttgcctggtttaccctggtggcggcgatttttgccctgccgtggatgcgcgataagtatcagcggatggcgaagtgggtggacggtatggcgggcgtgctgtttgccgggtttgcgcgccgctacgatcagtgccaatcgttacgccattttacgtgcgctggccagcagtgcgccgaccgccataaacaagccaccaaacacccggttcagcagcttcatctgcttcggacctttgatccagccggcgatgcgcgtcgccagcgtggcgtaaccaatcatcacaatgatgtcgaccacgatggtggtcacgccgagcaccagatactgcatcagctgcggctggtgcggcacgataaactgcggaaacagcgcggcgagaaacacaatgctcttcggattggctgccgcaccgcgatagccgtggctgatgccggtgctcatggtgttgatcgcgccggaaccgggcgagaggctgaggatggtcgtgggggacggatgcagcagcataaacagagttggctcggacgtgagcacgctttttcagcctttgctaccggtccgctgctcgacttctggcgtcagcgtgaagagtgtgaattcagcggcgtgggcaatctgaccattcgctatgtgcgcttcacctcaccgcaacaccgccgtgtcatcctgattgtgcccggacgcattgaaagctacatcaaataccccgagctggcctatgacctgttccactgcggctacgatgtggtgattatcgaccatcgcggtcaggggcgttcagaccggctgctggccgattcgcatcgcggtcacgtggtggagttcagcgattatgtcgacgatctggaaacgctgtatctgaaagagatcgtcagccatcactatcagcagcgctacgtgctggcgcactcgatgggcggcgcaattgtggcgctgtttctggcgcgccagccgcaggccttccacgcggcggtgttttgtgcgccgatgtttggtatcgtgctgccgctgccgccgtttctggcgcaccgcattctcgactgggcggaaaagctgcccgcgctgcgcgacggctacgcgctgggcaccggacgctggcgcgccagcccgtttggcattaaccggctgacgcacagtcgcgaacgctatcgtcgcaatctgcgcttttacgctgacgatccggcgattcgcgtcggcggccccacctatcactgggtgcgggaagggattcaggccggacgccatatccttaatcaggtggcgcagattacgacaccgattctgctgctgcaggccagtgaagacgacgtggtggataaccgcgcgcaggatctgttctgtgaggccatggcggcagcgggacatgcggtggaaggcaccacgccttacatcattcagggcgcgcgtcacgagatcctgtttgaaacagacgccatgcgcgccgaagcgctcaatgcggtggcctacatgtaccacatcgttgcatccgacctggatggcacgctgctttctccgcaacatcgtctgacgccgtttgcccgcaccacgctacaggaactggtggcgcgcgatgtgcattttatctttgccaccggacgccactacattgacgtcggtcagatgcgcgataagctcggcattccggcgtatatgatcacctcaaacggcgcgcgcgtgcacaacgccgacggcgaactggtgttcagccacaatctggacagcgatatcgccagcgagctgtatggcctgaagtatcacgatgagaaaatcctgacgcacgtttaccgcgacgatgagtggcacatcagccgccataatccgcaggaagcggagtttttccaggaatcggtgttcacctatcaggtgtatcagcccggcatgctggccaccgacggcatcagcaaagtgttcttcacctgcgacgatccggagcatctggttccgctggaacaggcgattgaagcgcgctggggtgaccgggttaacgtcagtttctcgctgcccacctgtctggaggtgatggctggcggcgtctcgaaagggcacgcgctggaagcggtggcgaaacagcttggctattcgctgaaagagtgcatcgcgtttggcgacggcatgaatgatgtcgagatgctgagtatggcgggcaaaggctgcatcatgcgtaacgcccatcagcgcctgaaagataccctgccgacgctggaagtgattggcagcaacgccgacgacgcggtgccgcagacgctgc

SEQ ID NO: 10978 - DNA, 483 bp, Glycine max
  Peptide Sequence Number=SeqID_127756
atgaccaataacgatgtgctgcgcagcgtgcgctatatgctggatttgagcgacagcaaagtggtggagatttttgcgctggcgggcagtgaagtaccgcgtgaagatgtgcaggcgtggctgaagaaagatgacgatgaggcgtttcgtaaactgccggatgtgctgatgggctacttcctcaacggtctgattttctaccgtcgcggcaaaagcgaagacgcgccggccccgtcggttgagcgccgcatgaacaataatatctttctcaagaagttacgcatcgccttcgcgctgaaaaccaccgatatcccggatatcttattgaaggctaacttcaaggtgtcacaggctgaaatcggcgcgattttccgcaacccggatcataaaaattatcgcgagtgcggtgaccagattctgcgtaacttcctgaaaggtttaacgctgattcagcggccatcgacacccgcgaaaaaaagctaa

SEQ ID NO: 10979 - DNA, 1080 bp, Glycine max
  Peptide Sequence Number=SeqID_127757
atggttctctccgtgctagcaagtgcgcaatcacgtaactatagcctggccttacggcaaggctggcgtagggagtctgatatggcccagtctgacgttttccaccttggcatcaccaaagccgatttgaaaggagccacgctggcgattgttcctggcgatccggagcgcgtgaagaaaatcgcagcgctgatggagaatccgcagcacctcgcgtcgcaccgtgaattcaccacctggctggcggagatcgacggcaaaccggtggtcgtctgttccaccggtattggcggtccgtccacctctatcgccgttgaagagctggcgcagctgggcgtgcgtaccttcctgcgtgtgggtaccaccggtgcgattcagccacacatcaacgtgggtgatgtgctggtgaccaccgcctcggtccgtctggacggtgccagcctgcactttgcgccgatggaattcccggcggtggctgacttcgcctgtaccaccgcgctggtggccgcggcagaagcctgcggcgcgaccacacatattggtgtcaccgcctcgtcagacaccttctatcctggccaggagcgctacgacaccttctccggacgcgtggtgagccgcttccagggctcgatgaaagagtggcagcaaatgggcgtgcttaactatgagatggaatccgctacactgttaaccatgtgcgccagtcagggactgcgtgccggcatggtggctggcgtcatcgtgaatcgcacgcaaaaagagatcccggatgcggccactatgaagcagacagaaagcgatgcggcttatagggagctcagcaattgcctgattagaatgcgcgcaatttcagccgattctgagaaatttcctatgcgcaaaacgatctctgtcccacgtccgggttttaccagccgccctgctgcaatgcaggcccgcgttgagagtgccgccgcgcgctttcgtcaggcaatggccgcgtcagattatcctctggcgcgccagtgctgcgaagaagtgctgcgcgtcatgcctaaccagatgcaggtgctcagcgactacgcgctgacgctgatgcgc

SEQ ID NO: 10980 - DNA, 1512 bp, Glycine max
  Peptide Sequence Number=SeqID_127758
atgaatgttctggacattcatacagtggcgctctaccttctcctcagcgagacgatccgcggggggattatggatcagcaacttatcatcagcggcgcgctggcgctggccggtttgggcattggctggattattgcccagctgcgcgccggccatcagcacgccagcttcaccaccgaacgccgcctgctggaacaggcgcagcagcgtcagcagcagcagctggaacagctgcaacagcaactgcagcagcgcgaacaggagctgcgccagcttcacggcacgctcagcggcgcgcaggagcgcctgcagcagctggattactggcgggccgagagtgaacagctcagccgcgagttgcgtaatcagctggaagttaacagcgcgcaggaagccgaactgcgggaagtcaccattcgattagaagagacgcgtttcgccgctgaggagaagcagcgtttgctgaccaacagcgaacagcgcctgagtgcgcagtttgaaaacctcgccaaccgaatcttcgaaaacagcggaaaacgcgtcgacgagcagaaccggcagagcctcaacagcctgatcggcccgctgcgcgaacagctggacggcttccgccgccaggtcaacgatagcttcggccaggaagcgcgtgaacgccacacgctggcgcacgaaattcgtcagctgcagcagctcaacgcgcagatggcgcaggaagcgatcaacctcaccaaagcgctgaagggcgacaacaaaattcagggcaactggggcgaagtggtgctcagccgggtgctggaggcctcaggcctgcgcgaaggctacgagtaccagactcaggtcagcgtgcagctggagcagcagtgccgtatgcaaccggatgtgattgtgcgtctgccgcagggtaaagatgtggtaattgacgccaaaatgacgctgattgcctatgagcgctacttcaacgccgacgacgagctgacgcgcgaacaggcgattcaggagcatatcaacgcggtgcgcggccatatccggctgctggggcgtaaagattatcaacaattgcccggttacgctcgctggattatcgaagcgctgcagcaaaacattatgctggtcagcccgaccacgctgctggtggcgctgcgcaccattaataatctgtggcgctatgagcatcagagccgtaatgcccagcgcatcgccgaccgcgctgcgcgcttgtacgacaagatgcggctgtttgtcgatgacatgagcggcatcgggcatagcctcgacaaagcgcagcagagttatcagctggcgatgaaaaagctggcgcaggggcgcggcaatctgatcgcccagagcgagtcgtttcgtgcgcttggcgtggagatcaaacggcccatcaacccgcagctggcagagcaggcgcagcccgacgcggcggatgatacatgggccgatgacagcgagcccgctgaaaatgcggcagattcttccgccgcttccctgcgccgcatcaacgaataa

SEQ ID NO: 10981 - DNA, 963 bp, Glycine max
  Peptide Sequence Number=SeqID_127759
atggttgatggaaacctcaagcaagagtttttgccctacgacgttataatcaacattctcaaaagacttcctgtgaaatccctcatccgattcaaatgcgtctccaaagattggttcaacctcttccaaaacacccctaattttttcacccaacaacaccttaaccactccgctcacactaacgcctttctcctcctccaacgaatccctcgccaaccccgtcccctccccttctccacctgtctcatcggacccgacatcaactttgtccatcccccccaattcttcgacatcgcatcacccgccgccaaaattgtcgcctcctgcaacggcatcttgtgtctccgagacaagaccgcgctttccctcttcaaccccgcctccagacagatcaaacaggtgcccggcacaaccctcttcggtttatactacgttggattcggtttcagccccgtcgctaatgattacaagatcgttagaatctccatgggcgtgttcgacgaggagcatcaggtcgtggttctcgacaacgttagggttgatcgagcggaagtgtattcgttgaccaccgggtcttggaggcaaattgatgccaccaagttgcgacctttgtgtctcgtctctagttccgtcgctaccactgaaaccatattttggcttgcaaccatgacttctgactctgacactgactctgaaattgtggtttcgtttgacattggaagggaaatgtttacgctgttgaatggccctccgcttccaccttcgcccactcgttcctatgacaatgtgcttgcggagtgtaacgataagcttgccgtgtttcgccactacattattggggactatgagtcttgttcttttgatttgtgggtcttggaagatgttcataatcatacatcttctggggagagttggattaagatgtatagtgtggggccattttcgaggggaagagttgtctag

SEQ ID NO: 10982 - DNA, 231 bp, Glycine max
  Peptide Sequence Number=SeqID_127760
atgtgggaattggtcaaagctcatgagattcaggctttacgccaaataagagacaacgactggaagcaggaaccctctttaaccaagtctgatattctggaaaaggtcttcgctaggtgtgaaagctggaagggaatttatggatcccatactagttgcggtgaaagtgtctatggtggaataaggtttaagcgaacaaacggaactgttgctcagaagcaactaacatga

SEQ ID NO: 10983 - DNA, 297 bp, Glycine max
  Peptide Sequence Number=SeqID_127761
atgacggtcaatgaccgatgttttaagctacaaataaccgatgtacgagttggtgccaagtcctatcacgaatctgttctagacgttatcagtgtccctcaccaccatgatctcactctcaaattacatcaggttgtcgacattgatgcaattttcccaagcacaaccaacgaagttaaggtcatgatttatgcagatggaggccaatttgagaagcattgggcaattgagaagcttcgagatatgggatctaagtttagaactatgagaagatggccagaaatggtggttcattaa

SEQ ID NO: 10984 - DNA, 471 bp, Glycine max
  Peptide Sequence Number=SeqID_127762
atgaaatcaggattgagttggaggagcttgtccttggtgccttgtgcattgaaggcatattatgattatgaattggagaataaaaagcatctacttctgacctctatccaagacacgcaaaggggcctcttaacaactactaatcaatgctcttgtatcgaggaggctctggtgagtctcgaaggatgcaacattggctgtcaccctatcaatctctccaacttggatggaacatggcgcctccagtacacttcttcctctgatgttctcattcttctccaagctgttgctacttttcctttctttcaagttggacagatctttcaaaaatttgaatgttgtcatcaatctaatggaggtgttatccgctatgttgttcgatggagcattccaaatttgttagaggaaattttagatagtattgcagaaagaaatgattttaatggttttatagtgtttgttcaaatgtaa

SEQ ID NO: 10985 - DNA, 261 bp, Glycine max
  Peptide Sequence Number=SeqID_127763
atggaccgtgagaaattagcactgactttcttccatgaagctcataaagttcatctgcatatgaattatgacaccattgtgtggaaattaatcctagataaaattcaaaccaacacgacaaagcttacgactgagaccgttgggcggcgaccgcggtgggaccacagtagggtcaaggcacgacggctggccatcacgggagtgcgactgatggagacaacgatgtcgataagtcagggcttagaatcggacgcaagctaa

SEQ ID NO: 10986 - DNA, 264 bp, Glycine max
  Peptide Sequence Number=SeqID_127764
atgacggaagggtgtggtgaagggttttgccttgcaaaccttcccggtgatgcttttagtctatgggggaacttctttgaggcaaagaaacaaatgatggctgatgccaaggtcggcggtgctgggttatggccccgtgctaagtttcggattggttggccccctcctcccccccgtgatcagttttgttgccaggattttgccaactttggcttgcgcccgttggctaagtctgtgcctcggtggtggatcatcatgtcataa

SEQ ID NO: 10987 - DNA, 219 bp, Glycine max
  Peptide Sequence Number=SeqID_127765
atggcggagcagctaatccgtgatcgagtagagatggagtgcctagagggagcttgggagaccctcgaaggcaacacgaggtgccgatttcggggcaccattcgattcacggctacttctttggtgcatccagatgaacctgcacggacgcttcagcgcacggcggagtggacagctccttggattagttttgtgtattttttaggacctgatgtatag

SEQ ID NO: 10988 - DNA, 174 bp, Glycine max
  Peptide Sequence Number=SeqID_127766
atgacatttcaaacaagttgcccatctactcctcctactcctaccaaaatcgtcatgaccaacacgacctcttttgacgatggagaaagattattgaaaaaggtacttccttggccgagtatgtgtactcgtgagggaagccttgtaaagaaattgaaggctttgcatccatag

SEQ ID NO: 10989 - DNA, 213 bp, Glycine max
  Peptide Sequence Number=SeqID_127767
atggcatttgggaccatggcagctcgcccaaacgagctgatggttcatcctgaagtaactggctctcccaggaaagttggttcctttagccctaagcaatttaggggcccaggcgagccagaggctagcctgagcgagctaggggtaaggtctgaaaacacctttcctgggtatcgtcccatgagggaccatggttcttcaccaactcaatga

SEQ ID NO: 10990 - DNA, 246 bp, Glycine max
  Peptide Sequence Number=SeqID_127768
atgtcacctacgtctaatgcggatctacttaatgcctatgtggatcaactaaaacacattacaaaccaaaaagaagctgaaacaaaaacaatggggagaaaggcctacctcgacgtcgacgatggagcaaaaccccatggaggtccacaatgccatcaaagcaaagctccaaagcacaccaacgagatgaagaagaagacaacgatgcaagaagaagcagagcggccaagaagagcagtcacgtga

SEQ ID NO: 10991 - DNA, 345 bp, Glycine max
  Peptide Sequence Number=SeqID_127769
atggttccattgtcaatgaattgtaatacgtttatatatgatgaggttacaatgctagttagatgcaggaatatggatgatggaacacaattcttttaccagcccgaccttttatatggagttaagcctaatgatgaaaatgatggtatagaggatagtaatgataaaaatatgggtggtgaagacactgatttgcaagcgcaacctagctatcctgacttttctagttatttcataactgatgagggagaaagaagtagaaatagtacaaagacaagtcagtgcgcaaatccaccggaactagaaaatgtgggtgtccttttaaatcaaaagggaggtttgtga

SEQ ID NO: 10992 - DNA, 366 bp, Glycine max
  Peptide Sequence Number=SeqID_127770
atgaatagttgcggaggcgttgaggaaggcaataccatgtggccaagacttgaggctttggtggacatgaccactgtctttgctgacgggatacgaatgagaacgacaataaatgagtatcagaaagagaacgacaaatgtacaagtggtaggactaacctcgaacgattacaaaaatcatggggtggtacagaaggggaaagcttgctcttgattgttttcgcaacttggcttctagggttgtgcctcaaaatcccatttttcagtatagttcaaggatttgtcaatctgggtatacggattcgggttcaaaaggagctagatttaatgggttgtctttgtgttgttcaatttctcagagactag

SEQ ID NO: 10993 - DNA, 348 bp, Glycine max
  Peptide Sequence Number=SeqID_127771
atgcaaatcgcagctcgtattggcgttttccttctcgacgcgacacctgacagtggtgtcgctagcttcaatggtgttttgcaggagcttggactcgccagtttgactggcgagttgaggggtgcgcaattcctaggtgcaggccagcagaggctatttccaaggctgcagtctgcaatgtgcagaggctgcagggtgtcgccagctccaatggcgttttggttggccaaaagcgccagcacgagcagcgatttgtgttgcttggggtttttaaatcccccctcccccgtagaccattcatgcgagaaaaagatacagaaaagagaagcttgctggtgttgtgtttga

SEQ ID NO: 10994 - DNA, 453 bp, Glycine max
  Peptide Sequence Number=SeqID_127772
atggatggtgctttcaaattcatcatccaaaaccatggactcaacactgaagccaattacccctacaaggctgtcgacggaaaatgcaatgcaaatgaagcagcaaaccacgctgcaaccatcactggctatgaagatgtccctgttaacaatgagaaggcactgcaaaaggctgtggccaatcaaccggtttctgtagccattgatgccagtggctctgactttcaattttacaagactggtgttttcaccggttcatgtggaacccagttggatcacggtgtcactgccgtgggatacggtgttagcgctgatggaactcagtattggttggttaagaactcatggggaaccgaatggggcgaagaaggctacattatgatgcagaggggtgtcaaagctcaggaaggactctgtggcatagctatgatggcatcttaccccactgcataa

SEQ ID NO: 10995 - DNA, 298 bp, Glycine max
  Peptide Sequence Number=SeqID_127773
ttatgtgaatgggttctcatgcaatcctagttcattgaatgatgcgttgagattggcttttgagtttgagaaggtgaagatgattaggggaaaggagggagtgggtcccacttgtgagaactcctcaatgaggcctttaggtcttctccacacgtttctctctccttcgccctcgatcccttcctttttcctcaaattccacgcctccttctccttgaagtccccgacctccacctttcgcgccttctccgacgccgaggaggacgaagaagacgatgaagaagaagaccaagactaa

SEQ ID NO: 10996 - DNA, 1197 bp, Glycine max
  Peptide Sequence Number=SeqID_127774
tgtattcttgattttcctgctactagtgctgcccctggtttgttaactgttgcttcttttggtttagcaattatgaacaatgttgctgaaagaccgcttaacggagacgtagaggatgatgatgaggatgatggtggaggccttgaagcctgggagagaacttatgctgaggatagatcatgggaggctttgcaagaggatgaatctggacttcttcgccccatagatactactgccatttaccatgcccaatatcgcaggcgccttcgtacccttgctgccacagcagctactgcacggattcagaaggggcttatacgatacctgtacattgttgttgacctgtccaaggcagcttcagagagagactttcgacctagtaggatggccgtgatggggaaacaggttgaggcatttatcagggaattctttgatcagaatccacttagtcatgttggtctggtgactataaaagatgggattgctcattgcataacagaacttggtggcagtcctgagtctcacattaaagctttgatgggtaaactggaatgctcaggtgatgcctccttacaaaacgcactggagcttgttcttggatatctaaatcaaatcccatcatatggtcatcgagaagttctgatcttatattcagctctcagtacatgtgatcctggtgatctcatggaaaccatccagaaatgcaaaaagagtaaaataaggtgctcagtcattggtcttgcagctgaaatgtttgtttgcaaacatctctgccaggaaactggagggacttattctgttgcactagatgagtcccactttaaagagttgatcctagagcatgcacctccacctccagcaatagcagagtatgctactgctaatttaattaagatgggtttcccacaacgatcagctgagggttctgtcgcaatatgcacatgtcatgaagaggccaagaccggagggggatacacttgtccaagatgcaaagttcgtgtctgtgagcttcccactgaatgtcgtgtcactccatcatctcaaaatgattcaaaccacagttttcccaatacttgttttggttgtcaacaaagtcttcttagtcaggaggttcttcgctatgcgaaggtatggaggagggatgttgtacgcagccttacccttgcatatgcaaagaggctgtttccggattcatga

SEQ ID NO: 10997 - DNA, 789 bp, Glycine max
  Peptide Sequence Number=SeqID_127775
atgggtgaagtagaggaggtgcaagagcagataaaggccaacatggaggccatgaaagagcaaatggccacaatggtggaggccatgatgagcatgaagaagataatggaagccaatgcggttacagttgccgctaccagtgctgttgctaaggtgaagtcgatgcccccatctggcctcaaccaaatgaatcatccaacctcagttatggtaggcaaagattttggaagtatgagcggcccctattatgtgcaaattcaaaacaagcacaccttcccaccatatggcttgcctctcaactatacaccacccaatatggcatacactcccagtgaggatgtcaataactctactcccatactcattgaaagccgacaacctcaaactgatcatgcacatgtctctcaacccatgggggagacacatgaaatgccccaccacaatctagccgacttcgagccttgcctcggatatgccactgaagggcaagcagttggttatatacccctgcaaaacacattggagagccctcagtatcacacacaaccgcaccccttgcattccacaccggaggaaaggctcagagccattgaaggaggtgaagattatgcctttgctaacctagaggagttgttcctagtacccaatatcatcacccctcccaagttcaaggtgtcgaactttaacaagtataaggggactacttgccccaagaaccatctaaagatgtattgtcggaagatgggggcatacacaaaagatgaggaactgctaatacatttcttctaa

SEQ ID NO: 10998 - DNA, 633 bp, Glycine max
  Peptide Sequence Number=SeqID_127776
atggatggattcaatgctgtgttctttgtcagcagcgaccacgagaacgttgcgtgttcttcctccgagagtggccatttctgctttgagggttttgaggtgaagcgaattgaggatttctatgaggtcggggatgaggtcggagcggtcctcgcagcacagcgaggccttgaagatgagccttccgtcgccgccaccggaggcgtagtcgcctccggtggtggagagcaccgtgatctcgtcggtctccgacggaacggtttcaagctcggtaatctccgaggtttgctgcttcaactccttcacccgctggacaaccttcgccagaagcgaagccttgtggtcgaggtgggagttgattctctccctccttctcttctcagcctccttgtggttcttcatggcagcaagggctctatcatggtgggagggtgtttcggtaatttgggagaggtggaaggggtagtaattagtattattggaggaattagtagagagggggtggtgcatggtgtgagtgtgaggtgcagcatggaagaagggggtgttggtggtggtggtggtggtggtggtgttgggaaggaattggaggaggtgagagttgtccatggcaaagtggtgcatgatgatagg

SEQ ID NO: 10999 - DNA, 393 bp, Glycine max
  Peptide Sequence Number=SeqID_127777
atggaatggttgttgggaagtgtgttttgggttggactcttgctcggtgaaatgacaaggggttgtaaatattggactgggctttcggtccccggaactggaagaataatgtgttgtgttgggttcccaaatcttgcttttggggggagaaaaaggaaaaaaggtgttgtgaccggtcggagaaagagagcaagcttattacaaagaatcagaactcagaaggtagttctgacgactttagttggacaccattatcaatacaacaatattattgttagatttttcaatacactctctcacgcacaatacttcttggacttggtgcgtgaacaacaaatgataggtggtcgcaacggaagcgaagacgaggtccaggatcagaacaaactctga

SEQ ID NO: 11000 - DNA, 1044 bp, Glycine max
  Peptide Sequence Number=SeqID_127778
tataggggtgcgaggcttttaatagtggagcagtttcctgatacagcgggttcgattatctccttcaaggttgattcggatattatttcgttggatgggaaggagccgcttcagacggaggcggaggttggtgatgatgggaagcttcacgtcacggtgagaaagtcggcgagttcgcggtcggagattttttctaggcgctcgcacggtggcctgaactcggtgtcgttgactccgaggccttccaacttgaccaatgcggagatttactcgctgcagagctccaggaaccccacgcccagaggctcgagttttaaccacacggatttttactccattgtgaatggtggtggtgggaggaacaacaacgtgagtgtgagtccgaggcagagtaatttcggggggtttgatgaggagagtggtgggggtatgagggtgaatggtgggtaccctgggcctgcgaatgcggggattttttctccggtggcgaagaagaagggtggtgagagtggtggtggtggtggtggaggagggaaggatctgcacatgttcgtgtggagttccagtgcttcgccggtgtcggagggtggtatccatgcctttagaggtggtggggattacgggagtgaccagcttcccgtttgtggggtggctcaccagaaagattatgatgagtttggtcacgatgagtttagcttcgggaacagaaccattgctaatggggttgacaaggaagggccagtgctttcaaagcttggttcgagttccacggctgagcttcaccccaaagcacaaggtgaatccaaacctacttccatgccacccacaagtgttatgacaaggctcattttgatcatggtttggaggaagctgattaggaaccccaacacatactccagcctctttggtctcacttggtctttgatctcattcaagtggaatgttgttatgccagcaattgttgctaaatcgatatcaattttatctgatgctggtcttgggatggcaatgtttagccttggtatatttaataaaatagattga

SEQ ID NO: 11001 - DNA, 213 bp, Glycine max
  Peptide Sequence Number=SeqID_127779
atgagtgatcaacaacaattgcaatccaaattttctccctcaaagaattcagattcaagattagtggaaaacagagtgagaaagcgtggtgaggaaagagatggattgggtggtgctggagggtcaccggaaggaccgtggcggtggtggcctgtaaaggtggtggaggaagatgagcccttgcgcttctttgatgattcttcgattttgtga

SEQ ID NO: 11002 - DNA, 252 bp, Glycine max
  Peptide Sequence Number=SeqID_127780
atgtcacgaaacctcacggattacgcaatcgtcccctctttggcttccggaatgttacggaattttacggattgcgcattaacactccctttcaactcccgacatgtcgcggaacttcacggattgcctaacgatgggtgtcaagtacctcgaaatggtcaagcgaaggtcacatcccaccaaacagatggtcctcggatgaaattagggtatgacagttgcccctctttacttgtcatttattggagataa

SEQ ID NO: 11003 - DNA, 273 bp, Glycine max
  Peptide Sequence Number=SeqID_127781
atggaagggatactgatgatggaacattttggatggaggggaatggacgctattgggagtggtaattgggggttctggcagtggaatccgttaccgcagtctcgacgaagtcgtattcgctccaagtcgggttcggcggatgcgaccggtggaggcggttaccgatttttggcgaagcaggcagtgaccgccgcgtccctaaccctcaccggcgacacaatccctcaactcagcaaccattggaggaaagcaaaggaaggtggtggcagttag

SEQ ID NO: 11004 - DNA, 369 bp, Glycine max
  Peptide Sequence Number=SeqID_127782
atggaggctgttgtggcactctttgaacgcatgtcgcaaagggatgtcttctcatggacaattgtggatagttttgctttgaatgggaatttcgatgcctcaattcggtttttcaggaagatgatgattcataaggatgtggtggacggtttggtgaagcctaatgaggttacttgttctggtgtgctctcttcttgtgccaatttagatgtgatgcaagcttcattggagcttgtaggcctaggatcttcttcatcaatggattcctttgcttcttggaggatgaatggcagcggaatggagaaagggagagagaaaggagacgctacttcaaggagaagtgagtctagaagaagctcaccaccatag

SEQ ID NO: 11005 - DNA, 184 bp, Glycine max
  Peptide Sequence Number=SeqID_127783
atgacttcatatggattccttttatatggtcctggttcttatgcctggtaccagtgccttgaccactttctccccaaaccaacagtccagaatctaatgttaaaggagctagcaggagttaaggatagtggtgatactttctatgttatctttgtttcttcttcgtcttcttcccttatggcag

SEQ ID NO: 11006 - DNA, 585 bp, Glycine max
  Peptide Sequence Number=SeqID_127784
atggggtgcttgagtaatgctgaaaatgttttcagagtaatggttgtcagagaggtgagtacttggaatgcaatggtttcttcattagcttctcatggaagagagaacgaggctctggacatgtttaaaaggatgaagcttcatgggttgaaaccaaatagcattacctttgttgtagttcttacaacatatgctcgtggaaatttaattagggaaggattggacttgtttcgatcaatgtggtatgactttggaataaagcaaaatttggagcactatggatgcgtgattgatcttttgggtaaagcaggccataatgaagaagcaactgagatcataagaaatatgtcttttcagccttacgcatctattttgggagcatgtaggattcatggagctattgaacttggagaaggaataggaaaaaagatgcttagattgcagacacaatattgtggccaatatgtgttactgtcaagcatgaatgcaaaggaaagatgggatcgtgctgctggtttgaggagagaaataatggaggctggaattcataaatttccagaatacagtatggttgacttgacataa

SEQ ID NO: 11007 - DNA, 333 bp, Glycine max
  Peptide Sequence Number=SeqID_127785
atggattgtttttcttccccataccaccactaccgccactaccaccactgctctcgaacaaagtcatcgtcgcgtttggctcgaaaaaccgagaacggaacggtggagccaattcaaatttccctcgacacgcttccggcgacggcgaagccttcgtcgccgtctctcctccgatctccgacgagctcccttccgatcaaggagcttctgcttctatcgccttcctcggcgcggaggtcaaaggaagaggaggcacagtgggagacacaggaaggagagactcagcttggtgccttttcaaccaccttcaacttcttctccaagtatgcatga

SEQ ID NO: 11008 - DNA, 294 bp, Glycine max
  Peptide Sequence Number=SeqID_127786
atgaagatcaagaaaagaacaaaagaaaggaaagaaggattcccgatcaaagatcgaaaggaagtgaaaaggggaaaagaagcaactctcgatcaacgaaaggaagagaatagaaagtctccaaagccagattgccactcagaatcattcttgactggcaatattccaccccacatgaacaaagaggaaaaaaccgaaacacccagcttcctctccaaaaacgctgacctcgagaaaatcctattgattagccccatgtttcccctgcgtgtttgtttgaaagctagaagttga

SEQ ID NO: 11009 - DNA, 230 bp, Glycine max
  Peptide Sequence Number=SeqID_127787
cgcaaaggagaatctggaagagcatcaacatcaaggccacgtgttaagcgcgagatcagtgcactaagcacagcaggtgtcttcagccaggctcagcgcaagactggcgctaagtccaaacccacttactcgcgcaagcgcgaggacttgtgcacactattccagagtgccaatttcagtaaaagagccctagaagcaacaagaggagcagcttgtgcattgaagcctaa

SEQ ID NO: 11010 - DNA, 243 bp, Glycine max
  Peptide Sequence Number=SeqID_127788
atgttccagaacaccaacaccaaaatccaacatccactccacagaagccaggcacactcacaccagaacccaacaccacatttgaccaacgcatttttaaccaaaaaatgtccatcacttaccttcgtcggtatcgcgcctagaaggttttggcacaatgttagaattctagctcttctagagtggtatctcactgatggctctggcccccccagatggaggccttctttgccctctacctaa

SEQ ID NO: 11011 - DNA, 335 bp, Glycine max
  Peptide Sequence Number=SeqID_127789
aggccatcttgcagttgtccttatacaaggcaatagaaggacagaagtttcttaggacattgatgaagtcagaaaatgttccagccattgcacaatgtgcaaactctgactatgaaagtgtgattacagcgtataagagtgctctaagcaagttgaaagacgatcctaaaactgctaagcattatgccagagatgctggtaatggtcctgtttcctgtgagacagccttggctgctacaactgtttattttaactttgaaatttctaatcttaacatccaaatggggtcgcttagctatattgcaaccctagccatagataaacttattatttag

SEQ ID NO: 11012 - DNA, 990 bp, Glycine max
  Peptide Sequence Number=SeqID_127790
gaaggtaagatgaaagaagcattttccttgttgaatgaaatgaaattgaaaaacatcaacccggatgtttatacctttaacatattgattgatgcattaggcaaggaaggtaagatgaaagaagcatcttccttgatgaatgaaatgatattgaaaaacatcaacccggatgtttgtacctttaacatattgattgatgcattaggcaagaaaggaagggtgaaagaagctaaaattgtgttagctgtgatgatgaaagcatgtgttgagcctgatgttgttacttataattctctaatagatggatacttcttggttaatgaagtaaaacacgcaaaatatgtattctattctatggctcaaaggggagtgactcctaatgttcagtgttataataacatgattaatgggttatgtaagaaaaaaatggtggatgaagctatgagtctctttgaagaaatgaagcacaaaaatatgattcctgatattgtgacttatacttctcttattgatggtctgtgcaaaaatcatcatctggagagggcaattgcattattaaaggaaatgaaagagcatggaattcagccagatgtatactcatacacaatacttcttgatgggctgtgcaagggtggaagacttgagaatgcaaaggagtttttccagcatcttttggttaaaggctgtcatctgaatgtttggacatataatgttatgatcaatgggctttgtaaagcaggcctgtttggtgaagcgatggatttgaagtcaaaaatggaaggcaaaggttgcatgcccaatgctataacttttagaacaattatttgtgccctatctgaaaaagatgaaaatgataagggagagaaaattctccgagaaatgattgctagaggcttattgaaagagggttggtgggattctaatgtgccgctagggtttgggagtggacttcttgcgggagtggcatggggaagctctttcagtcattag

SEQ ID NO: 11013 - DNA, 357 bp, Glycine max
  Peptide Sequence Number=SeqID_127791
atggaattctcaaggcacggtcaagtattggggaaccttttgtttgagttattatcagaggcacttggactcctgcctgatcatcttaaagacatggattgtgcaaagggtcacttaattttctgtcactgctatccatcatgtcgtgagcctgaactgaaaatgggaaccagaagccacacagatcctgatttcatcacaattttgtttcaagatcatgttggtggactcaaagttttggtccagaattattggattgatatgccccctattcctggagcactggttttaaacattggagatctactgcagcatacaacctcaatgccaatttgctgcactacaaaggatgattaa

SEQ ID NO: 11014 - DNA, 201 bp, Glycine max
  Peptide Sequence Number=SeqID_127792
atgaaacatttgggtatagataataagaaatttgtgatcgaaaatgaaaaggcaatgaaagttgcataccttggcatggttggaacttggaattcaaaaattaagccagcaaaaggtcacaaaataaacttcagagtagaaagtagcaatattctagttgaaaatgatcgagttacaaacaaggaggtgattgaagaatga

SEQ ID NO: 11015 - DNA, 2304 bp, Glycine max
  Peptide Sequence Number=SeqID_127793
cgtggaaagtatgtcccaaagattcatccttcatctattttctgtactctctgtccttcttcactaccaatgccatctttctcatccttaagaacattcagggtttctgttttttcgcattttcttctttcttatcccccaattgcaactgcaaccctccattatcaatcccattctcaacctcactatcaccatcatcaccatcatgctgttgcctcattcgatcgcatgctccttatgcgccctccccctcccaccttccattttaactacattctgagttcccttgtcaataacaagcattaccccactgtcatctccctttttaaaaaattcgaatcaaatggggctacacctgacctttgtactctgaacatcctcatgaactgtttctgccatctgactcacatcacttttgctttttctgtattggccaacattctcaagaggggttatcatccaaatgcaattaccctcaacacactcatcaaaggcctctgttttcgtggggagattaaaaaagcactgtattttcacgatcaggtggtagctcaagggttccagttgaaccaagtcagttatcggacgttgatcaatggtttgtgcaaaacaggagagacaaaggctgtcgcaagattactgaggaagctggaaggacactcggttaaacctgatgtggtaatgtacaatacaataattcatagcttatgcaaaaataaactcctaggagatgcctgtgatttgtactctgaaatgattgttaagggaatttccccgaatgttgtcacctacaatgctctcgtctatggcttttgcatcatgggtcatttgaaagaagcattttctttgttaaatgaaatgaaattgaaaaacatcaacccggatgtttgtacctttaacacattgatcgatgcattaggcaaggaaggtaagatgaaagcagctaaaattgtgttagctgtgatgatgaaagcatgtattaagcctgatgttgttacttataattctctaatagatggatacttcttccttaataaagtgaaaaatgcaaaatatgtattctactctatggcccaaagcggagtgactcctaatgttcggacctatacgaccatgattgatgggttatgtaaggaaaaaatggtggatgaagctatgagtctctttgaagaaatgaaatacaaaaatatgattcctgatattgtaacttatacttctcttattgatggtctgtgcaaaaatcatcatctggagagggcaattgcattatgcaagaaaatgaaagagcagggaattcagccagatgtatactcatacacaatacttcttgatgcactgtgcaagggtggaagacttgagaatgcaaaggagtttttccagcgtcttttggttaaaggctatcatctgaatgttcagacatataatgttatgatcaatgggctttgtaaagctgacctgtttggtgaagcgatggatttgaagtcaaagatggaaggcaaaggttgcatgcccgatgctataacttttaaaacaattatttgtgccctatttgaaaaagatgaaaatgataaggcagagaaaatcctccgagaaatgattgctagaggcctacaggaagtaagattgaaagaagctaaaattgtgttagctgtgatgacaaaagcatgtattaagcctgacgttgttacttatggcactctaatggatggatacttcttggttaatgaattaaaacatgcaaagtatgtattctattctatggctcaaatgggggtgacacctaatgttcagtgttataccatcatgattgatgggttatgtaagaaaaaaacggtagatgaagctatgagtctctttgaagaaatgaaacacaaaaatatgtttcctaatattgtgacttatacttctcttattgatgcattatgcaaaaatcatcatctagagagggcaattgcattgttaaaggaaatgaaagagcatggaattcagccagatgtatactcatacacaatacttcttgatgggctgtgcaagagtggaagacttgagggtgcaaaagagatttttcagcgtcttttggttaaaggctatcatttgaatgtccagggtaatcaagggttctgtgggaatcaattattaaacaaatgtgagtacaatggaaggtcaccatttggtccaccttctgcctctgataatgatcaagactccggatttttgggtgaatttgacgggaaagtggttctgattgggtttgggagtggacttcttgcgggagtgacattgggaagctctttcagtcattag

SEQ ID NO: 11016 - DNA, 699 bp, Glycine max
  Peptide Sequence Number=SeqID_127794
atgggttttttacaagatgatagagaattcattgactcaaccaaagaagcaaaagacaggggctcagcacattatctaaggaaggtttttgtattattacttttgacagaattacattttgatgatgacaacctgaagaatttggtattacgtgaaattgaacaactgttgcaagccaatcaaagatcacttagagactatccttcaatgccctatcctgagaatggaaatttggcaacttatctagacaataacctcatattggctgagctaaattacaacaatgaagagctcagattagaattcctgcaacttttttctcaaatgacaaaccaacaagcaacaatttataaccaaattattcaggctgtcaatccaaatgaaggttgcatgtttttcctgtatggatatggaggtataggaaaaacattcatctggaaagcacttgcaagttcattaagagctagcaataaaattgtaattatggttgcttctagtggcataacttctttgttattgcctgaaggaagaacaacacattcaaaattcaaggttcctactccaatttttgaagactcaacatgcaatatccaccaaggaacacaattagctgaattattgaatgaagcaagcctgatcatctgggatgaagccccatggctcacaaatttttttttgaagcacttgatcaaagtctaa

SEQ ID NO: 11017 - DNA, 291 bp, Glycine max
  Peptide Sequence Number=SeqID_127795
atgtgtcggcttggatcaagatttcgattcagcaactcatcacgcgccgtgcgcgtccgttccgttccgcgtcccaaatcgtgcggtcataaacgcgagatgaaacatcaggtagaagcacgcgacacgtggcgcgtggtaaaagtggagagtgaggtgagtcgcggcgtgtttggttatttaacgggaaggagagggacaggacgcgattttggatgcgactgggaagcaccgaaaacaaaggtgactgcgttacaagtttcaaaggacgcgtcaagaggaagacagtga

SEQ ID NO: 11018 - DNA, 99 bp, Glycine max
  Peptide Sequence Number=SeqID_127796
atggcatgggtgacaggagatcctctagggttcatcagtgaatttactgctcagacaaataaattcatccttatcgccatctacttcaagaggaaatag

SEQ ID NO: 11019 - DNA, 750 bp, Glycine max
  Peptide Sequence Number=SeqID_127797
atggatacaaagtttgcacgaaggactgagcgcattggtagtacaacatgctcttattggagagctggaagatgtaacaggaatcgttgcagatttttgcacatagagacaccatctccccctgctgcttgtggttatggcaatactgcatatagctacggaaaaaagccccattcctcctctgagaataccccgaaatatggttcaaagaaagcattgcttggagataatggagatagaggagatgcaacaagggttgctaaggctttcaagaaatcatcaccaaggatatgtaaatactggatcaacaacaattgtgtacatggtgaacaatgcctgtatctgcattcatggtttcgtggtgatgggttttccacagtaacgaaacttcatgaacataagaaggttatcactggcatcgcacttcctgttggatccgacaaactttattctggcagcactgatgggacagttaggatatgggactgccatactggtcaatgtgctaaagtcatcaatcttggtgctgaggttacctctttgatcagtgaggggtcatggatttttgttggtctgcaaaatgctgtcaaggcttggaatatccagaccatgtcagagtttactcttgatggacccaaaggccgagtccgtgccatgactgttggcaacaatacactctttgctggtgcagaggatggtgtcatttttgcttggagaggaagctctaaagccgattctccttttgaactg

SEQ ID NO: 11020 - DNA, 381 bp, Glycine max
  Peptide Sequence Number=SeqID_127798
atggggtacgaagttttttttattagtgggcagagcttcaggggacgtgtaaggtgggatgaggctaatattggagaaattgaggcaaacaaacctgtgaggcagaaaattactgagcctaagactccatatcatcctatgattgatgatgacagttctctatcccctgtacgaggaagttttgatgcatgtattgatgatcaaaatcacacgatgcatgctgaagcaatatggagtgctctgaatgatgtagcctccagtagcagaagaggcactggacaatctggtggttggacgtcatctgaggatgagccagaagcaatggagcaagatgatgatgataatgatggaatcagggttctgacagacctagtaaaatag

SEQ ID NO: 11021 - DNA, 155 bp, Glycine max
  Peptide Sequence Number=SeqID_127799
ggcttgctttggagaggcaggggtattcataccaggcatgccatcaccaagcaatggtatcatcactaagtgatggaggcagggcttgctttggagaggcaggggtattcataccaggcatgccatcaccaagcaatggtatcatcactaagtga

SEQ ID NO: 11022 - DNA, 321 bp, Glycine max
  Peptide Sequence Number=SeqID_127800
atggaggatgtttgggtgagtggtgtgggagggaagagcttgcgggcaaacacgaaggtgaaagtattcactggcaccgtctgtctgaagcattcggtgcaattgtggtggggatatagcttggaggtccttgttggtgtcactccgaagttcaatgagttgtccattgtggacgaatttcatgaccacatcagcaccacatatcagaagaacgtggaggttcgtggtgaacacgtgaccctgtacctaaactcgagcatttggacagagatggtgacactcaatctcgttaccatttcctacgagtaccctcagagctag

SEQ ID NO: 11023 - DNA, 1056 bp, Glycine max
  Peptide Sequence Number=SeqID_127801
atgcaatttgcctcactttttcaaccacccaccaccttgccaccatccagacccaccaaccacgccatccacctcaccccaaactcgaccccagtcaacatccaaccgtaccgatatccttactttcagaaacaggaaattgaaactcaagtggccacaatgcttcaaacagggataatccgaccgagcacgagccccttctcgttgcaggtgctagccttgaatgctctgacggtgaaggatagatttctgatcccaacgatagatgagctcttagatgagcttggtggcacaagctggttttcaaagttagacctgatgcaaggatactgccaaatccttatggctgtagatgatattagtaaaactgccttccggacacaccacagccactacgaatttcttgtggagtatctggggcatcttgtgtctcatcgtggggtggagcccgtgccgactaaggtcaaagcagtgcaacaatggtcgacgccccaatcaacacgtgccctacgcaagttcctaggcttatcaggcttctatagatggttcataaaaggatatgccagcatcgcggctccacctacacgacttctaactacagattcatttcaatggaaccctgaggctacacaggcattcgaacttcagaaggaactgttccaagactcgactttcctggagtatcaccagcaaattcaacaagctccccaggaatatcccgagtgttgcatccgccagggcttcatcctcaaaaaggggcgcatatggttaccaaaggggttgtcgtcaattcaaatgattctcgccgaatttcatgccacccctactggaggtcacatggggatagcgaaaatcttagcctgtctcagcgagaattttgtttggttgtcgatgaagaacaatgaagacctctcacttgatttcatcatgggattgccatctttgcaaggacactccgccgtactggtgatcgttgaccacttctctaaagggtctggtctcagatcgagaccctttgttcgtgagccacttctggcaagagctgttcaagcttag

SEQ ID NO: 11024 - DNA, 444 bp, Glycine max
  Peptide Sequence Number=SeqID_127802
atggcatgtttttatgatgctgttgaggagcatgttggtaagaaatgccatgatgggcatgttgatgttgatgatggtgaagaccagaatgattttgtggacattttgctttcgattcaagagactaacaccacagatttccagattgatagaacattcgtcaagactttggtcatggacatagttaatgcttgggcaatttcaactgacccttcatattgggaccaacctctagagtttcaaccagggagattcttgaagagttcattggatatcaaaggacatgatttcgaattgatccgatttggagctagaagaaggggttgtccaggaataggctttgccatggctttgaatgaggtagtccttgcaaacattgtgcaccagttttattgggcagtgcctggtggagtggtggagggaacagacactgaatatgtttga

SEQ ID NO: 11025 - DNA, 141 bp, Glycine max
  Peptide Sequence Number=SeqID_127803
atgaggttctcttttgagcgcaactacgaggttcccttcgagtgcaaacacaatggtaacatccaggttacctacgactacgagtgcaaaggcaaaatgtctcgttgccgatgcgagaagatagtgaactcttggtgtttg

SEQ ID NO: 11026 - DNA, 1758 bp, Glycine max
  Peptide Sequence Number=SeqID_127804
atgccatctttctcattcttaagaacactcaggctctctctttttccgccttataccccaattgcaattccaactgcaaccctccattctcaatctcattctcaacctcactctcaccatcatcaccatgatgctgttgcctcattcaatcgcatgcttcttatgcgccctcccccacccaccttcctttttaacaacattctgagttcccttgtcaagaacaagcgttatcccactgtcatctccctttttaaacaattcgagccaaatgggattacacctgacctttgtactctgagtatcctcatcaattgtttctgccatctgactcacatcacttttgctttttctgtattcgccaacattctcaagaggggttatcatccaaatgcaattaccctcaacacactcatcaaaggcctctgtttttgtggggagattaaaagagcactgcactttcacgataaggtcgtagctcaagggttccagttggaccaagtcagttatgggacattgatcaatggtttgtgcaaagcaggagagacaaaggctgtcgcacggttactgaggaagctggaaggacactcggttaaacctgatttggtaatgtacactacaataattcattgcttatgcaaaaataaactcctaggagatgcctgtgatttgtactctgagatgattgttaagggaatttccccgaatgttttcacctacactactctgatccatggcttttgcatcatgggtaatttgaaagaagcattttccttgttgaatgaaatgaaattgaaaaacatcaacccggatgtttatacctttaacatattgattgatgcattagcaaaggaaggtaagatgaaagaagcattttccttgacgaatgaaatgaaattgaaaaacatcaacccagatgtttatacctttagcatattgattgatgcattaggcaaggaaggtaagatgaaagaagcattttccttgttgaatgaaatgaaattgaaaaacatcaaccccagtgtttgtacctttaacatattgattgatgcattaggcaaggaaggtaagatgaaagaagctaaaattgtgttagctatgatgatgaaagcatgtattaagcctaatgttgttacttataattctctaatagatggatacttcttggttaatgaagtaaaacacgcaaagtatgtattccattctatggctcaaaggggagtgacacctgatgttcagtgttatactatcatgattgatgggttatgtaagaaaaaaatggtagatgaagctatgagtctctttgaagaaatgaaacacaaaaatatgtttcctaatattgtgacttatacttctcttattgatggtctgtgcaaaaatcatcatctagagagggcaattgcattatgcaagaaaatgaaagagcagggaattcagccaaatgtatactcatacacaatacttcttgatgcactgtgcaagggtggaagacttgagaatgcaaagcagtttttccagcatcttttggttaaaggctatcatctgaatgttcggacatataatgttatgatcaatgggctttgtaaagcgggcctgtttggtgatgtgatggatttgaagtcaaaaatggaaggcaaaggttgcatgcccaatgctataacttttaaaacaattatttgtgccctacttgaaaaagatgaaaatgataaggcagagaaattcctccgagaaatgattgctagaggcctactgaaagtgtaa

SEQ ID NO: 11027 - DNA, 180 bp, Glycine max
  Peptide Sequence Number=SeqID_127805
atggcatgcttttatgatgaagctgttgaggagcatgttggtaagaaatgccatgatgggcatggtgatgttgatgatggtgaagaccagaatgattttgtggacattttgctttcgattcaagagactaacaccacagatttccagattgatagagcattcgtcaagactttggtcatg

SEQ ID NO: 11028 - DNA, 1752 bp, Glycine max
  Peptide Sequence Number=SeqID_127806
atgccatctttctctttcttaagaacattcaggctctctctttttccgccttatcccccaattgcaactgcaaccctccattctcaatctcattctcaacctcactctcaccatcatcaccatcatgctgttgcctcattcaatcgcatgcttcttatgcgccctcccccacccaccttccattttgacaacattctgagttcccttgtcaagaacaagcattatctcactgtcatttccctttttaaacaattccaatcaaatggggttacacctaacctttgtactctgaacatcctcataaactgtttttgccatctggctcacatcacttttgctttttctgtattcgccaacattctcaagaggggttatcatccggatgcaattaccctcaacacactcatcaaaggcctctgtttttgtggggagattaaaagagcactgtactttcacgataaggtcgtagctcaagggttccagttggaccaagtcagttatgggacattgatcaatggtttgtgcaaagcaggagagacaaaggctgtcgcacggttactgaggaagctggaaggacactcggttaaacctgatgtggtaatgtacactacaataattcattgcttatgcaaaaataaacgcgtaggagatgcctgtgatttgtactctgagatgattgttaagggaatttccccgaatgttttcacctacaatactctgatctatggcttttgcatcatgggtaatttgaaagaagcattttccttgttgaatgaaatgaaattgaaaaacatcaacccggatgtttatacctttaacatattgattgatgcattaggaaaggaaggtaagatgaaagaagcatcttccttgatgaatgaaatgatattgaaaaacatcaacccggatgtttatacctttaacatattgattgatgcattaggcaaggaaggtaagatgaaagaagcattttccttgttgaatgaaatgaaattgaaaaacatcaaccccagtgtttgtacctttaacatattgattgatgcattaggcaaggaaggtaagatgaaagaagctaaaattgtgttagctatgatgatgaaagcatgtattaagcctaatgttgttacttataattctctaatagatggatacttcttggttaatgaagtaaaacacgcaaagtatgtattccattctatggctcaaaggggagtgacacctgatgttcagtgctatactatcatgattaatgggttatgtaagaaaaaaatggtagatgaagctattagtctctttgaagaaatgaaacacaaaaatatgtttcctaatattgtgacttatacttcacttattgatggtctgtgcaaaaatcatcatctggagagggcaattgcattatgcaagaaaatgaaagagcagggaattcagccagatgtatactcatacacaatacttcttgatgcactgtgcaagggtggaagacttgagaatgcaaagcagtttttccagcatcttttggttaaaggctatcatctgaatgttcggacatataatgttatgatcaatgggctttgtaaagcgggcctgtttggtgatgtgatggatttgaagtcaaaaatggaaggcaaaggttgcatgcccgatgctataacttttaaaacaattatttgtgccctatttgaaaaagatgaaaatgataaggcagagaaattcctccgagaaatgattgctagaggcctactggaagtgtaa

SEQ ID NO: 11029 - DNA, 816 bp, Glycine max
  Peptide Sequence Number=SeqID_127807
atggctccaccgactcctccgacgatgactccggcgacccctacgcctccgatcaattccgcatgtttgagttcaaggtccggcgctgtactcgcagccggagccatgactggacagactgtccatttgtacatcccggcgagaaggcccgccgtcgggaccctcgccggtttcattactctgcaacagtctgtccagagtttcgccgcggtcagtgtgaccgtggcgatgcatgcttgcaaggatggtaggaattgcaagcgaaaagtttgcttctttgctcacacccctcgccaactcagggttttgcattccaatgaaaatagcaacaagaaaaagtgcaccaatatgagccctcataacaacaacaacaacaccaacaattgttgtttggtttgccattgctcttcttctactcgttcaccaacttcaaccttgttcggcatgtctcatttttctcctccattgtcaccaccttctccttcttccccttctaggtttgagaccaaccatcatcatggtgttgtgaaatataataaggatgtgctctctgagcttatgtgttccatggagggtttgaattttggtgaggcttcacttttgtctgctgcttctaagcctcacaacaatttgtcttcttggcttgatgtttctgaggatcacaatcaaaaacagttcagtactctttcaccaaccatcactgcttgtggaagcttttccaacaacggaaatgggagatttttgagagaagaaagtggggttgttgatgatgttatttccccagatctcgcatgggtgaatgaattactgatgtag

SEQ ID NO: 11030 - DNA, 208 bp, Glycine max
  Peptide Sequence Number=SeqID_127808
agttcaaccagggagattcttgaagagttcattggatatcaaaggacatgatttcgaattgatccgatttggagctagaagaaggggttgtccaggaataggctttgccatggctttgaatgaggtagtccttgcaaacattgtgcaccagttttattgggcagtgcctggtgtagtggtggagggaacagacattggatatgtttga

SEQ ID NO: 11031 - DNA, 1152 bp, Glycine max
  Peptide Sequence Number=SeqID_127809
atggctccaccgccgccggtggaacacaacggcgactccgccgctaccgcctccgcctccgcctccgcggagtctcagagatcaattcccacgccctttctcaccaaaacctatcaactcgtcgacgaccaatccatcgacgacgttatttcctggaacgacgacgggtcaacgtttatcgtctggaaccctaccgttttcgccagagacttgcttcctaaatttttcaaacacaataatttctctagcttcgttcgccaactcaacacttacggattcaggaaagttgtgcctgatcggtgggagttctcgaacgattatttccgccgaggcgagaagcggcttctttgcgaaattcagcggcggaagatctcatcgccggcgccgtctccgactgcgccgacgacggttacggtgccgatgccgttgaccgcgataccgatcatatcgccgtcgaactctggcgaggagcaggtgatatcgtcgaactcgtcgccgttgcgagcgccggcggagcttctcgacgagaacgagcggcttaggaaagagaacgttcagttaacgaaagaactcgccgagatgagatcgctctgcaacaacatatattctctcatgtcaagctacggaaacaaaaacggaaacagcaacggcagttaccaaactgacggcggcgccggtggagcacagggaagcagggagtccggcatgacggcggtgaagccactggatttgatgccggtgaaacggagctccggcgaggacgcggcggatacggtgccgaaggagataaatctaattccgaatccgaagctgtttggcgtggcgattggagcgaagcgagcgagagagggaggaggaggaagtggaagtggtcgagattgcggaggaggaggaggaggaggagaggaagataccctgctgcgcctgcatcacgtgggttctgcagacgtgaaatctgagccgttggattgccagaaccatcgcgagaatcaggaaacgccgtggttgagtccgtgtcacaggacaaatcaaaggaactacgagcttcttggagagttaaatgagttcgaaaatcacgaagaattaatgcgtataaaagtggaagaagaaagaaaaacaattaaggagattctagccatcaaaacacgttga

SEQ ID NO: 11032 - DNA, 2433 bp, Glycine max
  Peptide Sequence Number=SeqID_127810
atgaaggccagcgaccgcagccgcatggaaaaagacatcatgtcacagcgcgaagcatcctcgacgaaagcgcaggctttcgatcaggataaccgccgtcgtcagatggaagagcgtaacaaactgctgagccgtattcaggacgcagtgaagaaagtggcggacagcgaagggtatgacgtggtaatcgacgccaatgccgttgcctatgcttctaacgcgaaagacattactgctgacgtgctgaaacagttggatgcagaattgcacggagatggcgatatcgccatctccggcattgcttctatgcaatccgccacccctggtcaaatcacttttcttgccaacagccgctaccgcgagcagctcgcacaggttcaggcctcagccgtggtgctgacggaagcggatctggagtggtgtaaaaccgccgcgctggtggtgaaaaacccttacctgacttatgcccgcatggcacaactgctggacaccacgccgcagcccgcgcaaaatatcgcgcccagcgccgtgatcgatccgagcgcgaagctggggaacaatgtctcggtgggcgctaacgcggtcatcgagtccggcgttgagttgggtgatgacgtggtgattggcgccggctgctttgtcggcaagcgcacgcgcattggccgtggttcccgtctgtgggccaacgttacggtttatcatgagatccagattggtcaggattgtctgattcagtctggcaccgtgattggtgccgatggtttcggttatgctaacgaccgcggcaactgggtgaaaattcctcagctgggcaccgttgtgattggcgatcgggtagaaattggtgcctgtaccacgatcgatcgcggtgcgctggataacactctgatcggcaatggtgttatcatagacaaccagtgtcagattgcgcataacgtcgtgattggtgataacaccgcggttgccggtggtgtgatcatggcgggtagtctgaagattgggcgttactgtatgattggcggagccagcgtcattaacggccatatggaaatctgtgacaaagtgacggtaaccggcatgggcatggtcatgcgtcccatcacagagcctggggtatactcatcgggtatcccgctgcaacccaacaaaacctggcgtaaaacggcagcgctggtgatgaacatcgatgacatgagcaaacgcttaaaagccatcgaacgcaagcgtaccttctttcacctcggggttaaccagagtgcggcagcaggtatcatggacaggaagagtattttgacaactgaaacgcatactctgaaaattgaagagattttagaactgctgccgcaccgctatccgtttttgctggttgaccgcgtgctggaatttgaagagcataaatatctgcgtgcggtaaagaacgtttctgttaatgaaccgtttttccagggacacttccctggtaaaccgattttcccaggcgttctgatcctggaagcgatggcgcaggcgaccggtattctggcgtttaaaagcgttggaaaactggaaccgggcgagctgtactatttcgccggtatcgacgaagcccgtttcaagcgtccggtagtgccgggcgaccagatgatcatggaagtcaccttcgagaagacccgccgtggcctgacgcgcttcaaaggcgtggcaaccgtagacggtgcggtgatcggcgccaacgtccaaatcggtccgttttgtgttgtcggagcgaacgtggaaattggcgaaggcacggtgctgaaatcgcacgtggtggtgaatggccacacgcgtatcggtaaagataaccagatctaccagttcgtttcgattggcgaagtgaatcaggatctgaaatatgccggtgaaccgacccgcgttgaagtcggcgatcgcaaccgcatccgcgagagcgtcaccattcatcgtggcaccacgcagggtggcggcctgaccaaagtcggcagcgacaacctgctgatggtcaatgcgcacattgctcatgactgcgtgatcggcaatcgctgtattctggccaacaacgtaacgctgggcggccacgttaccgtggatgattttgccatcatcggcggcgtgacggcggtgcaccagtggtgcaccattggtgcccacgtgatggtaggcggttgttccggcgtcgcgcaggacgtgccgccgtacgtgattgcgcagggcaaccatgccacgccgttcggtgtcaatatcgaaggcctgaagcgtcgtggcttcagcaaagaagcactgcacgccattcgtaacgcgtacaagctgctgtaccgcagcggtaaaacgctggatgaagtgaagccggagatcgaagaactggccaaacttcatagcgaagtgcagcctttctacgacttctttgcccgttctacccgtggattgattcgttaa

SEQ ID NO: 11033 - DNA, 2061 bp, Glycine max
  Peptide Sequence Number=SeqID_127811
gtgactgcgctggtggccggtcagaatgtggcgctgatggccgaacagtgtcagcaatttaaaccgcgctacgcggcgatgtccgacgacgcttccgctgcggcgctgcgtgaacgactgaaagcactcaacatggatacggaagtgctctccggcgttcaggccgcctgcgaactggccgcactggatgaggtcgatcaggtaatggccgccattgtgggcgcttccggcttacaaccgacgctggccgccattcgcgccggcaaaaccgtcctgcttgccaataaagaatcgcttgtcacatgcggccgtttgtttatggaggcggtacgccagcatcaggcgcagctgctgccggtcgacagcgagcacaacgccatttttcagagtttgcccgcttccatacagcatcagttggggtacgctgatctgcgggagaatggcatcgagtcgattctccttacgggatcgggtggtccttttcgtgacacgccattagccgagctggccgctatgacgccagatcaggcctgtgcgcatccgaactggtcaatggggcgtaaaatctccgttgattcggccaccatgatgaataaaggtcttgaatacattgaagcccgctggctgtttaacgccaccgacgcacaaatggaggtcatcctgcatccgcagtcggtgattcactccatggtgcgatactgcgacggtagcgtgctggcgcagctgggttcacccgatatgcgcacgccaatcgcccacagcatggcctggccggcacgtattaccgcaggcgtaacgccgcttgatttcacccgaatgaaggcgctgacgtttgctgagccggactacgcacgctatccctgcctgaagctggcaatcgatgcatgcgcaaccggacaggcggccaccaccacgctgaacgcagccaatgaagtcgcggtagcggcatttctgcagcatcagattcgctttaccgatatcgcggccatcaacagtgaagtgctggcaaccctgcagtgtcaggagccgggcagcgtggatgacgtgatggagattgatcggatcgcacgctcgctcgctcgcgttttacggcccgacattgtttcgatgtcatccggtgaggttaccggcgtttgccgcaggcgcaatgtattcagaaaccacagcatttctgatgaaaggaattattacgcgttatgtcgtccaacaatcacaatacaatcgatgacgggtcgtactgcacgccacggcaaactgcgtatttcaggccacaaagccggggtaaaatcagtacgccgggccgtcagctttgcggtcagcaacaagctggaagcgctcacgctctatgcgttcagcagtgaaaactggagccgaccggtacaggaagtgacggccttaatggaattgtttgtctgggcgctcgacagcgaagtcaaaagcctgcacaagcacaatgtgcgtctgcgcattattggtgatatcagccgtttcaataaccgcattcaggaacgcattcgccgcgccgaggaactgactcagcaaaatgatggactcaccctcaacattgctgccaactatggcggccgttgggatattatccagggtgtaaaaaaactggctgaacaggttcaggaaggactgctacgtcctgaccagataactgaagaaagtctggctccgcatttgtgtatgcaggagctggcgccggtggatttagtgataaggaccgggggagagcatcggatcagcaacttcctgctgtggcagatcgcctatgctgagttttggtttaccgatgttctctggcctgattttgatgaacacgtttttgaagtctcgtctgatcaccgcgtttattctgattccgctggtgatcgctgctctgttttggttgccgctgtccggttttgcgattaccaccatcatcatctgcatgcttgccgcctgggagtgggggcagctggcggggatggcaacgcgtcagcagcgtatctggctggcggtgctatgcggcctgctgctggcggtgatgctgttcaccctgcaaccctatcaacgtaa

SEQ ID NO: 11034 - DNA, 792 bp, Glycine max
  Peptide Sequence Number=SeqID_127812
atgcgcgtggcgggccgtctggctgccgaagtgctggagatgattgctccacacgtcgtgccgggcgtcaccaccggcgagcttgaccgtctgtgccaccagcacattaccgaaaagcagcaggccatttcagcctgtctcggctaccacggtttcccgaaatcagtgtgtatttcggtcaacgaagtggtatgtcacggtattcccagcgacgatcgcgtgctgaaagacggggatatcgttaacgtcgacgtcacggtgatcaaagatgagtaccatggcgatacgtcaaagatgttcatcgtcggcaaaccgacgattcagggcgagcgcctgtgccgggttacgcaagagagcctgtacattgcgctgcgtctggtgaagccgggcattcgcctgcgtgaactgggccgggcgattcagaaatacgtggaagcacaggatttttccgtggtccgcgagtattgcggacacggcatcggtaaaggcttccatgaagagccgcaggtgctgcattacgatgccgacgacagcggcgtggtgctgcaggctggcatgacgtttaccgttgaaccgatggtaaacgccgatcctgacgctgcgcgccgacgacactattccagcggtgctggaaaacaacgcgtaacgctcgtcatcaggataacaggccggctcaaaacgaacgcctgtcagtttaggttcacccatccctgcacctcccgtagcggcgccatcagttgcgcgttaatccgcgccgctactgcggtgatgtcacggacggtgactaactga

SEQ ID NO: 11035 - DNA, 1020 bp, Glycine max
  Peptide Sequence Number=SeqID_127813
atgacgcaccagccacgccaccagctgcatttcgcgcgaattgaggccgtgcagctcagcaaagtccagcgcgtcctgcgcgccaagaatcgagtggtcaccaccgcgccctttggcgatatcgtgcagcagcgcggccatcagcagcagctccggctgcggcagacgcggccacagctcgacgcacagcgggtgcatcgggcgcgtggcttcgtcggcaaaactttccagcttctgcaacacgcggatggtgtgctcatccacggtgtaggcatggaacaggtcgaactgcatctggccgacaatgttgccccacagcggcgtataggcccacagtacgctgtggcgatgcatcggcagcagcgcgcgctttaccgcgcctggatggcgcagaatcgccataaaggtgcggcgcgcttcggggatctgacacagcggctgttgcagatgacggcgggcgtagcgcagctggcgcagcgtggtggaatagatgccggtgatggtttcgttacgcaccatcacgtaaaacatgcgcagaatcgcctgcggctcgcgctcaaacagcgtgggatcgcgcaggtcaatcagattaccgcgcagctgaaaatcctcatcaatgctgcgcggcttctcggtggtcgacagcgccagaatggcttcgtcaaacagctgcagcagcatctggttcagctcgccgatacggcgcgtgacgcgatagaaatctttcatcatgcgctcaaccggctcattgccttcaccgccatagttgaggcgctgtgccacgttgagctggcgatcgaacatgagaaagccaaagccgaccatctcatccatggtggtggcgccaaagtggcggcgcgcgacccactgcagagtatgaatgtcgcgcagcccgcccgggctgcttttgatatccggttcgaggttgtagctggtgccgtgatagcgctgatggcgttccagctgctcctcaattttggcggcgaagaaagcgtgacgacggccagaaaccgtcgctga

SEQ ID NO: 11036 - DNA, 1834 bp, Glycine max
  Peptide Sequence Number=SeqID_127814
gcccggttattacggcgtggaacgtgccgaagcgaacaagcgcgcggaaaaataccttaatcagctcgacctgtggggcaagcgtaacgaacgggcgcgcatgttgtccggcggcatgaagcgccggctgatgattgcccgggcgctgatgcatgaaccgaaactgctgattcttgatgagccgacggctggcgtggatatcgaactgcgccgctcaatgtgggtgttcctgaaagagctgaacgccaaaggcaccaccatcatcctgaccacccactatctggaagaggcggaaatgctgtgccgtaacatcggcatcatccagagcggcgagctggtggagaacacctcaatgaaagggctgctgtccaagctgcagtcggaaacctttatcctcgacctggcgccgcgcagcccgctgccgcagctggagggcttccagtatcgtctggttgatacctcaacgctggaagtggaagtgatgcgtgaacaggggctgaatagcgtattcagccagctgagcgcgcagggcgtgcagcctgacgcagggaaaaacaggagtaaccgcatgacgcatctgtactgggtggcgctcaagagtatctggagcaaagagatcaaccgttttgcccgcatctggattcagacgctggtgccgccggtgatcaccatgacgctgtacttcattatctttggcaatctgatcggctcacgcatcggcgatatgcacggcttcagctatatgcagtttatcgtgccgggcctgattatgatggcggtgatcaccaacgcttacgccaacgtcgcctcgtcattcttcagcgccaagttccagcgcaacattgaagagctgctggtggcgccggtgccgacgcacatcattatcgccggttatgtcggcggcggcgtagcgcgcggcgtgtgcgtgggcgtgctggtgacggcggtgtcgctgtttttcgtgccgttccacgtattctcgtggccgatggtggcgatcacgctgctgctgacggcgattctgttctcgctggcgggcctgctgaatgcggtgtttgcgcgcacctttgacgatatcagcctgatcccgaccttcgtgctgacgccgttaacttacctcggtggcgtattctactcgctggcgctgctgccgccgttctggcaggcggtgtcgaagctcaatccggtggtgtacatgatcagcgggttccgctatggcttccttggcatcaatgatgttccgctggtgttgacgctcgcggacgcggcttgcgcacctgaggcgcagcccgtggctttccccatagtggccgctgaccaaaaaagcagcggggaagtgaagagtgaatcggctggtgaatcagctgctggcgccggtgcgtatggggctgatgtgctttgtctccggactgttcgtcgccagcggtttacgccacgggcaggcgcgctatctgcgaaacaaagtcagcagcattctctatccgtttgccgtctgggcgctgatctacggcgggctgaagtggaccttcagcgcgatggccaatcacccacagtcgccgctggccatcgtgctcggtcatctgagcggcggcgatatcacctggtttctgcactcgctgtttctgttttttgtgctgattatcccggcgcgccgcctgcctgcggcgctggtgctgacactgtgcgttaccggtgcggtgctgctgccgccgcgtcgtacaccgctgctgctgtcgctgatcgcctttatgctgctcacggcgttcagcctgtggggcgggctgcgtcagcattcgccgtggctgctgccgctggcgctgccctcaatcccgct

SEQ ID NO: 11037 - DNA, 2241 bp, Glycine max
  Peptide Sequence Number=SeqID_127815
atggccgcttcatcaggtaaaaaaacgcagatcggcacgcgtgaactgcatccggaaacgcagatgctcaactacggttacgatccgcgcctgtcagaaggtgcggtgaagccgccggtgtttctgacgtcaacctttgtgtttaacagcgccgaagagggcaaagaatttttcgatttcgttgccggccgccagcaaccgccggcgggcaaaagcggcgggctggtctattcccgcttcaaccaccctaacagcgagatcgtcgaagatcggctggccatttatgaaggtgccgaaagcgccgcgctgttctcatccggcatgtcggcgattgccaccacgctgctgacctttgcccgtcccggcgaagtgatcctgcactcgcagccgttgtacggcggcaccgaaacgctgctgagcaaaacgctgcacgatctggagatcaaagcagtgggattcagcgacggcaacgacgaaaataaagtgtatgaagccgcgaagctggcgtggcagcgcgggcgcgtcgcgatgattctgattgaaacgccggccaaccccaccaacagtctggtagatatccaactgatgcgtcaggtggcagaggtgatcacccagcagcagggctcccggccgattctcgcttgcgacaacaccctgctcggcccgctgtttcagcgtccgctgcagcacggcgcggatatctcgctctattcgctgaccaaatatgtcggcggtcattccgatttgattgccggcgccgcgctgggcagccgggcgttaatcaacaaagtgcgttcgctgcgcagcgcgattggcacccagctcgatccgcactccagctggatgattggccgctcgctggaaacgctgtcgctgcgcatggagaaagccgccagcaatgcggaacaggtcgcggcatttctacgcgatcacgcgcaggtggcgaaactgcactggctgccctatctcgacgccagcagtccggcaggagaaacctggcagcgccagtgcagcggcgccggttccaccttctcctttgatatcgagggcggccaggctgcggcattccgctttctcaacgcgctggcgctgttcaaactggcggtgagcctcggcggcaccgagtcgctcgccagccatcccgccagcaccacccattccggcgtaccgcaggaggtgcgggagcgcattggcatcaccgacgcgacggtgcgcctgtcgatcggcatcgaacatgccgatgatttgattgaagatattcgcctgacgctggaagcggccatggcagtgcgccatataggcattttcagtatcggcgacgtagttgaagcgcaccagcacttcactgcgccagccgttgacgctgaccatgtctttccagccggcgcgatgcgccgcaggcggcttgccgttctcggacagaatgcggaactgcgtgccgtgaatgtggaacggatgcagcatggcgtcgccttcgccggagatggtccatttttcatatttgcccagcggcacggcaaacatgggcttttccatggttgccctgatccatcgccatatcgccgtgatccatgttgccatgatccatcgcgccatggtccatgttcatgctgccatgatccatcgctttgcccgcgccgtgctggctgcccatcgctttggcaccgtagcgctgctgcagcgcctgcatgccctgctgatccagctgcggatccatcatcagctgtagccagcggctctgcagcccttccgttgccggcagcggcggcacatccaccagctggtccggcagcgtaccgctggccatcacgcgcagcggcagaatctgcaccagcggcagcggctgatcgaacggcgccagctatccaccagcacttcaaagcgctcgcccggcagcagcggcaggctctccaccttcaccggttcagccagcaggccaccgtcgctcgccaccacgtacagcggacgtttatcgctggcggcgatgtgcagcgagcgcgcgttgcagccgttgagcaggcgcagccgcagccagccgcgcggcaccgcgtgctgcggatacggcacgccgttgctgcttatcctggaaaatcagcggcacatcatcttcgccccactgcatcggcagccgcagcttgccggacgcctcatcttccagcagtaccagccccgccagcccctgcgccacctgatagccggttttgccgtgctgatgcggatggaaccagcaggtcgccgccg

SEQ ID NO: 11038 - DNA, 1427 bp, Glycine max
  Peptide Sequence Number=SeqID_127816
atgggccactggcgcgctttttatcccggcgggcgctttcatcgcttgaccctcccgcaggggaaaggtttacgctgtgcccctattcacgataaggatatgaatatgcaacgtcgtcattttctcaagctgaccgccgccctcagtgcagccggcgcgctgcccttctggagtcgctcgctgatggccgctacgcgcccgctgttgcccatcccgtcgctgctggagcccgatgcacacggccagtacacgctgaccgccatgaccggcagcagccagtggaacggcaaatccgtcccaacctggggttacaacggtagcctgctcggcccggcgctgcgcctgcagcgtgagaaaagcgtcaccgtcaatattcataatcgtctgccggaagccaccacgctgcactggcacgggctggaaattcccggcgcggtggatggcggtccgcaggcgctgattgcgcccggcgccacgcgtcaggtgagttttacccccgatcaaccggcggcgacctgctggttccatccgcatcagcatggcaaaaccggctatcaggtggcgcaggggctggcagggctggtactgctggaagatgaggcgtccggcaagctgcggctgccgatgcagtggggcgaagatgatgtgccgctgattttccaggataagcagctcactcaggacggcacgcgtatcgattatcagctggatatcatgcgcgccgccgtgggctggtttggcgatttgatgctgaccaacggcgtgccgtatccgcagcacgcggtgccgcgcggctggctgcgcctgcgcctgctcaacggctgcaacgcgcgctcgctgcacatcgccgccagcgataaacgtccgctgtacgtggtggcgagcgacggtggcctgctggctgaaccggtgaaggtggagagcctgccgctgctgccgggcgagcgctttgaagtgctggtggatacttcagacggcaaaactttcgatatcgtaacgctgccggtcacgcagatgggcatgacgctggcgccgttcgatcagccgctgccgctggtgcagattctgccgctgcgcgtgatggccagcggtacgctgccggaccaactggtggatgtgccgccgctgccggcaacggaagggctgcagagccgctggctgcagctgatgatggatccgcagctggatcagcagggcatgcaggcgctgcagcagcgctacggtgccaaagcgatgggtagccagcacgccgcgggcaaagcgatggatcacggcagcatgaacatggaccatggcgcgatggatcatggcaatatggagcacggcgatatggcgatggatcagggcaatcctgccagcagcgccgcatatgatttccacaacggcaacaaaatcaacggccaggcctttaacatggaaaagcccat

SEQ ID NO: 11039 - DNA, 1077 bp, Glycine max
  Peptide Sequence Number=SeqID_127817
atggctcctatgctctattctagggaacaacaagacaagatggagcttgcattcgaggagtcgtcaatggaagggagattgggagaaggatataaccttgaagacggtggaaagcagcatccaaaatcatctaataagaagactttggttagcttcttgaggattggaaacctcacatacatctatagagtcatccatatgatgttgggtgaaaaggtgaattttcctaaagtcatcttctactggcttcaagctttcaaggaaaaatttcacgccaaagacaagaagatccttgttccttatggaatgctattcattcagctcatgaggaatagtgggctagatgtgtctatgttgaaaccatctacaagtggcgcacaacttaaaggtttgacctttgtcaaaatgggaatagctgaaaacttccctaaatatgcacagaaacatatcaaaagaaagtccaagaaggaggaaccacgatgcaaccttgaaggccttggcagaaaggtcttggaagaagttccaaaatatgttattttggaatctctaaagactttgtctgttgaggaggtgcaaaggaaagaagttgaagagactgccatggtagatgtttttggtgagccacatggagctaaattattctctacaaatactgctacaaggcaagaaaaagttgaagtggctctcattcctgacgacttggacccaatggaaaaggaagctcctgaagaagcttggaatgatcagcagcaagccactgagtggcttctttcttcaaggtcactgcctccaccaccacctccaaagggatttcctattgaacccgatgtgaatctggagaagcttaatctccttaagctctggaaggaaggtttcctaggtattgatcttttttcctatcaatcttgggacactttacctgaagaagaagagcatgctcttggagtctatggcaaaaaggaaccaatcttcaagatgtttcgtccacgacagactatagctcttaatcctaatcgtctgatctttgaacatttgcccacagatagaaagatttatcctttagtcttaagcatctag

SEQ ID NO: 11040 - DNA, 534 bp, Glycine max
  Peptide Sequence Number=SeqID_127818
atgcctgctcagaagcgttccttccctgatgctcctaacgatcaccaccgtcacgccaaatatcaccaccaagaagaagaagaagaagaagaagataattacaaatcagatggttcggctttgtttatattctccccccgaagacaaatccgactcgtgtcgttcgagccacgacgcatgccgtttctgaatccccccgattcgattcgtaatcggtcgtttgcatgtttcgattttcgtcttcttcgtgcttttgcgacgccttcgttttttattcgtgccggtttcgtattgcatgttgagattggaagtgatgatttagaatgtcatggtgctgtggttgatgacgtatatgagaagcaggataattttgtgaaactaaaattaggttttagtagtattcataaattctttgttgcaatgaggtatgtgtttgtagaacttctggaaatacgcaaagaagtccaatgtccaatttgcctaggagacctcatcttgtgggataagactattattgttgttgcatcatgctaa

SEQ ID NO: 11041 - DNA, 597 bp, Glycine max
  Peptide Sequence Number=SeqID_127819
atgagatatctccttgccatctggaaggcaagtaggcctttgagcaatggtgaaggttgggagacaatgagacgtgaattgtcagttttatacagccgtttctatgggatcctattgggaggcatactgctcatgtatgaattccacaatcatttgagacctattcttcttcttgtatactcattttggatacctcaaataatcaccaatgttattcgtgactcgcgcaagcctttgcatcctcattatatcttaggcataactgttactcggctagcaatcccattatatatttttggttgtcctaacaacttcttgcacatagaaccagatcagagctggtgtgtttgtttggctatatttgttggacttcaagctgcaattctcttgcttcagcactattttgggtccttgtggttcattcctcgtcagtttctacctgagaaatactgctattatcggaggtttgctcaagatacaaatcatgccacagactgcgttatatgcatgacagccattgatctttctccgcgatctaatgattgcatggcatgtgaatgtaacctttggctattcaaattaatctttacaacctga

SEQ ID NO: 11042 - DNA, 1254 bp, Glycine max
  Peptide Sequence Number=SeqID_127820
atggcttcagcttcagcatcttattcctttaccattactgtgttattcctcctttatttgcacttgtcatgtttcataaataaccttaatgcaaatcataccaatgccagcggtcacaaccatcacaaacaccaacacactcagaatccacccttaaactcaaggcttgacatggcttttcttgggctacaagcatggaagcaagtgatctactcagacccaaataacttcacttccaactgggtaggtccttcagtttgcaactacacaggtgtgtactgtgctccctcacttgatgaccctaaagtgacagttgtggctggcattgaccttaactttgcagacttagcagggttcctacccaatgaaataggccttctctctgaccttgcagtccttcatctcagcaacaaccgcttctgtggcatcctcccaatgtccttcaccaacctcactctactctatgagctcgaccttagcaacaacagatttgtgggaccttttcctttggttgtgctttcccttcatatgctcaaataccttgacctccgctacaacgagtttgaagggccattgcctcctcaactcttcaacaacaccatcgatgccatttttgttaacaacaaccgcttcagcagtactattccaccaaacttaggcaaaatctcagcttctgtagttgtctttgccaacaacaaattcggagggtgtctccccgaaagcatagtgaactttgctgacactttggaggagcttgtgctaatcaacaccagtttgtctgggtgtttgccacaacaagtaggctttctctacaaactaagagtgttggatgtgagtttcaataacattgttggccctataccttatagcctttcagggctgtctcacttggagcagctgaatttggggcataacatgatgagtggcacagtccctgtgggggtttgtgagttgccaaacttggcaaacttcactttctcttacaacttcttctgtgaggaagagggtatctgtcagaacttgacatcaaagaggatagtgtttgatgataggaggaactgtttgccagagaagccactgcagaggagtgaaaaggaatgcaaggccaaacttgaacacccagttgattgctctgagctttgctgtgttgttgggagcaatgtctctgctggctcagtggctgtgccacctgctgctgcagttcctgcagcaatgcctgtgtctgcacctcttcttgcaccaagccacccttaa

SEQ ID NO: 11043 - DNA, 1671 bp, Glycine max
  Peptide Sequence Number=SeqID_127821
atggccaccatgctcagctactcacccccgcgtttcaaaatcgccgtcgacgctcaccacgatcctctcttaccttttctccggtctatcaagaaagccctagaagcttccgacgactccgcttcgaatctcagtaacttactcaaagattgcatcagaaacttcaagaacaatgaccgctaccgaaacgacgtcagattcctcaagatctggctcctatatatgggagttagtgatgattttgaaagtgttttcaaggaaatgctggacagtaatgtatgtaccaatagttcttcactttatgtgtggtctgcaagtttttttgagttgaagggaagattgcatgatgctctcaccatctatcagcttggcatttgcaggaatgcagagccaattgagtggttgaagaaggcacatgccttatttctcaatagaatttctgaaatacagaatgctgcttcaactcagaaggttgatgataaagaatccaagaaatttgaagataatggcattaatccttggggcacctctaccatggatagcctgttaaagaaaatatatcctttaattatgaaatttgatgggtatcgttcaagcactaaaccatacacaggaaaagtggccttatctaccttgaagaattcatcaaggaataaagtttacttattgctctataagctgcttccttatatgtgggcttcaatttgttttactaacggcgctattgctcctctttgtccttatcatgacattaaaggtggaaagaagtaccatataaaaggctgcgctggacagggtggttttgcccaagtatataaggctaatgttgacagtgaccctgacaatgttgttgcactaaagatacaaaaaccagctttcccttgggaattttacatttatcgtcagcttgataagcgcatcttagatagagagaggtcaagttatggtttcgctcaccgaattcatatctattctgactgtagtatactcatctgtgactatttagctaatgggacattacaggatgtgataaactcatatgtggtcttaggaaaatccatggaagaagtgttatgcatttactacacaatagaaatgttacacatggttgaaactctgcatggttttggcttgattcatggtgatttcaagcctgataatttgctaattcgctatgctaggggtgaccttacagaagatgggttcttcagccgaattggtccttggtgtgatcagggtctttgccttgttgactggggaagagggattgatctgcatctctttccagatcacatactatttaagggagattgcagaacttctggttttcgctgcattgagatgctagaggataaaccgtggaaatttcaggcaagtcacctcttaaattacactacaaatgcaatttcctatatggaagtcgtcaaaaaagaacaatctgatgggagctacatgtatcttcccaaactaccctttaaacgttactggaacattgagctctggaagactttcttcactaagatgctaaaccaatacccccatgatgatgataggagtttgctgcaggacttgaagaagtccttccaagactacatgagctccaatccgcagcttataaagaaactaaaggagttactctcaaagcaaagggcttccttgtgctctgcttaa

SEQ ID NO: 11044 - DNA, 435 bp, Glycine max
  Peptide Sequence Number=SeqID_127822
atgtcaatactggccacattgcattgtagagatgagccaaatccccactcctctactctcaagtttcaatctttcagagtcaacctcaaccatgtcaaaccccaaacacagcatacctcacaaaaaattcaatttgaacaacccagttcccaggtgatcacagggaatccaaaagaaaaatccaaagcccatcacaggaaactgcttaagaaagacaaagggttgcttcgaatggagtcaaaggaacgaatcgccgggtcacaaacaacaacgagtcacctcactcacagagagaggatgattcagataagaggagaaggagagagagacagtgaaaggccaacgactaggaaacaaaattcgcttcaccagcaaagtctgccaccaaatgaagctaccttagttgtgattaaaaaatgggttaacataatatag

SEQ ID NO: 11045 - DNA, 339 bp, Glycine max
  Peptide Sequence Number=SeqID_127823
atggacaaattagagtttataaaagcttgggcaattctcacctcacgagttagttttggggtggagttaggcccaacccaagtgcaagatgggaattggaagtttttagatactacaaatggttctaccggatttccagacatcagaaaaataaatggaaattctgtaattgaattagttagtatgcccacaaagataactggtgtacattatgtgcagggggtagtcatattccatgatgtatttgacaatgaatacaatgttggtggagctcaaatcagagtagaaggtgtatatatatggccttataggcagcttcgaatggtagccaacaggtga

SEQ ID NO: 11046 - DNA, 561 bp, Glycine max
  Peptide Sequence Number=SeqID_127824
atggatgaatcaacgaagaaggggtctgtgacctcactcgcctccctcttcccagtagaggaggcgcaaagggcggccaagcgcgtcgaagacaccattgccgacaagcagagcgagctcgaccgcctacgaggtttcgccaccgacaacaacagcctcatcaacctcgtccacaagctccccgaacagctctcccacgacatcatggttccgtttgggaaagcagcgttcttcccaggtcgtttgattcacaccaatgagttcctggttcttttgggagaagggtattatgctgagagaacttcaaagcaaaccgttgagattttgcagcgaagagggaagtccttggattcgcaggttgattctcttgaggccaatatcaaggaccttgaagcagaggcttcatttttcaatgccacagcttctcaagtagcggttagggatagaactcaatatcatgctattgggttggggtgctatgacgccagtgcggagcagagcaacccacagttcctggatgtcgtggtggtcacgctgcatttcaaggccaaaaacatgtga

SEQ ID NO: 11047 - DNA, 252 bp, Glycine max
  Peptide Sequence Number=SeqID_127825
atggggctaaagaagagaaggtgtaaaaaattgctgatgaactcgcttagtgaggcagccagctcgcttagcggatgcaaaatcctagaagatgatacgttagagattagcgcgctcagcgcgcaggcagcccgcccaatgaggatgttgtctcttctcacgcttagcgtgcccaagcttgcttatcagattttcacttactttcactcgttgagcgagccttcgtgtactgggaagtccaagagcctttaa

SEQ ID NO: 11048 - DNA, 306 bp, Glycine max
  Peptide Sequence Number=SeqID_127826
atggataatgatgtcacgtttcatgcatatgccatttggaaggaagacaaagggagcgattttggtttggaacatgtttgccaacttctgaaagatcaactgaaatggtcatatctatttacggaaaattgctctaaaaggatgaagattttcgcatctagggcatattcatcgtcaactaatccagaaacaccgatcgaagattctgaagctgacacatcatctccaattgtccttccaatggggcaaaaggcaaccaaaaggaagagcattggaaaggaatatgaacatctaccaatccattag

SEQ ID NO: 11049 - DNA, 303 bp, Glycine max
  Peptide Sequence Number=SeqID_127827
atgcatggtcatctgcagcaagaggctcctaatttgggaaatgctacagctgatgatggggaatatgctcgtatgctggctataatggatgaacttgaaaaagaagagcttgctgcagaaagtggcaatcacagtgatcaaaatgatgaaagtactggggatttccatgatatatcatatcaggaacatattgataacaaactccaaaattcaaaagtaatatctttgattattttgttgaaatctggtttagaggctatgagcacaatggactgtgatcgtctcataactcattttctatga

SEQ ID NO: 11050 - DNA, 348 bp, Glycine max
  Peptide Sequence Number=SeqID_127828
atgaggccgagacgctaccaaattgcaaccgtaatcgacttctacatcgttcttcattcgtcatccgaggaggaccaacaagttccaatcattctaggaagatccttcgtgagaaccactcatgtacccatcaatgtttgtaaaggagtctacacacttagagagggcaagaaaaaaatgttctactatattcaaggcattgaagacttccccaacaaatcgactcaccaacaacacctttacaatccatatgccatacgtcaagctattgacattaaagaagtgcttattgggtggcaatccaacttcctaactcttactttttacattacattcatagttttttag

SEQ ID NO: 11051 - DNA, 2140 bp, Glycine max
  Peptide Sequence Number=SeqID_127829
gggtcttggaaagaccattcaagcaatagcatttcttgccgccgtctttgctaaagaaggacattctactctaaatgaaaaccatgtagagaaaagagatcctgcattaataatttgccccacttctgttatccacaactgggagagcgaattctccaagtggtctaacttcagtgtttccatttatcatggtgcaaaccggaacctgatatatgataaattggaagcaaatgaagtggaaatactcattaccagttttgacacatacaggattcatggaagttcgttgttagatattaactggaacattgtgattatcgatgaggctcatcgacttaagaatgagaaatcaaaactctataaagcatgtttagaaattaaaaccctaagacgctatggtctcactgggactgcaatgcaaaataagatcatggaattgttcaatctctttgattgggttgcacctggatcccttggaacacgggaacattttcgtgagttctatgatgaaccccttaagcatggccagaggtcaactgctcctgataggtttgtccaaattgctaataagagaaaacaacaccttgtggcagttcttcataaatatctgttgagaaggacaaaggaagagaccattgggcatcttatgatggggaaggaagataacattgtgttttgtgcaatgagtgatgtgcaaaaacgtgtttacaggagaatgttacagcttcctgacattcaatgccttataaataagaacctgccttgcagttgtggtagccctcttactcaagtcgaatgttgcaagaggatagtaccagatggagctatatggccttacctgcatagagataaccctgatggttgtgattcatgcccgttttgccttgtccttccatgccttgtcaagctccaacagataagcaaccaccttgagctgattaagccaaatcccaaagatgatccagacaaacaaaataaagatgcagagtttgctgctgcagtctttggccctgatattgatttagtgggggggaatacacaaaatgaaagcttcatgggtctcagtgatgtgacacattgtggaaaaatgcgagcacttgaaaaactattgtactcatggttttcacagggtgacaaagttcttttgtttagctattctgtaaggatgctggacatactggagaaatttctcatacgaaaaggctactgcttctcaagacttgatggctccactccaactaatttacgtcaatctctggttgatgatttcaactcaagtccaagcaaacaagtattcctaatatcaactcgtgcgggtgggcttggattgaaccttgtcagtgcaaaccgtgttgtaatatttgatcccaactggaaccctgcacaagacttacaagctcaggacaggtcctttcgttttggacagaagcggcatgttgtggtgttccgtctgcttgcagctggttcacttgaagaacttgtatactctcgtcaggtgtacaagcagcagctctcaaacattgctgtctctgggaagatggaaaaacgatattttgaaggtgtccaggactgcaaggaatttcaaggagagctttttgggatttccaatttatttcgagatttatctgataagttatttaccggtgagatcattgaattgcatgaagaacatgggcatgaaacagaacaaccggaagaagtaaatctgtcagaagaagaaacaagttcatcagtactggaatcagaaaccagattgtgtaacaaatctgtgagggatgcaacaagtaaaccagatcttgtagaccttggcattgtctatactcatcgcaatgaagacattgtcaacttcggcccagggattcaagggaaaatagatactagcatccccttagatgatagcctagtcaagccaagcatctctttggatttggaccaccaaagaaaaaaaccagatagtatacctaaaaaacagaaagttcctttgattgatgaaaggaagagaacccaatataggctccttgcccagtctctgggcatgggagagcttgcttttagcaaatggttgctatcagcgactccactcgagagagaaaaagtgcttcttgacttcaagaagaaaaaaaagatacctaacggttga

SEQ ID NO: 11052 - DNA, 240 bp, Glycine max
  Peptide Sequence Number=SeqID_127830
atgctggcaaccaagatgctgggggatacaataagcagactcatatgggtctcaccttcagctggtgaactgttttaccatagaatgatgctatccactgccaaaggtgcacagtcttacagtgacattagaacaatcaatggtgtggtatatcctacatttagggaagcatgttttgcaaaaggctttctaggtggtgatcaagaatttattagtgctttacaggaagctaataattag

SEQ ID NO: 11053 - DNA, 276 bp, Glycine max
  Peptide Sequence Number=SeqID_127831
atggtgcttgcaggtacaccacaaccttattgcagtccttgggtcattaatggaaattctagggttgttgatggcagtctgcaagttattggtggttcttcaaggaccgaggggttcacatggcatcaactatcccctgatacattatgttcaacgactcggtcaaccattatcttactacttttggtgatccgaatggttcagaaatgtaatagccaaggtttgaaactttgcatggaagggtgcaacaacttcttaattgagttgagaggctaa

SEQ ID NO: 11054 - DNA, 210 bp, Glycine max
  Peptide Sequence Number=SeqID_127832
atgagttctgaaaccctaaatgtgagagagagaaaggggaaaaagtggggtcgaggccggcgacgatggcagcgtccgcggagtccttggtccggaagaacatgcttctggaaccctaccccaaccctaactttggaggctaaattttatagtttaaagccaagcccagaaagggaaactcggttgagtgcaggaacgacggcgagataa

SEQ ID NO: 11055 - DNA, 429 bp, Glycine max
  Peptide Sequence Number=SeqID_127833
aagcatgttcttccttctccaaaaccaaacttcaaaagagagaactacatcaaggaagaggatgaaatattcaatgtcgaccgcgacgccgtcagatacatcacctaccggaccaaggactccgcggacgctgccatcgtcgccggcctcgaccccaccttcggaatcaccgttaactctaaaacggtccaggtgttgtgggcaacataccctctagccatgtggagggaaggagttggtaatagcaggaacaaaggttctatgtcaaagcttgtgcgtgctgaggtacctttgagcaagcatggaagaggtaacagacttgcttcacccatagggaataccaaacgtagcaaggatagctcaggtagctcagttttagaagtgtctttcaagggcagagaaattgttgcttatgatgatatcctctga

SEQ ID NO: 11056 - DNA, 123 bp, Glycine max
  Peptide Sequence Number=SeqID_127834
atggcaatggtgtcgaaaaagctgaatcaagccatggctgttcaagtgctttatcctgaactcaatgtgtctcgtgtgaagatttctaaccaggtggttgaagggaaactcatcaatgtttag

SEQ ID NO: 11057 - DNA, 837 bp, Glycine max
  Peptide Sequence Number=SeqID_127835
atggcgagtcgtccttccctgagagttagtctccttgggataatcatcttggaagggcaagttgttgtttccaaaaagagtcggtcacctcgagataatccttttgaatggtatacaacccctcaagcattaaccctagttgcgttgatgcttaaagtgtgttatgtcactttaattgtgtatgttggtggtggggcttgttgcttcattatgtgcacccctcgtatgacatttatggaaaaaatcttaaagaacaatgcatttgtgagtcatttcatttcttggatccttcacttacaagaggacgaagaagtctactccagctctggtctatcaagtgttgtgggtaagggtgttgaggatgtcacaagatctagtgatgatgaggtcatcatatatgttgatgtagaaaaggaggttcttgctgaggatgttgttgggggtattcctatcatggtcgagtttggttgggtagatgagagaggcttggttacccaatccaaatatattaaccctaatatggttggggttttgaaaaaggttgtgtatagtgttaggggaaccgatttggttgaggtagaatcgtgtagcgcggaggaaaggatttgtcattttcccacggtgggtatggggtctatgatttctatttctaacgttcaacttcatgaggattacaagcagaaggcaaaatttcaatcaaagaatgtgaccaagtcatccttgttattcttggatgggaaagtatcctccaatctcgttcctgcaagtggtgttctaaagccaacctttgctcctctcgaccctctttctgagaatcaacccttgaagaagtcatga

SEQ ID NO: 11058 - DNA, 225 bp, Glycine max
  Peptide Sequence Number=SeqID_127836
atgagtgagatacgaagatttggaggtttgggaatggaggaacgtcgtgagagaaaaggggctgcgcagggatttctggaaaatgtgatatttatagagcaggacgcttggaggaggcagcctactggtaatcgattacatgaatactgtaatcgattacaggctatctgttctagtgtaatcgattacagtattcatgtaatcgattaccagaacaaggaatag

SEQ ID NO: 11059 - DNA, 1347 bp, Glycine max
  Peptide Sequence Number=SeqID_127837
atgggctatgacctgaaggccggctttattctgcgcggtaacggggccgatgtgcagcaggagctgtggggccgccgcatccagctgatcgccgcgatgatcgctttcgtcatcgcaatcccggtggtgtggtatgcgcataatctattctttgtcgacaacctgctgccgccggtggcgcgcgtttacgccaaaaccattcaggccggcgcggagccgggcattgccggcagcctgctgatgtgggcgattccgggagcgattattcagctgatcggcgggcctaaacgccagctcggcgtgctgttagccaccggtctgttaatcaacaatgccgccgcaggctgggcggtgctggtcgggattgcgttacgtgtcctgatcctgcgcgtgtggggcgagcgtggacgttcaccgatggaggtgatggccgctggattcattgcgggcgacgcgctcgcctacgtggatggccagcaggtggtcgatctgttcgccgcctatcctggcgtgcaagccagctttaagcgcgtcagcgggccaaaagggcgcaccgattttgtgcgcatcgacattccgggcgcccagggcaaaagccggggcggcagcgcgccgacgctggggatcattggccgtctcggcggcatcggtgcgcgcccgacgcgcatcggcatggtgtccgacgccgacggtgcggtcgctgcggtgagcagcgcgctgaagctggcacagatgcagaccaaaggcgacgtgctggccggcgacgtgatcgtaaccacgcatatttgtccggatgcgccgacccggccgcacgagccggtggacttcatggattcgccgtgcgacgacatcaccatgaatgacaacgaagtggttgagggcgtcgacgcgattctctctatcgataccactaaaggaaaccgcatcctcaaccataagggctatgcgctgtctcccacggtgaaagagggctacatcctgcgcgtgtcggaagatctgctgcgcatcatggagatgaccagcggtcagcctgcggtgacgttcccgatcactacgcaggacatcaccccttacggcaacggcgtgtatcaccttaacagcattctgcaaccgtccaccgccaccgatgtgccagtggtgggcgtcgcgatttgtgcgcaatccgtggtgcctggctgcggcaccggcgccagccatgaagtggacattgcggcgaccgtgcgctttgcggtggaagtggccaaagagtttggccgtgagacctgccagttttatgacccgcaggagtacgcgctgctgctatctttgtatggtagcctcagccacctgcgcagccggaaagcctga

SEQ ID NO: 11060 - DNA, 792 bp, Glycine max
  Peptide Sequence Number=SeqID_127838
atggcccagctgtacaaggagcatgctgaaacggaagaatatgtttttagttctctttcatcactgtccacggccacgagatcttttcttgtaagcaatggaagccaaataatcaacagagcaaataataatttgttcagcacgtcgattgaaagcaaggaatataagttgcaaaaagaagttggtcaagtaaaggatgaaaatgtatttggggttccttccttgccaaaaatcatatcagtaaatgatactaaggagaaatttaatgcagtcattgtgagaagtcgaagatcgagctcttccgacaatgtgtcgagtggaaaactcatccatactcaacaatttgataaaacatttctcttcagtcttgggatttcgttcgggatgataacttctatcatggcaaataaaagagaaatagtcaagttaagagagttgttgaagcagaatgaaaacttggttcaagatctacaagaggaactggaaatgaaagattcaatgactgtaaaggagttacagaatgaaaattatggttcacaggatacatgtgatcattcctcatatgacaaggagctaaatgaattttcccctgaaaagcacgtggataactctccaagaattgactctaaagaatcatatcatcaaaaggtagaacaaagttctgagtccatgagcaaaattgaagctgagcttgaagctgaacttgagagattggggttggacatgaatgcatcaagcctagaaggaaaattgtccgagcttgttgagtttttccatgtattcacctcctaa

SEQ ID NO: 11061 - DNA, 453 bp, Glycine max
  Peptide Sequence Number=SeqID_127839
atgacaggaggatgtatgggtttattcaatttcgtcaaagaagcgggtgaaaaactgtgggatgcggtgtcaggcggcgatgaccagagcaaaaagctgcaggagcacattaatcaactcggcctgcccgacagcgataaagtgaaagtcgatgtccagggcgataccgtgaaggtcagcggtgacggtatctcgcaggagttgaaagagaagattttggtggcggcgggtaacgtggccggcatcaccaaagtggaagataacgtcaccaccagtgacagcgccgcgcaggccgaattctacacggtgaaaaaaggcgataccctgagcgctatctcgaagcaggtgtacggcacgccgaacgaatacaacaagatctttgaagcgaacaagccaatgctgacgcatcctgataagatctatcccggccaggttttacgtatccctaaataa

SEQ ID NO: 11062 - DNA, 177 bp, Glycine max
  Peptide Sequence Number=SeqID_127840
atggagttgacatgggagcaagttagcataggacaccgaaattggggtgaattctacaagcttttttgctgcaaaactccttccttggttcatgttttggcaagctttgtggctgatttagtgatggcctcgtggatgattgggtggtgggtaatgaaaagggctaacgttggctga

SEQ ID NO: 11063 - DNA, 234 bp, Glycine max
  Peptide Sequence Number=SeqID_127841
atgcggaaattgattaaggaaaggatggaaaataaggtggttaatttcgtgggtcttaataaggtggttcttggcataaaatggatgaatgggatggtgaaaggtctcattttgaaagtcaatttaggctcaagaatcagtcaatttgagtgcgtaaaatgggagttatggccacgagataattctgggcagaggtggattttctggaattgtggtttgaaagaacaagggtga

SEQ ID NO: 11064 - DNA, 255 bp, Glycine max
  Peptide Sequence Number=SeqID_127842
atggaggtttcctttggtttttctaacgttttcctctcaataaacgttggtggcgactccgcgcattttcctcctatggaagacgcacccgtgagcttcgcctcgctctcccgcaaaagagtaggttgcgacagcgggtcagtgaactttaagaatagaaggttcgggagttgttttttacgcacgaggaagacaaaagcggggcttttgctcctacgtatcctccattgggatgaggaactcagacctatgtag

SEQ ID NO: 11065 - DNA, 402 bp, Glycine max
  Peptide Sequence Number=SeqID_127843
atgggggataagcttcatcgtcgagagggaaacagcccggatcaccagctaaggcccctaaatgaccgctcagtgataaaggagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgg

SEQ ID NO: 11066 - DNA, 550 bp, Glycine max
  Peptide Sequence Number=SeqID_127844
gcgcctaaagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggtccgaaccgactgatgttgaagaatcagcggatgagttgtggttaggggtgaaatgccactcgaacccagagctagctggttctccccgaaatgcgttgaggcgcagcagttga

SEQ ID NO: 11067 - DNA, 225 bp, Glycine max
  Peptide Sequence Number=SeqID_127845
atgaaggacatcacttttgtttttattgttctgttggttctttccattggaattgaaaatgaagggccattgaagttgatagaagcaagaacgtgcgaagaaacactgtatgagtttagctgtgtaagtaacaaatgtggcactgattgtcgcaataaacatggaaactttgcaagtggtgattgcaatgccattgaagattgcatatgtcgctatccatgttaa

SEQ ID NO: 11068 - DNA, 300 bp, Glycine max
  Peptide Sequence Number=SeqID_127846
atgggaactgtagctgctctactctcattccaattgaaattgaactgcaaggtgcgcgcagcttctgcttcgccttcttcgctgctgcttggtgttggttgttgcttcttcttgttgggttcatcttcttccaggcagcgacaacaagagcgtgttgttgaggatcctcctacggctgcaaaggaattgaacgaggagcagcaagaacgtcctgagatgaaactatcttcccatggaatgaagatggctaagtttggaaggtttgctctagagtgctacacattaaacgaagatgactaa

SEQ ID NO: 11069 - DNA, 516 bp, Glycine max
  Peptide Sequence Number=SeqID_127847
atgcaagacacttgggacaagatgggcctggattctaagttgaagcttattattgaaactgtctacttcattaaaaaagcagtcattgcagctctggctattctaaacccggccaagggagccttgttcggaggcaatatccatctcaccatcattttgtgtcccataccagatggtgcatgtgttccagagatgggctatgtaagatgtaacttaaatgctgtgtttcttggcttggcaaatattactagttggggcttctgctcagagacaagaatggagcttttgtgttggctgtcagattgggatcaaccttgtttgccaacttcagaagggaaagctttaggtctccttatagctcttaagtggttgatggattgtggtttggcccatgtggaatttgaatcagattgtgaagtgttggtgacaagcacaattcaagacttctcagctgttggcgctattattcgtcaatgtaaatacattaaaaacactatcatgaatgaaattccttga

SEQ ID NO: 11070 - DNA, 1008 bp, Glycine max
  Peptide Sequence Number=SeqID_127848
atgcaggatactgaacctgatataaaaaggcaccccctggaagatgcagaaaatgaatgtccaatatcccctgaggtggtgattgatatggggcaggagagtcagactcaaaaccacagtgatttctccgtctcagacactaacaaggtcattgacaccgagaatgagtgtaccagtccaaatgtttgtcctgttgacaatagtcacatggaaattaatgatgaatgccagacatcaaatattttccatgttgacaaatttcctactaacgtcagtagtggacagttgtgtgagactgagaacccctgtgctacctttgttacaatgactagtactgatgtaaaaaatgaggaggaaatatgtgtggcacccaagattggcatggagtttgaatcagaagacactgcttacaaatgttatagcgagtatgctgtcctcaacggtttcagcataagaaaggattttgtcaacaaaagtaggataaatggtgcagtggtgtccagaagatacacctgccatagacagggttatcgtcctagcaaaaatggtacatacttgaggaaattgaagcaggaaacaagaactggttgtttggcacacatgactatttctcgtcagccgaatggaaagttttgtgtcattaattttgaaactgagcacaatcacgagttagtaacaccctgtactgctcatatgttacaatcacagaaaagattgacttttgctcaagctgttgaagcaaacttaaccaagtcagggttggatggggtaccaaaactgggaatgggatttgactcagaggagcatgcatatgaattttataatacatatgctggacatgtaggtttcagtgtaagaaaagattatgtaaataggagtaaagttgatggtgctgtggcatctagacgatttacttgcttcagagaaggttttcggcataaagacaaacaggatacaaatgtaaagagacctcgaaaggatactagaattggatgtttagcacaactg

SEQ ID NO: 11071 - DNA, 657 bp, Glycine max
  Peptide Sequence Number=SeqID_127849
atgcctagactaggatcaagagacaatgtaagtgatagagacagattttgcatgtataaagtgatggtgggcgaaaaggtgaatctacctgaattcatcttcctttactggcttcaagctttcaaggatacatttcacgcaaaagaatggaagaattatgttccttatgagatgttgttcattcaaatcataaagaacaatggggtagacgtgtctgtgttggaaccatctataagtccctcacaacttaaaggtttgacctttgtcaaaataggagtagcttacaatttccttgaatatgctcaaaagtatatcaaaagaaaggcaacaaagcaatctttgactgagtcgaggaggaaggccaagatagataaaactcttaagaggaaggatgccttgcaggaagaagttggcatcattgcatctaggaaagctatgcccagggaagaacataaaaagaagttggctgaagatgcaaacctgaagacctttgcagtaaaggtctctgaagaaattccagaagatgttattttggaatctctaaagattttgtttgttgaagaggggcaaagaaaaacagttgaagaggctaccatggttgatgttgatggtaagccagtacctaaggaagtaattatagagtccatccaagcatag

SEQ ID NO: 11072 - DNA, 393 bp, Glycine max
  Peptide Sequence Number=SeqID_127850
atgttcagggaagaaatagccataagagctccccctaaatggatctcttcagactttgttactccccctcagatgatgtcgagcttcaaccttttactttttctccccgttctatttggaaacttcttcaccaagcttcctaagaaactcatcactagaatcctcagaatcagaagaaagatgaacaacactaccaggtggtgttggaggacaaggaggtttccacctagtggcttttcttatagaaatagtcaccaatcaaagaccatatatgagcttccttctcaacaagagtgcgatccttcaaggcctaggcaagtaactctctggttctacctagctccaattcaagcaaatgaacataggcacaaaagggtgaaggatcataaatag

SEQ ID NO: 11073 - DNA, 354 bp, Glycine max
  Peptide Sequence Number=SeqID_127851
atggcccctgagaaaagcgaaattgttagggtttctagtatccacaatgttggagatgctaagaaggtctttccaaaagattggttcatccttgggaaatgggtaaactttcaaagtctgatggaagaaggcttcattgtccaatgcctttttgattgttttggctggacaccattattggagaagttcaattcatggcactatgtgttatatgccctattctggagagcagcaagacaagatgaagttagcattcgaggagccgataatggaagagaggtgatcatctcgcttaagattgttgttgctgtgattggatgtccaaaagaggatttggtctttaataaagattag

SEQ ID NO: 11074 - DNA, 351 bp, Glycine max
  Peptide Sequence Number=SeqID_127852
atgcggtcatgggtgaggggtcagtggattccctttaatgcagatgccctcagccagttcctgggtgacccgctagtgttggaggaaggccaggagtgcaagtttagtcagaggaggaacagggccgatgggttcgacgaggaggccattgcccagttgttatgcaccctggggcaggatttcgcccggactgttgcagggagacgggtgcggatcatgcgcaccagtatgccacccaccaggcaccctctagacccgaataagtctaacagggccctggggtttccggcaatgatcacgggcctctgccagtcattcggggttcccgtcacgcctagtaaggtgatctga

SEQ ID NO: 11075 - DNA, 171 bp, Glycine max
  Peptide Sequence Number=SeqID_127853
atggtgacttcaggagagactttcagagagaaaaccggtgtgaccttaccccaccagatccaccgaacaagagacgggcggctcttacactacaacacttcacacggtgacacttcactcaatatccttgttggtcagaaccctttaccggtcaacatcctctgtagatag

SEQ ID NO: 11076 - DNA, 804 bp, Glycine max
  Peptide Sequence Number=SeqID_127854
atgactatctttggggcagcacttctttataatgaatctgtagaatctttgaagtggctgtttcgagttttcattgaggcaatgtctggacgcaagccaaagacaatccttacagatctagacataataacagctgaagcaatcaattccatatcacctcaaacaaatcatcgagtttgtgtatggcatgtctatcaagatgccctcaaacagctgagtcatgtttctgttagatctggttcttttgtaaatgatttgagaagctgcttctttgataatgaggaggaggattattttgttaatgcatggaatgctctcctggacaagtatgatctgtggcaaaatgaatggttgcaacaaatatatggcagcagagatagatgggccatagcatatggaagacagtttttttgtgctgacatggtaagcatgctactgagagaaaatcttactggcaacctgaaaaagtacctaaagcatggcacagacattcttccacttttgaagtatcttgttaaggttgttactgattggcactacagggaattagaagccaattatgacatgagccagcatatgccaccgctgatgggggatatcattacgttaaagcatgcaagtgctccatacacacctaagatatttgagttatttcagaaagaatatgaagcatgtttgaatctagtgataaagcattgcactgagagtggatcattgtataattataaagttagcatatatgaacaggaacataaggatagttccatcccagtacatcttaaagagatggacaaaagatgctag

SEQ ID NO: 11077 - DNA, 1797 bp, Glycine max
  Peptide Sequence Number=SeqID_127855
atgggggactcaacttgtctcatgcaacaaccattctgttatgcttccggcatttccaatgaagccaacgagaacaaccctattcatgcacttgggcaatcaatttcgtttgggaggttcatgtcagagtccctggcatgggagaagtggtccagcttctcccacaaccgctacgtagaagaggcagagaggtactcaagacccggttcagttgcacagaagaaggctttctttgaagctcactacaagaaacttgctgctcagaaggcagctgcactgcttgaacaagcaaacaatgaggcacagaaaaatgccacaggacaagaagatgagggagtaattgacaatgacaatgacactcataattcacaaataagtccaaattctgaaatggttgtcaaggaagaacaagatgcaaaggttttaagtgttacctctgagcaagatgctgtcgtcagactcacagtcagtgagcatgatgtaagtgttacacctgaaagtgccaaggtagagggagctgaggcagtgatggaaaaagtagctgttgtgggaagttcaatgaaggttgaattgcaaaaccaggttgaagatgttgatgcacaaatggaggaaagtgaaaagcttagtgcaattgtaacacctccaattttgacaccaatagtgaaggtatccaaatctgaacaggaagttttggcaagtgtgggcatgaagaaaccacccgtttcttcctttaagttgtcaaagtttaatggaacctccaagttaaccactacacctgttaagtccacagcaactatttctttcaaaagagataacattgctaccccaattagcaacaaacctgctaatggaacctccaagttcaccactgcacctattaagtccacagctgctatttctttcaaaagagataatattgctacaccaatgagcaataaacttgctaacggaacctccaagttcactactacacctgttcagtccacagctgctatttcattcgaaagggataatattgttactccaatgagaaataagcctgctatattaagcactgcagataaaaagagatctactcctagatcagttaattttacacccattagagaacttaatagattgactgcttcagtcatgaggaaatttgaaagtacaagagctggtgctggttcttccaaggcttcaaaggatagcttgactcctctaagaactccaactatggcttccaaggagatgcaaaagcaatcttcattgaccccattaactgaaaagaaaaggaacaaaacgcctcttgatctatcatcagcaccaggaaaccatacgggtggttctaaatggcgcttgctttctggagaaaacttgaagaaaagttcaatgctaatgaagcacaaaaagtgcagctgcataccaaactcaaggtgggagaaaactgagaccgagattattagaaaactacgccaaagcttttgcttcaaagccaggccactgcctgatttttacaaggaaaggaaaacatcaacgaatgagacaaaaaaggatccactgacacattttgaaacacctaaagacggaaggaaatccacccctagtatggcggcagacagcaagacttcttttcctcccaacagacctgtattgaaaaacagtggcacgaagcattttcagggaaagagtggtcgcaccttgtctcatcctctaacttcaacttccacgattattccaactcatgagaatacgtcaccaaatattcagaatggataccatactggtagaaacttcaaatatcaaccatgttga

SEQ ID NO: 11078 - DNA, 336 bp, Glycine max
  Peptide Sequence Number=SeqID_127856
atggaggctggattttcaatggtgattttcagccatggaattgcaacgaaagataaaggagaagagcgcaaaccccaccctcagccacgaaatcattctctctcacgctcaactctctctcaacccttgaagcacaagtgcgccggagacaaaggggccaccttgtgtgggcctctcatcggagacaaagggaccgccgtcgttcgcttgcaccgccgtatcgaaaaaggaaacactgcgccaccttgctggaaaagcggaaaaaatcaccaaaatttgctgcaccaccttgcttgctctctcccagaagacaaaggctcggtaggggaaatttag

SEQ ID NO: 11079 - DNA, 364 bp, Glycine max
  Peptide Sequence Number=SeqID_127857
gtcgactctagaggatcccactggtggaaatccagaagccagtaagtcaacctggcatggtagggatggagctagtagccgcaatgatgcaaacatcccagttcaaattaatttgcttgcacaagatgtctcatctttgaggccatctcaagttcctatttcggggatgtccatctatcatgagaaacctccagatggagatattgatggaggagggaatgttaatgtgctaggaaaagtgtggaggttcaatggctatgaagaaaggagaggttttaaccaagctagagcttccatctttgcgcagaacattgaagattgtaacttgatggggttggatcatattggtggaaaattcacttag

SEQ ID NO: 11080 - DNA, 495 bp, Glycine max
  Peptide Sequence Number=SeqID_127858
gggattcttccttctctcatcttttctttgtagatgatgtccttcttttcaccaaggataaaccatcaaaggtgagagttatgactaatattcttgctaagttttgtgttggtttgggtatgaagattaatatggaaaaatcgaaaaccttttcttctaaaggagttctgttgaagaggaggaataaaattgcttttatccccaaatcaggcttactaataatttggggaggtatttgggctataatatggtttatgggagagttacagtgtgtcactttcttcatcttgaagagaaaattcaaaggagattggcttcttggaagggaagatatcatgcataatcccatgaagccttggatgcagctgtttatctctaagtatccgggggaggatgttggtgatatgttgcagcacaaggggtcgtacttaactacttcactgggacgagcttatcctagcataagtagtggttttcagcttgaattggggaatg

SEQ ID NO: 11081 - DNA, 129 bp, Glycine max
  Peptide Sequence Number=SeqID_127859
atggttaaggaatcactacttatgcattccaacgaagcattcaagccaacacgatgggagatgacgggccagcctgcgattgacggagggcacgatgtcggtgagggcgcagaggcgttgtcgggttag

SEQ ID NO: 11082 - DNA, 771 bp, Glycine max
  Peptide Sequence Number=SeqID_127860
atggatatagaggcagacaaccgaaaggttcaggtatatggtagaaattatacatttgtggagactagatggaagaaactccgtgtctgcgatatcattaaagtgtataaggatgtatactttcctgctgatcttcttctgctttcatcaagctatggtgatgggatttgttatgtcgagactatgaatcttgatggagaaactaatctaaaattaaagcatgccttggaggtgacaattcatcttcaagatgaaaaatctctgcaaaagtataaggtcgtggttaaatgtgaggatcgtaatgaaaatttgtactcgtttattggaactttacaatatgatggtaaagaatctcctctttccttgcagcagatcctgttaagagattctaagctgaaaaacactgattatatatatggcattgttatctttactggctatgatacaaaagtcatgcagaactccgctgatcctccatccaagggaagaaaaattgagagaaaaatggataagataatctacatcctcttcagtaccttggttttgatatcctttattggttctgtcttttttggtgttgagaccaaaaggaatattagttctggcaggtatagaagatggtatcttcgtccagacaatacaactgtgttttatgatcctagaagggcaacacttgttgttcttcttcatttgttggctgcccttatgttgtatggatctataattccaatatcactttatgtgtccatagaacttgtgaaagttctgtag

SEQ ID NO: 11083 - DNA, 261 bp, Glycine max
  Peptide Sequence Number=SeqID_127861
atgattaatgcaaactgtccacaagaatcattgcattcaatctcaaacgggaatctaagttctgttggaaaccttgagaaggagcagagaagaaaaggctatgccggggaagaaggttctatgttgatgttgttggagggagaaattggggttgaagtaggaggatcggagctgggaggggacgaacatggaggagccggaaccataaaggaacaatatgcagccaaggcacaacttgaggtagccaatgggcacaactag

SEQ ID NO: 11084 - DNA, 609 bp, Glycine max
  Peptide Sequence Number=SeqID_127862
atgaattttcaaaagatcaaaactactgtaacagaagaccgagatgcgttggtggatgcagttgttgataagatggaaagggatttgattcttcttggtgctactgcagttgaggatagactgcaaaaggggtataggttcctgaatgtattgaaagctctcctgggcaaaaatcaagttatggatattaatcggagacaagatggaaactgcagtcaacataggattaaccagatatcctatatatcattggaaaaacaaggggacaaggaagctctatcaaaggcctctcttgaaagcattaagaagcaaattagagaaggaatctcacaaatcaagtctgcaaaagagagttctaatacaaataaaggaagttcttctgggtttggcttcatgatttatgggaagtccttggattattctcttaacaagaatttggaaaggtccttctttgagctggcaattaattgtgcttctttcatatgttgccaatcttcacccaaacaaaaagctcgcgtgggtgctattggtgcgcaatttgaatttctgtcatataaaaatagaagttccttgtataccatcattgctttgggtgtgaaaacattttaa

SEQ ID NO: 11085 - DNA, 246 bp, Glycine max
  Peptide Sequence Number=SeqID_127863
atatgctattttttctataaaaatattacatttggatttaccctattttggtttaaggaatatgcttctttctctggtcaagctccttacaatgattggtacatgtcattttacaatgtcttcttcacttcacttccaataatcgctctaggcgtttttgatcaggatgtttctgccaaactttgcctaaagatacttaaggaccagcaggacctttatgttaccagtttacctatgaccatttga

SEQ ID NO: 11086 - DNA, 636 bp, Glycine max
  Peptide Sequence Number=SeqID_127864
atgcagttgaaattaaggcataccataaacaatgagatactgatatacccgggttatgttcctgtaccgagtgtcaactatagagtctttcattacggattgcgattcagtgttggcaattggagctttgacaaagcagactggcgcaacgttgacatggtcaacaaatgctgggccaagttcccagacccaccagattcctcaccaattgatctggccaacaatgaggatttacagcgagacctgctcagcattgaatgtgctaagacgttgaatgaagcactaaatctgcaccatcagaaaaggtgttctagtaataattccttgtcaacatcaaaagaggacaaaaaagaggaaaatggagtctcaagagtcaacagcatagatgcaaatgatgattcagtaagcaataatatctcaacaaatcaatcggaggaatcagcgaatgctcggaaagacgagatgcctagttctttcaggttttgggtgatattcttgtgggcattttctggagtaggtcatagaagaagaggaacaaggttaaaacacggtagaaggagaagaagcttgcatacaggattcatggaaacgaatagccgtgaccggcatagccgtggtgtcgatgttcctctgtag

SEQ ID NO: 11087 - DNA, 387 bp, Glycine max
  Peptide Sequence Number=SeqID_127865
atggcatccttcagccagatgcagtccaagtttcagtctcagatgcaattacaggaacttgcaccgcctccggagccagaggttggtccctcaggtgctcgtgtcagcacaaaggagagttgtgttgctccctcagggaacgatccagggacgggtgactcagacaaatgcaggctatacattgaagaaaatccttcctgcctggttgccctgggaagactttatgagggatccacaacagttcacaacatccctttgttgcatggccaagtcaacgttggtgttgaggaggttaaagatgcagaggctctcgttcctgtacccactgacgatgttaccttagtggggcaggcacttaacaccttccttgcttggccgacacatctt

SEQ ID NO: 11088 - DNA, 566 bp, Glycine max
  Peptide Sequence Number=SeqID_127866
ccaacaaggacggtgtggatgacattgtctgtgaaaaatacggcattagcaaggagaaatgggcccagttttgtcagacccgcagagacacctcgtgggaggatgtgcggaaaaaggcacaggccatccagaaacaaaacattgccccccacgtgttgtctcgtgggggttatgaatatttagaacaaaagctcatggctgagaagacaaagaaaagactggaagaagtttcccagtccggaagcactgagggcgtcattgaccctccatctcccatcagacgccacgtgaagtggaaggtgactcgcacgaagaaaactgggcagatgacgtctgaggcagcaaaggaaatagctaagaagattgattctttggacgagcaggcgtcacagggatcgttcatcccccatggacgccaggatgtcctgactgctgccgttgggcaaccagagcaccctggccgtgttcatgctgctggagctggtatcaccataaagcaatactttggatcggctccacgaacgtctcgcagttcttccttcatggctcctgaagacctacaatag

SEQ ID NO: 11089 - DNA, 228 bp, Glycine max
  Peptide Sequence Number=SeqID_127867
atggaagcaaaagcacaaaaatggtggcctaggggtgaaaatctgcaaatgccgtgggtgtttgcgtttttgaatgagggaggagagttttgggtggaaagaaactccccctccctcgtttttatgtttccagatgcaggggtgctcgcccaggatactagggtgcctcccagctgcgctttccgcttgtccagagccgggcatgagacgacgatctatcaatcgtga

SEQ ID NO: 11090 - DNA, 495 bp, Glycine max
  Peptide Sequence Number=SeqID_127868
atgtctctccctctactttctcctattcatgtttctatcactctccctctcacttctcagaatccctgcctccctctgccctgctactccccaatgaaacctttgccatcatcgactcctatcgcaacaagtggtactccctctgccatggcaacctcaaggccacccactggcagaaggttgtcgacgccatctccactcactgccccaatgcctcccctcccaaaatccccgtccagtgacaccgtctataggaatgacttttcgggtttcattgcttttgtcgttgctagtgggtttaggattcaaattcctactaggaagaatagggaatgggagagagatcccgtgggtgaagtcgtggctgggattaaggttttaggagatgggtttgtgagaatggaacaaacaaagatggagatggccaaggagattgagaccatgtggatggagatggagatgaatcacactaagatgattctagaatcgcaatag

SEQ ID NO: 11091 - DNA, 468 bp, Glycine max
  Peptide Sequence Number=SeqID_127869
atgggtgaaggagaacccaaccagccactaaggagaacattgcaggattacatggccaacattgggccaaggtactttgacgcattggcaagaccaaatgtgcagacaactaatgttgaaataagagcttctctcattcatttgatccaccaaaacaagtttcatgctcttgatcataaagatccatatgcacatttgactacctttattcgcatctacattttcttcgaagagtttcctaccatgggaaagccaatttccccattggatattttactttttaaatggacagttgtgattttttctattttttttatttgtctttccttctttgaccctaataccctcttttctcccacggtcttaccaccagatctgactatggtgtcaccgatggcaatgacagtggcatctccatggagacgtgatgatgaagacaacttttgtgccttgaggcatcctcactga

SEQ ID NO: 11092 - DNA, 288 bp, Glycine max
  Peptide Sequence Number=SeqID_127870
atggaacttcaaatggaaggtgaagaggattcttaccattgtacacaaccccagacaacaaaaaggagtaagaaaggtgctctcttgaacaagatatatttcctaaatttgagaaaataccaacctctccctaccaaggcaatgagctttgacatgcattcaacttctacatcaaatttgctagctgttgttagagcagatcttctctgggatcagcacattcaatatttgactattatcaatctttatggtacattgacaactggaggtgaaaatcttactaaataa

SEQ ID NO: 11093 - DNA, 300 bp, Glycine max
  Peptide Sequence Number=SeqID_127871
atggcaaagatttgccacagcaaagttgcacttcgccacgtcagatctacagagctggagaccttggaattaagagaaactcaccgcagtgaactgcttttgttgtttgttttgtcaggctacccttccaagagtcaatccactagaagtggatataatgcgattgtgagaccgatcacctcaaaattgtgtttggacactgaagatgggaggcaacgctgtatgaaaatgttccgacacacaactgagacagacatgatgcaaaagagagaaccaaggaataatatgtctaattcttaa

SEQ ID NO: 11094 - DNA, 261 bp, Glycine max
  Peptide Sequence Number=SeqID_127872
atgtgcaaaggctgttgtaattcgtttttgggcactggtaatcgattacatactttgatcgcgatggcagcgcagttgatccatgatcgcgttgtgatggagtgcctagagggtgtttgggagaccctcgaaggcaatgagaggtgccgattccgtggcacaattcgactcagtgctacttctctagtacatccggagcaacccgcacgcacacttcagcagcctgtggagtggatactacctacacctactccatattga

SEQ ID NO: 11095 - DNA, 284 bp, Glycine max
  Peptide Sequence Number=SeqID_127873
atgaggaatgaaataacttctgctatctactcactcttgccactgagaggggatgattcatacccgatagcagtagccaatgtcggaagaggagccgttggtgctttagttccgcagctcttgcctgagacggaaagttggcaaaggcttcagacgcggtctccggctcaaggtcaatttatttttgagttcccggcccaagtcaaggcgatgcaatactcgggcgataaggaagaagcagtcccaggccttaggtccagaccagatctgagaactttcgagat

SEQ ID NO: 11096 - DNA, 204 bp, Glycine max
  Peptide Sequence Number=SeqID_127874
atggagtctggtgaggtagctcttgtctcttggtcagctgtttccgctcgagtgaaaatgcttgatggggcgagatttgccttgggttcgctttccgggaaggatccgatcccaagtgacattgaatcagttgggggtataagcgctgctatttcagcagttggtgttggaggactgaatgccagtcgaaaggcgcatctatga

SEQ ID NO: 11097 - DNA, 186 bp, Glycine max
  Peptide Sequence Number=SeqID_127875
tgggctaaacgcgcatccaacgttaagcgtagcttcagcgcgcttagtgcaagggaagaatctggtagagcatcaatatcaaggccacgcgctaagtgcgagatcagtgcgctaagcgcatcagttgtcttaagccaggctcagggcacaattggcgctaagctcaaatccatttactcatgctaa

SEQ ID NO: 11098 - DNA, 276 bp, Glycine max
  Peptide Sequence Number=SeqID_127876
atgaggaatggagaacaacattgtcgcaacctagccttcagcgggagggcaagagagactcattggtgcctcttcgaagaaaggaaaatgcgaaggagtcaccaccaacgtttattcgaggaaaacgttagaaaaaccaaaaaggggtctgtgaattttaagaataaaggttcgagagttgtttatgtgtggggaaggcaagctggttacttcagccctaagttttctggtggcccaggcgagctagaggctggcctgggtaagccaggggcctga

SEQ ID NO: 11099 - DNA, 228 bp, Glycine max
  Peptide Sequence Number=SeqID_127877
atgggggacttgggggctgctggattcgtgattccagtaagctttagtgttcttggagttttggggaagaaatggggtgaagaaatggcttcaccccttccctttttaaaatcaatgtcagttatgctcgcccaggctttatgcataatatcgtttggcgatatcggaattcacaggcgaaggcaattcttcatcgtccatactggcaagcaacaatgccccttctga

SEQ ID NO: 11100 - DNA, 627 bp, Glycine max
  Peptide Sequence Number=SeqID_127878
atgaaaaaagtactgattgtgtgtggaaacggtttaggcagcagcttcattgtggaaatgaacgtgaagaaaattattaaggagctgggtaaagaggctgaagtgggtcataccgatttaacctcagccaaatccgagcaggccgatattatcatcagcgctaaagatatcgctgaccagctgtcgagccacagcgcacagccagctattcgagcactcgttcaatattcagggcgtagtgccgaataccgatgcgatggccgcgctggcacagaaaaactacggtaccgaaaccgcgatgatcatggtgttcggtatgctggtgaatattgtgctggcgcgcatcacgccgctgaaatacatcttcctgaccgggcaccatacgctgtatatgtcggccatgctggcggtgatcctgtcggtgggcggcgtgcacggcttctggctggtgctgatcggctcgctgatcctcggcaccatgatggtggtatgtccggcgattctgcagccgttcacccgcaaaatcaccaactcggacgatctggcgctgggccactttggctccaccggctacctgttgtcagcgctggttggcaaagcggtgggcaaaggcagcccgtcaattga

SEQ ID NO: 11101 - DNA, 867 bp, Glycine max
  Peptide Sequence Number=SeqID_127879
atggcgcagctcttcgtcaagctgcatgcggcgccagcggttacgcagcgcaatggcgaccgcttttttggcgccgtcctggccgatgatgaagcggttaagctcgctgacaatctcgcgtggagtcatctcagacatggttttggtccttacgccttagacgatatcaccggcgatattcagcgctttggctacgatatcgtgcgcacccatctccgtgttctccagcagcgcgcgggcggctgcctgggcgtaaggcccgccggaaccgatggcaatcaggtcattttccggctgaatcacgtcaccgttaccgctgatgatcagcgaggagttctcatcggcaaccgccagcagcgcttcaaggcggcgcagcatccggtcagtacgccagtctttcgccagttcgaccgcggctttcaccagatggccctgatgcatctccagtttgcgttcgaacagttcaaacagggtaaaggcatctgcggtgccgccagcaaagcccgcgatcactttgtcgttgtaaagacgacgcacctttttaacattgcctttcattacggtattgccgagcgtcgcctggccatcaccgccgatcacgacccggccgttgcgtcgtacacttactattgttgtcacgggcagaccccttgttgcagtggaaaaaagacaccgcgcagcgggcgcggcgtatcatgcaaccagatatggggtaatcctgtggggtttcaacccccggcaatatctgatgctgcaaattgccgggggcgagcagggagggttaaggcagggcgagcgggatacagctgctgtggccggagctgtgcaggcgcttcaccgtgctgtctgcgctgctgcggtctttaa

SEQ ID NO: 11102 - DNA, 231 bp, Glycine max
  Peptide Sequence Number=SeqID_127880
atgcacatcggccagatgctgttccagcgcgcctttgcggctggtggtgtcgcgatcgatgcgcgacaccggtacgccaggaaacagcgtactgagctgctgctccagctgttccgtgcccacgccgaccggcagcagatgggtagaaccgcagcccggacactgatgcggcagcggacgctggctgtcgcagtggtggcagcgcagctgacgatgctgctgatgcagcgt

SEQ ID NO: 11103 - DNA, 573 bp, Glycine max
  Peptide Sequence Number=SeqID_127881
atgcccgttgttcaggttgccctgcccgttccgctgcctcgcctgtttgactacctgctgcccgccgatgcgccgcagccggtggccggcgcgcgcgtgagcgtaccgttcggcaaccggaaaatgacgggcatcgtggttagcacgcgcgccaccagcgatctcccccttgcccagctgaagcagattgatgcgttgctcgacgaccgctcgctgttctcacccgcgctgtggcgcatcctcaactgggccgccggctactatcactctccgctcggcgaagtgctcagccatgcgctgccggtgctgctgcgtcagggcaagccggcccaggaagcgccgctgtggcagtgggtagtgaacgaagccgggcgcgaagtggcgctggaaagcctgaagcgcgcgccgaaacagcagcaggcgctggcggcgttgcgtcagcggccactgtatcggcatcagatcggcgagcaggattttaccgatgccgcgctgcaggcgctgcgtgccaaaggcctgtgcgacctgcgcgaacatgcgccacagcagcacgactggcgcgccagtttcgcg

SEQ ID NO: 11104 - DNA, 510 bp, Glycine max
  Peptide Sequence Number=SeqID_127882
atgtacggcagcgatctggtgtcgctgctgaaagaggtcggtgatttcgacatctcggtagcggcctatcccgaagtgcatccggaagcgaagagtgcgcaggcggatttgatcaacctgaagcgaaaaattgatgccggcgccagtcgcgcgattacccagtttttcttcgatgtggagagctatctgcgctttcgcgatcgctgtgtggccaccggtatcgacgtggagatcgtgccgggcattctgccggtctccaactttaaacagctgcagcgtttcgccaccatgaccaacgtgcgcgtaccgggctggatgaacgccatgtttgacgggctggatgatgatgcggagacgcgcaaaatggtcggtgccaacatcgccatggacatggtgaaaatcctgtcgcgcgaaggggtgaaggactttcatttctacacgctgaaccgcgcagagatgagctacgccatctgccacacgctgggtgttcgcccgacgctggcggcataa

SEQ ID NO: 11105 - DNA, 1694 bp, Glycine max
  Peptide Sequence Number=SeqID_127883
gcgcgttccgcgttaacgacgacggcttttatcaacagtattacggtttcagccatcagcaccaggcgtggctcgacaaagccgtttacggcctggccgaatggaaccacgagcagattaaagacgcgcagctggtggcggtgccgggttgctatccgaccgccgcgcagctggcgcttaaaccgctgattaaggctggcctgcttaatccggctcagtggccggtcatcaatgccaccagcggcgtcagcggtgccggacgtaaagccagcgtcaccaccagcttctgtgaggtcagcctgcagccgtacggtctcttcaatcaccgccaccatccggagattgtggcccacctcggcacgccggtgatcttcacgccgcatctcggtaatttcccgcgcggcattctggaaaccatcacctgccgtctgaacgccggtgtgagccagcaggatgtggcggcggcgttccacagcgcttaccacgataaaccactggtgcggctgtacgacaaaggcgtaccggcgctgaaaggggtggttggcctgccgttctgcgatatcggctttgccgtgcagggcgagcacctgattgttgtcgcagcggaagacaacctgctgaaaggcgcctcctcacaggcgctgggcggcgtactgctggatagcgaagaagcgctggcgcgtctgtttgatgccctgctggcgtaccgcacgcagtatcagcgtccgctgatcatcgtccacggcggtggctgcctggtggacgagctgatgaagaaactggcgctgccggtgaaaaagaagaacggtttgcgcgtgacgccagccgatcagatcgacattattaccggtgcgctggccggcaccgccaacaaaacgctgctggcatgggcgaagaagtacggcattggcgcagtgggtttatgcctcggcgatgccgggctggtgaacgtggcacagttcgatgaggagctggggcatgtcggcaacgccacgccgggcaatccgcagctgctcaatacgctgctggatgcaggctatatgccggtgatcagctcgattggcatcaccgacggcggcgaactgatgaacgtcaacgccgaccaggccgcgaccgcgctggcggcgacgatcggtgccgatctggtgctgctgtcggacgtcagcggtattctcgacggcaaaggtcagcgcatcgccgagatgactgcagccaaagctgagcagctgattgcccagggcattattaccgatggcatgattgtgaaagtgcatgcggcgctcgacgcggcgcctgccaacccttttcaacggcgtgtcgattggcacccggattctcgcataatcaaggattacgacatgagcacgcaaaacatcaaaaaaatcgttctggcttactcgggcggtctggatacctcggccatcattccctggctgaaagagaactacggtggttgtgaagtggtggcgttcgtggccaacattggtcaggatccggccgatctggaaggcgtagagaagaaagcgctgcagtcgggcgcgtctgagtgccacgtggtcgatctgcgtgaagagtttatcagcgaatacgtttacccggtgctgcagaccggtgcgctgtacgaaggcacctatctgctgggcacctcaatggcgcgtcctatcatcgccaaagcgcagttgaactggcgctga

SEQ ID NO: 11106 - DNA, 2101 bp, Glycine max
  Peptide Sequence Number=SeqID_127884
atgaacgtcaacgccgaccaggccgcgaccgcgctggcagcgacgatcggtgccgatctggtgctgctgtcggacgtcagcggtattctcgacggcaaaggtcagcgcatcgccgagatgactgcagccaaagccgagcagctgattgcccagggcattattaccgatggcatgattgttaaagtgcatgcggcgctcgacgcggcgcctgccaacccttttcaacggcgtgtcgattggcacccggattctcgcataatcaaggattacgacatgagcacgcaaaacatcaaaaaaatcgttctggcttactcgggcggtctggatacctcggccatcattccctggctgaaagagaactacggtggttgtgaagtggtggcgttcgtggccaacattggtcaggatccggccgatctggaaggcgtagagaagaaagcgctgcagtcgggcgcgtctgagtgccatgtggtcgatctgcgtgaagagtttatcagcgaatacgtttacccggtgctgcagaccggtgcgctgtacgaaggcacctatctgctgggcacctcaatggcgcgtcctatcatcgccaaagcgcaggttgaactggcgctgaaagtgggcgcagacgcgctgtgccacggcgcaaccggtaaaggcaacgatcaggtgcgtttcgaaaccacctataccgcgctggcaccgcagcttaaagtggtggcgccatggcgtgagtggaacctgcgttcgcgtgaagcgctgctggattacctgaaagagcgcaatatcccgaccaccgcgtcgctggagaaaatctacagccgtgatgagaacgcctggcacatctcgaccgaaggtggcgtgctggagagtccgtggaacgcgccaaacaaagattgctgggtgtggaccgtcgatccgctggaagcgccggatcagcccgaaaacgtcaccgtcagcgtggagaaaggccaggttgtcgcggtgaacggtgagaaactgagcccgttccagtgtctggaaaaactcaatgcgctgggagcgaaacacggtgtgggccggattgatatcgtggaaaaccgtctggtgggcatcaaatcacgcggctgctacgaaaccccgggcggcaccatcatggtcaacgcgctgcgtgcggttgagcagctggtactggatcgcgacagcttcaaatggcgtgagcagctgggtcaggagatgtcttacgtggtgtatgacggccgctggttcgcaccgctgcgtcagtcaatccaggccgctgccgcatcgctggcagagctggtgaacggtgaagtggtactgcagctgtataaaggccaggccacggcgatccagaaaaaatcggcgaacagcctgtactcagaagagtttgccaccttcggcgaagacgaagtgtacgatcaccgtcacgcgggcggctttatccgtctgttctcgctctcttcacgcattcgcgcgctgaacgagcagaagaagagcaaacagatggcactttggggcggacgtttttcgcaggcggcagatcaacggtttaaacagttcaacgactcactgcggtttgactaccgcctggcggagcaggacatcatcggttcggtggcctggtcaaaagcgctggtaacggtaaacgtgctgagcagtgaagagcagcagcagctggaagccgcgctgaatgcgctgctggaagaggttcgcgccaatccgcagcagattctgcagagcgatgccgaggatattcacagctgggtggaaggcaagctgatcgacaaagtcggcgcgctgggtaaaaagctgcacaccgggcgcagccgtaacgaccaggtggcgaccgatctcaaactgtggtgtaaaacgcaggtggcactgctgctggaagccacgcgcgagctgcagtcggcgctggtggccacggctgaagccaatcaggacgccgtgatgccgggctacacccacctgcagcgggcgcagccggtgacgtttgcccactggtgtctggcctacgttgagatgctggcgcgcgacgagagccgtctgcaggatacgctgaaacggctggacgtcagcccgctgggctgcggcgcgctggccg

SEQ ID NO: 11107 - DNA, 3379 bp, Glycine max
  Peptide Sequence Number=SeqID_127885
atggataccatggcgccggcgctgaaaagtggcggcaccgctatagcggctggaatggtgagttcggccagcaaaattctgaaaggcgagttttctcttgcctcgctggcggcgcatgatcagcagcagcaactcaatccgcagcatcgcagcggacgccaggagcagctggaaaatatgcgaagcatggttatcgggatcgatttaggcacctccggcgtcaaagtggcgctgctggatgcgcacggccaggttcaggcaacggccagcgcgccgctgcaggtgacgcgtccgcagccgctatggagcgaacaggatcccgaaagctggtggcaggccaccgatagtgccatgcaggcgctggcgcagcagcacgatttacgccacgtcagcgccatcggctttagcggtcagatgcacggcgcgacgctgctggacgctgcgcatcaggtgctgcgtccggcgatactgtggaacgacgggcgcagcagcgcgcagtgtcacgagctggagcagcgcgtgccgtcgtcgcgtcagattaccggcaacctgatgatgccgggttttaccgcgcccaaattgttgtgggtgcagcagcatgaaccggcgatatttgcgcaggtagcaaaagtgctgctgccgaaagattatctgcgctggcggatgagcggcgatttcgccaccgatatgtcagatgcggcgggaacgatgtggctggatgtggcacagcgcgactggagcgatgcaatgctggcagcgtgcgggctgaaccgcagccacatgccgcagctgtttgagggcaaccagattaccggcacgctgctgccggaaattgcggcgcgctgggggatggagccggtgccgctggtggccggcggcggcgacaatgcggctggcgctgtcggcgttggcatggttgagccaggacagggcatgctgtcgctcggcacctccggcgtctattttctggtgagcgaaggctatctcagcaatccgcaacgcgccgtgcacagtttctgtcatgcactgccgcagcgctggcatctgatgtcggtgatgctgagtgccgccgcctgtctggactgggccgctgcgctgaccggctgcgatgatgtgccgcacctgctggccgaagctgaacgcgccagcgtgcaggccacgccggtgtggtttttgccttatctttccggcgagcgcacgccgcacaataatccgcaggcacagggagctttctttggcctgacgcaccagcacggccggccggaactggcgcgcgcggtgctggaaggcgtgggttttgcgctggcggaaggcatggatgcggtgcatgagtgtggcgtactgcccaacacggtgatgctgattggcggcggtgcgcgcagcgcgtactggcggcagatgctggcggacatcagtggactgacgctggattattgtcacggcggcgaggtggggccggcgctcggtgccgcacgtctggcgcagctggcggtggacccggccagcgaatggccggcaccggcgttagtgcagcgccatcagccggacgccgcgcagcatcaggcctatcagccgcgccgtgcgcgctttgcgcagctatatcagcagctatacgtggccggatttggctgcgcatcttcgcccatcgttaccccttcatcgcctgaggaacccaccatgccgcagcccgtctattttcttgtcctgccgggcgtcatggcgctcgacctcaccgggccggcagagacgctgcagctggcgggcggacattttgcgctgcactacatcggcccgcaggcgagcgtcatctgctcgaccggcatgaccattgcggatattgcaccgctgcccgccacgctacctgataacagtctgctgattgtgcccggcgtgttcgattcccgcatctggttcgataccggggcagccgggcaggcgcgtgactggctgcgccagcaacacggcgcgattcatacgcggcgcattaccctcgtgtgtatttgctccggcgcgctgctctccgcgcaggctggtctgctggatggcgtacagtgcaccacgcaccatgatgtgttgccgcgcctgaaagctgccgcgccggctgcgctggtgaaagacaaccgcgtgtttgtggaagatgccggcatctggaccagcgcggggattactgcgggcgctaacggtggcgcgggagatggtggtgtggacgcgatgattgcgcatccggaacatgactggtcgctgggcgcgctggccgaacgtgcccaccgtgcgggaataccacgagcagctacggctggtgattgcgcgccagcgccagcagcagggggaagcggcggagaaagcggcgctggccgccggcttctcctcggcacgccagctgcgccgcgcccggcagcgctgggacgatcagctcaccagatgatgcttgtccacgcgtttcagcaccattgccagcagcaggctgcccagcagggttacgccaaagacccacggcagatcgagccacggccgcgacatatcgtccggccggtggttcagcacatttttaaacagcaccagcaggcttatcgccgcgataaacaccagtgggccacagtaaagataccaggtgtcattaaacgcgccgttaatcttcagcatctgtcgggtgccaagtgcgataccgatgacgcaggcgataaaactcagcccggccagccagctgatgccgcgcctgtcggtatccatcacgccaattgcccgtccaagcagcgcgtacagcaggtagtaaatcgagtcgccgctgacatacagattgaccggcagccagtggaacggccccagcgactggctgacggtgttcggattggcgatcaccgcgaggatcagcaccagcagcgccacatagcgcggcggcacgtttttcacctgaatcagcggagacagcaggtagatgccgataatggcgaagaagaaccacagatggtagaacaccggcttctgcaacagcttcagcagcgatcggccttcgctgatcggcgtcagccaggtgatgtaggccagcgcgacggcgctgtagaacagcaggcacagcacaatgcgcagcagatggcggccctgtgcgctgcgttcgccaaagaacagataaccggaaatcatgaagaacagcggcacgcagacgcgcgaagccgagttaagcagattggcgacgtcccagctgggtccggtgactgccatcggtccggtaatgtaccaggtggtggtgtgaatgacgatcaccatcagacaggcgaccgcgccgggccaacaacccccgcagcctggatttcggagctctctgttaaccgccgcataaccgcacccgcctgcgccaggatttccggctgcacaatgcgcg

SEQ ID NO: 11108 - DNA, 1694 bp, Glycine max
  Peptide Sequence Number=SeqID_127886
atgagtattcgcatcatcccgcaggagcagctggagaagagcgaaaagaacacggcggagcaagttccgccgttacttttcccccgtgctgaaaaatctctacagccgccgtgcggcgcggcccaggaaatcgtgctgtatgaccatccgctgcagatcgatctgcatcagcggctggccgagagcgcgcagcagggcaaaccgccgctggatatccacacttacccgcgcgatgtgcactggcagcggctgctgcattcgctgatcgccgagctgaagccagagatgagcggccaggcgctggcggtgctggagaatctggagaaggcctcgtccaccgagctggaaacccttgccagcgcgctgctggagggcgaattcgcccaggtcagcagtgataaagccccgttcatctgggcggcgctgtcaatttactgggcgcagatggcggcgatgatccccggcaaagcgcgggccgaatatggcgagcaccgtcagttctgcccggtgtgcgccagcgtgccagtcgccagcgtggtgcacatggacgttggccagcagggtctgcgctatctgcactgtaatctgtgcgaaagcgagtggtacgtggtgcgcagcaagtgctcgaactgcgagcaaacgcgcgatctacattactggtcgctggacagcgagcaggctgccgtgaaagccgaaagctgcggcgactgcggtacctatctgaagatgctataccaggagaaagatccggcgctggaaccgatggccgacgatctcgcctcgctggtgctggatgcccgcatggagcaggaaggattcgcgcgcagcagcctgaatccgtttatggtcgccattcatggcgaccaggtttattcacctgcgtcatccctgttgcctgaattgatcattcacacggaggcttcgatgaaactgattggcagctataccagcccgtttgtgcgcaaaatctcagtgatcctgctggaaaagggcctggtgtttgaattcgtcaaccactctccgtgggagcctgacagccacgtcccgcagtacaatccgctgggtaaagtgccggccttcattgatgaccagcagctgacctggtttgactcctcaattattgctcaggtgattgagctgcgtggcgatgcgcctgccctgctgcccgacgacgcactgcgcgccctgcagatccgccagctggagaagctggccgacggcatcaatgatgcggcggtgatgatcgtgcgcgaacagatgcgtcccggcgatcggcaatcggaagaggtgctgctacgtaatcgcgagaaaatcgcgcgcggcctcgacgcgctggaaaccgccgccgcgcagggcgagttgctcaacagcggcacgctcaacctcgccgatatcgctaccggctgcaccctgggctatctcaattttcgccgcgtgctgcccaactggtgcgtcaatcgcccggcgctggttaaactggcagaaacgctgttcgagcgggaaagctttgcccgtacgtcagctccctgccatcgacagcctgctgcgcgatccggcgctgcagccgctgctggcacaatccggaggcgcgcgaccacattcagcaacatcaatcgttaccgcactggcacgccagctggccggatgaagcgctgcgccgcgcgcagcagcagcagcaaagcgcgctgcgcccg

SEQ ID NO: 11109 - DNA, 294 bp, Glycine max
  Peptide Sequence Number=SeqID_127887
atgtcactcaagagagttaggcatgtaaaagataaaacttgttcaaggttcaaggctaagtcttcatccgctgttgtcgccaatgacaaagccaagcaggtggctgcaatagctaacagagacgacaagggtgtcataggagaggtcgagaatgggcctcgagttggttcagatcccgatgcggttaagttggatctccgggtcggaggggtaaaggaggaaggcagcgcaaacaatgaggaggaaaaggaagagtgtggcaaagtagaggatgcaacgacacaccgttattaa

SEQ ID NO: 11110 - DNA, 210 bp, Glycine max
  Peptide Sequence Number=SeqID_127888
atggtgctcgtcgctgtcatcttcatcgtgagagctgctctcgctttcggatctaggtggttcatggaggttggtagtggcgagacaatgcttgttagagatgggtgtggaggttggtggtttcatgggtggtggcacgtggcagtgcatgacgtgggtgggtgcacaacgaggtgtcctgtggcttttgagttgagtgtagatgtatag

SEQ ID NO: 11111 - DNA, 2388 bp, Glycine max
  Peptide Sequence Number=SeqID_127889
atggtgcgaatgttctgcgccccgaccgagtgctgtgtccagcccagtgcatacaggaacgaggtggaaatccgcttttggcgtgccgcagatgcgctcgaccatttccggcgtataacggctgacgtgctgcttcagcagattccagacgcagcgcggatggttcaggctgtcatcgcgtttggcaaagccgtcgtcgcccagctcgtagttccagctggttttgtcatatttgcgattggcttcgtcgtagccgctgaacaggccatcgtcgaaatggtaatcctcccgcacgatcaggctggcattggtgtacgcctgcacatattcatgctggattttgtcattctgcagcagccacagcagcacacccgacaggaaggcaatgtcggtgccggggcggataggcgtgtaaaagtctgccaccgatgccgtgcgcgtgaagcgcggatcgataacaatcagtttggctttgttgtgaattttggcttccatcgcccagcggaaaccgaccggatgcgcctcagcagcgtttccgcccatcaccacaaccagattggcattacggatgtcgacccagtggttggtcatcgcaccgcgaccaaatgttggagcaagacttgctaccgttggtccgtgtcagacgcgtgcctggttgtcgaccgccagcataccgagcgatcgggccgaagcgcacagcatgccggtggagagccagcggtttaccgtcacgccggcggcgttctgcgcgataaagttggcgtcgcgatcggctttcatcagctgcgcgatgcgcgtaaaggcgtcatcccagctgatgcgctgccatttgtcggagcctggcgcacggtattccggatatttcagacggctgtcgctgtggacaaaatcaagcaggcccgcgcctttcggacagagcgcgccgcggctcaccggatggtccggatccccttcgatgtggaaaatggtctctttggcgttctttgcgccatcgccgaggctcgcggcttccggcgtaaagccgagcagtgctgccgtggttcctgccataccgccagcgcagatcttgaagaattttcttcggctgacgttcatggccggggttcagaatggctccacgcaggattgcgtcaaaagcgacctgatattaccactactttaatgtggttgttatgcgagacgagagaagtgaaagcgaaacagcaaaaaagtaaccagaatgtgaatgagatcgcaggactgagccagaccaccgtatggcagcgccacgcgattaccgaagcggaaagcgactggctggcgcaggaagtgccggtggcgctggtctacaacggcatttcacacgtggtgatgatggcaacgccggataatctgcaggcttttgcgctcggtttttcgctctccgaaggcattattgagcaacccggcgagatctatggcatggatgtggtgccgggctgcaatgggttcgaagtgcagatcgaactctccagtaggcgttttatggcgctgaaggcgcagcgtcgcgccatggcgggccgcaccggttgcggcgtatgcggggtggagcagctggatcaaatcggcaagccggtgcagccgctgccgtttacgcagaccttcgatctggcctgccttgataacgggctggcacagctgcgcgatttccagcccatcggcaatctgaccggctgtacgcacgccgccgcgtggatatcgccgcagggcgaactgcagggcggctgcgaagacgtgggtcgccacgtggcgctggataagctgctgggtcagcgcagccagcagcactggcagcagggcgcggtgctggtttccagccgcgccagctatgagatggtgcaaaaatctgccatgtgcggcgtagagatcctgtttgccgtctcggccgccacccagctggccgttgaagtggccgagcgctgtaacctgacgctggtcggtttttctaaaccgggacgcgccacggtgtacagccatccgcagcgtctgattaacgcaaggaaatggaaaaagtcttcatgccacaaacagaataaacaggatatcaaatccattctgctggttcgcaatgaaggtaaaatcggcgatgccattgtttctacgtgttttctcagagcgctgtttgaagccgggtatcgtgtagatattctggcgcgcgataaatatgacaccgccatcgggagtgaggtcgtgaccctcctgagagacaatgcttacgatttattgatcgatacggctatctggcaaaccgcgctgtatatgcccaaaatgattgccgatatcaatcctaaaatgacgctgggtttcaacaagcctggctggcttaaaccttacgatatcaacattcagttcgatcaccttaataaccac

SEQ ID NO: 11112 - DNA, 2576 bp, Glycine max
  Peptide Sequence Number=SeqID_127890
caaggaaatggaaaaagtcttcatgccacaaaccgaatagacaggatatcaaatccattctgctggttcgcaatgaaggtaaaatcggcgatgccatcgtttctacgtgttttctcagagcgctgtttgaagccgggtatcgtgtagatattctggcggtaaaggagaatgagagccttttccgacataatccgtatattcacaacatctatctctcggagagtttcagcgattgtcatcagcgcgataaatatgacaccgccatcgggagtgaggtcgttaccctcctgagagacaatgcttacgatttattgatcgatacggctatctggcaaaccgcgctgtatatgcccaaaatgattgctgatatcaatcctaaaatgacgctgggtttcaacaagcctggctggcttaaaccttacgatatcaacattcagttcgatcaccttaataaccacgttaaaaatatctatcgtgcggttcttgactatcttcaggttgagacggttggtggactgaattatgaaatattttaccctgagcgcattgatgccgaaattcaccagtccggcatgttttccgctgatgagcacaatattttaatcaatatttatgccagtcatgccgatcgtgacctctctgagcagcagctgaatgagctaatcggggcgattgtcaggcacaatgcggccaccaatatcgtggtgctcgatcacaaaggcgcgctggaacaggcgtcgctgcaccccgcgaagttataccgcgttccctcgctgtatcacgctttcgctgcggttaagaaaagtgattgcgtgattactcccgataccgccgtggtgcatatctcggcggcttataacaaagccctggttggcatctatcaggactcactgaaaaataatcacctgtggtcgcctggctacagtaacggccatcagatattttccgatgagtttgtttgtaaaaatgacggacggctggttgagaaaataagccaaaaaatccacacgctgagcgttgagcgcaccgggctttgccgcgccgccgtcgcaaatcaacagatcgatatcgccgacaggggcgtactgggtacggctgatcacgccgagtttgctgtgatccgccagcagcagggtgcggctggcctgctgtaccatggcgtgcgcgatggcggcttcatgcggatggaagctgctggcgccggtttcatgctcttcggccgcgctgagcgccagtgccgcctgcagactgttggtgatgatggtcaggccggacatggtgcgcagctcttcagccagcagcgtggtggtggtgccggcatcgaggaacagcgtctggccgggttgcagatgttgtaccgccgcggcggcaatcgcacgtttctctctggcctgtgcgttacggcgcacctgcagcggtggctccggcgggctctccagcgccaccagaccgccatgcacgcggcgcgccagcccctgcgcctcaagcgaaatgatgtcgcgccgtgccgtttcccgcgaaatgcccagctctttgatgatgcgttcagtgctgagctgatgttgcgtgctcagcagcgcgcggatgcgatgcatgatgttcgcagagatcaggctgcaaacacccctttcaccttcgcaacgggagttaccatggttacacgttccaccatcatggataccaacagttttcgcgccgaacacgccgacgcgctggatccggccacccgcactctgacggacaagcgcagcaaagtgctgggcgaatcgtatcggcagtatttgtgggatgcggcgggtaacaaatatctggatgtgtataacaatgtggcgagcatcggccactgccatccggcggtcattgaggcggtgaatcagcagatgaagatgctgaacacgcacacgcgttatctgcacgagcgcattcttgactacagcgaagcgttgctggcgaccacgccggaagccattgaccgcgccatgtatatgtgtaccggctcagaagccaacgatttggcgattcgcgtggcgcgcgcctggagcggcggcaccggcattattgtctcgcaggaggcgtaccacggtaccagtgatttgacctctggcgcgtcaccggcgctgggtagcggtcagccgctggccgcgaccacccgcctggtgccaccgccggatgcttatcgtgtcgatgcgcccgacctcggggcatggttcgccgaccagattcagcagcagattgatgacatgaaagcgcacggcattaaattcgccggtttcctcgccgactcgatcttctcctccgacggcgtgctgcctaatccgcgcggattcctgcagcaagcggtggatgtggtgcatgctaacggcggcatttttatcgctgatgaagtgcagcccggctttgcccgcaccggcgatgccttctggggctttgcccgtcacggcgtggtgccggatgtggtcaccaccggtaagccgatgggcaacggtattccggtttccggcctgctggcgaaaagcgacgtgctggccgcgttcagcgatgagatcccttatttcaatactttcggcggcaatccg

SEQ ID NO: 11113 - DNA, 477 bp, Glycine max
  Peptide Sequence Number=SeqID_127891
atggaagaacgaaataatatggccgagcacaatgccgacgataccgaagtccgcatcaccaaaggtggtggacgcgaagccaaggtcacccatcagcggcagcagaatggcgggcaggaaggagatcagcagcccctggacaaaggaaccgatgatcgcaccgcgccgtccgccggtgatattgccgtagacgccagcggtcgcgccgcagaagaagtgcggcaccaggcccggcacaatcacgctcagaccgaacagcgggcacaggaacatgctgatcagcccggcggcgaagctgcacaggaagccgatgatcacggcgttcggcgcgaacgggaagaccgtcgggcaatccagcgccggtttagcgtttggcaccagtttatcggcgatgcctttgaacgccgggacgatctcggcaatcaccatgcgtacaccggcaagaatgatgtaaacacccgcagcaaaggtgattga

SEQ ID NO: 11114 - DNA, 648 bp, Glycine max
  Peptide Sequence Number=SeqID_127892
atggatttgacccgcttccgcgagcagatcgaagcgatgaacgccagcgcctcgttctatcatgtcgatattatggatggcagctatgttaagaatattacgctgtcgccgttctttattgagaacctgcgtaaaattaccgatgtgccgattgatgtgcatttaatggtgaaccacccggaagatattattccgatgtgcattgacgccggcgcggatattatcagtttccatccggagacggcgaataacaaaatttttcgcctgctgacgcaaattaaagaggccggccgtcgctgcggcgtggtgctgaatccggcgacgccagcggaaagcattcgtgagtatgcgcatctgctggataaagtgacggtgatgtcagtcgatcccggtttcgccgggcagaaatttattccggaaacgctgaacaaaattcgccagctgatcgccatgcgggaaacgcacggttatcactatctgaccgaaatcgatgggtcgtgcaatgcgcgcacctttaagcagattgccgcctcgggcgtcgacgtgtttattgtcggcacctccggcctgttcaatctcgacgatgatgtggcgcaggcgtggcagaagatggagcagatttttgcgcaggaaactgccgcagcgtga

SEQ ID NO: 11115 - DNA, 1235 bp, Glycine max
  Peptide Sequence Number=SeqID_127893
gtaatcaacttgaaggaaacattccaacttctttgggtaatctctgcaacttaagggtgatagatttatcatatctcaaactcaaccaacaggttaatgaacttttagaaattcttgctccttgtatttcccatggactcacaacacttgcagttcagagttcacgactttcaggcaatctgacagatcatattggggcatttaaaaatattgacacgttacttttttccaacaactcaattggtggtgctcttcctagatcatttggaaaactttcatcattaagatatctcgatctctctatgaataaattcattggaaatccatttgaaagtcttcgatcactctctaaattgttatctcttcatattgacggcaatctttttcacggagttgtcaaggaagatgatcttgcaaatcttacaagcttgacggagattcatgcatcaggaaacaatttcactttaacagtgggtcccaattggattcctaattttcaacttacctatttggaagtgacatcatggcagttaggtcccagctttccattgtggattcagtcacaaaaccaacttcaatatgttggactatctaacacggggattttcggttctattcccacacagatgtgggaagcacttcctcaggttttgtatttaaacctctctcataatcacatccatggtgagagtgggactacattaaagaatccaatatctatccccgttattgatctaagctcaaatcacttgtgtggtaaattaccctatctttcaagtgatgtgtctcagttagatctttcaagcaattcattctctgaatccatgaatgactttttatgcaatgatcaggacgagccaatgcaattacaatttctgaatcttgcatcaaataatttgtcaggagagatacctgattgctggatgaattggacatttcttgtgaatgtaaatttacaaagcaaccattttgttgggaacttaccccaatccatgggttccttggcagagctgcagtctttacaaattcgtaacaacacactctcaggaatatttccaaccagtttgaagaagaataaccaattgatatccttggaccttggggaaaataatctttcaggatgtattccaacatgggttggagaaaagctcttaaaagtgaaaatccttcgccttcgatcaaacagttttgccggccacattccaaatgaaatatgtcagatgagtcatcttcag

SEQ ID NO: 11116 - DNA, 110 bp, Glycine max
  Peptide Sequence Number=SeqID_127894
tgaatggtgagtactcagtagtgagattcaactacactttcacgtgcaaacctgctgctgtgagtaattgcaaacctgaagccgctttcaatcacgtcattcataactaa

SEQ ID NO: 11117 - DNA, 636 bp, Glycine max
  Peptide Sequence Number=SeqID_127895
atggagtaccaccaaagacaagccttaaggcaatccttactactaattagctttggacagcttctgcaattcagtcaccaacttgaccattataggtataacatagtgaaatcacttgcatctgcacttctctatctgcatgaggaatgggatgaacaagtcattcacaggaacataacctcttcagcagtgactcttgaacctaacatgaccccaagactaggtagttttgctctggctgagtttttgtcaaggaatgagcatggccatcatgtaatcaataatacgagcaacatgaggctgtggattttaattcaggttaggagttgtggatttaaggctgtggtgcccaaaactaggcaacttgaggtgctagtggtaaagaaagttcatgaatttgaggtgaaaaaaggagtgaagcagcacagacactcagtggatgagaaatctgatgaccttgacctcttagagacagaatcacttgtaggctttatgctaatattggaatcagaccctataaaagagacatatcttcagccaattggttcaacacttgctgtacaagagaactatgttgcaagtcctttggtagataatccaacagtggctcagattacaaactggaacgaaacataa

SEQ ID NO: 11118 - DNA, 342 bp, Glycine max
  Peptide Sequence Number=SeqID_127896
atggatgcaagcggtgcacttagcggaatgagctctcacttagcacgcatgtacaactcatctttcttccagattcttcctcgcgctcagtcagaaaatgcctcaaactccataaagaaaaagtcatatcagtcaatgcttcttgtgatgtccatagcttgtttgtactgcttttggtgtgcaattcaaatatactggactattccacgtcatccagctgtaggtgaagaggccgatctcggtgttctcgtgttcttagctatatactttttcctaccttatggtttgtgtataatgtccatgtccctaaaagatcatgatcctaatcagattcctctttaa

SEQ ID NO: 11119 - DNA, 183 bp, Glycine max
  Peptide Sequence Number=SeqID_127897
atgaacgtgacttttcggttgagcgcaattccttttaggttgggatatgcactcagtgcgacatttcgtgctgagcacaattcctctcgacttggaattgcacttagcgatatttcaaaaagtgttattttgaaaatcccagtggtcaaactatgggacatgggtaacgaacctacaatctaa

SEQ ID NO: 11120 - DNA, 216 bp, Glycine max
  Peptide Sequence Number=SeqID_127898
atggcaaagtctaatagttcagacataaacatcaatggatcaccaaatgatgaagtatccttcctctcaaagaagctcaataagatgttaaagaagaaggataagtataaaaacttctctagaaagaaggacaagtatgagaaagacgagaacagcgaaaccgatgttgattgggtagatttctacatcggttatcagtcaaccgatgtagaatcg

SEQ ID NO: 11121 - DNA, 540 bp, Glycine max
  Peptide Sequence Number=SeqID_127899
atgactacaaacaccatcgcgactggaaacaccaacatgactgaagaagcctcgacgaaacatggaggttgctttggttcaagggaacgaaagaaaagtaagtatttgcgtgatccctacacaaacattggggatttaaggaaacatagaactgattcaaaagttaaacaggagagcccaacccagccaattggatctataaaaatgtctggtgtaaccgctactcaaccaactgggtctacaacaatgcctagtgtgacccctacccaaccaatagggtctacaacaatgcctagtgtgacccatacccaaccaatagggtctatatcaatgcctagtgtgatccctacccaaccagttgtgtctatggaagtgcctagtgagacacctccttcccttgagtttatgaagcaaaggttggagatgatggcatcaaccatggagagttcaggacatacactttccccccggatgagagccaaattggatgctggaattaaaaaccttttggaaagggtgaacgctaggattaatgtctga

SEQ ID NO: 11122 - DNA, 168 bp, Glycine max
  Peptide Sequence Number=SeqID_127900
atgatgactgaggagtattggaagcaagcacacaccggattccacaaccctgttccactaatttctctagcaactgttggccgtacgttgtgtgctgtagttgaaaagtggtcgtcgacgccgtcaccgcatgctgccacaaaatggaaaaagtccacaaatgcttag

SEQ ID NO: 11123 - DNA, 1278 bp, Glycine max
  Peptide Sequence Number=SeqID_127901
atggctacagtgcacagtttcacgggtaatggctggagtgatgaacttcctaacagtggaggtgttaatggtatgtcttctctctctatggacatgaacgtggaatcagtgccaagtgatcaaattgagaatactagtgggggcaaagctatggtcactctttacttggcagaagaatatcggcaatgggaggcatgtgaggaagaagctagatcgataaaagacaaatcctttcacttccaggaagcttggactactcacccagaatttagagacttggtgtcccaaacatggaacatggtactgggggatgctcctcaaaagcctgaagggataagagagaaagcactcgtctttaacagagagacttttggcaatattttcagaaggaaggagttagaggccagaattaaaggggtacacaagattcttaatgtaaatgtaacttctgatatggtacagcttgaaaagacccttcagcaagaatataatgaggtgattggtctctttattgatggcacctggtgcacagacccacagcttttacagattgaagctccgtccttctttaagaatttgttcaacacgaatgagccttgttttcccccatgcttgaagctagataatatttcccctattagcatagacatgcttgaagacctcattaaacttgtctcaaagactaaagtcaaacaagtgtgctacaatgaaatgattgacggcttcaagcttaatagaggattgcatcaagaagacccactttcaccgtacatgtttctgttatgtatggagaaattagttttgcttattcaggcgaaggttagcaaggcaacttgtgctcaagtgaaacttgtcaaggaggttttgggattgttttgcaaggcctcgggtttaaaggtcaatgcccagaaattcatcttttatgccttctccaatctcaagagacaagagattaccaagtttgcctctattcttcaattctatcacactaccaatctaggttcttcctacatatggcgttcaatgatgaaagcttatgaccaactagaagatggattcaagtttaaactgaggcgaggaaaggtgtctttgttctacgagcagtggtttgatggggatctactttgtcaacatctagaggaggtgcatgaaatggacatccatcttagcatcaacaatgtgtggttggataacacatggcattgggagcttgttcgaacaccgttgcatgctgctataaaacataaactttcgaacatcatacgaaggataaattga

SEQ ID NO: 11124 - DNA, 288 bp, Glycine max
  Peptide Sequence Number=SeqID_127902
atggggttacgatgtcggcggcgccgatcgggtggcccgccgatggttagttccggtttaggaggcggcgttggtgtttggtggaacggtggttatggaggtgaggtagataggttttggtggtttacggtgaaagagaaaggtgatgggcgtgcttcaggaggagacaaagaaaaggctaagaaaatgattggttgctttttgaaacggaataaatgtggattacggccccaaggacttaatggaattgaatggatgaatgtgaatatgaatattaacaatggataa

SEQ ID NO: 11125 - DNA, 715 bp, Glycine max
  Peptide Sequence Number=SeqID_127903
atggcgaagcgtttgattccactgttcaatcgggttttggtggagaaaatcgtgcctccatcgaagatcaccactggcattttgttacccgagaaatccaccaagatctcattcttggagaatttatggctaacaatatatgaaatgcttcagcttcttacaagtattccagactatgtaaagatagtggaagttggtgcaagggatggattgcaaaatgagaaggccattattcctactaatgtaaaagttgagttaataaaactgctagtttcttctgggttgtcagttgttgaggcgacaagttttgtctcaccaaaatgggtaccccagttggcagatgcaaaggatgtactggcagcaattcaaaatgttgaaggtgctaggtttcctgtcttgactccaaaccttaaaggctttgaggcagctgttgctgctggagctaaagaagtggctgtttttcctgcagcttctgaatcattctcaaaagcaaatctgaattctagcattgaggataatcttgctcgttgccacgatattgcttcagctgctagaagcctctcgatcccagttcgtgggtataactttcagttcatacttgtccatctctacagaaatattgctccagcaaaagttgcatatgtggcaaaatcgctttatgagatgggttgctcagagatttcactgggggatacaatcggtgttggcacacctg

SEQ ID NO: 11126 - DNA, 288 bp, Glycine max
  Peptide Sequence Number=SeqID_127904
atggagttggtggtagatccatgtgtaaggatcctttgtataaaaagttttcttggcgatggagatcaggcgacgtgcttcatggccatgaagaggtggagcatggcgtgtgtcagcttggacaacaacggagatgacaatgacaatcataataatagtgacaaaaatcatggcaatggtgatgtggtgacagaggcaacaccaacaactacaattatgaccatagtggtagtggcaataaaggacatggtggcggacacaatgacaaccatagttaaagaagaatga

SEQ ID NO: 11127 - DNA, 411 bp, Glycine max
  Peptide Sequence Number=SeqID_127905
atgtcctttccttcagagggctccacaccctcaccttcagaggactacacgtcctcgccttcagagggctacacaccctcgcctttagaggcctacaggctcttgccttcagaggactacacgtccttgccttcaaagggctacacgtcctcgccttcaaagggctacatgtcctcgccttctgaggactacacatgggtacatgtcctcgtcttcagaggactgcacgtccttgccttcagtggactgcacgtcctcgcctttagaggactacatgtcctcgcctttagagggctgcacgccctcgcctttagaggactacatgccctcgccttccgagcgcttcacatcctcgctttcagagggctccacatctgcacgtttagagaacttaatgtcctctgcccttaa

SEQ ID NO: 11128 - DNA, 1051 bp, Glycine max
  Peptide Sequence Number=SeqID_127906
atgaattcctcctttttttatattcttgtctttgtccagctttggttgttcagcttaccatgcagagagagtgtgtgtatcccaagtgagcgtgagacacttttgaagattaagaataatctcaatgatccttcaaataggctttggtcttggaatcataatcataccaactgttgccactggtatggagtcctctgccacaacgtcacttcccatgttcttcagcttcacctcaacactacgttttctgctgctttctatgatggctactatcacttcgatgaggaagcttatgagaaatcccagtttggtggagagataagtccttgtttggctgatttaaagcatttgaatcacttgaacttgagcggcaattatttccttggagcaggtatggcaattccttctttccttgggacaatgacttccttgactcacctcgacctctctcttactggattcatggggaagattccatctcagattgggaatctctccaatttggtctatcttgacctcggaggttattctgtcgagcctatgttagctgaaaatgtagaatgggtatcaagtatgtggaagcttgaatatcttcatttgagttatgcaaacctatccaaagcatttcattggctacacactctccaatctcttccttctttgacccacctagatttgtcaggatgcacactccctcactataatgaaccatccttgctcaacttctcatctctgcaaactctccatctttccttcactagtttttcccctgccatttcttttgtccccaagtggatattcaaattgaaaaaacttgtttctcttcaattatggggtaatgaaatccaaggtccgattcctggcggtattcgaaacctcacacttcttcaaaatcttgacttgtctggaaattcattctcatcttctatacctgattgcttatatggtcttcatcgtctcaagttcctcaacctaagggacaaccacttgcatgggactatttctgatgccctgggaaatttgacttctcttgttgaacttgatttatcag

SEQ ID NO: 11129 - DNA, 468 bp, Glycine max
  Peptide Sequence Number=SeqID_127907
atgcctctcacacagatggacagcaaagaaggccttctaaggcggactctggctctttcatttgtatgtaagagtcctcctcaggcacgagattgtccgatgaaggataaacttgctggttgccgaggaccagagggaagaacacctaggatagtgctgaatgaaatggccactctgctcgtgcgatggtcgataccggcgccacgagacgaggctacttccatccaagggaaaagtgaagtcccggaattgaaagcccgggaggtccccccgtgtttaatagcatatcaagtttctgcctggattccggcggcttttgccacttatgatcagtgttcacaagagcgagacggttcaatgtcttacaatgttcaagcagcattcttgccggaaggattttttaggaagcccggacacctaccgaacatccctgaaggatggaacaacatgatgaagaaggcggcgaaa

SEQ ID NO: 11130 - DNA, 492 bp, Glycine max
  Peptide Sequence Number=SeqID_127908
aaatataggcttcacactagaagacccagtccgagcctacataccggaggaccaacaccccagcttgtagtccttggaggaatttgggtgccaccggaatatgccacaactacagcagccatgacaaattccggtgaccccacactctatggcccacatcctacctcacaagtggcaccaccacactactgtgcagccacccaaatgccccaagaattctataactcagcgttgccgttatcgttgctgccaccaccacatgactacacccttcatcatcatcattttcacatgtacaagacagcagcacagacacaaaactctccggagtccgatattcggagcagtggcgaccggtcagagagcattgtggatgggaagtcggagagtggtaaatggaatggagagagtggagagaagaaagggttggcagcactaagagatcaagaaggggaagagagcactggaagtgagattactcttaaattctag

SEQ ID NO: 11131 - DNA, 162 bp, Glycine max
  Peptide Sequence Number=SeqID_127909
atggcaggaactttgttgggtaccggtagaccacttggttaccacgtgaattcctcaaaagtatgtatgcaatgggatttgcacccatttctgatgttattggtatatctatcaatgtttgtcgtggcttaccttctagggagcaaccatatcttgaaatga

SEQ ID NO: 11132 - DNA, 531 bp, Glycine max
  Peptide Sequence Number=SeqID_127910
atgaccgtcgtcagggttcgtcactgtcgcgagtctgagtatcctccgttggagtccgacatcaacgcaagtttaaggctaacttcatcttttccatccacaacgcaattgatctgcaattgtgaaacaaccgacactaccctatcgagtcgcacgagcaactctcacagggaatactgggtcctcttttcactcaacaagcctttctcttctggcatgtttatggtactgattctggtgttgacacttactttgtctattactggaattgattaccgcaaatacttgacttgggttcctactgaagaatccagtcattacattgttcctgaaataggtctagatgttaagttctcctatgcatcacacaaggtgtaccgaatagacatatatgcttttggacttgtagcttggactggaaatgacgtcttgaatacaagtgttgagaaagatcttgcaccgcttcatgctcccaaacaagaagaggcctcctccatcaatacaaaaggtcagtcttcagccttcgtatag

SEQ ID NO: 11133 - DNA, 420 bp, Glycine max
  Peptide Sequence Number=SeqID_127911
atggcagctcgcccaggcgagccaagacttacacctaaagtaactggctcacctaggcgagctggtttctttaggctgaagtcttttgaaggcccaagcgagccaggggccaaaaaacttagcaaaatgacccttttgcccctcctttttggtatctttcgcattcctgatcaaaacgttgaacgatctctccttttgtgtggcctaggatcttcttcatcaatggattcctttgcttcttggaagatgaatggcagcggaatggagaaggaagagagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 11134 - DNA, 438 bp, Glycine max
  Peptide Sequence Number=SeqID_127912
atggtatcgcaggacaatgcttatcttcatttcttagaccttggaggcaagggtcttcttgttgacaaattcagcatgtctccaaaaggttcttatcagtttagggtagatggtttgaggtctacttttttgagttctttgatatcgaaaaaagtgttctacatggatggatggctcattatctatgtgtattgtgttgatttcgatggttgggatagctttagttataggggtgtttgcagaggccatttgagggagatgaaagctaaggtttggatactcagagaggaagttaaagtgtttgcaaagagaatgtgtgcgctaagcctgacaactcccaatttcttcttaggttggaattgggttaagccaaataggtctcaagaagcccgacaggtcgcgctaagccccaacgctaagctagacaactctcgctaa

SEQ ID NO: 11135 - DNA, 651 bp, Glycine max
  Peptide Sequence Number=SeqID_127913
atggaagaaccatcaaagaagcgcaaaggttattcgagtagaagccaacggcactctgaggctcaggatactccaattccttcctccatttccccctcctcattgttctcattggaagaacaccatacacggtacacaaacctcttctcctcttgttctatcattgaccctaagttcatagatatggatttattttctgatgagagtttcgaatgcattcaagcatttcataactcaaatctcattccctttatgtctttaaaactgcatgtgtattctaaattggtaaaagccttttattctaaccttgaaattcaagaaaataccttgatttctgaggtctataggataaagatggtcattgaccaatccctcttctatgatttgacccaattgtctagtgacggtgtaccatttgaagatgcactagatgatgagtggaagtttgatttttctgtgcataatgcccaccggttggtttgcaccaaccaagcggatatgaccagaaggttgcttgccggttcattggctcttgaaagccgcatcctccattatctaattgtctgtatcttacttcctagatcttcaaaccttgcacaggtttctgaagaagatctaatagtcatgtgggcctttcctaccggccaataa

SEQ ID NO: 11136 - DNA, 288 bp, Glycine max
  Peptide Sequence Number=SeqID_127914
atgacacctttatatatatgcctccagttaagactatgtagcttgtgttacagtgttctccattatgaccatcggaatctagagatagcagcaatttctattctagggtcacttgttaattccagtatcagggttctggtatacagtggagatcaagattcagttatcccattactgggatcgcgatctctggtgaacggattagctaagcaacttggactgaatacaacagtagcttatagagcatggtttgagggaaagcagacttttgacatgacgcttatgtga

SEQ ID NO: 11137 - DNA, 372 bp, Glycine max
  Peptide Sequence Number=SeqID_127915
atggcgaagcgtttgattcctctgttcaatcgggttttggtggagaaaatcgtgcctccatcgaagaccaccgctggcattttgttacccgagaaatccaccaagctgaattccggaaaagttattgctgttggccctggctttcacagtaaggatgggaagctaattcctgtggctgtaaaggaaggtgacactgttcttttgcctgaatatgggggaactgaggtgaagcttgataacaaagagtatgatagggagtgtcttgattttttatctgttaacttgccattctcaaaccctctcaaattgtgggatttgagtgtggcaaagttaacagacgaaatatcgacatcaaggtttaagggatgctag

SEQ ID NO: 11138 - DNA, 1383 bp, Glycine max
  Peptide Sequence Number=SeqID_127916
atgaccatgctacctcacccatttactatgattgcaacaataatcattgttcttgcacaaacacttgtgggggtgaattcacttcctgaagctgataaaataagcaatttgccggggcagccacatgtcaaatttcagcaatattctggttacttttccgtggataaccaaaatcagagagctttgttttattactttgttgaagctgaaaaacaccctacttccaagccagtagtcctatggttgaatggaggtcctggttgttcatctattggagttggagctttagttgagcatggccctttcaaaccagacagcaatgttcttgtgaaaaatcattttagttggaacaaagtggcaaatgtgctatacttggaatcaccggctggtgttggattttcctactctagcaatgcatctttctatacgttagtgacagatgaaattacagctagggataatcttgttttcctgcagcgctggttcactgaattccctgagtactcaaataacgacttcttcattacaggggagagttatgctggccactatgctccacaacttgcacaacttattgttcaaacaaagaccaactttaatcttaaggggatagcaatagggaatcctcttatggaatttgatactgatttgaactccaaagctgaattcctttggtcccatggactgatttcagattcaacttacgatctcttcaccagagtctgcaactattccactattaggagacaaacgatacatgggaatcttagtgacgtttgtgcaaaaataaatggactggtgtttactgaggttagcaactatatagaccaatatgatgtcactcttgatgtgtgtctgtcatcagcaaatcagcaggcttatgagctgaatcaaatgcaagagacacagaagatagatgtttgtgtggatgataaagcagtcacatacttaaacaggaaagatgtgcagaaggctctccatgctaagcttgttggagtctcaaaatggtcaacttgcagcagagttctccattatgaccgtcggaatctagagataccaaccatttctattctaggagcacttgttaattccaacatcagagttctggtatacagtggagatcaagattcagttatcccattactgggatcgagatctctggtgaatggattagccaaggaacttggactaaatacaacagttgcctatagagcctggtttgagggaaaacaggtggcaggatggacacaagtatatgggggcatgttatcatatgccaccataagaggagcatctcatgaagctccctttactcaaccacagagatcactcgtgctacttaaagcatttctagaaggaaagccattacctggtgttaaataa

SEQ ID NO: 11139 - DNA, 231 bp, Glycine max
  Peptide Sequence Number=SeqID_127917
atgaaagttgacactaactccaaacttcaggtgttggtacaatgggaaggtctattgccagaagaaacttcatggaaagattgggatcagctaaagtcagcttatcaccttgaggacaaggtgattttacaagtcacaatggatgttacgaagaaggagcaaaagggtggactaaaggaaaggcccaacagaaagagcaccaaacttgggtacctcaaggactacctctaa

SEQ ID NO: 11140 - DNA, 111 bp, Glycine max
  Peptide Sequence Number=SeqID_127918
atgaagatcaacaacgaaggtaatgtcctggacctatataggagtagctttgcagttggagctaaagttgagcatggccctttcaaaccggtgacaacaatgttcttgtga

SEQ ID NO: 11141 - DNA, 582 bp, Glycine max
  Peptide Sequence Number=SeqID_127919
atggtggtagtgaggacgcgcggcggagaggacggaggtcccacgtggatctggccggagtggggctgtgcgccgtggttctggtatttggtgagtggtggtggtgcgcgtcgtggaggagacggggttgtcggcggtgatgatggctgcgcgagttcagatcatgggttaggtgagaagaaggagacaaggttgttaggtcagctatcaaggccgttagaggtagtccttgaggtacccaagtttggtgataagctgactttagctgatcccaatctttccatgaagtttcttctggcaatagaccttcccattgtaccaacacctgaagtttggaggcacaatggagttcgtggtggaatgatgaaacgatttaagcaacgaatagtggaacacagggtggatatatgcaccctcaggggtatggtcttacattcactggttcagagtatgggaggaggtggatatggtgatttgtgggtcgcgatggaggtttgtcggggtaatgtggatgtggaaatacgaactgactccctctttgcgaaacaaccgacaaagttgtggtggggtgatgagatgtag

SEQ ID NO: 11142 - DNA, 222 bp, Glycine max
  Peptide Sequence Number=SeqID_127920
atggaagagttcaatgctaataatacttatgaggaaaaattaaagagacctaagaagcatctaaagataatcaacacataccagctcaagcccaaggtgggagaagaagatcctaagatgttaggtgcagatgcttctagtggaaaaaggtccaacttggagacttatggccttatggggcgccaacttatggcctctaaactgattttatatatgttttaa

SEQ ID NO: 11143 - DNA, 252 bp, Glycine max
  Peptide Sequence Number=SeqID_127921
atggatttacctccattaagccagagaactagaggtgactgttcaggcaaggatttcaccttatcagcttctggaaatgactcaaccagtgaggacatgaacactgaagttgcaaagattgtagctatcaagaaaatccatggctggggaaacatgctgagtagctttaacaggttcttgttaatcatgggtgtcctacataaaccgcacttcccgtttgctaatggtgtcggcattccacaaccatcgtaa

SEQ ID NO: 11144 - DNA, 855 bp, Glycine max
  Peptide Sequence Number=SeqID_127922
atggaggtcattatgtacctcaacttgcttaactcattatcaagaataggaaatcctcttctggatttcgacactgatatgaatgcagttgatgaatattactggtctcatggaattataactgattatgcatacaaaatcatgacctctctatgtaactcgtctagagtattaagagaatacttcagtggccaaatttccaaagattgtgtcttgttgcagctcaaaaagtctcagaagtgtattcttttacaactttcattgacccatagtatgttgttggggagaaattttaagaaatcccataatgtgcttcaaaccgaagaacctgaccagcaagttgatgagtgtaatttgaaatattcagagatgtacttgaacaggaaagatgtgcagaaggctctccatgcccggctggtcttcgagtcatcgtttacaggtgataatacatatagggaatacataaaggtgttggttgtgataataaatttgaatgaagtctatactggggatcaagactctgtgattccatgcatgggcacgagaagattggttgatagactagcaaagacactaggacttaaaacaaccgtgccttacagttcctggtttgtggacaagcaggttggaggatggacacaagtttatggcaatcacctctcgtatgccaccgtaagaggagcttcacatggcactccagttactcaaggacacatggccccttgcttgaaattggctcgtacctctgtgtccttgagttctaaggagacaggaacctacgtctggtggatgaatcaagaccaggatcgttctcagacagtctcacctgcctgggatggtcgcacggttgtctga

SEQ ID NO: 11145 - DNA, 207 bp, Glycine max
  Peptide Sequence Number=SeqID_127923
atggatcgccatcagtcaaatgttgaaagggcagatatggttgagcaaagaagcaattacagtatggaggaaatcgaggaagtgtatgataaggttgaggaggaacgccggaatattaatcacattttggagattaaggagctacttgtcaacaatgaaaatgagaggctcggttcgatttacataaaagtttggcttggcctatga

SEQ ID NO: 11146 - DNA, 1242 bp, Glycine max
  Peptide Sequence Number=SeqID_127924
atgatgagttatctcaagctctcaaatgtttatatatgtaggaaatttaagagaatcatagaggatcaagttgatgaaaatgctgacctttcttcagaaggcaacaatgacaaagttgcagtttatatagcaaggactaaaggccaaaaccctcccaccattttagatgaacatgtattgtgtaaccctccaatggatgaaggatttccccttggtaattacatacctgacctggactttacaacgttttttgaggatatagacgatgatggaaatcctataattcataaccatggaggtcaaaagttcgatgaaagccagataaatcctacaagagaagacaatgaagaacttgctagtgcagcatcaatcaccgccatcaaaagacaaaagcaaattctcattaacagagtagttattagtcccaaaaatcatacaactccgcacaagaaaaatgaaattaatgaaggccacggatatccttcaattaaagaaacaaaagtggagttgttgcttaaacaagacttacaacccccaacaaaaaagttacaaaatcatgtgaggggatggaaatgcaataaaatgagttacaatagaccctcagatactcagttttctttgcaaagatttgccaaacaaagacagcagaccgaatgtaacaatgataggaagattaagaaggatgagaacaaatttcatcagagatcaactgttggtcgtccaagactacattcacgagggacatcaaatgatgctgcaaaaaaggaaaagaaacatgaaaccttaaagagaaaagttcatgagggataccaagcacatgaaaggggtttgaaactcagagggacatcagatgatgctgcaaaaatggaagagaaacttgaaacctcaaagagaaaacttcatgagggataccaagcacataaaaggggtttgaaactcagacggacatcagatgatgctgcaaaaatggaagagaaaattgaaacctcaaagagaaaaccttatgagggaaaccaagaacatgaaaggggtttgaacctcagagggtcatcatatgatgcttcaaaaatggaagagaaacttgaaacctcaaagagaaaacttcatgagggataccaagcacatgaaagggagagaaggagcacaagatactttgagggatatgaatgtcatcttcctaaaggcaagcatagccgcagaagctcacgcccgaagttcagcaatcgaaggagatacaactga

SEQ ID NO: 11147 - DNA, 1122 bp, Glycine max
  Peptide Sequence Number=SeqID_127925
atgccaaagggaaaaaccactccatcagattctaatcaccctggtagagatagcctacaatggaatgatgaaatggatcaaatgttgttgaatgctttgggtgaagaggcaaataagggaaataggcacgatggtgcttggacaacacaagcatacaacaacatggtcgaagccttaagatctacaattggaccaaatatcacaaagaatcatataaagaatagaatgaagacactaaaaaatcattttgctgaagcttacgacttgttccatagcttaagtggattctcttggaattcaataactcgaaaatttgatgctgaggacgacgtctgggaagagctgattaaaggaaagccacatgctgcaagatggagaaaaatgcaaattaagcattatgacatcttgactgagttatttgcaactgatagggcaaaaggaaatgttgcgaaaacagctaaggaaaggaggaaacaatgggagaaggagaatattgacttgaataactattttgaagatacagaaatgtatgtgccaaatgttggtatgtttgatgaaaaccaattttcaccccccaactttgaggatgctagtccacaaaatggtcaaacaaatcctagtggcttaaatacttcaaggggtacaaaacggaagagaaatgtggttgagttagttgaagatcaatatgagcgaatgaatgaaagtatcatgacaattgctgaagctttgaaagagggaaattctgtttctaaggagctgcaccaagttgcagagcgtcaagttgaagttgctgaaagacaagttgcagtcattgaaaaacaagttgaaattgctgaaaaacaagttactgtgatacaacaaactcgtcctcgtcattattcagaatctgatgtatgggatcttttagaggaattaagagtcacagatccatttcgcatgaaggtttataaccatttatgtgataatgagcacaaaaaacgtaagctttttggcgtaccacctcatatgagaggagaagctctcattcaaatgatgactgatgcaggtgctttcacctctagtgcaatacaagtagaagtgcagcaagcaactggagctatagtgcaaagatgtgtatactaa

SEQ ID NO: 11148 - DNA, 105 bp, Glycine max
  Peptide Sequence Number=SeqID_127926
atggcaaagggaatgtcggtgaaaaggaaaatggttaaaggtacccttaccatcgcaaacaaaagaggagcaccatcaaacttaggttctcccatttcgatttag

SEQ ID NO: 11149 - DNA, 371 bp, Glycine max
  Peptide Sequence Number=SeqID_127927
ggtatatgaagacaatgatggtgtaatatttgaaggcagtaaaaaagcgattcagattaaacgtggaattagtttcaatgctttgaagaaaaaaattggagataaggatgtggctggtggttcaatgtttcattctgccaattcgcttacatcatgtggaaattacttatctaatgatgagacacaaccggcaacaaatatgagtaatttacatattgacgaagacgatgatgatgatgatgattatcttgtgtctaactcatacgttgaagagtctttagacgaagatgacagtgttgacggtatatctgacacagacgatgaagtcaccaacattcctcaaccagtaagaattgttcacccagcagaag

SEQ ID NO: 11150 - DNA, 213 bp, Glycine max
  Peptide Sequence Number=SeqID_127928
atggtaacctttgtgttatgtaccataatcaagaaaacaacaaagacatacgtgaggctcaagcttagtatattcatgaaggtggagaagaacaaaacaagcgcaaccaaatactttaagagaaacattaccaatggcaaaggaaggaagataattgatgagatggacaacggtaagggcaccttcaccccaagcacgcttaggacaagatga

SEQ ID NO: 11151 - DNA, 258 bp, Glycine max
  Peptide Sequence Number=SeqID_127929
atggggggtagtgattttgggggttcatttcagcaacccctgatggaccgaaaagtcatttccattggcgtttcctcctcagaggatacttgttgtggtgcctctgaaaatgaatccacttactcaaagaggttgaaggctttgcgctgtactggtggaggcacctctcacttccgtaggagggcacgaccttccgctacttccccaatcagggatcctgtctcagtcatggtgattcttcccctctttttcttctag

SEQ ID NO: 11152 - DNA, 1221 bp, Glycine max
  Peptide Sequence Number=SeqID_127930
atgaaggtgactggcaagattggttgggtctccttgaacaatgtgtccaagaagctttttgagtttgactcgaatgtttttcaccgcttcaaggaccatttcttgaaggtcatggctactgatgtcgtggctgatggaattatgggtgacttccctttaaggccactggtgaagcaggtctcccctagtgctctttcctctattttggcaaataggaaacaagatgatggtgttgggccatctggccgtaaaaagtcgagggcccctatgagcctttgcatcctaaggcaagttgtagggttgaagcccggtgcgggtcaccctttgagtttgcaagatgcacctacggctccaacagtcatcgagactcctgcttctgctactattgttgctactattcctgctcctttacctcctcctgccatagttgttcaggaggttactcctaccactagagttggtgtgccaactacttcggctagttctgttttggtgtcttcgtccaccgctgccacacccttactaagtgttggtgtagcaaccactagtgctcccataatgtcacctcctccttctttagctccccccgattcgaccttttgttgtgttggtggctgcgccgccttcctcgtcttctttcccgatgtctctttagaccacatgtacacttccagcaatgttaattcactgtggggtggtaattacaaaccagagcagaagacctcgactggcattgtgtcaacctttgataaaaacctcatctggtcagttggggtgcagaacgctacgaactttgccaaagtcttcctccaaagaagtttgacaattctagaggagaatgaacagcggcacagagaggctttgtgcaaggtgtcgtccttggagatagaggttgccaaatggagggctaatgctcacatggtttggagacaaaagcgccctaagttagctaacgccaccatcgccttcgctgaagttgaagagaaaaaggacttggctggcaaggtggaaggcattgcggcaaagacggacaagctttccaagatggttgctaatttagaggcttggctaaagaaatcggagtccagactggaggaggccgagctgcggatagctaaggagagggaggctagcaaggagcttgaagaggagctaataatgcacaagaaggaggttgtggagcagcagcatgagaaaggctttcaaaaggccataaggtag

SEQ ID NO: 11153 - DNA, 363 bp, Glycine max
  Peptide Sequence Number=SeqID_127931
atgcaccctccaacggttagaaaaggacaaagttgtcaaatctataggcttccctcacttgaaacgtcagacctcgcttgcaaaaccaaaagcatgtccacctcggacaacttgatagaagcagtctggacaacacttgtccaagctccacagacctacaactctcacacctatcgagattaccgctctcaacactggacaacacttatccatgctttagggctcgacaaactcatcacccttctacttgttgaggctactaccccggacatcagacaatcttcaatgctggacaacctttttcgcctgcaagccagctcagagcttggggggcttatgtactgtccaaggtccacaaaataa

SEQ ID NO: 11154 - DNA, 321 bp, Glycine max
  Peptide Sequence Number=SeqID_127932
atggggagtccacgtgcaccatcatcagcaaggaatgttgtcgggaatttaccttcctatccagctcgccaaatggaggcaagcagctatgcatttatgattttgatgaccctatcagctttctatgcagccgtgatatttgaagctgggtgtagaaactaccctgctccaatgcaagctgctgtagaaccaacagaggattcgatcactactctagtctctatgggctttgacaggaattctgccagacaagccctggtgcaggccagaaacgatgtcaatgtggccaccaacatcctactggaggcacagtctcactaa

SEQ ID NO: 11155 - DNA, 348 bp, Glycine max
  Peptide Sequence Number=SeqID_127933
atggtttatatagattggagtcagggaatattgctagaaagagagaactggaatgtccatcagccaaagcaagttccgactttcttaaaaccaacatttggaagcttcaaacaatattttgaagacaactcagagatcttggtgaagttggggaatatcactagaaagagagaggagaggaaatcgttgcagaaacgcacaagcagtgaagcacagcagaagtcaccgagaaacatgttggaaacggacagcaacaaaataggtgaccagaaagttcttcgctgtaaaatgagtggcaaactgaaagcggcagccagaaaacacgctgaagagacgaaaataggatag

SEQ ID NO: 11156 - DNA, 964 bp, Glycine max
  Peptide Sequence Number=SeqID_127934
agacttacactccaatttccaaaccgaatcgaatttgaatttcgatttgaatttgaatttcattttcaacttccctgtgatgccttacacggtccgcgagaacctttcgatcgggaacatcggcgacgcggcggagattctcgaaaacggcgccgtccagagcgtgacacacatcctctccgtcctcagctccgcctccatctccttcttctccgaatggaaaaccactctctccatccccgccaaggagatcaccaaagtccacgcggcggacgccgccgccaaatcggcgctcccgccggagaagctcctctactctctcgagtacgccggccgcgacctcaagctcgtgcgcatggccgtgcctctcagagacaccgagaaggaggacctgctcgattacttggaagcctgcatcgatttcattgatcgcggtcggaaggaaggttccgttctcgttcactgttttgccggagtttccagaagtgcggcggttattacggcgtatttgatgagaaccgaacgtctatctgtagaagatgagaatcatttctcagggttgaggatagacagttctaaacttggtgcagatcctggtatgcctgttgaagtttcttcagaggcagaagaaactactaaagtaggaaataatcgtaggcctacatatcgctgtaagaagtgtcgacgacttgttgcattgcaagaacatgtcatagaccatgttcctggtgagggtgagagagcctttgagttccacaaacggagaggtggcaaccctttcaacaaatctgatgaatttgagtgttcatccatatttattgagcctctacggaaggtgcaatggagggaaaactgtcctgtgcacattgtgatgcccgtttgggatacttcaattggtcaggcatacaatgcagctgtggaagctggatcactccagcttttcaactccacaaaggccggatag

SEQ ID NO: 11157 - DNA, 1296 bp, Glycine max
  Peptide Sequence Number=SeqID_127935
gacgaatcttcaatggatttgtttttcttccagtctaatgtcatgatgacaacagcaattgctatagaggatgtaaggagagaagtaaagatattgcaagctctgactgggcataagaatctggtgcaattctatgaagcctatgaagacaatgacaatgtttatatagttatggagttatgcaaaggaggtgaactgctagataagattctttccaggggtggaaagtactcagaagaagatgccagaattgttatgattcagatattaagtgtggtggctttctgtcatctgcagggtgttgttcatcgtgatctcaaaccagagaattttctctatatttctaaggatgaaaattccactctgaaggtcattgattttggactgtctgactatgtaaagccagatgaaaggttgaatgatattgttggaagtgcgtattatgtagctcctgaagttttgcatagatcttatgggacagaagccgatatgtggagcattggtgtaattgcttatattcttttatgtggaagccgacccttttgggccaggacagaatctggcatatttcgggctgtcctgaaggcagatccaagttttgaggaagctccttggccatcgttatcagctgacgcaaaagattttgtgaagagactgttgaataaggattatcgtaaaaggctaactgcagctcaggctctcagtcatccatggcttgtgaatcattgtgatgatgtgaagataccttttgatatgataatccacaagcttgttaaaacttatatatgttcatcttcattacgcaaatcagcattaggggctcttgcaaagacattaacactagtgcagctagcatatctgagagaacaattcaatatgttagggccaaacaaaagtgggttaatctctatgcagaacttcaagacggctattttaaggagtgccaccgatgcctcaaaggattcacgtgtcttagattatgtgaacatggttagttcaattcaatatcggaaattagattttgaggaattttgtgctgctgctataagtgtccatcaactagagggaatggagagctgggagcaacatgcaaggcgtgcgtacgagatgtttgaaaaggaaggaaatagaccaattatgattgaagagcttgcttcggaacttgggcttagcccttcagtgcctattcatgtggtactccaagattggataagacactcagatgggaagcttagcttcttggggtttgttaggcttctgcatggagtttcttctcgcacatttcagaaggcttga

SEQ ID NO: 11158 - DNA, 288 bp, Glycine max
  Peptide Sequence Number=SeqID_127936
atgtgcaagagagagcacaaatccatcaaagagtatgcccagagatggagggatttggcgacccaggtggtacctcccatgatggaaagggagatgatcaccatgatagtagacactttgccggtgttctactatgaaaagttggtaggctatatgccctccagcttcgcaaacctcgtcttcgcgagtgagaggatagaagtcgggttgaaaagagggaagttcgactatgctctcccatcggcaccagtgtccaaacccgacaagtgcaccggattgcgcaagtag

SEQ ID NO: 11159 - DNA, 294 bp, Glycine max
  Peptide Sequence Number=SeqID_127937
atgacaaattttgagagagatgataagggggctcattcaggtatcttgggagcatgtggcaattggtattttttttattgtttgcaccattgcccaaaacttgaagctacactggctaggcagatacaggcacaatttcaaacctctggcaagcaagctcttcagtacatccaattgggtttgagcttgtcaagccatcaaaaatggcaacaacaattcgaatggtgtcatccaagggtttgtgagcctcactctagtgctgcttgtcttaagctacattgctgctattgttag

SEQ ID NO: 11160 - DNA, 2061 bp, Glycine max
  Peptide Sequence Number=SeqID_127938
atggagaacaaaagagaagatgagattgaggacatgtcaatgtcacctccatctattggctccatgcagattgcagggagcaatggctttggtcacagcatggagttcatgtctcaggcataccttccaaatatgtacacagagattgacataaaagttgaggattcaggtttcgaccaagatccccccctccccatttatctcaagtttgaagatgtagagttcaaggtgagggatagccaagcggctcccaataaccctgtgaagacaatgatgtcaaaagtaggcacacaacaccacgtggaggaagatagatacaagaaaattttgaagagtatcacaggaagcattggccctggtgaaattcttgctttgatgggtccttctggtagtgggaaaacaaccttgttgagagttgtaggtggaagattaattgacaatgtgaaggggaagataacttataatgatgttcgatttaatccagctgtcaagaggaggattggatttgtgacacaagaggatgtgcttttcccacaacttacagtagaggaaacattaatcttctctgcattcttaagactgccaagcaatatgagcaagcaacaaaaatatgctagagtggagaacactgtcaaggatcttggccttgaaagatgccgccacacaaaaataggtggaggatatctgaaaggcatatctggaggagaaaggaagcgaaccaacataggctatgaaatccttgttgacccttcactgctgctacttgatgaaccaacttcaggccttgattccacctcagcaaacagactccttctaactcttcaggggcttgccaagggtggaaggaccataatcacaacaattcaccagccatccagcagaatctttcacatgtttgacaaacttcttcttatatcagaaggctgtcccatttactatgggaaggctaaggactcaatgcagtacttttcatccttgaggttcatcccggaaataccaatgaatcctgcagagttcttgcttgacttggcaactggacaagtgaataacataagcgttccacaatatattttgaaagatcaagaatctgttgactcttcaaaagctgttattaactatctacaactcaagtacaaagacacactggagccaaaagaaaaagaagagaatcatggagcagcaaacacaccagaacatcttcagctagccattcaggttaaaagggactggacagtgagttggtgcgaccaattcgttattctttataagagaacattcagagcaagaagcaaggactattttgataaattaagactagttcaagcacttggcattgcacttttgttggggttactttggtggaaatcttctaccaatacagaggctcaagttagagatcaggttggtttaatgttctatatatgtatattctggacatcttcatgtatttttggagcagtctatgtctttccatttgaaaaggtctacttggtgaaagaaagaaaagcagacatgtatagactgagtgtgtactatgcaagcagcactctgtgtgacatggtggcacatgttttctaccctacttttttcatgctaatcttgtacttcatggccggatttaagagcactgttgcttgcttcttcctgactttgttcgcggtgcttttaatagctataacaagtcaaggggcaggagaactatttggagctgcagttatgagcattcaaagagcagggatggttgcttctttgatactaatgttattccttctcacaggtggctactatgtccagcacgtaccgaagatgatgcattggttgaagtatttgtcgttcgtgtactatgggttcagacttcttctaaaagtgcagtattcaggagagcaaccatacgagtgtgaaagcgaaggagggtgcaggacactgcagagttcaccatcatttgacactgtaaacttggaaggaggcttaactgaagcatgggttctggtagccatggctctatgcttccgcgtgttagcttacttctgtctccgcagaagaattgacatttgcaattag

SEQ ID NO: 11161 - DNA, 2298 bp, Glycine max
  Peptide Sequence Number=SeqID_127939
atgtctttcatttctgattctaccatgggtatggacaaaagtgactctgggggttctattcagcaacccctagtggaacaagaggtcattccaatcggcggctcctcctcagaggggacatgccacgaaacttctaacaacgagtcatcttccttcgagaggagtctccttcccctttcagcttcgagggcaatgaaaatgattggtggtagggatgtcagggtttatcccagtaacaagcatagccacactattgggtcaccttcatcccctctcgttgttgttggctatgagtggttcaccaacctagaaggctcctacaagatgaatgtccaggcttgcgagagtgatgattttccctttatgagggcagcaccgggttgtccaccattcttcttcatgtatcgctatctttttgaagtcttgggtctaattctccctctgaactcctttcaatgtgctctgctggaacatttgaatgaagcccccctcaacttcatcccaatagttgggcaatggagagggctttcaaggttgggtgtccctcaacagtgtctaaaaagttgtttgaaggtgtttcatcgattcaacgaccactttttcaaggtcttggcgactgatgttgtggctaataggttgccactgatgtttaatcaggatagggaaactcgcttccctttctactggcagtcagaccctaccaggtttaagtcttttgatgaggatctgttgaccttggtggagagggttgacaaggccattttggaacaattgtcggcttcgttggatgcttgggccatcttgtcccttcctttggcggacgatcctctctgccttatatggcccttggtgaagcaggttggtcctactggtggggatgtgccaccttctgttgtcaaaccttccgtaagagaagggggtcaacctactgttagggtttaccctgatgatgaagttattgaggttactcccaatgttcctccctctttcttggccaagaggaagcatgatgacgatgctggggtgttgatgtctggtttgggtcacccctttcctgctagttctcatgatccaccttcggcctctttggctgctctggctatagttgttgctcctcctcctctggttcctccttatgtgccgactcaggaggtttctatctcccctcctactgtggctattacgttgatccctttggtcgctcctaccccagctttgccttccactattgttacatctttgctcaacactagtgtctaccagccttgtgtattctacatggctgctatggcaatcaaagaggtatccaaaggcggcactgagccacgcctgcgcatcttcgttttgctgcgtggtggcgacgacggtgtggttgcgggtgttagcggagtagtcgaggatgcacttcaccatggactacgcggaggtgaggttgtcggagaagagggtgatggcagattggaggagttggaaaagggttgggttgggaggaagctggttgtgggattgggagagagaggtttggcaatgctgagggaagagagtcacgttgggagagagagggtggaccttaagtttgtcgagcctttagagaagcgagactcaccaagggtggaccttgggtttgatgagcctttggagaaggctgaccttgggttcgacaagcctttggagaggcagactcaccaaggacggaccttaggtttgacaagccgttggagaagcgaccaggaatgcacccatcctgggttttggcgagactcaccaagggcagaccttagggatcttggcatccgtgttgaatgtgaagtgataaggagtttcattggtcattgtctgggggcctttggcaacagtcctaggatgtccattcctcgcatggcaaaaggccaatgggagcttaagctgtggaggttgtcgggagggacagatggccagtttgtggcgtatgatgttggggtggatgcccagcatgctagatggttaccatgcgaacaggtctctgctaagctgtctatattgcacatgtttgggtctgagctgcaacttgacaagttctttaataggctttgggcctttgtcaacaatgtcatcacgcggatccacatcggataccccatcatgatctcccagacatgcttcatagatgatcagggttcagattggggtcccttcatccactctcatgacttgattgttaccaccagcctacttctagtctaccttgacagttacgatctttctcatcaaggttgggaatttcatctgactgtgaagctccttaagagctggtcttga

SEQ ID NO: 11162 - DNA, 204 bp, Glycine max
  Peptide Sequence Number=SeqID_127940
atgaaggagcctcaaagttcagcaaatgctcgttccaagttgcgtgttgatcaaaaaatgaaggctgaatccaatgggtgggttgtgaaaagaaggcaacgtttacagttcactggctctggaagaaaagaaatcgggtcgcatctcagcactgtaattttgggcttaagatcaggtcaagtgtggcattgcgggttgccttag

SEQ ID NO: 11163 - DNA, 1546 bp, Glycine max
  Peptide Sequence Number=SeqID_127941
cctcgcccttcccctcacgtcttcacgctcttcatttacaacccttgttgagattcgtgaagcttctctcagaacccttctcaggaagccgaagcctgagaatgagaatgacaacacaaataagcgtagcggcttttccaccgtgcttcgtttgctcttgtcctttggggtgtttgttgctgcttatgagaggcttggtgctgttgggtctctgtcacttctaggattaggctttgttttcagttccaagaacatggatttcagtttctcacttttctttccctctggtgcgtttttcacaagaggggtattgaagaggttgaaaaccgttgtggctgttgggttgattgttggcatgattgttgggttcttgagtggggttatattcttctcttacaagattggcggcgaagggaaagaggcagtgatttcgctgaaggttcgagtggaagagaacaattacgctgagagaatcggtgtgaagaagtggatggaggagaatgatgttgctgggatggtggataagtacactagtcagttttatgagacggtttctgatcagattgatgggttggcaatgcagtacaatatgactgaatttgtgacggttattaagcagtttgtgataactgctcctgctagtgctagtgctaactcttcttcaacgaattcgttaatggtgccttcaccatacacagaaaagctcttgagtttgaagggtagggttaggaataaggagtggggcgagatttatgcagaacttgatacccttttccaagagcttataattactagggaggatttggttgagaaggcaaaagggtatgcggttaaagggatggatgttggtcagcgtgttttggctagtggtacaagtgtgcttggaagtggtgcaaagtttgtgatctccattttgaattccatagtctctggtgctgcggaggttttcaattttgtgtctcaggcaatggtgtttttctgggttttgtattatctcatcacatcagagtcaggtggggcaacagaacaagtgatgaacatggttccgatgtcaaactcggctagggtcaggtgtgttgaagtgttggataaggctatttcaggagtccttttggccactgctgagattgcattcttccaaggatgcctgacttggcttttgtttcggctatacaaaatacatttcttatatgtgtcaactgtcattgccttccttagccctttgctaccaatatttccatcttggcttgcaacaattccagcaacactacagctggtactagaaggcagatacatagtggccattttcttgtctgttgctcaccttttcctcatggattatggggcaactgagattctggaagatgtgcctggacacagtgcatatcttactggactgagcatcattgggggaatggctttgtttccatcagctctagagggagctattttggggccattgataactacagtcatgattgctctgaaggatttatatgctgaatttgttttgggcgaacctgatgacaaggtggttaatgggtga

SEQ ID NO: 11164 - DNA, 786 bp, Glycine max
  Peptide Sequence Number=SeqID_127942
atgccccctttgcatctgatctcaaaggccttggtgaacttgatattagctttaggctgggtaccccattcaaaccaattgataggggtctttcctgctgcaagctctcattcacttcctgagccgtataggagacttatgacagatccaaactcaccaatcattgatttttatctaattgactttgaagtggacatgaatagcaaacgctttgcttggcagagatggttgcatcatagctcaatagtgaacgggctgtggtcaaggaaaaaatcaaccctaaagaaaggagggattgagttactccttgctaaaattattcccttcaataattttgaattgaagcaagacttggaaatagccaaaagaacacatgaagaacatgtttcagagttagaattgcaagctactgaatctgaagctgaatatgaaaaaagaatagagggacttaagcttcatcttgtagatgcaagaatgcaagtgaaggaactagaggcattttccgaatccagatttttgaaatggaagaataaagaggatacctatcaaactattgaactgagagctgccatgaagtctgtcaaagatgatgtgataaaaacaaaaagaaactacttagaggaattcaagtactttggaatcaagttgaaaggtctagctaaggctgttgaaaattatcatgtagttatagctgaaaataggaaattgtataatgaagttcaagatttgaaagttcgtgatttactaccaaacaatggtcctcaaaagagatatccttttctttag

SEQ ID NO: 11165 - DNA, 570 bp, Glycine max
  Peptide Sequence Number=SeqID_127943
atgagaggtaaggggcttttattaggaggaaggagcatgcttgatggtgttgttgtggaaaacgagggggtggaggaggctaaaaggtggtggaggagatcaagaccccgccaccggtggagagctacacttaataggctaccaacgaagctgaatttgaagaaaagaagggtgttgctgaaaaatgatcttggattatgcttgttttgtggcaaagatgtggagtcagaggaacatttattgctaacttgctgtgtaacagagaggatctggaagcactggtgtagctgtattggttctcatgtggttatgcctaatgatctgagaacacactactggcagcacccctcgatggtgagagggaaattgggaggtatggcttggacgatggtatcgtttaccatcatctggatgaagtcttgggtatggctgtatcctaaagtggatgggtttaattacttgtttgctgaatgggtgatctcaccagttaattccttccaggcaagtgactttctccaagagaagcaaagggtttttcaagaaggctctggaattgtcagccctttgtga

SEQ ID NO: 11166 - DNA, 708 bp, Glycine max
  Peptide Sequence Number=SeqID_127944
atgagaatatctagagcaagatggtttacctttttgagaagagtttttcattaccaaaatggatcaaggtccaaccttggctccaaccctttcaattctagcacttggatgatgctggagtttattgccttgattctccaaataacaattacaacgttcactttggccatttccaagagggagagacctatttggccgatgaggatttggatttctggatatgatattggctgtgttcttaatctgcttctactttatggacgctaccgtcaaatttatctaactcaaggagattctctcagtctttctgatatggaacagcagagaaacaatgaagaaaccaggatgtcacacttgatgaataaatgccggacttcacttgagcttttcttcgccatatgcaccctcctcggctacaacatgaacatggcctcttccaataaaggagcttctgatgatcaaatttcacaacttccaagttggagacataaagaagccggtgtcaagttagagcttggcaatggctctgaaggcagtaaaaaattgatcaatgaagacccagaatgctgtatctgcttagccaagtacaaagacaaagaggaagttagacaattgccctgttcccatatgttccacctaaaatgtgtggatcaatggctaaaaattacatcatgttgccctctttgcaaacaaggattagagaggtag

SEQ ID NO: 11167 - DNA, 798 bp, Glycine max
  Peptide Sequence Number=SeqID_127945
atgaacttcataatcatcaaaaagaagaaagacgtgatctttggagaaagtgtgcacaaacacaaagattatgaagacctcaaaatgagtaaacataatctttgggtggaatgtgaagaacacaagaaatatgtgagtttcttgaataatgagctgctgaattatcaagaacttaagggtcaacctcaagatgttttcaaacgtcatgaggaaataagaaccttaaagtctacattatccaaatttggcaatagaatagacaatcttaacaaactgttaggatactatagaagttcttcagataaatttggaaatggatatgatgggaagcaaacttggccatacaagttggaggttaaactccaaactgccgaaaaacaaccttgtaagaggtctaccaaaattgcttccaccggtggtaagaggaatggacttgtcgtagtggatgactactttagatggacatgggttatgttcttaaaccacaaggatgagtcttttgatatcatctttaaattttgtaaatgtgttcaagacgaaaaaagagtatgcattacttcaatcaggagtaatcatgagggaaaatttgaaaatgacaagttccaactgttctgtgaagaaaatggaattattcataatttttcaacaccaaaaaatcctcaacaaaatggaatagtggaaagtaaaaatagatctctccaagaaatggatagaaccatgctaaatgataattcaacccctaagcacttctgggctgaagcaatgaatgttgcatgttaccttcaaaacagaatttag

SEQ ID NO: 11168 - DNA, 660 bp, Glycine max
  Peptide Sequence Number=SeqID_127946
atgactcacgaggatcttagtggcgagggaatgggaggggccacggtgggagagggaattgagagggacttcagcggcggagtgttcggcctgacggagagtggagcagtagtgaggggtctcgaagatctcgccgttaaatttgatggtggccttgaaccttggcgcgtgattgggaccttcccgaatagacatgtaggaaggcagattaaagcagctccgttgggccagctcttgaagctgggtgtcacatctctaaactatgaatctccatcactcactgaagaagaagaagaagaaaaagaagaagaagaagaagaagaagaagaagaagaagaagaagaagaagaagttgtgtggtgtgtttgcgtttcgttcttccaaatggcgatttccatcagtcccagcggtggctctatgccacctcaacaggaacaacaacccaacaagtattctttcaccaagcccgtctctctcgtgggtcctaccgatgctgatctccaacggctctacaagagcaatgaagaatccgtggagaggaaagaggttaccgccttgatcaggtcttctacttcttcgatcttgcttttcttcatactattcaagatcgagaaaaattgggtgaagcagttgatgcgccaacgtggctacacagattag

SEQ ID NO: 11169 - DNA, 506 bp, Glycine max
  Peptide Sequence Number=SeqID_127947
atgcattttcttgctttttatattcaaacattcatagagatacccccattttaccatgaacaatgggcacccaattacccacacgaagttcggttcaaatacaatggagcaacctacccaatacgggtccaacaacaccgaggtagatatttttttgcagatggactctcagaggtcagggcagatttaaaaatctacgagtctattatcatcaacttctttgcctgcgatgataataccgtctttgatctacattttacgcctcccctcaatcaacagacatgcggtagaccaatacttcattcccgtgtacatgcctggagaactgaaattacccaatgtatactgggtgctccccaaccactggaaatcccatcacatgcaaggaaatatctgaaacaatgtgagaatcacttgacaattttaaggaagactgcacctcctctgcaatgggacgtcgttacacttgaccgcgacattaaagataaaagtatcgttcggccatg

SEQ ID NO: 11170 - DNA, 633 bp, Glycine max
  Peptide Sequence Number=SeqID_127948
atggaagaaggattcactaccaacaaagcacttctatttagagggataaagtatgactactggaagaagcttgtgatagcccattttgaatcgattcatatatatctatgggacatggtggaaaacagagattatattccatatgatgaccgactgaatgagattcctagaagtcattggacagagcaacaaaagctcggatttttgctaaactccaaggcttggaatgtgatgttgtgcactttttcagaagaagagtacaccaaggtaaagaggaacaaactcagtctcctcacccataagtatgaactcttctccatggaagaaaatgaagacatacaatgtatgttcagatgttgtcaagccattcttagtgaactaagatccttagatagagctcatgataattatgaccacgttgaaaaaaatttgggaagtctacctaggaagtggagaccaaagatagcagcactaaaagccttaaagaatctagattctatgtctcttgaggaaattgttggtaccctcaaggttcatgaacaagagctccaagaagacgaaggtctcagaagagaaaagtctctagctctcaatagtcagaagaacaagaaagaatcatcatccagagaaaaa

SEQ ID NO: 11171 - DNA, 138 bp, Glycine max
  Peptide Sequence Number=SeqID_127949
atgtggggaactgaaaagcatgcaaatgcaatggaagcatgcaagtcagtagaaataggcaaaaagagaacaggcagtggtgatatgaagagcctcaacgtgaatagttgtggaagtaaccgaagggtttttttctga

SEQ ID NO: 11172 - DNA, 489 bp, Glycine max
  Peptide Sequence Number=SeqID_127950
atgacacatggaatgggtcgggtgatcgaaaaccctaaagtctcatgtaggatccgaattttgaaccctaagggaggctcttgggaatttcaaaccctcaaggtgttttggttgatgggagaaaggatgaatggaaaagatgggtcttcattgtcatcctcatctcctactttggtgaagtgcaaatgtgagtgtgaaccatccggggagaaggttttggagatgcttacacaagaacaaacaagttcttgcagattttttcaatggattggtgatactggggctggcaataacgtgtttgcggaagggagtgagtttgtctggtatgttcgggaaaatgaagagctaaagctgaaagttgcttcattaatggaggaacctaaagcaaatgcagaagaaataaaaaatttgaggaaaaaagttgttgcacaagaggaagaatgtcgtgcatcctctattcaagttgtgcagttgaagagtaaaatttga

SEQ ID NO: 11173 - DNA, 280 bp, Glycine max
  Peptide Sequence Number=SeqID_127951
tggaaatcagggtgcacctactggagttcaaatagggcaagtcaatgttgttgagggtggcactgagggagcggctgaaggtggaattgagggtaggggtggtggcattgagggaaaatatgtgcagcagtctgtaagaaaagctcttggtgctcaacagcatcagcagaccaaacctacaaataagcacacaacgaagaaggttgagccaggaattggtcttgctgctactcaagccaaggcaagcacatcaattgaagatgcaaatggacaaaaatag

SEQ ID NO: 11174 - DNA, 144 bp, Glycine max
  Peptide Sequence Number=SeqID_127952
atggaggcaacaaagctcgtcgtcgttgacaatggaggcaaagtgattttggcaccatttgaattttgtccaaaacgcagaataaggcttggaagagaagttgaagatctagtgactctcgctcaacgtgccatacgcgcttag

SEQ ID NO: 11175 - DNA, 141 bp, Glycine max
  Peptide Sequence Number=SeqID_127953
atggctaacggagaacgtttgagcgactacatcgaggagttggacctgaatgaggaaggtggggctctaatggattcttcggagtctataggcattggaaaatgttcatctcttaagaactgcaaaagaacatctaaataa

SEQ ID NO: 11176 - DNA, 258 bp, Glycine max
  Peptide Sequence Number=SeqID_127954
atgcccattccgaaatggggcttttctaatcgaagagaggtgttagggttcaggaaattggggaagggagtgatgagggtagtgatgaggggagagctgagatcaattatcatggataattttgtccactcacataaaacgataagggcaggaagcaagtatgggtgtgcaggaagcaaaggcctggactttgttgcgactttgagtctaaactcaagtgtggttaactttaatcaatcgcttaaaattgggctatag

SEQ ID NO: 11177 - DNA, 288 bp, Glycine max
  Peptide Sequence Number=SeqID_127955
atgaaaaggaaggagagaaagagaaagagaaagagaaagagggagaaagggatgtgtgaggaaattaacggagaagttgccttgtataatcctaaaaggtggcaaaggtggccaagtagatgttatgatgcccagtctcatcttggggttttgggaggggcattgacgccaacaagtggcgtctgggtctactaccgcggtaccaccattcacaattgtgatttgtgtggatttctggggccagaccccaaaagtacaacaccctgtgaaaacagtcaattactctag

SEQ ID NO: 11178 - DNA, 183 bp, Glycine max
  Peptide Sequence Number=SeqID_127956
atggtcaccaaggaacaacaaactcactttccatgtgcagtttctcctgaaagcatgatagtgtcaacaccttgtcttactgcaattgcgatgtctgagacttttgcccttgttgggcattggatagaagactccaagaagattgggttagagatacaagagaatgccctagggatctcatga

SEQ ID NO: 11179 - DNA, 240 bp, Glycine max
  Peptide Sequence Number=SeqID_127957
atgacggcttacgacgatcactggtggtcttgggtggtggaaaacgaggttttagggtttgggaggcattttggagaagaggagagtgaaaaatcatcgcacctcggggcgctcagcgcaattccttctttggttggaattgcacttagcgcgccattctcgcctagcaagagatcaaaagttgttattttcaaaatcccaacggtcagatgttggaaaaatgtcttagaaagctcctga

SEQ ID NO: 11180 - DNA, 453 bp, Glycine max
  Peptide Sequence Number=SeqID_127958
atgacactgcagaaattaaaaaatgtaactgctatttgtaaccgaaaatatcataagggtattttcgctaattggaaagttgctgggtgccccggcaaaaatgctgggtgccccaatcgagatgctcgtggtggtttgttcgtagttcgtggtgggtgttgcggcaaaatggtggaggagattaacaatatgtatgattcatatgaattaacaatccagaacaagactcgtggaggaggagaacaaactcgctggaggagaagagacacgaggaggaagcatggaggaggaggagaggcacaacggcaagaggcaaaaatgttgggtgggtgcacggtagctggtgtatatcagcttttaagtgaaggacgaaaatggaattgcacaattaatgctgggtgtagaagaaaagttaaaggtgcaggaagaatatcccttcccctttcactttga

SEQ ID NO: 11181 - DNA, 3282 bp, Glycine max
  Peptide Sequence Number=SeqID_127959
atgtctgtcatcttaagaaatctgtcacttcctcccaaaatcttctccctcaccttgcttctcttattaaactctcttttgtttccatgctgttactcccttaatgagcaaggccaagctctattagcatggaagaacagtttaaacagtacttcagatgcactagcatcttggaatccttccaacccaagcccatgcaattggtttggggtgcaatgcaacttacaaggagaggtggttgaggtaaacctgaagtcagtgaacttgcaaggttcactacctttaaattttcaacccctcaggtccttgaagactcttgtcctctcaacaaccaacatcacaggcatgattccaaaggaaattggagactataaggagctcattgtcattgatctcagtggcaattctctctttggtgaaatcccagaggaaatttgcagactgagcaaactgcagactttagctctgcatgccaactttcttgaaggcaacatcccatccaacataggaaatttatcaagtcttgtgaatttaacactctatgacaacaaagtaagtggtgaaattccaaagagtattggctccttaactgagctccaagtgttgagagtaggagggaacacaaaccttaagggtgaggtgccatgggacattggaaactgcaccaacttgttggtgttaggccttgcagaaaccagcatttctgggagtcttccttcttcaatagggatgctgaaaaaaattcagaccatagccatttacacaactcagctgtcaggccctatcccagaagagatagggaagtgcagtgagttgcagaacctgtacttgtatcagaactccatatctggttcaatcccaattcaaattggagagctcagcaagcttcagaatcttctcttgtggcaaaacaatatagtaggtataatcccagaagagcttggaagctgcacacagcttgaagtcatagatttgtcagaaaatcttctcacaggtagcataccaaccagttttggtaagctatcaaatctgcaagggcttcaactaagtgttaataagctttcaggcattatacctcctgaaatcacaaattgcacttccctgactcaactggaagttgacaacaatgctatttttggggaggttcctcctcttattggcaacttgagaagcttgactctcttctttgcatggcagaacaagctcacaggaaaaatcccagatagtctttcacagtgccaagatcttcaggcacttgatctctcttacaacaatttaaatggtccaatacccaaacaactttttgggctgagaaacctcactaaactgctgcttctttccaatgatttgtcaggctttataccacctgagataggtaactgcacaagcctctacaggttgaggctaaatcacaatagattggcaggtaccattccatctgagatcaccaacttgaagaatttgaactttttggatgtgagcagcaatcatcttataggggagattccttcaacactatccagatgtcaaaatcttgagtttctggacctccattcaaatagtctcattggctcaattccagagaatctgcccaaaaacctgcagttaactgacctctcagacaacaggctaacaggtgaactgagtcattccattggttcattaactgaattaaccaaactcaacttgggaaagaatcaactcagtggaagcatcccagcagagatcctatcttgctccaagttacaacttctggacttgggaagcaatagtttctctggagaaattcccaaggaagttgctcaaattccttcactagaaatctttctcaaccttagttgtaaccagttttctggagaaatcccaactcagttctccagtcttagaaaacttggagtgcttgacctctcccacaacaagctctcagggaacttggatgctctctttgaccttcagaaccttgtttcactgaatgtttccttcaatgacttctctggagaattgcctaacacaccattcttccggaaactccctctcaacgatctcacaggaaatgatggtctctacattgttggtggtgttgcaactccagctgacagaaaggaagccaagggtcatgccagattggttatgaagattataatatccactctcttatgcaccagtgcaatactagtacttctcacgatccatgtcttgatccgtgctcatgttgctaacaaagcactcaatggaaacaacaattggttgataactttgtatcaaaagtttgagttctctgttgatgacattgtccggaacttgacatcatccaatgtgattggcaccggaagctctggagttgtctacaaggtcacagttccaaatggccaaatactagcagttaaaaagatgtggtcatcagcagagtcaggagcatttacttctgaaattcaagcactaggttcaattaggcacaagaacatcatcaagcttctgggttggggatccagcaagaacatgaagcttctgttttatgagtacctccctaatggaagcctgagctcattaattcatggttcaggaaagggaaaaccagaatgggagaccagatatgatgttatgttgggagtggctcatgcacttgcatatttgcaccatgattgtgtgccttccatattgcatggagatgtcaaagccatgaatgttttgttaggtcctagctatcagccttaccttgctgactttggcctagcaagaattgcaagtgaaaatggtgattatactaattccgagccagttcaaagaccctaccttgctggctcctatggatacatggctccagaacatgcatctatgcaacggatcactgagaagagtgatgtgtacagttttggtgtggtcctacttgaggtcctgacaggaagacaccccctagacccaacacttcctgggggtgcacacttggttccgtggattaggaaccacttagctagcaaaggagacccttatgaccttcttgacccaaagctgagagggagaactgattctagtgtgcatgaaatgctacaaactctagccgtgtcatttctatgtgtcagcaaccgagccgaggaccgtccatcaatgaaggacactgttgcaatgctcaaggaaattcgacctgttgaggcctcaaccacaggtcctgatgtgttaaagggagttttatcagtgcatacttctccagcacctcctatgaaaggtgtttcacatggaacttctaattgttcctttcatttctcagaggactcaatctgttga

SEQ ID NO: 11182 - DNA, 630 bp, Glycine max
  Peptide Sequence Number=SeqID_127960
atggaagaggttggagagttgacaatccatgagggaggagactcttgtgaccaggaattgatacaaattgacaaatttaccagtgatgtcgaggaagctgctattaaattacttgcatctagggcactcacagcacttgagttgagaaagaaattgcttggaaagagattctctcctgattcagtggaggcagtgataaacaagttccagagaagagggttcatcaatgataggttgtacgctgaaacattttctcaatctagatggacttcatcaagttgggggccaaggcggatcaaacaaattgaattgagtctaatcccttcccctcctccagaaaaggcactgttcaagaagggagttagtcaagctgatgctgagaaggcagttgaagtggtctttaaggacaatgattgtgccgaagatcacaagtcagttattggcttgtcaaaacattccatggatcatctttatactcaggcctcaaagcagtggttcagaagtcagaatgtactcaaggagacaaggaaatcacgaattgttcggtggcttcagtaccgtggctttgactggcatgtcattaacatcatactaaagaaattagacaggcaggaccagaattctccatag

SEQ ID NO: 11183 - DNA, 898 bp, Glycine max
  Peptide Sequence Number=SeqID_127961
atgactaattttcttgtagaatctgtgatgttagccattccagaaccacattccaggaagaaaacaacatgcaaggataataaagccatgaaaatagatgcccctcagagttttgtcacctttgtttatcaaaccaaagtagtagaattgttacgaagcataacagtttcatggtgcaaggaccccatagatcatttcctttccatgagcgtcgacaacactttggaagagaacaagtacacctgcaagattgatttgggatccggacagtcttggggtaaaaagggtcttagatcatttgaaatagcaggtgcaagagtagacattttttgggattttcggcgtgcagaattctccgctacaagtccacagccttgttcaggttattacgttgccttggtttacaagaaagaggtgcttttgttgttgggagatttggagaaggatgcttttgaaagaaccaaatcaaaaccatccctagatgaggctaccttgttgtgcaagagagacaatgtgtatgggaagaaaatgttttgtaccagagccattctagaagatggtaagatagaacatgacgttgtgattgagacctccctttctgggcctgatgatccagaaatgtggattaacatagatggaatgttggccagtagaataatgaacttgcattggagattcagagggaatgaaatagtgatggtgaataattttcctgtgcaaatcttttgggatgttcatgattggcttttcaccaatgaccttggtttaggccctgctttctttgttttcaagccaatctttttggaaactactagcgattttaatagcatagaatgcccagaaagaggtgggggtagcagcaaacatgaattactagaggataattcatccacccaag

SEQ ID NO: 11184 - DNA, 117 bp, Glycine max
  Peptide Sequence Number=SeqID_127962
atggggaaccccttggtttggtttccgcggcaaacatcggcttcaacatctcgtcccactttccctgtcgcgttttttcaattcaccgaaaagcttgattcttgtgagagtaaatga

SEQ ID NO: 11185 - DNA, 294 bp, Glycine max
  Peptide Sequence Number=SeqID_127963
atgatgcctcctaaagggtctttgcctatgggtactaaatcagctgttgacttaatggagtctttatccgaggttcatttttctggatttcacatggatggcttagagcaaagaaaggctggcacagagcaaccaaccacttcagcaactgacatgtataaacaaccttttgtgataggtgttgctggtggagcagcatccggtaagacatcagtttgtgatatgattgttcagcagcttcatgaccaacgagttgtacttgttaatcagattgaaacggtaggaatagattag

SEQ ID NO: 11186 - DNA, 1535 bp, Glycine max
  Peptide Sequence Number=SeqID_127964
atggaaaatgctttacgagcatgctgcaaaggtatcaagattgggaaaattcttattcatagagaaggtgacaatggtcaacagcagctaatatatgagaagttgcctaatgacatctcagataggcatgtattactgctggatcccatcttaggcacagctgttcaagcaatttctttgcttttaaagaagggtgtaccagagtccaacattatatttctcaatctcgtatcagcacctcaaggtgttcatgtggtctgtaaaagatttccaagaataaaaatcctgacatctgagattgagattggtttgaatgaagatttccgtgtcatacctggcatgggtgagtttggggaccggtactttggaacagataatgatgaccagcaggatgaggtgccacttgggcaagggaaggatcactcgttgctttatccaagagtgataaccttcgttaggctaatcactggacacgtggttcctttgcatgggttggatgagcttatcaagaatgccaagtacatagccacacctgggaagggcatcttggcagcagatgagagcactggcaccattgggaagcgcctatcgagcattaacgttgagaacattgaggccaaccgccaagctcttcgcgagcttctcttcaccgctccagatgccctccaatacctctctggtgtcatcctctttgaggaaactctttaccagaaaacctccgatgggaagccttttgttgaggtccttcaagagaacaatgtcatcccaggcatcaaagtggacaagggtgttgttgagttggctggcacaaatggtgaaaccaccactcagggattcgactctctcggagctcggtgccaacagtactacaaggctggtgcacgcttcgccaagtggcgtgcagtcctcaaaattggcccaactgagccctctgagctttccatccagcaaaatgcacagggcttggcacgctatgccatcatttgccaggagaatggccttgtgcccattgttgagcctgagattttgactgatggggctcatgacatcgccaaatgtgctgctgttactgaaactgtgcttgcagctgtttacaaggcactcaatgagcagcatgtccttcttgaaggaactcttctcaagcccaacatggttactcccggctctgatagcccaaaggtaccaccagaggtgattgctgagtacacagttcaagcactccgcaggactgtcccagctgcggtgccaggggttgtgtttctgtctggtgggcaaagtgaagaagaagctaccctcaacctgaatgcaatgaacaagttggaggtgttgaagccatggactctctcattctcattcgggcgagcactgcaacaaagcacactcaagacatggggtggaaagaaggagaatgtcgccaaagctcaagaggcatttctggcaagatgcaaggccaattctgatgctactctgggaaagtatgttggtggaagcggaagtggcttgacttctgagagtttgtatgtcaagaactacaa

SEQ ID NO: 11187 - DNA, 696 bp, Glycine max
  Peptide Sequence Number=SeqID_127965
atgctagcctctgtcgaagaagaacttggcacaccaaaacaaccaaggaatcaacattctcagcaatcagaagcaccaaattcccttgccaacactagagcaattttcgggcaacctcgacttcaaaggacaaaaccaattatatggtgtgctgcaatactgtgcttcatattcagcctagtgcttatcttctttggaattgcaacactgattctctacctttccatgaaaccacgaaaccccacgtttgacattcccaatgcaagcctcaatgtggtgtactttgactcaccacagtacctcaatggtgaattcactctccttgcaaatttttccaatcctaacaggagaattgggctgaggtttgagtccttgaacattgagcttttctactcagacagactcgtgtcttcacaaacaatcaagcctttcactcaaaggccaagggaaaccaggctgcaatcagtgaacttgatatcaagcttggtgtttttaccgcaagatgttggtgtaaaacttcaaaggcaagtggagaataacagggtcaattacaatgcaaggggaacatttaaggtgaggttcaatattggccttgtccatttatcttactctctgtatagcacatgccagatagagatgactagtcctccagctggagatatagctaatggtaaataccagtgtgcaaaacagtga

SEQ ID NO: 11188 - DNA, 294 bp, Glycine max
  Peptide Sequence Number=SeqID_127966
atgtgttgtggggggagaatttgcatgctttgcacgtgtctggttctggtggtgatcgccatcgggttggtattcgggttcggagtgttcaagcatggattccacaagatcaaagacactgttagtttctgcgattcttgcggcggcggaggaaggcctttcatcggttatgcaccgccgccattgttctattttggtcgtaagaaaacaaggggccacaaaggcccagagaaaaaggaaggaaaggataaggcaacccaacccaagagttatataatcagttacaatccttaa

SEQ ID NO: 11189 - DNA, 204 bp, Glycine max
  Peptide Sequence Number=SeqID_127967
atgttgcgtttgttgttggttgaatttagctttgttttgtgcagtgcgatgagagttgagagaggtttttatatagcggtcaaagatggagaatggcacaagatagagagaagggtgctttgcgttcatatattgcgcctgcaaattatatggcagcccttatgcctttttcatgctatcaccaagaatgtaccgataaaatag

SEQ ID NO: 11190 - DNA, 555 bp, Glycine max
  Peptide Sequence Number=SeqID_127968
atggcgggaaccctaaatctcacgcctctcaccggtgccggcaggactctccggcctccgttcaggatctcaattcgggcattcacggcgacggcgatcgattcccggcgagcggcgagcctctatgaggtgctccggatcaagcagaacgcttcggcggtggagataaagtcggcataccggaaccttgcgaaggtgtatcaccctgattcggcgctccgtcggtcggaatcggacgaacgggacttcatcgagatccacgacgcttacgagacgctgtcggatccgtcggcgagagcactgtatgatctgtcgttgatggcggcgcgcgatgataatcgctcgttctcgtctttggttgctgctccgaatggctcttccggattctactatcagacccaagtagaagtagaagcaccctttcttggctcaaacgagagaaaaacaataaaatcacaagagcttaaactgttaatattgaatattatcaggcttgaatttttttatttcggtgttggacaactcagtgggtcatgtttttgggtcaaagagtaa

SEQ ID NO: 11191 - DNA, 354 bp, Glycine max
  Peptide Sequence Number=SeqID_127969
atggcgaaaaagggaaagttggatcatataaaggaaatgctcaaggacattgaaggaggcagagattatgcttttgctaacttggcagagttgtacctagtgtctgacatggtcattcctccgaagtacaaggtgtcggacttcgataggtacaaggagactagttgccctaagaatcacctgaagatgtactgcaggaaaatgggaggatatgtgagagatgaaaagttattgatgcatttcttccaagaaagtcttactggagtagccgtcacctgcttaagtagtgccctcaatgacagagaaggagatgataacaatgatagtagacacgttaccagtgttttactatga

SEQ ID NO: 11192 - DNA, 387 bp, Glycine max
  Peptide Sequence Number=SeqID_127970
atggccacaatgatggaggctatgatgagcatgaagaagataatggaggtcaatgcagttgtagctgccgctactagtgttattgctgaggtggacctgactctcccatctggcctcaaccaaataaatcatccaaccttagatatggtaggtcaagggagcaaagaattaggaagtaccggcgccccccattttgtgcaagttcagaacaagcatgccttcccgccatatggcttgcctcccaactacacaccacccaatgtggcacgcactctcgatgagaataactccactcccatactcattgagagccaacaacctcaatctgatcatgcacatatctctcgacccatggggagacacatgaagtaccccagcacaatctag

SEQ ID NO: 11193 - DNA, 1353 bp, Glycine max
  Peptide Sequence Number=SeqID_127971
atgtttggtaggggaatggtgtggtcagtgtggaagcgcggcaaagaagcatgcaaaattcacaagctatgcctaagaggaacgcctttctcttcttcttcaacacaaccaccacctttcaagttcttaacccctcccgtcgccacccattacattcatgctttccgatcccaactattccccaagggtcatcatgttcatgtgccacaaatgaggaacttttctaagatggtgtctgctgaacagaaagagggattgaagctgctagtgaatgggggttctcgtgctcagaaattggttggaatatggctctttgggtcagcggcatgggtgttcagcatggtggtgcttgggggtttaaccagactcactcgatctggtctttcaatgactgattggaaattcaccggcacgctccctcctttctcagatgacgaatggttgcaagagtttgacaaatataagcagtcacctgagtacaagcgtgttaacagaggcatgaagattgaagaattcaaattcatctattggatggaatatgcacatcggatgtggggaagggcgctaggagttatgtttgctttgccatattcatattttcttcataagcggtatattacgttgagattaggactgagactctctgctctgtttgctctgggtgccggacagggtcttattggttggtggatggagccaccatctgaatattctcagccaagggtaagctcttatcgtcttgcagctcatcttacatcagctttcgctatttactgtggcctcttttggactgcactttctgttgttatgcctgaaccaccagctgaatcgctaacatgggttcgtggggcagctaaagtgaggagacttgcattgcctatcagcgtacttgttggtcttactgctgtctctggtgcatttgttgctggaaatgatgctgggcatgcttttaatactttcccaaagatgggtgatacatggataccggaagacatttttgaaatgaagcctttgattcggaatttctttgagaatacatcaactgtacagcttgatcaccgtatacttgcaactgcaactctgatttctgtgggcattttatggtggtcaacaagaaagctggagatacatcctgcagtacgatctgtgattggaggtgctgttggcatggcagctcttcaggtcaccttaggaatttcaacgcttctttcatatgtacctgtttcactgggcactgcacatcaggctggagccttgacacttctgacatttatgttacttcttaatcacacggttcgaagaccgtctttgtcccttctcaaatctctgcctcaagttgtcaaagcacactaa

SEQ ID NO: 11194 - DNA, 1248 bp, Glycine max
  Peptide Sequence Number=SeqID_127972
atggctgttcaaaactctctccaaataactagaagtggtagtggtggttatgacgatgacgggcgtgctaaaaggactggaactttatggagtgctgtggctcatatcatcacagccattatcggtgctggtgttctgtctttagcttggagtacttcccaattgggatggattgcaggaccagtttgcttgcttttttgtgcaattgtcacctatgtttcttcattcctcctttccgattgttacagaactctggatcctgtaactgtgaaaagaaactactcttacatggatgctgttagagtctatcttggcaataagaggacatggttggctggttcccttcaatatttgagcttgtatggggtcataatgtcattcataccagatctccacaacatggcatgggtttcaattgttgcggccataatgtcctttacatactcatctattggacttggacttggaatcacaacagtcatagaaaatggaagaattatgggtagtttaacaggagtaccggcttcaaatattgctgacaagttatggttagtcttccaagcaattggtgatattgcctttgcctatccatacacagtcatcctccttgagatacaggacactctagagtctcctccaccagaaaacaagaccatgaaaaaggcctccatgattgctatcctcattacaacattcttctacctctgttgcggatgctttggatatgcagcttttggaaatcaaacaccagggaacctcttgacagggtttggattttacgagccttactggctcattgactttgcgaatgcttgcattgttcttcacttggtaggaggatatcagatttacagtcagccgatctatggagctgttgacagatggtgttcaaaaagataccccaacagtggatttgtgaataatttctaccaattgaaactgcctcggttgccagcttttcagctaaacatgttcaggatatgttttagaacaacctatgtggtttccacgactggactcgctatcctatttccttacttcaatcaagttataggagtgttaggagccttaggcttttggccattggctatatatttccctgtagagatgtactttgtgcagaggaaaattgaagcttggtctagaaaatggattgtccttaggaccttcagctttatttgctttctggtgtcattagtggccctcattggatcacttgaaggaatcataagtgagaaactaagctaa

SEQ ID NO: 11195 - DNA, 1449 bp, Glycine max
  Peptide Sequence Number=SeqID_127973
atggcgcataggttgctcagagatcacgaagccgacggttgggaacgctccgacttccccatcatctgcgaatcctgcctcggcgacagcccctatgttcgaatgacaagagctgagtatgacaaggagtgcaagatttgtacacggccattcactgtttttagatggagacctggtcgagatgcaagatataagaaaactgagatctgtcagacatgtagtaaattgaaaaatgtctgtcaagtgtgccttctggatcttgagtatggactaccagttcaagtccgggacacagctctcaatattgattcccatgatgccattccaaaaagtgatgttaatcgggagtattttgctgaagagcacgaccgtagggctagagctggtatagattatgaatcctcttatggtaaagtacgcccaaatgatactatcctgaagcttcaaagaacaacaccatactacaaaagaaaccgggcacatatttgcagtttctacattaggggtgagtgtaccagaggagctgagtgcccttatagacatgagatgccagaaactggggaattgtctcaacaaaatattaaagatcgttattatggggtgaatgatccagtggccttgaagctacttggcaaggcaggggagatgaacactctggaggctcctgaagatgagagcattaaaactctctatgttggtggacttgatgctagggtcactgagcaggatttgcgggatcacttctatgcgcacggagaaatcgaatccatcaaaatggttctccaacgggcttgtgcttttgtaacatatacaaccagagaaggtgcagaaaaggcagctgaagaactctccaacaaactggtcattaagggcctaaggctaaagctgatgtggggcaggcctcagacatcgaaacctgagtcagatggctctgatcaagcaaggcagcaggcttctgtggctcatagtggattgttgcctcgggcagtgatatcacagcagcagaaccaggaccaaacacaaggaatggtttactataacaatccaccaggaccaccacctcttcagcaggaaagaagctactacccatcaatggatcctcaaagaatgggtgctcttgttgcatctcaagatggtcctcctggtgggccttctgggtcaggggagaacaagcctagttcggacaagcagcaaatgcaaaattatacccatccaatgatgccacctccacctggccaatatcatcatcagtattatcctccatatggttatatgccaccagtttccccttatcaacagtacgcatctccatacaatgctgcagtggctccatcccagacaccagctgcaaatcatccttatcagcattctatgcagccagggtctggacaggctgcacatgccccagctgaatctggaacatcaacatcaggatcgcagcagcattaa

SEQ ID NO: 11196 - DNA, 540 bp, Glycine max
  Peptide Sequence Number=SeqID_127974
atggatgtggcagctaagtctgagtcaaaggacaaccttcccttgttactcacccaatctgctgaccctctcaaaaggacagggacggtgtggacagcagtggcacacatagtgacaggggtgataggatcgggagtgctgtctctgccatggagcactgcacagcttggctggcttgcaggcccattctccatccttctcattgcttccatcactctcttctcttcttttctcctatgcaacacttatcgccatccccatcccgaatatggtcccaataggagtgcctcctaccttgatgttgttcatttgcatttaggaataagcaatggacggctcagcggccttcttgtgaatataagtctgtatggttttgcaattgccttcgtcatcacaacagctatcagcttaaggtgtgttgattcatcacttatcttactgcttcctctcctgttatgtcatttccttttctttgttcttcttttcatccgtttgtgcaaaacaagatttttacactggtactccactaaggaagcatga

SEQ ID NO: 11197 - DNA, 381 bp, Glycine max
  Peptide Sequence Number=SeqID_127975
atgggggtgggaatagcaaagcccttggagtgccagatcaaaaccttatgcaacccccttcaggagttctttgaggcagacaggagccatgatgatgacaaacctgttgtatatggtcggagttggaaggcatcggaattgcgtctaaaatcttgggatgaccttcataagttgtggtatgtgttgttaaaggataagaacatgttgatgactcaacgtcagatgcttaatgcacagaacctgcgttttcctaaccctgagcgcatccccaaggtgagaaagtcaatgtgctgcatcaagcaagtacttaccgagagagcaattgaagaatcggatccaaggagatctgctgagatgaagagaatgataaatgttctttga

SEQ ID NO: 11198 - DNA, 666 bp, Glycine max
  Peptide Sequence Number=SeqID_127976
atggtgggtggtgtatctgtggcggtggagtcgcagagttgcccacgtttgtacgtggatgctctgcccaccacccctagtatgagtgttttgtgtctcaagaggaagcacttgctgagcctcaccacttccttcgttcagagtcacagtgttaatacaattttcaacaagcattgcagacacaaggagaagactaagagactcactattgtcaatgagctcggtggtcaatatgaggacacttttcatgatgtcaaaaagcaaatactcaattatttcacatacaaggctgtgaggactgttcttcaacagttgtatgagatgaacccacctcaatataggtggttctataaaattctttatgtgcgtttactactctcaaaacttgccactgccagcaatggaagtgctctggttcgtttcgttgcaacaaacgacccagcagatgggaaacattttatacgatccctcgcaaaggagcaacatcaacttgctgaaagagtgatgataacgcggcttcacctttatggcaaatggatcaagaaatgtaatcacgctgagatatatcaagaaatatctgatgaaaacttggagttgatgagggaacggctcatggaaactgtaatatggccttcagatgacacaaacacagaaaaaatcggctga

SEQ ID NO: 11199 - DNA, 801 bp, Glycine max
  Peptide Sequence Number=SeqID_127977
atgagaaaagctgtgcaatcggtcataacgaaaatcaaggcgagacagatcctcgatagcagaggaattccaaccgtcgaagtcgacttgcatactaacaaaggcgtgttccgcgcttcagttcccagcggcaactccaccagcatgtatgaagctgttgagttacgcgacggtgacaaaggagtgtatctcggaaatggcgtggctaaagctgttaaaaatatcaatgacaaaatatctgaggcgttgatcggtatggatcctacgcttcagtcgcagattgatcaggccatgattgacctcgacaaaactgagaagaagggggaacttggagccaatgctatattagctgtgtccattgctgcttgtaaagctgacaaaaatatacaggttccactttacaagcacattgctgacctgtctggaaaaaccagcccaacacttcctgttcctgcctttactgtcataagtggtggaaaacatgctgggagtaacctggccattcaggaaatcatgattctcccaattggagcaagcaaatttgaggaagcattgcgaatgggcaccgaaacctatcatcacttaaaggctgtcattacagaaaaatatggtgcacataactgtaatgttggtgaagatggtggctttgctcctaatatctccaggcaagctttttattggatttctacagcttttgaaaattctttactgttaaatacaacaataaagcctttccactttatggggtcaattacatggaaccactgcaccacaaatttctgtacaattcttcaccattaa

SEQ ID NO: 11200 - DNA, 162 bp, Glycine max
  Peptide Sequence Number=SeqID_127978
atgttacagcaggaagaagaaggatcatccttaaagaaggaagagacaagttctgctgaagaagaagaagaagaagaccccttttaccaaaacgaagatgattgttttgccattaaagtcccgatcaaaactacatgtccttgtgacaaaacagtccaatag

SEQ ID NO: 11201 - DNA, 228 bp, Glycine max
  Peptide Sequence Number=SeqID_127979
atgaatggctctggaatggtggcctcagatgacgcctactctacatgttgtggagctgctggagtaggagctgcagatgtggaaggaagatcagctggcctcgccctcgccctcctagcccctcggatagaaactgtcagatccattaagattccaacagttcttcctgatgtaggccaagttaatgaccaggctcaggcgatcaaaagtgaggaaacccaagtctag

SEQ ID NO: 11202 - DNA, 346 bp, Glycine max
  Peptide Sequence Number=SeqID_127980
atggttgtcttgaccaaacatgaaatacccagcttcctctccaaaaacactatcctcgagaaaatcctattgatccgtgatcgtgcgtgtgatcttttggtgaaagaatttggtggaccattcggtcctgccaacaaatcaagtacggagccccacgaattgattgctgtcgcaacgtgcccttttgcgggcgggcgacgcgtgactcacgggatgcgtgttccacgaaaggaatacgcggggagtcaccaccaacgtttatttgaggaaaatgttggaaaaaccgaaggaaaaccggtcaaaaagaaaattctaagttcgggagttgtatttacgcttgaggaag

SEQ ID NO: 11203 - DNA, 618 bp, Glycine max
  Peptide Sequence Number=SeqID_127981
atggaacttggaaggcagctggaaggggagccttggcaacattcaaaaccataccaaactgagcaactgcttttgaggaagccaaagcaatgggtactctctgtcttggtaacaatgttgctgtttgtaacaaaagagagagacaagaaaccaggcgaggccttaaacaagactagaacatgccacagttctgaagacaaagaagaagggccaaaagaggagaatttggagagttccagagaagagactttggagaaggagaagacaggaccgacaaatgccatttctgataaaaaagaagccttaacggagaagaagaaagggacgcaagagctggaacagttgagattgaaacaggggctgaaacgtgcccagagggagatggcgagacttttggaactggacacgcgacttctagggatggatcgcgctcttcaaggcgcacctaacctgggtttgccggaagaaaagacggcggcggcggccggagatggcggcggacggtggcaacgccggaaacagtcagaacgggattgtacttgctctgataccatgttaaaaattaagggctacattgttgaagggtttgagatacacattgtattagagaagtgctga

SEQ ID NO: 11204 - DNA, 234 bp, Glycine max
  Peptide Sequence Number=SeqID_127982
atggcagatcaaggtgagccatattcagatccaataagatatagaagactggttggaaagctcatttatctcacaattacaagacctgatatctcctttgcagttagtgtggcaatattatctcttggaagagcaagaagcaaaacactgttgctcggtttagtgcaaaagcagaatatggagctatggccacaaccacttgcactccatattgcttccaatcccgtgttttag

SEQ ID NO: 11205 - DNA, 801 bp, Glycine max
  Peptide Sequence Number=SeqID_127983
atgagacaaagccagagtaaggatgatccaaacagtaaccagtttgatcacaggagaaaaggtttcatgaaaaccaaaaccatgcacttgatgaaatcccttggctaccaatcgagctttgaacctgttaatgaaaccatatgcattttcctttaccctgaaaacccatttacagccaatatcttgcctattaatgataccaagtcccagatcgtggccaaattgctagccaacagattgaagaaggttatgtcattcataatagatgaaggtcaatctgcattcatcgaggggaggcatttgctacaaagtgcagtgatagcaaacgaggtagtggatgaggccaggagaagtcaaaagccgtgtatagttttcaaagtggacttcgagaaggcatacaattcgatggtttcagtgaattgtgggatgtctaaaatctgcatctgtatcggtactgaggcactgaatgggttggtgagagaggtcgtcaagagaaagttgtacagcggattccatgtgggatcaaacagagttgagcaaccaacaactcaaggaagaatatcaccaaaaaatagtggattgcaaccacacaaggagaaactgatcatgttcgtaccaaacatgatactaattggagactttatcagcattgcgatcttcaaccgaagcatacttcggaggagtttgaggattaatgatgtagccttcaagatgatgactaccgaagcatacttcggaggaagcccaccgatgacagtggtggtggtagggaggaaggaggagtcaatgcagaagccatga

SEQ ID NO: 11206 - DNA, 309 bp, Glycine max
  Peptide Sequence Number=SeqID_127984
atggaccttgactgtccaatgactgagaaatacaggaaagtcatacaaggagtagcaagtctcacgtgtatggcctattctcttacaataggaacaccaagggcgatcactttttccactgctaactcggtttccagagcaagggagaagacgaccgagcccctaaatcccaaattcacagccaaacagctattgtacatgcacgggaaaccagaccaactatccaaacagctacaaaatgatgatctgagggctgaaacagaactggaagccgaagaacataaccttggcatcgcaatgaagttctga

SEQ ID NO: 11207 - DNA, 1236 bp, Glycine max
  Peptide Sequence Number=SeqID_127985
atggtggaagctcgtcgggtgcaaggttcagtcctgaagcacatggttgaggccataaatgagatgtcggtgaactgtgcaaacttcaatttctcccgcgctggtttctccctgctagccatggaccccacccaaacggcaatggcggagattttcctccgctctgatacttctgccgcaccatctccttcggcgtcaacctcaaccacatggccaagatcctccgttccgccgccaaagatgacaccatcaccatcaaagccgactatggcgcccacttcgccatcttcatcatcgaaagcccttatagaacgtaagctagcttgctgttctaaagattcgtgtgctgttgtgtgtgttatagcccaagacctgatatctcattttatgatgaatctggtggatatagacactaagcccgttctcattcattccgaggctcagtattaccatgccattgttaagatgccttcagctaagttttcaaggatttgcactgacctctctatttttggggacactgtttccattgaggttaccgaagagggtgtggggtttagcaccaaaagagatattgggacttcaattatattctgcaggcacaatacttccgtccacaaggctgatgaggaagctactgcgatagagatgactcagactgtgagcttgaattttggattgacatttttgaacagtttcacaaaggcaacgccgttgtctaatacagtcactatctttttgtcgaaccagctgcatctgcctgttgtgtttcagtaccagattggtgagaaggaggagggtgtgaagtttagcacgaaaggagaaggagatatactctggtgcaggtacaaggaagttaaacttattctgtttgaagtcactaaggtgtcctgtgaacttgaacgacgcactagtgatcccatgatgaccctcagagccctagaaggagcgctagtcgtcaccttcatcttcattcatgttaccgacaagggtactctcatgtttagcaccattggagattttgggatttcaactgtactccgcaagcacgagccttttgaagtcactctgataaagatgactcagcctgtgagcctgaaatttgaaatgagatgtgtggacatgctcaggaaggcaacgctgttatctgatacactcaccatcgatcagcttgtcaaaggagctgccggcggctgtgacctggcacgaacagtgtttgctggggttcatgtgtag

SEQ ID NO: 11208 - DNA, 1422 bp, Glycine max
  Peptide Sequence Number=SeqID_127986
atgaccagaaaggtgtcgaatttctccgatctgatccaaagggtcaccacctcctgcttcctccacccattcgacgatcacaggtctgacgtcggcgacagggaagaggagtaccacagcggctcattaggaaacagacacgaagacgaagatgccaacgaagaaggttactacggtgaagaaaaaatggtgatgggtttgaaggtttcaagagaggaaaagaagttgaagaagatgagggcgttaatggaggaggtgttcgaagcggtatcggcaatgaagagtgcgtacgtgagcttgcaggaagcacactgcccgtgggacccggagagattgagggaggctgacgtggcagtggtggcacagctgaagaagcttgctctgttgagggacaggttccatgggagtgtgagtagtgttgaagaaggcaagggtagaaggagaggaggagggcatgcaccctacgagacactactcatgaaagaggatttgctacttcagaatcttaaagagaagcttcagtgtgctgccaccctctcaactcatcaaaacaaagctcagccttacacaaagagaaaccttgcttccaatagtcatattcaagcggcagggtttgtagcagcaccatccccgccagaactcttggaagcaacaatggcgcaagtaaaggaagcatcaaagtccttcacatctctactcttctcgctcatgcacgacgcacaatgggacatggatgccgcagttcgttccatgggagcagcttcagccaccaccaccgacaaatactataataataaaaatacttgttcagtaaccaccacctccaccacggtctcaactcttcatgccaagtacgcccttgaatcctacatctacaagaaaatgttccaaggattcgatcacgagagtttctacatggataatagcaccctctcctccctcctcaaccctgctcagtttcgccgcgattgcttcagccaatactgccacatgaagtccgtggacccttctgagctcattggaggagttttagcaacgtgtaattttgggaaattctgctccaaaaagtacctttccattgtgcaccccaagatggaggagtcactgtttggtgatttggagcagcacagtgtagtctctgaagggaaacatccaaggactcggttttacaaagagtttttgggggtggcaaagggagtgtggttgcttcatttggttgcgttctggtttgatcctgtgccaagtaagtttgaggcaagtgctggagctgagttccacccgcgttacatggagagtgtgctgaaatttgctggtgggactgtgcctcctcgaaagattgttggtttctcagttagtcccggttttaagcttggaaatgggtctgttctaaaggctagagtttatttgatggctagaaactga

SEQ ID NO: 11209 - DNA, 222 bp, Glycine max
  Peptide Sequence Number=SeqID_127987
atgaatctaggaacttttgcttgcattgtatcatttggtctacgtaccggaactgataacattcgagattatgcaggattatacacgaaagatccttatttggctctctctttagccctatgtctcttatccttaggaggtcttcctccactatcagcatctactataccaggaatatcaatgaaccctattattgaaattgctcaggatacccttttttag

SEQ ID NO: 11210 - DNA, 147 bp, Glycine max
  Peptide Sequence Number=SeqID_127988
atgccttgcctttacatctccaccaacataaacttagatggagttaacatcgatccaatcttttctcaagccaccactgcagtttccacaatcatcggcaaaccagagaagcttatgaaatttggtctcaattctcaagacgtgtga

SEQ ID NO: 11211 - DNA, 948 bp, Glycine max
  Peptide Sequence Number=SeqID_127989
atggcttctttccaggcttcgtcgcagcgcaatgccaccctggtcgaggccctgacggggctggaagcggtcaagaccctcaacgcccagggcgcaatccagcgcaactgggagcgttccaccgagttcatcgcgcagacgggcggcaagctcaagctgatctcgtcgtccaccgtgggcttcgtgcaggcggtgcagcagctggtgtcgatcgcggtcgtgatcatcggcgtgtacctggcgcaggattcggccctatcgatgggcggcatcatcgccgcctcgatgatcgccggccgctgcctggccccgctgggccaggtggccggcctgctgatgcaataccagaatgcccgcacctcgctgggttcgatcgacaactacatgaagctgccgatcgaacgcccggccgaggccgagttcctgcaccgcccggtgttccatggcggcctggaattccgcgacgtcagcttcacctacccgggcagcacccagccggtgctcaagaaggtgtccttcaagctcaagccgggcgaaaaggtcggcatcatcggccgcatcggctcaggcaagaccacgctggaaaagctggccttggcgctgttccagccgaccgagggcgcggtcctgctggacggcgtggacgtgcgccagatcgacccggccgacgtgcgccgcgccatcggccacgtgccgcaggacccgctgctgttctacggcagcctcaagcacaacctggcgatgggcgcgccctacgccgacgacgccagcatcctggcggcggccaacatggccggcgtgaccgagttcgccaacctgcacccgaacggcttctacatgctcatcggcgagcgcggcgagtcgctgtcgggcggccagcgccaagcgaggcccagctgcgccgccgcctgggcgaagccagcgccaacaagaccatcctgctggtga

SEQ ID NO: 11212 - DNA, 263 bp, Glycine max
  Peptide Sequence Number=SeqID_127990
gggtgccggaagatgcagtgaggctcagcttgttttcattctctttggatggagaagcaaagagatggttgcactctttcaaagggaacaacttgaagacatgggaagaagtagtggaaaaatttctgaagaagtacttctcggaatcaaagacagctgaaggtaaggcagctatctcttcattccatcaatttccagatgagcctttgagtgaagcgcttgaaagattctatggcttgttcaaatatatcatgaagttttga

SEQ ID NO: 11213 - DNA, 174 bp, Glycine max
  Peptide Sequence Number=SeqID_127991
atggtttatgccacacttatgctaaaggatggggctaaaaagtggtggaaggaagaggataagtcacagatgtgctcgcccagcacgcagccagcccgctcaacgaggtcgttgtcccttctcgcgctcagtgcgcccactcttgctaagctaaaattcagtaactcgacttag

SEQ ID NO: 11214 - DNA, 333 bp, Glycine max
  Peptide Sequence Number=SeqID_127992
atggaggattgccttgagggtcctcacttaggcaatcatgaaacacagctccaaactcgaaaatggaggacacatgaacagcgctgggcaataacattcatggggctcccaaaaagggtgagaatggaggattgccttgagggtcctcacttaggcaatcatgaaacacagttccaaactcgaaaatggaggacacatgaacagcgctgggcaataaccttcatggggctccgaaaaagggtgagaatggaggattttcttgagggtcctcacttaggcaatcatgaaacacagctccaaactcgaaagtggaggacacatgaacagcgctag

SEQ ID NO: 11215 - DNA, 387 bp, Glycine max
  Peptide Sequence Number=SeqID_127993
atgtgcagcgccaccgattacaaaactaaatcaatcggagggtgtccttcgcaacccttgaatattcatggcataacgctgaaaggcaaacaagatgaaaattgggagcaactgttcaccccaatgatcggtcaatggaacaagcaagttgattttagggtcgacggttatcctcgacaagaggagcaagagagaatcactgagcctgtgtcacatggtccagcatcagagcatcaatttccagcacaagagtttcacattctccagtcaagtgttgaacctcaagggaaaggcaggcgaagggtggttgttgaagcggaagaatattcccaacaaatatcggagcgtggccatggaatgtattacacaccaccaacattttcttag

SEQ ID NO: 11216 - DNA, 301 bp, Glycine max
  Peptide Sequence Number=SeqID_127994
atggcagaggtctccatagaggccattgcctccctcgcccaatattatgaccagccatggaggtgcttcacctttagggacttccagttatcacccacggtggaagagtttaaagaaatcctgggatgccctctaagaggaaggaaaccatacctcttctcaggattctatccctctttagcaagaatttctaagatggtccaaatctcgacgcaggaattagaccacagaaagcaagtcgaaaatggggtggttggagtaccgaggaaatgtttggaagtaaaagcaaaagtcttggcag

SEQ ID NO: 11217 - DNA, 342 bp, Glycine max
  Peptide Sequence Number=SeqID_127995
atgacgaagaacgaacgaagaacgatgaagaacggcgaagaatcttcacgatatcgcttacagaaacgtctcagaagcgggaaaagagggaggtggttgccgcccagctcgcccaggcgagctgggttgcttccaccagaaggcaccgccttctgttggaacaccctggaaggcctaaaatgttgcggaactttacggattgcgcgacaatgctccctttcgactttcggcatgtcgcgaaacttcacggattacctaacaatgggtgttaagtacctcaaagcggtcaggcaaaggttgcaggccatcaaacaatggtccccggacgaaattagagtatga

SEQ ID NO: 11218 - DNA, 2136 bp, Glycine max
  Peptide Sequence Number=SeqID_127996
atggggaaagtttggattttgatggtgtttgtgttggtgggtgtggttggcattgttgaaggggcaaggaagcacccatcatcagggaggaggatccacactctgttctctgtggaatgtcagaactacttcgactggcaaacagtggggctgatgaacagttacaggaaggccaagcatcctggaccaatcacaaggctcctcagttgcactgatgaggagaagaataagtacaaagggatgcatttggcaccaacctttgaggtgccctcaatgagtagacaccccaaaactggtgactgtgtggaatgtggattggtttgtgtggtttgttgtggagtgaggtcaatgacattggctttggttctggttgtccaattgtatgttgcaattgctgctgttgatcttttcttaggcatgtccaggggcaggatctctttgtgtggtactacagttgtgattgctattttgacttgtgaggttgaaaataagttttctgatgtcaacaatattcagtttttccttatacacaagaccattgagcttgtacttatcactagttacagtgcagagtaccctgcaataaacaaacctgctggggttgtacactggcttaaacatagtaaggaggcaaaaaatgttgactgggttgtcattctggatgcagacatgataattcgagggcccattatcccttgggaacttggtgcagagaaaggaaggcctgttgcagcatattatgggtacttaataggttgtgacaatattttggctaaactgcacacaaaacacccagaactgtgtgacaaagttggtgggcttttggcctttcatatagatgacctgcgagtttttgcccccttgtggctttcaaaaacagaagaagtacgggaagatacggttcactgggcgacaaacataactggtgacatctatgggaaaggatggatcagtgagatgtacggatactcttttggtgctgcagaagttggacttcggcacaaaatcaatgataacttaatgatctacccaggttatgttcctcgcgagggaattgagccaattcttcttcactatgggttgccatttagtgttgggaattggtcattcaataaactggctcaccatgatgacggaattgtatatgaatgtaaccagctctttccagaacctccttacccaaaagaggtaagacagttggaacttgatcctaatcgaaggcgaggactatttctaagtttagagtgcataaacattataaatgagggtcttttattacaacatgcagcaaatggttgccctaaaccaacatggtctaaatacttgagctttttgaaaagcaaagcttatgcagaactaactcagccaaaatatgtgaatcctgctactttacaaatgatggaggatatcaaagaagaacatgtcgatgatggtgctggaaagccacatcccaaaatccataccattttttccacggaatgcaccccgtactttgattggcagactgtaggacttatgcacagtttccgtagaagtggacagcctggaaatatcactagacttctcagctgctctgatgaggacttacgtcagtataaaggccatgatctggctcccacacattatgtcccttctatgagtcgacatccattaacaggagattggtacccagcaattaataaacctgctgcagtccttcactggcttaatcatgtaaatattgatgctgaattcatagtgattcttgatgctgatatgatcttgagaggcccaataacaccatgggagttcaaagctgctcgtagtcatcctgtttcgactccctatgactaccttatcggctgtgataatgagcttgcaaaattgcatactagccatcccgaggcttgtgacaaggttggtggtgttatcattatgcatattgatgatctccggaaattcgctatgctatggctgcataaaactgaggaggtccgagctgatagagctcattatgcaagaaatataacaggagacatatatgaatctgggtggattagtgagatgtatggttactcatttggtgcagctgagtatagtattagagatataacttctttcagttccagacctggcctttgcaaccttttcaattaa

SEQ ID NO: 11219 - DNA, 393 bp, Glycine max
  Peptide Sequence Number=SeqID_127997
atggctcggcggcatccaatggaggtctgcagttgtgaagggtactgttcatctgtgaaaagagcatgcactaagagcgtgagatgcaagtgcatgggggtgcatgtggcagcagacggcgacacaattgtgacgtcagggttgctggagacaagtgacagtggtcacagaggggctgcgaggattcctctgtccagtgagcctggtctgcaaaagacagtcggattggtgaccagacataccgggaacagggattgtttggcacagcaaaaggatgtgcgtgagagcacgttggtggttgtttcaagacaccgtcaatggcgtgacgtagatcagtggaaggtagttcagatccgtaggttgttggccagaaagttcaccgaaaaagcttaa

SEQ ID NO: 11220 - DNA, 240 bp, Glycine max
  Peptide Sequence Number=SeqID_127998
atgcaccttgttgccatcgagtacataccttacctcccaaatggtcaatttttttcaattcacactctcccctatccatcatcactgtgtacggtgcgcaagttggaggtggcaattagggttttcagtgatgttgatgaagaggggaagatgatgaaggagttcatacatctcaagttttcgcgacaacaatttggtaatcgcgaccattgggatgcaattgaaggttggagaatatga

SEQ ID NO: 11221 - DNA, 285 bp, Glycine max
  Peptide Sequence Number=SeqID_127999
atggataggggagagtgtgaattgaaaaaaattgaccatttgggagacgttgatgaggaggctggtgtggtggccgcgaatgatggcctcgagaaagcgactctgcatgacgaaggtgtgaaatctcgaggggtcataagaaatgacatttcgaatggcaatgaatgtttgcccacgcatggagctcaatgccaccttgcagatggtgtggtagggaaagtggttgcgagggagagagtgaagtgttgcagtgcgggaagtggatatgagggagagaaggaagtg

SEQ ID NO: 11222 - DNA, 273 bp, Glycine max
  Peptide Sequence Number=SeqID_128000
atggcaaatgaaaattgtatgccgacgataacaaatgaagatgctatgcaagatatgataaatgctgcatgtggattctctacaatgtgtggcaatgaagctcccattccatccttaaccaaacatagagatagtaataaaagagatgaagataaagaagaatgcaaagtatgcaaaacatctaggtggcaacaaaatgataaacaagttgaaagtggtcatggttcaactcctaccaagccaccaacgaaactacccacaaaaattttgtga

SEQ ID NO: 11223 - DNA, 279 bp, Glycine max
  Peptide Sequence Number=SeqID_128001
atggtcattcccaagttcaaggtgccagactttgacaagtacaaggggactacttgccctaagaaccatctaaagatgtgttgtcgaaagatgggggcatacacaatagatgaggaactattgatacatttcttccaagaaagtcttactggagtagctgctacttggtacactaacttggagccttcccgtgtccattcttggaaggacctaatggttgcttttgttagacagtgtcagtacaattctgatattgctccagataggatgcaactatag

SEQ ID NO: 11224 - DNA, 2063 bp, Glycine max
  Peptide Sequence Number=SeqID_128002
atgagaatcatgagatgttactgccatgacagtagggggtctaaggagtggaccgaggaaattgagtacttggatgaatctggtggtgttatttacaagggtaagggtgttaggtctgttgagcccggtgttgatgatcatgtgatggttggtgaggtgaagaagccctttgtgaatgccctggctgtggccaaaattgtagaggttgtgaagaggtggaagtggggtccagaattggagacccaattggacaagctgcagtttgtgcccaacatgactcacattgctcaggccttgaaggttgttggtgatgttgatgcttgttttagtttgtttaggtgggccaagaggcaggcttggtatgtacctagtgatgattgttatgtcatgttgtttgatgggttgaaccagaagagggattttgaggggattcagttgttgtttgatgagatggttggtgattcggcagatggggtttccttgtttgcggcatgtaatggggtgattcggtacttggctaaggcggagaagttggaggtctcgttttactgctttaagaagatactggatgttggttgcaaagttgataccgagacatataattcgctcattactttgtttttgaacaagggtttgccttataaggcatttgagatgtatgagagcatggagaaagccggttgttcgttggatggttcaacatatgaattgatgatcccaaacttggcaaagtcggggcgtcttgatgctgctttcaaactcttccaagagatgaaagtgagaggttttcggctgggtttgaatgtgtttgcatcacttgttgattcgatggggaaggcggggaggttggacagtgcaatgaaagtttacatggagatgcgagaaactgctctaaggctttgggatgaaatgaggatggcagggttcaggcccaactttggcttgtatactttgatcatcgaatcccatgcaaaatcagggaagcttgagattgctatgtctacatttttagatatagagatagcaggatttctacccaccccatctacgtatgcttgtctcttagaaatgcatgctgcatctggacaaattgatcctgccatgaaactgtacaattcaatgactaatgtaggtttgaggcctggcctaagtacttatactgtccttttaactctactggctaataaaaagctggtggatgtggctgccaaaattttacttgaaatgaaggccatgggatattctgtggatgtgacagctagtgatattttgatggtttatattaaggaaggttcagttgatctagctttgaggtggttgcgtttcatgggttcatcagggatcagaaccaataattttattatgaggcagttgtttgagtcatgcatgaagagtgggttatatgaatcggccaagcctcttctggaaacatatgtcaactctgctgcaaaagttgatttgatactttacacctccattttagctcatcttgttaggtgccaggaagagaaaaatgagaggcatttgatgtctatccttagtgctacaaagcataaggcacactcttttatgtgtggacttttcacaggcccagaacataggggacagccagtgttatcttttgtccgggaattctttcaaggtattgattatgaattggaggagggtgctgctaagtactttgtcaatgttcttctcaattacctagttctaatggggcagataaatcgagctcgatgtgtttggaaggttgcttatgagaataaacttttcccaaagactatagtatttgatcagcatattgcttggtcccttgatgttcgaaacttgtcagttggagcggctcttattgcagtagtgcatactcttcatagattcagaaagcgcatgctatattatggtattgtgccaagacgcataaaattggttacgggagcaactctgaagattgtgattgcacagatgttgagctcagtagagtctccatttgaggtgagtaaagtggttcttagggcatctggagattctgtcatggagtggtttaagaaaccaattgttcagca

SEQ ID NO: 11225 - DNA, 324 bp, Glycine max
  Peptide Sequence Number=SeqID_128003
atgacatcccttcatcatccgctccagctcctcaatctgcatcagcaggaccagatgcccagagctcttaaactacagtcgctatgctacatagcttattccagggacaggttaattaggcaagctttgaaaagtgttgtttttcaccttctcgctaagccaatttgctggcttagcgagcgtccgctaagcgtaacactcatgggccaagcgcaaggaagactctggaagaagatgagttgtacaggttcgctaagtgcaccacttcatctctctaagtgcactaattcagttcatcagctaagcaagaaaggcacgcactaa

SEQ ID NO: 11226 - DNA, 891 bp, Glycine max
  Peptide Sequence Number=SeqID_128004
atgggaagacagccttgttgtgataaggttggtttgaagagaggtccatggactattgaggaagatcgcaagcttgtgaatttcatcatcaataatggtatccactgctggagaacagttcccaagctagcaggcttgctaagatgtggaaagagctgcagattgagatggattaattatctgaggccagacctcaagagaggtggattcactgaaatggaagaggatcaaattatgcaactgcattcgtgtcttggtaataggggtattgcggttttaaaaggatatcaatgcatactaatttcttctgacacaatgaagcacattttcaggtggtctaagattgcttcacattttccagggaggacagacaatgaaatcaagaaccattggaacacaaaaatcaagaagaggctgaagctccttggtttggaccctttgacactgaagccagctgagcaaaaggaaaagtcgggtgatgacataaaaaatatagaattacaaccaaacacttcaaaagggtctgaacaaggtgtggagaacaaatccttggacatgcatggcacaagagaagtggcaaaaacagaagggaaaattgaagagaacgaggtgacatgggatgataccactggaattttcaacaattatgaaatgctgtgctcacagttggacttgggatcatgggtgagccaagaaaccaaatccagcactagttcttattgtagttcttctttctcacttgatgattctagcaaccattctgtgggtgaatcctcttaccttcaggaaaattccttacagcaatgggttgatgatttggattccattctgtcttgggataacttcaattctcttgagaaagattttctcttcttggataataggcaataa

SEQ ID NO: 11227 - DNA, 1052 bp, Glycine max
  Peptide Sequence Number=SeqID_128005
gatttggaaggattggccgtttggtcgccagggtggcactgcagagagacgacgtggagcttgttgctgttaatgatcctttcatcacaactgattacatgacttatatgttcaagtatgatactgttcatggcaaattcaaaaactgtgagattaagattaaggacagtaaaacccttctccttggtagtagcccggttactgtttttggcatcaggaacccggaggaaattccatggggtgaggctggagctgattatgttgttgagtccactggagttttcactgataaagacaaggcagctgcccacttgaagggtggcgcaaagaaggttattatttctgccccaagcaaggatgccccaatgtttgttgttggtgtcaatgagaaggaatataagtctgatatcactgtcgtttctaatgctagctgcacaaccaactgtcttgctccacttgcaaaggttatacatgacaaatttggtatccttgaaggcctcatgagcaccgttcactctatgactgccactcaaaagactgttgatggaccatcaatgaaggactggagaggtggaagagctgcttcttgtaacatcattcctagtagcactggagctgctaaggctgttggtaaggtgttgccatcccttaataataagttgacaggaatgtctttcagagttccaactgtagatgtttcagtggttgatctcactgttagacttgagaagggagccagttatgatgagattaaagctgctgtcaaggaggcatctgagggaagtatgaaaggaatccttggttacacagaggatgatgttgtgtctactgattttgtgggtgacaacagcatgtcattttccatcaacaaggctttagtgtggtgtagcttaccatgtgatccattatatgctggcaggtcaagtatttttgatgcaaaggctggaatttcattgaacaacaattttgtgaaacttgtctcttggtatgacaatgaatggggctacagcacacgtgtggttgacttgattcgacacatggcctcagtctaa

SEQ ID NO: 11228 - DNA, 282 bp, Glycine max
  Peptide Sequence Number=SeqID_128006
atgttttcctcaaataaacgttggtggcgactccacgcgtattcctttcgtggaacacgcatcccgaaaggaaaaggctacaatgtgaaaggtatttctctcagctcaaacatgatatccaaattcccaacggaaaggaaaaggctacaatgcgaaaggtatttctctcagctcaagcatgatatccaaattcccaacggtgagaatactaagaattgggctgcaaacatagtgctcaaacagagagggttttgggagaagagagaagaaacgaaattgtga

SEQ ID NO: 11229 - DNA, 534 bp, Glycine max
  Peptide Sequence Number=SeqID_128007
catggaaactattcctacctgagaaagagtttagcctagatcatccagccgccaatcctctagccccagatcacagtcctcctttaaagaagatgcctccaacattgacagtggtggcagaccatgactggatgagggaccgcgccattgcctattcagaggagctaaggaaggtgaatgttgatgcacctgtttatgagtataaagatgcagtccatgaatttgcaacacttgacgtacttctcaaaagcccccaggcccaggtttgtgccgaggacattgccatctgggtcaagaaatatatttcgcttcgaggtcctgctgtccttcttgttgattggttccacgttccctccacctccaccaccactgccggtggtggtggcgatagtaacaacgctcatgttgatgatgacgatgatggtcaagatgatgattatagcgacggtagcaacagtaacaatgacgatcatgttaataacaacagtaatcatgacagtaacaacaacaacattcatgttgatagtgacgacg

SEQ ID NO: 11230 - DNA, 449 bp, Glycine max
  Peptide Sequence Number=SeqID_128008
atgagggtggaactagagacaaaggatgaagtccaagagatggccaaaatcaaacaaaaggacaccaaacttcaagcatcaaggagatacaatacaaaggttcaacctcgagcttttcaacctagtgacctcgtattgcgagtccaaggtgaagccagaaaagatccccaagcgggaaagcttggactcaatcgggaaggtccatttagggccatagcaagctgttcgctttcggcaagtgcaccggatcgtgcaagtagtataaaatgtgtgaaaagagatgtgtttactatgaacaggtgcctgatgttagaaggatattctctacttaacaatgctcatgcgttctatgatgtctctctgtcctatcaagttcaagaatcataccagtttccactgttgaatgatcctgaaaacacatgcatctgcgtgatcaagggaaaaacatg

SEQ ID NO: 11231 - DNA, 120 bp, Glycine max
  Peptide Sequence Number=SeqID_128009
atggtggacacaaggtgtgttcttcttggcgtgagttgcggtgcaaatattgcagaccatgtggctcgaaaagctgtagaagcaggcaaacttctggaccctgtcaaggtggtggcacag

SEQ ID NO: 11232 - DNA, 360 bp, Glycine max
  Peptide Sequence Number=SeqID_128010
atgggagaagagcgacataaagccgtcaaagaagaagtcgacaagctcctccatgcaaactttatcagagaggtcaagttttccaccttgcttgccaatggcgtgccccacatacacataccctctgcccagcatcgacaagttggtcgatggagtgtccagattctaggtgctaagcttcatgtacgcctactccggatacaaccagatcagaatgcatccttctccagacgaaggaaaatagaattcatcactgaagatgccaacttttgctacaagttcatgccattcggcctaaaaattgcaggcgcgacataccaacgactaatggaccgagtcttcaaacaacagatcggatga

SEQ ID NO: 11233 - DNA, 969 bp, Glycine max
  Peptide Sequence Number=SeqID_128011
atggttagcactcggtctggccttagacctagaggctcgtgtcagacgtcctcaggtgacgagaaatccacccacaccttgcctgaacacacccaaggggaattacaccccagatgcacaggcagcactatagacgacctaagtctctcccatattcaccgtccaacatcacagactgtccatcgacatccttttgttgaccatattatggaggcaaacatacccttgggatggaagccactcaacctcgagcaatacgatgggacaacagatccaaccgagtccatagacaatttcgacaccctcgttgaacgattcagttcacagtacgccactggcaagtctcaccacatgacctcaatcgccttggctagtttgcgacaagtagacgaggagtcccgcaaaaagttcatggacagatttgggcgcacagttgtccagatccaaaatctcaatcttgagatagtctatgcaaaaaatcacccgatagcatggacgaactacgcgaacgagccaagggctacatccaaatggaagaaatgtccagattctggaataaagtccgctaagtcagacagaagcgcgacaagcgcaaagcaaacaccaaggccgacttgcacaagtctgacaaaaggaagcattcaacctggaggtacccatctggctaccctagacgaaacctccgaggccgaggtcagatgcaaccaagtactgcagcgaagtctccctcctatcacctttatggatagggacttcaagggcatcaactttggtcaaggcaagctctccaggagcttcaccatcagatatttacgggttgacacaaacacatcatactttgccttaatcgacaggaagacactcaacgagcttggagctatagtctccatgccccatctgacaatgaaattccttacactgatagaggagattgcaaccgctaaggctaaccaaaagcaagcatgctag

SEQ ID NO: 11234 - DNA, 134 bp, Glycine max
  Peptide Sequence Number=SeqID_128012
atggtggaattggtgtcggggatgatccgatggcttagggacgtgatgttctatgtgccgcagcagaggtggatgaacccttgcgcttcttggatgattctgtcatttggtgaagttattgaagattttgattg

SEQ ID NO: 11235 - DNA, 558 bp, Glycine max
  misc_feature (556)..(556): n is a, c, g, or t
  Peptide Sequence Number=SeqID_128013
atgccgagcgtggccgtgaaactctacagcgtgtttttcaagtttctcttaaagcaccgtttgcagaaccggatccaagcaccgcccgaagactccgactctttcggcgtcacgacccgacccgacgaatcggtggctccggccaacccttcattctccgacggcgttgccaccaaagacattcacatcgaccccttaacctctctctccattcgaattttccttcccgattccgcgctcgagcctaattccaaacctagctccaaacccgaacccggatcggcgaaccccaaaacggcgtcgttaagcaggctgaggcgcaacagctacgagccggcgattttcttgccgcgggaggaggagcggcggaacagcgtcggcgatgtcggcgcgtaccgggggtacgcgccggcgccttcgggggaaggtcgccggaaaaagttgccggtggttctacagttccatggtggggggtgggtgaccgggagcaacgattcggtggcgaacgacgtgttctgccggcggatcgcgaggctctgtgaggcggtggtggtgncg

SEQ ID NO: 11236 - DNA, 198 bp, Glycine max
  Peptide Sequence Number=SeqID_128014
atgacagatcttgtgagcgcggaagatgacgcttttcgtcttacagacagcaaaaaagttttgaaagtgcggacaaccacttgggtatctccgcgtgtcactgccagcatgacagaacttgtgagggtggccgacaaaagcgaggctcttgctcctacttatcctccaatgaggaactcagacctacgtagttcttga

SEQ ID NO: 11237 - DNA, 282 bp, Glycine max
  Peptide Sequence Number=SeqID_128015
atggcacgcagcgtgtccgcttcgtgcccctattcaagggacctatatgggagagagctaaaagggtttttagtgataatccccaaggtggtcatatctctcttgatggtctccagagtccccagtggagtcgccaactgtcgcaacctacccttcggcgggacggcgacgcagggctcgcaggtgcgtcttccaagaaaggaatacgcgcggagtcgccaccaacgtttatttgaggaaaacgtcggaaaaaccagaagagacgtagcctacgaactttaa

SEQ ID NO: 11238 - DNA, 172 bp, Glycine max
  Peptide Sequence Number=SeqID_128016
catgcaacagggacaggcagatatcctcatagctaggttccctgaccctaactatggtgttaaaatgtctctttctctaaggtttttcaaaggaagcataagacatgcaatggcggttgcaaagttagaaaagatgcaaagacaagatgaaactaacaagaaacaagcatag

SEQ ID NO: 11239 - DNA, 330 bp, Glycine max
  Peptide Sequence Number=SeqID_128017
atgtcactcgttgtgggtgacatgtactggagtcaccatggtgatacactcttgcgtgtgtttcactcaccgtgggtggcatgcactggagttgtaatgctagaagaagggctcaccaagggcggaccttgggttgtaagagccttggagaacaatagtctccttgttgatagttccccgacttccacagggatcatggcatttgtgccatatgcccttagacttgtcaagtctagttcccagggccctgaggatgactttgttagctgcctctgtctgtccgttagtctgaggatgtttgacagaggtgatcaggtgcttgatgcctag

SEQ ID NO: 11240 - DNA, 2796 bp, Glycine max
  Peptide Sequence Number=SeqID_128018
atgggcacgggcaatagtgactttgggggtcctattcagccacctctggtggagcgagaggaggtgtggcgtttcgttgcttctctggatggggaactcattccggtcaccatgatcattcccccttctacttctaggggagcgagaaggagtgacagtcgggatgttaggttttctccccacaataggcgtaaccatagtgttgggtcgcctttgtcccctctcgtcgttactggctatgagtgggtaagggacaatgtgttgaaatacagatcctccattatctctacggtgagtttcactgctttggagcatcaactgaagttggccaaccctaaggacttcaacaagataaccatccaggcttgtaatagtgatgattttccctttctaagggcgcacgtccaagaagttgttcgagttcgactcaaacgtgttttgccacttcaaggaccattttttcaagaccctactaggttcaagtcttttgatgaggatctatcgaccctagtggagaaggttaacaaggccattttggagcagttcccagcctcgttggatgcttgggccatcctgtctcttcctttagcagacgatcctcttgctatcttagatgatataatgagcgactttgcatggaggcccttggtgaagcagatgggtcttgctagtgggactgtgccaccatttatgtcgatcctcctattaaagaaaggggatattgttgttgctcctattcctctgactcctccttctttgcctgctcaagaggtttttgtttctccgcccactgtggttactatgccagtctctttggctattcctgtcgtggctcttgcttccaccattggtacccctttgctcaatgttggtgtgacagccacgagtgctttagaaaggccacctcttttttcttcagcttcaccagttcctactttgactattttggcatcggtgttgccttcctcctcttctcgccctagtgtttccttagattacatctacacttcttgtgatattgatttgatgtggagcataggatataagccgaagcagagaactctaactggttttgtgtctttctttgacgagaaccttattcggtcaattagggttcaaaatgaaactaattctacgaaggtcttcctccggagaagtttggtgattttggaggaaaatggacaaaggcatcaggaagctctaagcaaggtggcgtccttagaggctaagatttccatgtggagggccactgctcggactgtttcaagaatggagcgtcccaaggtggccaatgcaattgttgcctttgctaaggtcatcaagtctaaccgccaactgtcgtccaaggttggcgatgtccttgccaagctgttgcgcaccagactggatgttgacaacatgtttgggcgctgcaaggacttgttgaaagaaaaatttgacttggtcagcaaggtggagagcactgctgtagagaaggaagagcttgccaaggtgtttgctaacctcaaggcccaattgaaggagtcagagtccaagttggaggagtctaagctcagggcgctaaaggagagggaggtcgggttcttcaccaaggatcttaacttgggtcttttttaccctttcaaggatgtgaaggacggtgaactacttgatgaagaagagatagttgttgcggcggaggatgacggtgaggagcagggtcttagggccaattttgattcccacctagttgaaggtcttgttgaccaatttggtgggagcaagcttaccaagggcatgccttgggcttttgtaagaatggttatcaagggtggaccttgggttttctatgtttctacaaagatagaatttaggaatagaaaagcttatcaaggggcgaaccttaggtttgttgagcctttggggatgcaagactcactgagggatgaacttgggtttgacgagcctttggagaagcgagactcaccaaggactgactttggatttgacaagcctttcgagaagcgagacttaccaaggatggaccttggggagaaccttgggtttgacgagcctttgaagaaacaagactcactaagggcagactttagggtggaccttgggtttgacgagcctttggagacgcgagactcaccaagggcgaaccttgggtttgacaagcctttggagaaacgagacttaccaaggatggaccttgggtttgatgagcctttcgagaaggtggaccttgggtttgacgagcatttggagaaacaagacttaccaagaatggaccttgggtttgatgagccttttgagaaatgggactcaccaagggcagaccttgggtttgacgagcctttggagaagcgagactcaccaagggcggaccttgggtttgacgagattttggagaagcgaccagggacgcgctcaccaagtgtggaccttgggtttgacgagcctatggagaagcaagactcatcaagggcggaccttgggtttgatgagccttcacttgctacgatcctcaatgggccttcccagttgggtccaagatttcccactcagagatctttcctagcttcacctcggactcgccatactaggtcgccagtgataagcccagagtatactagggagttcctccttccattgacccttggacttgttgagtctggtattagcactcgacgtgcccgtcacaagggacagcagcctttaatcgaggggtgcccttgctcctacgtatcctcaggtgcgatgaggaattcatacctacgtagttctttacaaagtgagaaagtttgtgtgtag

SEQ ID NO: 11241 - DNA, 402 bp, Glycine max
  Peptide Sequence Number=SeqID_128019
atggctctttatagaaaaagccattttggggcagttgaagctcgcccaagcgagctgaaccttaaccctgaagtaatgagctcgcctaggcaagctggagctcgcccaagcaagctgtatgttcattccccacacggtgaaagaacaaggggagctcaagctatggaggttgtcaagagtggtgcgcagagtgtctgcaaacttttggcatcgtctacacctcctagtgaagtcgagggtcccctgagcttggaatgtctcttggatgatgattttgagatgcctggtctttttggtgctgaccagcttggagagcaggtctgctgtagtgttactctccctgggtatgaggttcatctcaaagcaatcaaagtcctcatgagagtttttgcagtatgttag

SEQ ID NO: 11242 - DNA, 144 bp, Glycine max
  Peptide Sequence Number=SeqID_128020
atgaaggagcctcaggcctctagcccttggtcttttggggtccccgaaaaactctcaaaagtcaatgaatcagaagtgactccctgggttttgcataaagcagtgatgagggcagggaaacctagcctcaaggagtcatgctaa

SEQ ID NO: 11243 - DNA, 303 bp, Glycine max
  Peptide Sequence Number=SeqID_128021
atgtgtggcatattcaattcagtattctatcaggctaatggcattgagttaacgaaattatctctaaatcatgaccacaatttacttttcaatttgtatgacgatgcagagcctctcttcaatgcacctcaatcaaacaaacctccctacaaaaacaaaacggtaaatcatatatccactaaaatcacgtttctcacagttaagttacaagtttctcttctagtaaccacatttgctatcaaagaaaatgttcaacatgggaagaaggaggtcttcaaccctgtcatgaacaagattatttaa

SEQ ID NO: 11244 - DNA, 495 bp, Glycine max
  Peptide Sequence Number=SeqID_128022
atggcttcccaaaagagaaaggcacctacctcagcatcccaggcccgctatgaccgctctagattcacatctcaggaggcctgggatcgctactctgatatagtgattggcaggaagatcctggctgagagaaatgtcatgatttaccatacagaatttgatgaattcaagtataagggatttgagcttagtgctgatgggctgccattgaagatcttgcaaaagaatctgactacgctcgctcagacatggagtgttttatcattctccaacctggcctctacttctcacacgtctgacatcacactggacagggccaggctaggtttccctgccctcatcactgctttatgcaaaacccagggagtcacttctgattcattgacttttgagagtctcagtccaaccattaatttggcttatgtgaagaaaaactgttggaaccttgatgacccctcagtcacttttcggggaccccaaaagaccaagggctag

SEQ ID NO: 11245 - DNA, 192 bp, Glycine max
  Peptide Sequence Number=SeqID_128023
atggttgttgggggaggattggagctctctagaggtgtcttgcgtctgaggccatatcgtgtgctaaccattggtgaaagaggtcatgggggtgaatgtggccaaggtgggctccatgatctcgtacgtcagactatggataacccatcgactgctaaggacgatgtctacatgctcctgcgtcaaggctga

SEQ ID NO: 11246 - DNA, 414 bp, Glycine max
  Peptide Sequence Number=SeqID_128024
atgaaattcccaaccttgatagaagagatcgtgactgtcaaggcagaccaaaagcaggctcgacagtgctatgctaaaagcttgaaagtggctccctatcctcccactagagagccaagcaggcctcatctcacaactggtggtagcagtcaagtcatgagtgtcaacaaagggtcttcaatccgaatcttgattgtctacaaagcaagtctgggaggtcatgatggtgtattcgatgtggattcgcatgatgacactgttaacaaaggtccaaagcctattgaagaacttgccaagctgcagctcgaatccaaacccgggaaatgtacacagctcaacagagaccttactagccatgagtatagacgcatagtcgatgtcctacataggaacatagacctattcacatggtag

SEQ ID NO: 11247 - DNA, 445 bp, Glycine max
  Peptide Sequence Number=SeqID_128025
atggccataatgatggaggccatgatgagcaggaagaagatgatggaggtcaatgcggttgtagtttccgctaccagtgtcattactgaggtggactcgattcccccatctggccttaaccaaataattcatccaacctcatatacggtaggtcagggaggcaaagaattgggaagtatgggcaccccccattttgtgcaagttcaaaacaagcattccttcctatcatatggcttgcctcccaattatacacaacccaatgtgacccacactcttgatgagaatgtaaataattccacacccatactcattgagagccaacaacctcaatctgatcatgcacatatccctcaacccatggaggagacacatgaaataccccaccacaatctagccaactttgagccttgcctcgaatacaccactgaggggcaagcagttggtg

SEQ ID NO: 11248 - DNA, 597 bp, Glycine max
  Peptide Sequence Number=SeqID_128026
atgtggcgtggagacaatgttcattcaacgttttcctgtcaatcaaagcaaaaagtaggaggtctacgtaacctctggtctcaactctttctccaacaaagccaaggagtggtcgagagtgtggctggactgtatcaggatgttcatagagctgccttggtcaatgaggaccttagataccatgaaattggtgatcacgatggaaacaaccatgggatcgtcctggttgacagggttgatgcccttgaagtctctttcggtgaaggaggaagtggcggaggtagctttatgggtacctccgtgttgaaggcttcttcaagaataatggttcaattggcagtcaggggtgtgtatcactcatacatgggtccccttgggagagctagttgcatactgagagttgaagtgttcgacaagggtgtcgaagctgtcaatggaccttggagggagtcctctataccatgccaatgtttcccctttgagggacgttgggaaaacgtgacacaaaattacatcgtcattggtgtagagattttcctaggtgaggaatgcatccagatgttcatctggatcggtagttccatcataatgctctag

SEQ ID NO: 11249 - DNA, 621 bp, Glycine max
  Peptide Sequence Number=SeqID_128027
atgtcccctcccccctcctccctcccttcccccctctacccgtggtccaactctcccacgcgtcgcagcgcggctcgtacctggtacacgcacctaaacgccttgtcatctgcccccttaacttttgttggagagaagaatcgtggccccaccaacgcggaaaaggcaattgggtatgagcatggccttgttgtccccgaagtaccaattctgggttatgttcttggtacagacgacgacggtgtaggtgttggggtgaacctgaagcatgtcttttgcgaggtcaacgacgtcgatgatgacgccgacgctgcagcccatgccgccaaggttgaagcttttcacgttaccgcggagcatgtacttgttaacgatcatggaggagaggaaaggggtggggttgaagaggctacagttgacgacaaggatgtcgatgtctttggggttgacaaaggagaagctcggaggagagagatagtgttgaagaaagaggggtggtcggagaccaaagggagtagcttagaggagagagaggagtggtctgaggggacgaaaggcaaaagcttggaggctagaggagagagaaaaaaatctcatatttttttatctgatttagtataa

SEQ ID NO: 11250 - DNA, 1587 bp, Glycine max
  Peptide Sequence Number=SeqID_128028
atggctaagacagaagtgatgttgaagagagctatgatcaagcagatattgaataggctccctcggaagccctccaaatcgggggaaagtcgtgaaggaggggcaatattgactccctcttcaactccttcgacaagtgcaaggagcagtgatgctgcaggctatcactatgcaaatgcaactgcctcacctctttcaggcactgctgattcggttcctggattaaatcatggtgacaggattgtccaagctatgaactcaaaactgaatctgaatgggagttttccagttatggcctatgaagccttgccaagttttcgtgatgttccaaacccagagaagcagaatttgtttataagaaagctgcaaatgtgctgtgttctatttgacttcactgaccctacaaagaacatcaaagaaaaggaaattaagcgacaaacactagtagaacttgtggattatgtttcgtctgctaatgggaagtttacagatgttatgatgcaagaaattgtaaaaatggtgtctataaatttgttccggacatttatttctcctccgcgagagaataaagttctagaagcatttgacgtggatgaggaagagccttccatggatcctgcctggccttacttgcaaattgtgtatgaactgcttctaaggttcgtcatgtcaaccgagactgatgcgaagttggcaaaaaggtatattgatcattcatttgttctgagactgttagacctttttgattcagaggatcccagggaacgggattacttgaagacagttcttcatcgtgtttatgggaaatttatggtgcaccgaccattcatcagaaaagcaatcaacaatatattctaccgcttcatttttgaaactgagaaacacaatgggattgcagaactcttggaaattttgggaagtataatcaatggatttgctttgccactgaaagaagagcacaagctgtttcttgtgcgagctcttattcctcttcataaaccaaaatgcataccaatgtaccatcagcagttatcttactgcatcacacagtttgtggaaaaagattgcaagcttgcagatactgttatacggggattattaaaatactggcccattacgaatagttctaaggaggttatgttcataggggagctagaggaagtcttggaagcaactcaacctgcagagttccaaagatgcatggtagcagagagggctttgttcttatggaataatgatcacattgagaccttaatcaagcagaaccacaaaattatacttcccattgtcttgcctgctctggagcataatgcccgaaaccactggaaccaggctgtccagagcttgacaataaacgttcgcaagatattcgtggacactgaccctgaattctatgaagagtgcatgatcaaagttcgggaaaatgaagcgcaagagaaggatatgaagtcaaagcgcgaggccagatggaagcgtttggaagaaatgggaggcatgaaagctacaaccaacgaagcagttctagtttctcccagaactgcttctcataccccttctggcaaggcaagtagagctcagttggagtga

SEQ ID NO: 11251 - DNA, 278 bp, Glycine max
  Peptide Sequence Number=SeqID_128029
ggatcgtgcccgcaagacacccagtggacctgaagaaggccaacagtgtcttggagttgccagctctaattacgggtctctgtcagttctacggagtgctcgtcacccccagcaagttcattaggccccctattaatcgggctttcatcaagaagtactgcgcccccaggcaggcgcagggtgaagcaccacaacagcctggggagggccggcagcgggcaacagacccaccgccaccacctctagagttcacctcagctcatccacaaaaaggttag

SEQ ID NO: 11252 - DNA, 402 bp, Glycine max
  Peptide Sequence Number=SeqID_128030
atgcgtgatcatggatcaataggacttttctttgggagtagtgtttttggagggaaatttggctctgagtgttttggctttttccttttctgtttttgtttagtgcgaggcgaaaaagttaccggcgcacaagattttgggcgaggatggaaattctcatcctgggtggagctttatggtgagttgggattttggctcaaggcttatagaacggctgaacatgatatatgtcgaggtgttggtttggccagtggttcagggataaaggaatgtgtcccacattatttccatgacatgcgtgcaacaatgatgattcagaaattttttgcaaaactggtcatgcatgcacctatgtggacactcaatcatcaagttttatggtcatgtgacactagggcttag

SEQ ID NO: 11253 - DNA, 228 bp, Glycine max
  Peptide Sequence Number=SeqID_128031
atggctctgagaaagctttcggcaaagagatctaggaatgatgccgcggctgaagggactagtgccgctcccgagttcgacagccatcgtttcaggagcactgagcaccagcagcgtttcgaggccatcaaggggtggtcatttcaccgagagagacgcgtccagctcagggacaatgagtacacagatttccacgaagagatagctcaccggcgttggacgtcgctg

SEQ ID NO: 11254 - DNA, 312 bp, Glycine max
  Peptide Sequence Number=SeqID_128032
atgggaggatattcatctgacaaggacagtgtcaaggacactgtatgcaaaaagtatgacatcagcaaggagaagtggacccatttttgtcagagccgcagagacccttcgtgggaggatgtgcaaaaaaaggcacaggtcatccagaaacaaaacactgcccctcaagtgttgtctcgtgggggttatgaatatctagaaaacaagttgatggaggaaaagaaaaagaaacaattggagaaagttgctcaatcgggaagcactgacactatgattgatccttcatctcccatcaggcgacacgtgaagtag

SEQ ID NO: 11255 - DNA, 246 bp, Glycine max
  Peptide Sequence Number=SeqID_128033
atgtgcagtcctctgaaggcgaggacgtctagtcctctaaaggtgagggcgtgcaaccctctgaaggtgagaacatgcagtcctctgaaggtgagggcgtgcagtcctctgatggcgaggacgtgtcgccctctaaaggtgaggacatgtaatcctctaaaggtgagagcatgtagctctctgaaggtgagggcgtgtaaccctctgaaggagagggcgtgtagccctctaatggagatagattga

SEQ ID NO: 11256 - DNA, 132 bp, Glycine max
  Peptide Sequence Number=SeqID_128034
atggagctttgggttggcttttatagagggaaagtgatgttctggttggctatgacatcatacagtaatcgattaaaacagcaagaaatcacgaaacaactaagacaagcatgtgatcttcaagaaaactaa

SEQ ID NO: 11257 - DNA, 516 bp, Glycine max
  Peptide Sequence Number=SeqID_128035
atggccatcaattcattcatagcacagaagaaagccaagcctttgaagagaaagcaaggagagtgctctcaaatgaagggaaccttctaccctgagttggtaaaggtcttctgtacatgtgccaaagttgatatggaaggtaacttgtactctactgccaatggtatagagatggtgattggtgctgcagtttggaaagcaatagcaggaatagatatgggtcgagtttgcaagtttgaggaatctgcgaatggctacaacaaaatggccagatacagagactttaccaaagcctctaatgagataactgaaagacatctcaagaagcttggcatggcgtatgttgatcatgagtggatcatgattggagagcaactaacggtagcaaatgttgatcaaatggaagaagaagctgaggaagaagctcaacaagagccaactcatcaatggaacccttctgagtccattatgattcaaaggatggatgctatccttcatctccatcaagagcattaa

SEQ ID NO: 11258 - DNA, 328 bp, Glycine max
  Peptide Sequence Number=SeqID_128036
atgttgaaaagttttaaacaacaagaacaaatgtcagttcttgaattgtacatagaaaaggatgtggctggtggttcaatgtttcattctgcaaattcgcttacatcatgtggaaattatttatctaatgacgagacacaaccgacaacaaatatgagcaatttacatattgacgaagacgatgatgacgacgatgatgattatcttgtgtctaactcatacattgaagaatctttagacgaagatgacagtgttgacggtgtatctgataccgacgatgaagtcaccaacattcctcaaccagtaaggattgttcacccagcagaag

SEQ ID NO: 11259 - DNA, 183 bp, Glycine max
  Peptide Sequence Number=SeqID_128037
atggcagctcacctagaagagctgagacttactcttgaagtaattggctcgcccaagcgagctggttccttcagcctaaagtcttctgagagcccaagcgagccagaggctagcctagatcaaaacaatgaacgatctttcgtcttgtgcggtaaatggtgtcaaacaatgcagttcggctag

SEQ ID NO: 11260 - DNA, 369 bp, Glycine max
  Peptide Sequence Number=SeqID_128038
atggcttcaacggacacttctatcattgccagatcccagatcttcccatatatcttgactttcacgcttatttgtgactttgacgacgaaaaagaatgcaaggtttctagagatatcattctctttgataacaacattgtggcggtagggactactagcgacaacgtatcatcaatagaggaaaacatagatgaggcttcactgttatcaagcgagtcggagagccagcatgaccacagatcgacctccactccctatgatcacacagacccgagtatagggcctaatacctcaatgtgtgtgcaaaggtgtaggtgccatgtgtgcatagaacgaacaaatatttctaactacaaatgcaatagatag

SEQ ID NO: 11261 - DNA, 372 bp, Glycine max
  Peptide Sequence Number=SeqID_128039
atggaggattgcactagagggtccgcactagtcaatcatgaagcatggatccaaactctttcgtggaggatgcatgaacgaaaacgcacttcatggggctccgaaaaaaaggcgaggatggaggattgcactagagggtcctcactagtcaatcatgaagcatggctccaaactctttggtggaggatgcatgaacgaaacgcaattcatggggctccgaataaaaggcgaggatggagtattgcactcgagggtcctcacttgtcaatcataaagcatggctccaaactctttggtggaggatgcatgaacgaaaatgcaattcatggggctcctagaaaaaaaaaaggcgaggatggaggattgcactag

SEQ ID NO: 11262 - DNA, 1242 bp, Glycine max
  Peptide Sequence Number=SeqID_128040
atgacaggccctctcaatgagtcaatctcgtgcttttctcataagggtggaccattgggtactagtaccctcgcctttagagcactacacgtcctcgccttcagagggctacaggccagtgtcttcagaggactacacgtcctcgccttgagagggctacacgccctcgccttcagaggactacacgtcctcgatttcaaaggactgcacatcctcaccttcaaagaactacacgtcctcgccttcagagggctacgcgtccttgccttcagaggactacacattctcgccattagagggctgcatgcctttgccttcagaggacaacacgtcctcaccttcataggactacacggctacacaacctcaccttcagaggactacgcgtcctcgccttcagagggctacacgccctcgccttcaatgggctacatgcactcgccttcagaggactacacgtcttccccttcagaggactacacgtcctcgccttcagagggctgcacgccctcgccttcaacaggctacaagcactcgccttcagaggactacatgtcctttagagggctacacgccctcaccttgccttcagagaactgcacgtcctcgcctttagaggactacacatccttgccttcagaggactgcacgtcctcgccttcagaggactacaagtcctcgccttcagaggactacaagtcctcaccttcagaggactgcacgtccacgccttcagaggactacatgtcctcgccttcagaggactgcacgtcctccccttcagagggctacacgccctcagcttcagaggactacacgtcctcaccttcagagggatgcatgccctcacattcagtgggctacacatccctcaccttcagagggctgcgcgccctcgctttcagagggcttcaagccttcgcgttcagagggctacacgccctcacttttagaggcttgcacgccctcacctttagaggactacacgtcctcaccttcagagggttgcatgccctcgccttcatagggttgcacgccctcaccttcagaggactacgcgtccttgcctttagaggactacacgtcctctccttcagagggctacacgccctcgcctttagaggactacacgtcctcgccttcagagggctgtatgccctcaccttcagagggctacacgtcctcacctttagagggctacacgccctcgccttcacaggactacacgtcctcgccttcaaa

SEQ ID NO: 11263 - DNA, 486 bp, Glycine max
  Peptide Sequence Number=SeqID_128041
atgtcaaaagaccagaagccagattgcatttcggagaggctaaggattgagaaacttggtggagtggtatacgatggatacttgaatggccagttatctatttcccgtgccttaggagactggcacatgaagggttccaagggttctgcctgccccttgagtgctgagccaaagctgcaggaaatcaacctgactgaggatgatgagttcttgattatgggctgccacgacctatgggatgtaatgagtaaccaatgtgctgcaaccatggcaaggaaagaattgatgatacataatgatcctcaaaggtgttctagagagctggtcagagaggctcttaagcgtaactcgtgcgataatttgacagttatcgtgatatgtttctccccagatcctccttctaggatagagacacctccttctcgagtcaggaggagtatatcagcagaaggcctcaatttacttaaggatgtattagactgttag

SEQ ID NO: 11264 - DNA, 144 bp, Glycine max
  Peptide Sequence Number=SeqID_128042
atggggggttcaaatagcaaccaggcccacttgggccttccaggaagttccccagaaggcaccggaaccaacctagctagcctgggcgagctggattttccgccattcttcgttcgttcttcgtcgttcttcggtcttcaaccg

SEQ ID NO: 11265 - DNA, 370 bp, Glycine max
  Peptide Sequence Number=SeqID_128043
tactattcaagaccttttggtgcaacaaggtcttgatcaggcgttagaagatgaaagaccggcttctataaatgaaatcaagtggactaagatccaatggagggttgtgagcatgattcggttagtccttactcctgagataaaaacatgtgttgaaggagacaacaccgaaggcctcacgggagaagttcgagaatatctatacgtcaaagtcgctaaccaatcgtctttgtttgaagatggagttgcactgttgtttttggcctcactaccaaggtccttcaaagctttgattcagacgttgcttgtgagaagatcaactttgaagttggatgaggtgaccactgctctagagaaaatgagagaatga

SEQ ID NO: 11266 - DNA, 234 bp, Glycine max
  Peptide Sequence Number=SeqID_128044
atggcgatacatgacgattgtcgtcatgcagcacaacggagaaatgatgatgatgtgacactcaacaacaacctccggtgcaacagtaagctgtttgaggctggggagcaacttgggcgcaccaagtatcaattggattactcaaactgtcccacaacacctgtgaattctcatgcagaagctggaagttacccgtgtcatgcattagtcggtaggaaattgcacctgatatga

SEQ ID NO: 11267 - DNA, 144 bp, Glycine max
  Peptide Sequence Number=SeqID_128045
atggcctctgtggagacttctgccatggctaggtcccagattttaccaggtatcatccccttcgaagaacatattgcagcagtaggggctactagcaacaatatgttatcaaagagaaaagctctagatgagggttcactgtaa

SEQ ID NO: 11268 - DNA, 252 bp, Glycine max
  Peptide Sequence Number=SeqID_128046
atgactaaagcacgtcaaaatggggtacagaaagaaaatgagggaggagcttgccacccagctcgcccaggtgagctaggttgcttcctccagaaggcaccggcttctggggaacttcctgcaaggcccaacataatgtctggggagggagaaatactcattgcacgcagacagtggaatgaaggcttcgatctcttctccttccctcttatgtctgtaaacctcattagagcaactagaggaaaagcttga

SEQ ID NO: 11269 - DNA, 189 bp, Glycine max
  Peptide Sequence Number=SeqID_128047
atgacaagagtgatgagcaaaatgacggcgacaacgacgaagtctatttcgttgaagcctttgggaagagacagcactgtgaggcgctatttggcggaggagattccgatctctagcgacaatggcattggaaagcatgcaccaaagaaggcggagtggagggcgcagaagccggcaatggcaatttaa

SEQ ID NO: 11270 - DNA, 384 bp, Glycine max
  Peptide Sequence Number=SeqID_128048
atggctcagagacttactgatggttacatcttttggttttttccttttctccattcagcaaatattgtgttatttccattcagttatttgatcaattcaagcagtgaaggttcaagaaatccaatagcagatagcagtcttcaagtgcttcttgttctcattcattatcataaatgtcttgtgagtgagggctactctgtcctaaagaatcaagtatctgcctcttcagattctttaccaaaagagaatacatatttttctaacaacccttactgcagggccttagagcgtgcaactgattgtgaatatttagagggtaatgcacacagtgaccaacttgtaaaattgccttttgcaccgttgtttgatacccttggcatgtga

SEQ ID NO: 11271 - DNA, 1218 bp, Glycine max
  Peptide Sequence Number=SeqID_128049
gatatgaagaggagagggatcaaacctgatgtcattaccttcacagttttacttgatgggagcttaaaagaatattcaggtaaacgtttctctcctcatggaaaaagaaagacaacgccactttatgtttccaccatcttgagagatatggagcaaatgaaaataaatccggatgttgtttgttacactgtgttgatggatggacacatgaagacagataactttcaacaagcagttagcctctttgataaaatgattgagagtggactagaaccagatactgtaacatacactgctttggtctctggcttatgtaacagagggcacgtggagaaagctgttacactgcttaatgaaatgtcttccaaaggaatgacaccagatgtgcatatcatctcagctttgaaacgtggtattataaaagctagaaaggatgatgaagggagtgagcaattcacagaagatggctcagttaactttagaggagagcctattcttaagaaggatactcgcacggccgctatagcggcggagcggcccccatccgcgacgggcacctctttagcggagcagtttcgtgtcgcggctggagcggccgctatcgcggcggcgcgggttctggagcggtgtcttgatagagtagctatagtatccgattatgagagtaaaagtggtgactattctaatccatggagactttgcaccatgacccaggtggaggaattgaaaatcttgatctgcgtgtttccaatttgggccaccgggatcatttttgctgccgcctatgcccaaatgtcaacattgataattgtttcaatcataaggacattcacaggcaaggaaagaggcctctcaatgctgcaaagaatgggaattcgccttttcatttcagttctgtgcatgttatcagctgctgttgtggagattatgcatctgcagctcacaaaagagcttgaccttggttataagcatgttgccgtgccccttagtgtacttcagcaaatccctcagtatttctttttaggggcagcagtagtattcacatttgtggggcagcttgagttcttgtatgaccaatctccagatactatgaagactttaggtactgcaatgacacttctgaacttttcattgggaaattacttgagttcttttattcttactatggtaacttcaccacacaaggtggaaagcctggttggattccttataacttga

SEQ ID NO: 11272 - DNA, 1029 bp, Glycine max
  Peptide Sequence Number=SeqID_128050
atggagaaagttggggtcattcctcattcgtattgctttgctgcttacattgaggggctttgtaataaccataggtctgatttggggtttgaggttctgcaggcatttaggaaaggtaatgcgcctttagaggtttatgcgtacaccgcagttgttcgtgggttttgtaatgagatgaagttggatgaggctctgggtgtgtttgatgacatggagaggcagggggtggttcctgatgtgtatgtttattcttcactgattcatgggtattgtaagagtcataatcttctccgggctttggctttgcacgatgagatgatttcgaggggtgtgaagacaaattgtgtggttgttagctacattctgcattgtttgggggagatggggatgactttggaggtggtggaccagtttaaggagttgaaggaatccgggatgtttcttgatggggtggcctacaacattgtgtttgatgctttgtgtatgttggggaaagtggaggatgcggtagagatggtggaggagatgaagagtaagcgtttgggtttggatgttaagcactacacgacacttatcaatgggtattgccttcagggtgatcttgttactgcgtttaacatgtttaaggaaatgaaagaaaagggtttaaaacctgacattgtcacatataatgtactggcagccgggttgtctagaaatggtcatgctcgtgagacagtgaagcttttggattttatggagagtcaaggcatgaagccaaactctactacacacaagatgatcattgaaggcttgtgttctggaggcaaggttttagaagctgaggcatattttaacagtctggaagataagaatattgaaatctactctgccatgttgaatggctattgcgaaacagaccttgtcaaaaaatcatatgaagttttccttaagctgttaaaccaaggagatatggctaaggaagcttcctgtttcaagctacttagtacactctgcatgacaggtgacatcgcgaaagctgttaagtag

SEQ ID NO: 11273 - DNA, 744 bp, Glycine max
  Peptide Sequence Number=SeqID_128051
atggaagaaaacggaggaaacatccacgctgatagtaccttttgcggttctcctgcggtagttcaagttatacaaaaggtgattgcagagttgatagggacatatttcttaatatttgcagggtgttgttctgtgattattaataacgcagaagagactaaagggagaattacctttcctggaatatgcctagtgtggggtttctcagtgactatcttggtttattctcttgctcacgtttctggtgctcatttcaatccagcggtgcctctttattttattgcgcaagtactaggatctttccttgctagtgggacattgtaccttctctttgaagtaaacgagaaaacttactttggaacaataccatcaggatcttatattcaatctcttgtttttgagatacttacgtcatttctcttaatgtttgttgtgtgtgcagtttccacggacaatagagcgattggaaaattgggagggattgcagttggtatgacaatcatagtaaacgtcttcattgccggaccaatctcaggagcttccatgaacccagctagaagccttggaccagctttggtgatgtgggtttacaatggaatttggatttatgtagttggaccatttgttggtgccatactaggtgctacatgctacaacttgattagatatactgacaaaccactcagagaaattggtgcaagctcaaaaatatttaaaaccagtgcgtgtacaagtgctacataa

SEQ ID NO: 11274 - DNA, 377 bp, Glycine max
  Peptide Sequence Number=SeqID_128052
tcttggaagagtgtttcgaagaggttaaggaggggaaagggaagaggagggtggtcgtggttgatgaggttccagaaagagaggattttgatgatggcggcgtaggtggagatggtatgggagaaaccagtgtggtggagggtttggagaacgtcgaaggtggagaaagaagagggaggtgtgaaaggggtgttggagtcggcgagtgcggcagaggaaaatgggtgccaaaggatgctcaaggtgggattttgtttgttaatggctttgaaggaaagcttgaaagcgcgaagccgcatgagcatggagagaagaacaacatgcggtggtggtcgtggcggctgcttcaccctgcaaaattcgaattttgctattag

SEQ ID NO: 11275 - DNA, 153 bp, Glycine max
  Peptide Sequence Number=SeqID_128053
atgaggccgaggcgctaccgaattgcgaccgtaatcaacttctacattgttcttcgttcgatattctttgttcgtcatccggctaaaggctcaagtggagaagggcgaaggcccaagtggagaaggataaagcccccgaggggagaaggatga

SEQ ID NO: 11276 - DNA, 1464 bp, Glycine max
  Peptide Sequence Number=SeqID_128054
agggctacatgcccttaccttcaaaggactgcacgtcgtcgccttcaaaggactacacgtccttgccttcaaaggactgcatgtcctcgacttcaaaaggctacacgtccttgctgtcataggattgcacgtcctcgccttttgagaactacatgccttcaccttcaaaggactgttcgtcctcgccttcagaggactgctttcctcgccttcatagggctacacaccctcgccttcaaagggctacacaccctcgccttcaaagggctacacgccctcgccttcagaggactacacacggccgcatgtccttgccctcagagggcttcatgtcctcgccttctgaaggccgcacgtcctcgccatcggagggccacacgtcctcgccttcggagggccacacgccttcgccttcggagggctgcacaccctcactttccgagggctgcacgtccttgccttcagaggattgcacgtcctcggcttcagagggctacatgcccttgccttcagagggttgcaagccctcgccttgagggctacatgccctccctttcagagggctacacgccctcgcaatcagagggctacacgccctcgccatcagagggctacatgccttcgccgttagagggtatcacgcccttgcctttagaggactggacgtccttgccttcagtggactgcaagtccttgccttcaaaggactgcacgtcctcaaattcaaagggctacacgtcctcgccttcagaggactgcacttcctcgccttcagagggcaacacgccctcatcttcagaggacaacacgtcctcgtctttaaaaggctgcacgtcctcgccttcagagggttgtatgccctcgccttcagagggccgcacgccctcaccttcagagggtcgcacgtcttcgccttcagagggccacacatcttggccttcagagggccgcatgtcctcaccctcagagggccgcacgtcctcgctttctgagggccgcacgccctcgccttctgagggctgcacgcccttgccttccaagggctgcacgtcctcgcctttcaagggcggcacgtccttgcttctcgccttaagagggctgcacatcctcacctttagagggttgcacatcctcgcctttagagggctacatgtcctcgacttcaaagggctacacgccctcaccttcagagggctgcatgccctcgcctatagaaaactacacgccctcgccttcagaggactgcacgtcgtcgccttcagatggctacaagccggcacctttagaggactgaacatcctcgccttcagagggccgcatgtcctcaccttcagagggctacacgccctcccctttggaggagtgcacatcctcacctttagagagccacacatctttgccttcagaggactacatgtccttgccttgagagggtttcacgccctcgccttcatgggactgcac

SEQ ID NO: 11277 - DNA, 276 bp, Glycine max
  Peptide Sequence Number=SeqID_128055
atggggcatgccacattgcccccactctcttgctattcatgcctaaacgtgcgcccaccaagtgctcggaaatggccccgaggaaacttgcctcaaagagatccaggaaggataaagtggccgaaggaactagttccgctcctgagtatgatagtcaccgctttaggagcgctgaacaccagtagcgcttcgaggccatcaagggatggtcatttctccgggagcgacacgtccatctcagggacgatgagtataccgatttccaggaggagatag

SEQ ID NO: 11278 - DNA, 468 bp, Glycine max
  Peptide Sequence Number=SeqID_128056
atgacggaagggtgtgatgaagggttttgccttgcaaaccttcccggtgatgcttttagtctatggggaaacttctttgaggcaaagaaacaaatgatggctgatgccaagtttgcggggctgcttggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggctttcaaccaagcgcgatga

SEQ ID NO: 11279 - DNA, 441 bp, Glycine max
  Peptide Sequence Number=SeqID_128057
atggagtatgaaaagattcatgctagcccaaatgattgtgtggaagaaatgtcttccaagattattttgatgatgccaaagaatcaagagtcaagcaagttccaaagaatcaagagtcaagcaagtttcaagaatcaagatcaagatttaagattcaagaataatcaagatcaagattcaagtaaagcatcaagactcaagattcaagaatcaagagaagactcaatcaagataaagtttctaaacgttttgattttcaaatttaaacaagaagagtcacatctgttgatgactgttgcaacctacccttcggtgggagggcgacgcgagactcacgggtgcgtgttccaagaaaggaatacgcgcggagttgccaccaacgtttatttgaggaaaacgttggaaaaactggaaaagacgtggtctacgaactttaaatga

SEQ ID NO: 11280 - DNA, 468 bp, Glycine max
  Peptide Sequence Number=SeqID_128058
atggatgaaaatggtaaagttataagaaacaaagcaaggttagttgctaaaggttactcacaacaacaagggtttgaaactaaaacctttcctcaacatgtttttaaactcaacaaagccctatatggacttaaacaagctcctagagattggtacgaaaaattgatgtatactgaattcgaaatgagcatgatgggagagttgaaattctttcttggattgcaaataaaacaaacaccccaaggcatctacattcatcaaaccaagtatgtgaaagaattactaaagaaattcaacatgagtgatgcaaaagagatgaagactcttatgaatcccactacataccttggactagatgaggaatcaacgaaggtggacgggacacagtacaaagcaatggttgtgttaactcattggcaagtgcaccaaattgtcccaagtagtaaagtaaaatggaagtccgagtaa

SEQ ID NO: 11281 - DNA, 324 bp, Glycine max
  Peptide Sequence Number=SeqID_128059
atggatacccgcatcacccagcttgaagaggatgaattaaattgtcatcatcaaaaagggggagaatgtagaagcaaagactttgactttggtgttttgatgatgccatatgatcatgacgtgttgatgtcttatggaaatacgcttctcaagattaattcaagacaacaatccgagaatacaagatacaacatcaagaagatgtctagtattttaggaagggaattccaaattgaaatagcaaaaggtttggccaagaaatttaagttaaaaagtctttttcaagagatttactctctggtaatcgattaccagaagatgtaa

SEQ ID NO: 11282 - DNA, 153 bp, Glycine max
  Peptide Sequence Number=SeqID_128060
atgcaaattgaagatttgaagatgctcgctcagaagagcacgcttagcgcaaagagtcagatggagaaatctgatcatgaaggggcggtcagcacaaggttaccgccatactcgctaagcacagcaatcacgcttagcgcaaaagttgcatga

SEQ ID NO: 11283 - DNA, 399 bp, Glycine max
  Peptide Sequence Number=SeqID_128061
atgggcccgaaatctaccctaaggctcatgggaaccctagggccttctcttgcatctctagcccaatctttttggagtcttctatccaatgcccttgggggacatgttgagtttgtcaacaagaagagaatttcctccaaggttttagcaatgaacgtaatgttgtcctacaatactatttttaaagatacaagatgtctgggtgaggtcaatacttaccaggttggctgggaggagaactatgactcccatgtcacaagagctctctatagggagaatattgacaaagctggtgatcaaaagacgattatctacaacctgatgtgtgagaaagctaagatatgggccaatattttgaacaaagtgttctcaataaaacaggttccaaaacaaccctaa

SEQ ID NO: 11284 - DNA, 264 bp, Glycine max
  Peptide Sequence Number=SeqID_128062
atggcacgcaaagacaaatatggtcatctgctccctttgtcgaagactcaatgtcttcatgctttcatgggttttactgcttggacttccactagtggccagttggatggtttcgcgacgtttcagaaggaaatgagcaggaaattcaaagtaggggaaaatggtctattttgggacattcttctgcccctgggccctcctgggcccattagaagacttagggtggctgaggggaaggccctgggcccacccaggcaagcttag

SEQ ID NO: 11285 - DNA, 726 bp, Glycine max
  Peptide Sequence Number=SeqID_128063
atgaggactttgagtcctatgaaagataaagactttgagccctctaaaggcgaggactttgagtcctctgaaggcaaggaatttgagtcctcaaaggcgaggactttacgtcctataaaggcaaggactttgagccctctgaaggcgagaactttgagtcctcagatggcgaggactttcagccctctaaaggcgaggactttgagtcctctgaaggactttgagtcatatgaaggcgaggactttgagtcctgtgaaggcgagaactttgagtcctctaatggtgaggactttaagccctctaaaggcgaggactttgagccctgtaaaggcgagaactttgagtcctttgatggagaggactttgagtcctctgaaggtgacaactttgagtcctctaatggcgagggatttaagccctctaaaggtgaggactttgagccctttgaaggcatgaaatttgagtcctctgatggcgaggactttgagccctctaaaggcgaggactttgagtcctctgaaggcaaggaatttaagtcctctaaggcgaggactttgcgtcctatgaaggcgaggactttgagccctctgaaggtgagaactttgagtcctcaaatggcgaggactttgagccctctaaaggcgaggactttgagtcctctgaaggtgagaactttgagtcctttgatggtgagaactttgagtcctctaaggcaaggactttga

SEQ ID NO: 11286 - DNA, 534 bp, Glycine max
  Peptide Sequence Number=SeqID_128064
atggcacgtattcaaacgattaaccgcgaaactgctagcgcagaagtcaatgcaacactggatgctgtaaaagccaaattgggcaaagtgcctaatttgattgccacattggcacaggcacctgttgcattaaatgcttacctgagtttgagtgaggcggcgagcaaaggccgcttaagcgcaaaacaaagagagtcactggctttagcgattggccaggcgaatagttgccagtattgcttgtccgcgcacagcctgattgcaaaaggcgcaggtctgaatagcgaggccatccagtcggcacgccaagccagtgcagaagatgcgttgactgatgcgctgctcaaattggctgtgaaaattgtgcagcagcgcgggttactctcagatgaagattttgcagaggcttatttggcaggggtggatgatggcctggtgttagaagtgattaccagcgtggcgttaaacaccttgaccaactacaccaaccatatcgcacagactgacattgatttcccggtcgtgactttataa

SEQ ID NO: 11287 - DNA, 762 bp, Glycine max
  Peptide Sequence Number=SeqID_128065
atgcaattacattatcaagttcacgcccaaaaccagggcgaaggcccgccgctcgttctgctacatggcttgttcgggtctgctgataactggggcagtatcgccaaacatttctcgcagcactatcaggtgatcagcgttgatttgcgaaatcatggccgctcgccgcatagtgcgtcgcaaacttaccctgaaatggcagatgacttgtcagcgttatgcgacgccttagggttagcgcaaattcatttacttggccattctcttggcggcaaagtcgccatgcagtttgccacgcaatatccccaaaaagtcagaaaactcattatcgtcgatatggcgatgcgcgcttatcaagacagatatacgcagctcatggatcacatgctggccgtcaatctcagccaaatggcctcgcgtagtgaggtagataaggccttggcggatgcgattccaaatgtgagggtaaggcagtttttactgaccaacctggtcaaccatgaagggcagttacagtggcggattaatttgccagcgcttaaagcgaattacgctacattgattgcggcagttgccgtgcactttgacccgcctagcctgtttattcgcggggagcgcagtgattatgtgcaggatagtgacatcaccgaactacagcagcatttcgttcagtctgaatttgtgactttgccgaccgaccattgggtacatgccgagcagccgcaattgtttattcaggcagtagaagactttctttcctaa

SEQ ID NO: 11288 - DNA, 249 bp, Glycine max
  Peptide Sequence Number=SeqID_128066
atggagtgcagcatctgtggagtaaaaataaaatctgttggacctgtcgagagagcagttgcaagaacaaatgtggatgcaaagggaacaaatggaataggtgctgcagccgaggaaggggaagccttagaagatgggggagcctcagacctcctcccttttgccttgcgtggccctctgaaagttactgagaggactcaatctctcatgggtcaaggaatcagagtggactccccgggctttacataa

SEQ ID NO: 11289 - DNA, 144 bp, Glycine max
  Peptide Sequence Number=SeqID_128067
atgttgcgcttagcgccaccctcgcacttagggcggattctccttcacgctaagtgcgctgaagcttcacttagcggtggatgcgcgcttagcccaattgctaagctaagctcaactgtcacttgtttgcacttcatgacttag

SEQ ID NO: 11290 - DNA, 1896 bp, Glycine max
  Peptide Sequence Number=SeqID_128068
atgctggccaccggggtaatccaacccagccacagccccttctcttcacgcatcttactcgtaaagaagaaggacggcacatggcgttgctgtgtggactaccgggccctaaacgcggttaccgtcaaggatagatttcccatgccaactatcgacgagttactggacgatctgggcagtgcttcgtggttctcaaagttggatctacgccaaggttttcaccagataagaatggccgaggaggacgcgcacaaaacggcatttcgaacacaccagggccattacgaattcctcgtgatgcccttcggcttgtgtaatgcgccctcgacatttcaatcagccatgaacgacgctctccagcctttcctccgccgtttcgtcgccgtgtttttcgacgatatactggtatatagtccggacttatcctcccacgtgtcccatttggaagccgttctatccattctggccgaacgcgcattcctcttaaaacaatcgaagtgttccttcgcgcaacgcaagctcaattacctgggccacataatttcctctcagggggtggccccagaccccgacaagatcacaacaatgctcgaatggcctctgccgacgtgccccacttccctccgcggattcctggggttgaccggattctatcgcaaattcgtcaaaggctacgctgcaattgcggcgccccttaactcgctccttcgcaaagacaatttctcgtggtcccctgaggcgcttcaggctttccggcaactgcaacaagctatgaccaccgcacttgtgttggccaatcctaatttcctcattcccttcgtattggaaacggacacctcaggcacatccatgggtgcggttcttctacaggaaggtcacctaatagcgtattacagcaaggcactctgcccccggttacaacgagcttccgcctatgtccgggagttacacgccattaccgcagcagtgcgcaaatggcgtcactacttgttgggacattcattcataatcctcaccgatcacaagagtttaaaagacctgatgtctcagacaatccaaacaccggagcagcagacctacctatccaaactcttgggttttgattacaccatcaaatacaaaccaggtccggccaacgtcgttgccgacgccctctcacgcatccctccgagcgaggccacgtgtcttactctgacggttcctcacttcctcttcttacagaacttgcgtcaggctctgttatcggatccacaatacgcggcactcctccaggatattcgtgatcaccctacggcccatcccgacgtcgtccttcatcaggacctccttttccagaacggccgtatttggctcccttttccatccccattcactcaggttctattagaggaattccattcttcacctctaggcggtcataccggcgtcgcaaagaccttccatagactcagccagaatttcgattggcctcaccttagggaggacgtccgtcgttatgtggcccaatgcgccacgtgccagcagacgaagtacgagacgaagaagagtgccgggcttcttcaacctctccccgtccctacccacgtctgggaagacatatcgttggacttcgtgacagggcttccgctatctcaggggtacacggtgatcctggtagtggttgatcgattttcgaaggcagcccatttcggtgctttgcccacccaccacactgcctacaaggtggcggttctattcctggacatggtctgccgtcaccacgggtttccgcgcagtctcctgtcggacagagatcccatcttcgtcagcaacttctggcgggagcttttccggttaagcggcaccaagctccgtatgagcaccgcgtaccacccccaaacggacgggcaaacggag

SEQ ID NO: 11291 - DNA, 774 bp, Glycine max
  Peptide Sequence Number=SeqID_128069
atggcttcagagacagaggtgttaaatattatttcctctgttttcgaacgcttcgagagaaacatgtctctgtttctgcccttcatcttcggcttctctgacgccacctcaggacgagatagcgacgacccagatcacgaaactgctcacacagaaggttcactgcgtcaaagaataatcttggtgaaccccttgactcagggcatggtggtgatcgacggcggtttgagcctcgaagctctgtttcgcgaactcgccaacgggaaaggtggtcgaccaccggcttctaaggagtccattgaggccttgccaagtgtggaaattggagaagataatgaggatttggagtgtgtagtttgtttggaggagtttggggttggtggggtggcaaaggagatgccttgtaagcataggtttcatgtcaattgcattgagaagtggttggggatgcatgggtcttgtcctgtgtgtaggtatgagatgcctgtggaggagattgattgggggaagaagagggaagaggaagtgggagagaggagaagtggtggtggtggtgaagtttgggttagttttccttttaataggagtagtaggagaggccaagatcttgatcaagctcaagctgttgctggtgattcaaatgatgatgattcttcatcaactcatggaggtgctgctgaggagatcagagatttataccattttaggactgaaaggaaagatgagaggttcatgaaggtttctcttattttctggtcaaagttaatccaatga

SEQ ID NO: 11292 - DNA, 162 bp, Glycine max
  Peptide Sequence Number=SeqID_128070
atggcggcatcacccgacatcatttttgatattttgaattccaaagaagcttctctttgtgcattgaatgggatctgctttgctgggaagcacattaagcttgaacccggtcttcccaagattgcaacatggttgctactgccacttattttttatttttaa

SEQ ID NO: 11293 - DNA, 855 bp, Glycine max
  Peptide Sequence Number=SeqID_128071
atggtaaaagatggttatcagtggaagaagtatggacagaagaaggttaccaaagacaatccttcgcctagagcttatttcgagtgctccctggctcctagctgctcaaatttgaaaaaggtgcaaagaagcatacaggataagtctatccttgttgcaacttatgaaggaaagcacaaccatggtgtttttcatgatttactcaagccatcatcttctatacccgaaacctcaataatgattaataatttacctataacaaacatgcctaacgacaaagatacgttgaacattgaccttgctctatgtaattcggatcaaacagatataagactttgtgatgatgttaagcaacagaaccaccgtggcagcaaaagcaaaattgaagaatatgtaactcctctagttaaagatcctgacttcatcatgccattagctgaagcagttgcccactccctcaagagccagacttataagcaagaagaaagggagaaggggatagacatgattgttgtttcggagaagagtgctggaaatgatgctaacaagtgtcttagtaacaccagtgacgccaacactgagggttcaatatggggctacttcacgtgcagagaagaagccgccaaggctgcgcgacacacagtgaagaagaccatgaagcttgcgcgtggaacatgtgaccgcacttgggtagcaagtgaagtgcgtcgtcggcgtcgtcgaactcctccaaacacaccgcacactgaaacgcagggttttgcgcgcctagggttgttcttcgtgggagcagtagcaaatgaagatggagcagaatgtggtgaagaggagggcgaagaggaagatcacgagtaa

SEQ ID NO: 11294 - DNA, 168 bp, Glycine max
  Peptide Sequence Number=SeqID_128072
atggaagatgttcaaatgacagttgctgaagatacccctagaccttcaccaaaaattcacttaaagaagaaggccttgaaacttaaacacctcaagcgcaaagatttaagcttcgacttggataagggtgttagaattaatgtatcatgtgagaggcatatgacttag

SEQ ID NO: 11295 - DNA, 315 bp, Glycine max
  Peptide Sequence Number=SeqID_128073
atggctcaagtgaatgttccaatgctactacagtttaagaattctgctctctttggaatccaaccaaactcgtttgtttgctttcagacacaaagtaaaagtataactaagaaaccattagtgattgaagccagagccagagcaaatactagaaaagaaagtgcaaaaattcggaacagaaggatgcagaaaaaggaagctgctcatcgtgtcggagaggcacttgtcaaagcttgtgttgatctcaacataagtgaaatatcatcctatgatcacaatggcctccattcaagctatggattcttaccaagataa

SEQ ID NO: 11296 - DNA, 1953 bp, Glycine max
  Peptide Sequence Number=SeqID_128074
atgaagaagttgtatggaggagttctgattgcctcactgtttacgttgtttatgcttatgatcctgcgatacggggtcatgaaaaatcctattggtgaaggttatctgactatacctgtcctcattaatggtactaatcctctattatggataaatcccacagtaccggatgctattaaaaaacatccagatggtcattctcaagttatttcttctgatattttagtatctagcctctttactgggagcaacttttccaaagaagagcaacaagctctgcagacatggaaccaattgaaccacttaattgataatgttcagggtttacccaatgcagcagaagctatcaaggaggctgccagtgtgtggaatagccttatttcctcaattgaagagcaaaagcaaggtcatggaaatgatagttcaagagctaaagagaagcagtgtccccattttcttaataacatgaattccactgaacttggtaatagtagttataaactgcaattaccttgcggcctgacacaaggttcttccatcaccataattggcattccaaatggcctgctaggtaattttcggattgacttgactggagaaccacttcctggggagcctgatcctccaattgttttgcactataatgttcggcttcatggggataaaatcactgaggatccagtaattgtccaaaactcctggactcaagctcatgattggggtgaagaggatcgttgtccatcccctactcctgaaaagtttgacaaagttgatgatttggagcagtgcaataagattgtagggaagaacattagccaacgtcacccagctggcatgcattcccacacttcaagacaatcttcaacaatggacgaacaatcagtaaataggaaatactttccttttaagcaaggttacccatttgtggcaactcttagagtgggatctgaaggaatccagatgacagttgatgggaagcacataacctcgtttgctttccgtgaaactttggagccatggctagtcagtgaaataaaaatctcaggggacctcaaattaatatctattcttgccagtggtttgcccacatcagaggattcagagcatattattgacctagaatcattgaaatcaagtcctatatctgcacagaccccattggatctcttcattggtgttttctctactgctaacaatttcaagcgtcggatggctgttagaagaacctggatgcagtacaatgcagttcgatcaaatacaacagctgtgcgcttctttgttggtttgcataaaagcactgtagttaatgaagagttgtggagagaagcacggacttatggagacgtgcagctgatgccatttgttgactactacagcctcatcacctggaaatctttagctatctgcatttttgggacacaagtttctgcaaagtttgtcatgaagacagatgatgatgcatttgtccgggtagatgaagttctagactctttgcacagaatcaatgcggatcatgggttactatatggactcatcaatttggattccagacctcatcgaaatacagatagcaaatggtacatcagcccagagatatcagttgaaagtgttcgtctctttgtgcaagaatggagcgaaggaacttatcctccttgggcacatggtcccggctatgtggtctcacatgatatcgctaggacggtgtccaagaaattcagagagaaccatttgaagatgtttaaactagaagacgttgcaatgggaatctggatcgctgacatgaagaaggaaggtctagaagttcgctatgagaatgaggtcagagtgtaccctgaaggttgtaaggatggttatgtggttgcccattaccaaggccctagggagatgctctgtttgtggcagaagcttcaggtagataaacgtgcaaaatgctgtggtgatagtaggaaatga

SEQ ID NO: 11297 - DNA, 321 bp, Glycine max
  Peptide Sequence Number=SeqID_128075
atggatcaggtttggggatggctttcatgtctgcaaggtttatgtcaacaaaagtcggaaggagttgatcggccgcaatggtccacatttagtgatgttaactactcaggttctctttcatccacatttggtagcaagtatacctgttcaattatggatattcctttcttcttcaacttctttctattcatgtcaaagtttctcatccaaaagaaatttgttatgaaggaaaaagctttagcaactgaaggagagaaggaaaatttgatgacagattatgtcttaagggactggaggggagatgctggttggactagctaa

SEQ ID NO: 11298 - DNA, 453 bp, Glycine max
  Peptide Sequence Number=SeqID_128076
atgcgcaaggacattgatcgtccaatggcaagagaagaatgttgcatagtaggttcggctcatccagcgctgcttgactatttggaagtggccatcaaaagacaaggaagtgcaagtgaatctgaagatgacaatgagagaaatgatgttgtagaggaagaaacagatgatgatgacaatgccttttttgatactcatgattggtacaacagtagctacaagtggaccaacagcttgcaactaccatttcgtcttcggccttcaaaaaattgttgtttgggctgcaagattgatctcattcatttgttgcgtgaagatactccaccagaatggatatttaaggaaattcaaaatattggaaacatagatttcagatttgtggaagagcagcctccacatgattattctgttgagcttgcagttttggttcctatcagtgttgaaaatgattaa

SEQ ID NO: 11299 - DNA, 249 bp, Glycine max
  Peptide Sequence Number=SeqID_128077
gtgagggcgtgtagccctctcaaggggtggacgtatagtcctctgaagatgagggtgagggcatgtagccctacaaaggcaagggcatgttgccctcagaaggtgagggcatgcagccctctgaagtacccaagggtggcgagggcgtgcatccctctgaaggtgaggacgtgcagtcctctgaaggagagggtgctagtacccaagggtccacctgatgcaatcctatcccacaagggcattgggtag

SEQ ID NO: 11300 - DNA, 172 bp, Glycine max
  Peptide Sequence Number=SeqID_128078
ctctggacaagcggaaagcgcagctgggaggcagcctagtatcctttaaattcccagtaattattaccggggatggcctcaggcctaggttgtggtctgaaatgatagggcaagccacattgcccctattcccttgttattggtacccaaaagtgcgcctaccaagtgctcg

SEQ ID NO: 11301 - DNA, 342 bp, Glycine max
  Peptide Sequence Number=SeqID_128079
atgatgctagcgcgctctctccctcagcacactagctctctccgtacctctctctccctctcagccaccctcacgcaccacacctatctctctctcaagtattatgaaggtggcatttcatcagtttacatgtgggaagatgataatgaagatggctcaaagacagggcagggtcgacggggatatttagaggaaggtgcatgggatgctatacatgttatagagattagtatgaagctatcagttgctgatggtcatctttgtaacatgggaaggatgattgaagaaatggagagtaagctgaggaactcactagatcaggttatcgtgagcaaggaatag

SEQ ID NO: 11302 - DNA, 417 bp, Glycine max
  Peptide Sequence Number=SeqID_128080
atgggcgtcgtcaagtacatgaccattgatgaattaaagcgcccaagcatcccctcagaaatgcttaaattctttaaccactttagtttcccacacaagagacatccgacaaggaaaatcagcatgcaacagggacagacatatattctcgtagctacgttccctgaccctaactatggtgttaaaacgaagaagcttgggacgttggggaagggttttgaaagaaagaaggagaaaggaataaccattttccaaggctacacgaaaaacaaagcttgcaacactcaagtgtttctgctctcgggaaaagaagcggttctcacacactatatgacatatcgcagattgcaacggtcagatcgtgggaatctgtcctttgaacctctacaccaaatttcgagaagatccaatggttaa

SEQ ID NO: 11303 - DNA, 267 bp, Glycine max
  Peptide Sequence Number=SeqID_128081
atgtcgactgaggttgtcaagaattcttggaaaaaaagagcaaaggaatcagtcatgattagcaaaggggaggtacagcttgaccgtgccaaggtattcacgaagtctgcagttctaatgaatttagagtccagagtcaacaagaaatgtgaaaaatgtggccatggggaagctatctattatactagactgatgagatcagcagacaaagggcaaactactttctacacatgtatcggctatggtcatccgtctcaggagaattag

SEQ ID NO: 11304 - DNA, 301 bp, Glycine max
  Peptide Sequence Number=SeqID_128082
tgctaaaaggagtagttgcgctaagcggaccgtgtgggctcagcgcgcatccgctgttaagcgtagcttcagcgcgctttgtgagacaagggaatctggaagatcacaagaatcatggtcacgtgctaaagcgcgagatcagctcgctaagcaagacgtttgtctctttccaggctcagcgcacgaatggtgccaagcccaaatccacttgctcgcgctaagcacaagggtggcgataagcagtattcgagataatgctcaggaggcagcaaagaggagcagttgtgcagagaagcctagg

SEQ ID NO: 11305 - DNA, 954 bp, Glycine max
  Peptide Sequence Number=SeqID_128083
atgaccactcttgctcaaacttggagtgttctttccttttttaacctcatccccacttcccacacttctgatgtcactcttgatagagccaaactcatttatgacattatcatgaagatggacatgaatgtggggtacctcatctcccaccagatctccctcatagcacagcatgacacatccagactaggattccctgccttgatcacagctttatgtaaggctaggggagttcagtcaaattcgaggtccttggagagcctgagtcttaccattaattttgcatatattaagaagaactgttggaatcttgatgatccaacaataactttcaaaggacccaggaaggccaagggtaagagatctgaggccccttccacttcagcaccagagacaccagctccttcttcgtccacaactccattacctcccattctgactctagttattcctcctacacccacacagataccatttccagctccattctctccaggaccattagattttacttttacaccacagatgttgcactccatgctccagagcatccatagggggcagtccattataatgcagagccttcagggcttgggcttgccctccattatgagcatagaggagtttgaggctcaggtggcctggcgaggagaccagccctcttcttctaggaggggtggggcctctgcagcccaggagcctgatattgaggagccaccagcaccaacaccagcaccagcagaggaggaaactactccagatcagactccacagccatctccagcccctgcacatatacctgaggatgttgcaccagttgcagagcctgagcagcttatacaggattcatcaacaactccaacactggatcttaatgaagaccagccacaggaggagcaggattttaaatttttgcattctaaacactttagtttattttcagttattttatga

SEQ ID NO: 11306 - DNA, 386 bp, Glycine max
  Peptide Sequence Number=SeqID_128084
atggcgctttcggcttccgacgtggcagcgatgtactcgctgctttcgaattccatgagcgccgatcaccgcctccgcggtccggcggaggacgcgcttgcgcaatcggagtccaggcctggcttctgctcctgcctcctcgaagtgattaccgcgaaggatttggcgtcgcaaacggatgtgcgcatgatggccaccgtctatttcaagaacagcgtcaaccgctactggcgccaccgccgcgattcctcgggaattagcaatgaagagaaaatgcacctgaggcagaagttgttgatgtactcgagagaagagaatgatcagatagctctgatgctggcggtgctcatctccaaaatcgctcgcattgattatcccaaagaatg

SEQ ID NO: 11307 - DNA, 947 bp, Glycine max
  Peptide Sequence Number=SeqID_128085
aggactccacgtcctccccttcagaggactgcatgtcctcgcctttagagaacgacacgtcctcgccttcgaagggctgcatgtcgtcaccatcatagggccacatgccctcacctttagagaactacaggtcctcgcctttagaggactagacgtcctcgccttgatgactaaaggcgctcaccttaagagggcgacacgccatcaccttcagaggactacacgtcctcaccttgggtactcatacccttaccttcagaggactacacgccctcgccttcatagggctactcgccctcgccttcagaggacaacacgtcctcacattggggctacatgccctcgcattcagaggactacatgtcctcgccttcggaggactacacctcctcgccttctaagggggttgcacgccctcgccttcatggggctgcactaccttgccttcgtagggatacacgccctcacctttagaggaccacacgtcctccccttcatagggctacatgccctcactttcagaggactatgcgtcctcacccttagagggctttaccccctcaccttcagaggactggatcccctctccttcgtaaggctacaagccctcacctttagaggagtacacatcttcggcttcatatggctgaacgccctctgcttcctagggttgcacgccctcgccttcagaagactacacgtcctcggcttcggaggactacatgtgctcaccttcagaggactagatgtcttcggcttcagagaactacacgttcttaccattagaggactacacgacctcatcttcagaggactacacgtcctcgtcttaagagggctacacgccctcgccttcgtagggctgcacgccctcacctttagaggactacacgtcctcgaattcatagggtgcacgccctctccttcagaggactacgcgtcctcca

SEQ ID NO: 11308 - DNA, 699 bp, Glycine max
  Peptide Sequence Number=SeqID_128086
gctgatgagaatcctagggccttctcatgcatctcttgcccaatcttcttggagtctcttagccatggctctggtgatgggtctcctccttggaaggattgcatcagtaggttaccagaagaaaacatgttgccaaaaagttactacgaggcgaagaagatactatgttcgatgggttttgagtatcagaaaattcatgcatgccctaatgattgcatactataccgagatgagtttgaagaaattcataaatgccccaagtgtggggtatcattgtacaaagtgaaggatgatgagtgtagtagtgatgaaagcataaagaaacatccccgaacaaagccaggaaatgacatcaatgtttatctaagtcccttgattgaagacttaaaaaagttgtgggaggaagggattgacgtgtttgatgagaatcaaaatgagaccttcaagttgcatgcaatgaaaaatgcgtgtgatagtgtaatatacatgcttcttaataataaaggcaagactaaggatggtttggatactcgtcaagttctaggtgatataggcatacgtaaccagttacatccaaggtttgatggtataggtggtgatggtacccctcttccaggaggagacaatagattgttgattgatgtcattacagcccaaatgcaaaacaattccaagctagaggagtccattgcgtggtga

SEQ ID NO: 11309 - DNA, 1368 bp, Glycine max
  Peptide Sequence Number=SeqID_128087
atggtgttcccgtggacaacgtgggtgaagccaaaggaggctggggggggggggcatcttatggatcaactcatcaatcttaagagtcatggtgtgcacagtttcgctcaaggaaagctgatgggagagcaccaaattgatagcaactctaggcttcgagggctagaatcctccgaagaattcaaggaaagagggaaacaattgagagaaaagcataatcctaacagaaaggaatctaaggcactaatggcagacaaagctaaggaaatgaccagctcagcacatcacacgaaatcctttaggtatgctgttccttttgggcctgtttactgtatgcacctccttcttgctattagcctccttcttgctatcacatacccaattgggtgttacgacacattggttctacatttggagtcaaaagaactcagattcagattgagagtcattttccacagctttgatcaaaagatttggagattgctatggaccaacatttcagagttgaaaaacatgttgtgcaagatattgaatgaagaagttgattcccatgcctctcaacaagacaaaaatagcatggaggaaagtgggtcagaatgccgtgaagcaaaggctagttcttggacaagaaagatgaaactacccaactttgatagaaacataaaagggggaactgatttaaaggatagtagttttgagtgtgacagtgacccattgcagttcttgaaatcagaaaacaaacaagaaaccaaaaatgatgaagcaaaattagcaagagaaacaatgattgaaaaggttatggaggaagaagttgattcatcaataaaaagggagaagcacaaggagaatagagtaacggatgtggttggaacatcaatggtactggaatcttggaatgtcaacttgttgggtgagcctctagcattaaattttgttgcaactatggatgacaactcgacaatggagccaaggagtccaccctcatccccaccaccaccaaagccgccggacctgagtttgcatgaagtggccagtgggttcatagttgatcccccatggagggacaccaaagaggaataccctgttagtgtaaatgattcaattcttaaggatgagaaagagaaaggggggagttttggaattctgcaaaggaggtggaaagagattgaagcatcacacatggaggtccagtttaatcagaattttcttccatcccgatctccaccagagccaccgaactcaaccccgcatgcagggacagcaggttattcccagttaagttacaagaagtgcaaatgtcttccagcaatcggagaaaacttgaggagatttcagtgtgcatttccagttttcaaattccaaccttga

SEQ ID NO: 11310 - DNA, 2637 bp, Glycine max
  Peptide Sequence Number=SeqID_128088
atggaagctaacgggattggtgaacttaagatacctttgttgcagactccggaagatggcgccgttaggacagtttatttccaactgagtgacatcaagtgtgcctcctgcgtgaattccgtcgagtccgtcgttaagaaccttgacggcgtcaaaagcatcgccgtatcgccacttgatggaagagccgcaatcaagtttgaccctaagttcgttacactggaaaaattactttcaggggaaaccaaacgtaatagcaaactgagtttggatgaggcaaaagtgaaacaaataaaagaaagcatagaggagagtgggtttcgagtaaatgagcttcatgagcaggacatagcagtgtgccgagtgaggattaaaggaatggcatgcacaagctgctccgaatctgttgagaatgcccttcaaattgttgaaggggtgaaaaaggcaattgttggtcttgctttggaggaggcaaaagtgcactttgatcccaacctcaccaatgttgacaagataattgaggccatagatgatgctggttttggggctgatcttattagctctgggaatgatgcaaacaaagtgcatctaaagcttgaaggggttgattctgcagaggatgtaaatgcagtaatgtcttctcttgagttagctgtgggggtgaaccacgttgagatggatttgtcagaacataaagttactgttagctatgatccagacattacaggtccaaggtctctcatttactgtgttcaggaggaagctagctgtggctccaagaagtatcaagcaaccttgtactctccttctggtcaaagagaaagggataaggtgaatgaaatccgtatgtatagggaccaatttttgttcagctgcttattttctgttcctgtgtttgtatttgccatggtgcttcccatgcttcctccttatggaaactggttaaactacaaggtccacaatatgcttactcttgggttgtttttaagatgtattcttagcacgcctgtgcagttcatagttggcaaaaggttctatgtgggatcatatcattcactgaagcgaaaatctgctaacatggatgtgctggttgcgctgggcacaaatgctgcttatttttactctctctatattttaataaaagcgctgacttcagatacatttgaaggacaagatttctttgagacaagttccatgctgatatcatttattctattagggaagtatttggaaattgttgctaaagggaaaacatctgatgctttaggaaagctgactcaacttgttcctgataaagcttatttagtagcaattgatactgatggaaatataatcacagagacagaaattgacactcaacttatacaaaaaaatgacataattaagattgttcctgggtccaaaattcctgttgatggtatagttataaaagggcaaagctatgctaatgaaagtatgatcactggggaggcaagacctgttgataaaagcccaggagataaggttatcagtggaaccattaatgagaatggctgcatactggttaaggccacacatgttggatctgacactgcactttctcaaatagttcagctcgttcaagctgctcagctggccaaagcaccagttcaaaaacttgccgaccatatttcaagggtttttgttccaatagtggttgttgtagcactaattacttggcttggatggttcattcccggggaagctggtatttaccctaaacattggataccaaaagcaatggatgcatttgagcttgctttgcagtttgctatttctgttctggttgttgcttgcccatgtgctctgggtcttgcaacaccaactgcagtcatggttgcttctggcatgggtgcttctcaaggtgttctcatcaagggtggagatgcactggaaaaggcacacaaggtaaaaattgttgtgtttgataagactgggacactaacagttgggaagccagaggtagttagtgcagtgctgttttctgaattttctatggaggaattatgtgacatgacaattgctgtggagcctctttgcatatgcaaggataaggctgcgtacaacatccctcccccataccttcgcatagcgaagagcctctgggcaagtagtgagcacccaatagcaaaagctgttgcggcacatgcaaagaggctgcgccagaaatttggttcttgcactgaggaagtcccagatgtggatgattttgaagtacacatgggagctggggttagtggaaaggttggtgatagaacagttgtggtaggaaacaggagactcatgcatgcttgtaatgttccaatatgttctaaggttgagaagtacatctctgaaaatgaaattctggctagaacttgcattttagtttcaattgatggaaagattgctggtgcattctctgtaactgatcctgtaaaaccagaggctaaacgtgtcatttcttttctccattctatgggcatctcaagcatcatagtgactggtgataactgtgctaccgccactgctattgcaaatgaagtaggtattgatgaggtcttcgctgagatagatcctgtgggcaaagctgataaggtgaaagacttgcagagtgttaggaaccaagaattgaaatga

SEQ ID NO: 11311 - DNA, 675 bp, Glycine max
  Peptide Sequence Number=SeqID_128089
atggttgggaaacctccaaaatttgcccagttgcatatctatgatacaaaaaatgaaattgaaaatagaattggtggaacaagatggaaaaataatcttgattcacagcttgtgtcgaagttaaaagaaatgtttgatgaatacaatgtgttcgctaagtcttttaggatggccaaggaaagttatgataactttcagatggagaatcttaatttacaattgatatcaggcatgaaaaaagatggaaggatttataatttgctcaaaatttcaaatgtggttgcagttattataggtgatgcaagtcaacctatcaatcgagacataatacttgaaaaacaaagtggcagcacgatctctcacccttccctttctctctcgtggttgagccccagacctttcccaacctcaaggaggccgcgcgcgaactccaagcccaagaggaagaagggaacttacgtgcgacaagatggttgtgcgaccgcgatagtggtttcggccaacaccttatgtgcaacaagatgctcgcacgactgctacaatggcaacaataaaggttcgtggggtgaaggaaacagaagatcctacgacaaattcgacaaggcggtccgttgcgtgaggttgatcgaacggagccaccgaggctggagttggatctgtcgcgagacgatctga

SEQ ID NO: 11312 - DNA, 507 bp, Glycine max
  Peptide Sequence Number=SeqID_128090
atgggtgtcaagttcctcaaagcggtcaagcaaaggttgcatgccatcaaacaatggtctccggacgaaattagggggtataccctcattgttattacccaatggcagaactgcacattccaatttgttattcctgtgcctacattagaaaactccacattcgaatttgacattctaattacaaaatttgttgatcctattgaatccattgtcacccatacctactcaaatatccaatacaattataacaatgaagactttctaaagtctagagctatactagcttcagacattgagactatagaccaaattaatgagtatgtattaaacattgtgccaggtgacgagaaagaatatttaagttatgattccattgacatgactgattttgtagaaagtcaaggttaccaagctattacaccagagtttatacattcattaaaaacatctggattacctaatcataaaattaagttgaaaacaagcacacctattatgttgatttga

SEQ ID NO: 11313 - DNA, 393 bp, Glycine max
  Peptide Sequence Number=SeqID_128091
atgagggaagtatattacaactttgtggaagttgtaatatacttcactaggcctagtttaggcagaatgatcccaagatctagcaatagcagcagtgctagttcctccaatgaatatacggttcttcaacaatcagcacctgtcaacattcttgactggtttgatggtgatggtgttgctaactatggagggggtagtgatgaggatggagaggaaaatgatgagagtgattccaagcttcctccacatgagtttattgcccgaaggcttgaaaggagtcagatatcctcattttctgttttagaaggtgctgggagaaccctcaaaggtagggatcttagcaaagtgaggaatgttgtactcccaaaaattggtttcctcgaaacactataa

SEQ ID NO: 11314 - DNA, 474 bp, Glycine max
  Peptide Sequence Number=SeqID_128092
atgtgggtgtcaagggagtggtttctggcagatttcaggtgggaggagaaagagaagagcgatttcaggaaggaagacaaagagaagagggagggcaaggttttcgagcgcacgggaccgagtgtcggtgctcttgttccagggctaatatggagggttgacacatgtctcggagtgtcgtgtaaggaggttgacgagtttgtcgagccaccgagtatggatgaatgttgtctggtgtcgagtgtggtaaccttgacaagtgtgagaattgcaggcatgtgcggcgcacacgcaatactcttgtatatgtgtcactcgtggagtgggcacgtaactgagtcatggtgcgtggcaacccatgatggaccagaaggtcatttccttttgtggttcctccttggaggatactcgctgtggtaccttcaacagggagtccttttctttagaaagggtgagggctttgcatcatactga

SEQ ID NO: 11315 - DNA, 267 bp, Glycine max
  Peptide Sequence Number=SeqID_128093
atgacaggtagggatgatggcgacccaacactatggctatgtcgcatgtggggagatgccctgacatctccaccatcactacttctcttcactcccccagaagcagaagaggggaggatcatagttagcaggacaagctctgatgaggacatgaccaagagcaagggcaaggatccacttggaggacctatgacaagggctagagcaaggaaagccaagcatcatccttttgggagaccaaatggtggctggcttgatggctgttag

SEQ ID NO: 11316 - DNA, 642 bp, Glycine max
  Peptide Sequence Number=SeqID_128094
ttcaagcatgtgactgttgagacagataggttgcagaagaagaaagggaaagtagactcaacagttcaaaatctgaatttcaagattttgagagcaaagtctaaattagaacctgtgtctgctgctgaggaaaaggccagattcatagtcatgagcaaaaaccgcatcacaatcttttctacagtcttattagttcttgcaatgctaagaaattcgggtggtgggcaccatcttaggtacatggaaggaatgttcagagccaatggtggttgtggttatgttaagaaaccagacatactgttgaatgttggtcccaacaatgagaagctgaaaactcttactgagagtaccatgagagaaagagctttaacagcacagcatagttccatgatcactatctcaaaatttgagtatgagtatctaacaaatcatgcagcctcagtagaagaaattattgataaaaaagtagcagcagttgaggcatggattgaagctctcaaggccagcgtttacaccaaagagaaaatgctattaagaagagttagtagtagtgaggagcttgacaaattggccaacaaaacgcaagaagagttcatccaaaaacttccagaaagccatgtctacaaagagcatcaaacttaa

SEQ ID NO: 11317 - DNA, 309 bp, Glycine max
  Peptide Sequence Number=SeqID_128095
atgcaatggcggttccaaagtcagaaaagatgcaaagacaagatgaaactaacaagaaacaagcgtagaaccatgggtttcgttctctaccgaaaccgcaagccaagttggaagattccgcttcggttgaagggttcctctcggtgtgggatttcaatggagaacaacgatggtttgtggtggccaatggtggctatgggtgatggagaaaatgcttgggacgttagaaatggctttggaagaaagaaaggagaagaaatgacatttttcctaagctacacgaaagcaaaggctgaaatgcttaaataa

SEQ ID NO: 11318 - DNA, 1389 bp, Glycine max
  Peptide Sequence Number=SeqID_128096
atggcgacaaaagctttgtccttcgctctgtctctcaatgacctcaccaataaccacttctcttccaatacgccacacaccgccgccaaagtttccgtctttaccgtcaaatgctcttcttcgggtggtggagagaggccttggaagaattcagatgctagacttgtgcttgaagatggttcaatttggaaagcaaaatcgtttggtgcttcggggactcaagttggcgaagttgttttcaatacatcattgacagggtatcaagaaattttgacagatcctagttatgctggccagtttgtgctcatgacaaatccacatattgggaacactggcataaattttgatgatgaggaatcaatacagtgtttccttgctggtcttgtaattagaagtttgagtatcagtacctctaactggagatgtaagaaggatctgggggattacttggccgaaaggaatatcatgggaatttatgatgttgatactcgtgcaatcacgcgccggttgcgtcaagatggcagtcttattggtgtcttgaccactgacaattccagaacggatgaggaactgcttcacatgtctaagtcatgggacattgttggtaaggatctaataagcggagtatcatgcaaaactccacatgaatgggttgataaaacaaagcaacaatgggagtttagtaaagtgcctggagagactttccatgtagttgcttatgattttggaatcaagcataatatacttaggcgcctagcatcttatggctgcaaaatcaccgttgttccatgtacatggccagcatcagaaactttgaagatgaagccaaatggggttattttcagcaatggccctggagatccatctgctgttccttatgccatcgaaactgtaaagaatatcattggaaaggtgcctgtttttggaatttgcatgggtcatcaattgttaggccaggctttaggaggtaaaaccttcaagatgaaatttggtcaccatggaggaaatcatcctgttcgcaaccttcgaagtggccatgttgaaattagtgctcagttccagttccatgtccctgttgtagcgactcatggtattattggaggtgaaaatgagcataacaaattctacaaccacaactatgctgttgaccctgccacactgccggaaggagtggaggttactcatatcaatctaaatgatggaagttgtgctggtcttgctttccctgctcaacagcttatgtctcttcaataccatcctgaagcatcccctggacctcatgattctgactacatttttagggagtttatagagctaatgaagcaagggaaaaacagaacaaagggaaggctacaccaactatcaacagcacatgctttggatgcataa

SEQ ID NO: 11319 - DNA, 795 bp, Glycine max
  Peptide Sequence Number=SeqID_128097
atgtattctgttgcttccacttcccttacttcaccactcctccacgaccttgagaacttccattactcaagaaggttactccttcactccccataccttaaccaatcagccaaacccccaagaagcagccacgattcttcaacagaaacataccttggagatggcaatttcgatgcaaatgttgtcatggtactctcagtcctactctgtgctctcatatgctcactggggctaaactccatcataaggtgtgcactaaggtgttcaaattttgttgtgagtgactcagtggcaaccaataacaataacaacaaccctccagcagcaagagttgccaacacaggagtgaagaagaaagcactcaagactttcaccacagtgagttactcagctgagctaaacttgccaagtttggactcagagtgtgtgatatgcttgtcagagttcacaagtggtgaaaaggtgcgcattttgccaaagtgcaaccacgggttccatattcgctgcattgacaaatggctaagttcacactcttcatgccccaaatgcagacagtgcctaattgagacttgccagaagattgttgggtgcagtactcaacaagctagctcatcgcaacaacatgtgttggcagtgccagaaaccattgtgaccataatagccccacttgagccagaagtggatgaatggaatggaatggaccctagtcagccatacttggttaagactagtcagccacccaccactcaatcaatcatagttaatgtagtggttaatgatgatgaatgtatatag

SEQ ID NO: 11320 - DNA, 399 bp, Glycine max
  Peptide Sequence Number=SeqID_128098
atggaatgtgaaggcaaattggcgaggagggtggtgggagtgagaaatcattgttaccttttgaaatccaaaatcggagagggttcattctccgccgtgtggagagcggagcagagaccaccaaccggcgatgacgtggcggtgaagcaggtcttcctctccaaactcaaccctcgcctcaaggcatgtttggattgcgagatcaatttcttgtcctctgttaaccaccccaatattattcgccttcttcacttcttccagtgtgaacccaattgtgtgatgctgggtctggtctcaaagttacactctcacggcattattcagagacttgaaaccagaggtagggatattggagtatatgcttttccggacatagaattgagttcagttcacttttga

SEQ ID NO: 11321 - DNA, 387 bp, Glycine max
  Peptide Sequence Number=SeqID_128099
atgaaaaatcattatgctccacataacatctcgttgcggcattttattgaacacaagatgcacgcacattcttcatttccactacaaattgccttcaaattaacaatactttgcagtgagtttcaaaattgggggagaggtgatcgtattcaacataaaccagacggtggaggaggtagagaagcttcgatgtcgagcatgacttgctgtggggttttctatcgacgcgacgaaggtggtggttttctacgggaacaagcggtggctgtccgatctcggtgcctttttgtcgtcatcggcgagggtaaaatgtacgtggcggcaaaaatgagtgcgaaagagaagagacagagagagactccgagggtggtagcggagcaggggtag

SEQ ID NO: 11322 - DNA, 1980 bp, Glycine max
  Peptide Sequence Number=SeqID_128100
atgagtttgatggaaacagaaagctcagaagagggtgcaggccttctagagcctcctgatcctaacgttcttgaaatcgatcctactaatcgctacatgaggtataacgaagttattggccaaggagctttcaagactgtgtatccattttacaaggcgtttgatgaaatcattggacttgaagttgcatggagccaagttcagattgatgaggtattgcagacaccaggtggcttagagaggctttactcagaagtgcatctattgaagtcactaaagcacgacagcatagtaactttctacaattcctggattgatgacaagcacagaactcttaacttgattaccgagttgttcacctcagggagcctcagaaagtatagtaagaaacacaagaaggttgacataaaggccgttaaaggatgggcaaagcagattttaatgggtttaaactatctccacagtcacaacccacctattatacatagggacctgaagtgtgataatatatttattaatggtcaccgaggagaagttaaaattggcgatctagggttggcaactctgttgaagcagactactgccaagagtgtaattggaaccccggagttcatggcacctgaactgtatgatgaacattataatgaattagccgacatatattcttttgggatgtgcatgcttgagttggttacgtctgaatatccttacagtgaatgtagaaactcagctcagatatacaagaaagtttcatctggcataaagcctgctgctctttccaaactcaaggatccagaagtaaaatcatttattgagaaatgtcttgtcccagcatctcaaagattgtcagcaaaggagcttctgaaggacaattttctccaagtgaatggttcattgaagaatcgtcgacttccattgccagatattgttctccctaaatatggaaccttcgaaaatcgttgtcttatgtcagaaggcccagctagtacacgtattagatccatttcaatggatcttggtgatgccactgagcttccattgaccactttactttataattctgttgattctattgacaatgcattgccttccccatgtgttgagatacgaaggttgaaggaaggtgacatattttttctaaaaggtgaacaaaatgatgaaaagtctgtatcattagttctccgcatagctgatcagaatgggcgggcaagaaatatccatttcatattctacatcaacagtgatactgccatctcagtttcaagtgaaatggttgaacaacttgaacttgctgagcagaatgttaaatttatagcagagttaattgatttgctattgacaactttgcttcctgattggaaaccttgtgtagcaattgatcatttagtttcttctaatggtaaactaactcattcaagtaaacagaaagactcagaattagcaaaatacaggcaaagctcagaagattctagccaaattgtggctgaaattgtaggtctctcaacctcgcctggaagaccggcagaagtggaaaacattgataatgtgatttgcgacaagtttttgtctcatgcaaacattggtcttcgaagagaattaaagacagatgatttgtattttgagaaacataggtcatacgcttctgcaacatctgacttcaatgataagcatttttctacagtttcattcatgtctgctaaatcaggatttacagactttgaccttcccaaagttaatagtcaatgctcgcttgcatctgaattcggggcaacatttgattatagcagttttccttgtgtggaaagcaatggtacgatgaaattctctagtcatcccattaatgcttcctgcttctttcaacctggggatgagttgagaatagagttagagaggattgagcaacaatatcaggatgaaatggaagatttattgaaaagaaaaaaccatgacatcatggagactagaaggaggcattcttaa

SEQ ID NO: 11323 - DNA, 318 bp, Glycine max
  Peptide Sequence Number=SeqID_128101
atggccaccgcctctctattttccaatgacaaccccattcgaagaaaacccactctttctgactcaacaaaccgcactcagaaccctaacaatggtgaccaccttgtgaacaccgattccggggaggaaaagaagcggaagaggaacaaggaaaaaaccccaaccctagccatcgataccgttgtttccgtaatcaaagcttcaaagaaatcagagaataaaatgaagcacgattccaacaaaggaaaagaccttaatgtggatgtatatgcgattgggaagaggaaaagaaaaagggacaaagttgagaaagattag

SEQ ID NO: 11324 - DNA, 240 bp, Glycine max
  Peptide Sequence Number=SeqID_128102
atggctccagaagctcttaagttccagagatatgatgacaaggcagatatgtggagtgttggaaccattctttttgagcttctaaacggctacccaccttttaatggtagaaataatgttcagctttctaaaaagaaaattgatgggaacgtgacggctatatcaggatttgaagtgtgcacgatctttcatagcagttgtctgcaaaactatcttcgaaactatcaaattcatcagtaa

SEQ ID NO: 11325 - DNA, 603 bp, Glycine max
  Peptide Sequence Number=SeqID_128103
atggcagcatctgatggggttgaattgccatcctctaattcctcctctggtggagatatttcatcaacagctgcatatgattatattttgacccaaggaagagcatgggcaatttctataacacagaaaagtacagtaaaggaagagatttctagagcatttataagcaatggaggtggaatggatgataaccttctttatcggtcatccactcatggaagaggccttggcagattttggtctcatgttgaaggttacagaggtcctttgttaattttgatagctgcaagttcaggagatgcccatgagggaaattccattgataggaaatgggttgtaggtgccttaacagatcaaggtcttgaaaataaagatatcttctatggaaactctggatgtttatattctattggcccagtgtttcatgtgtttccacctactggtaaggaaaagaattttgtttatagccacttgcatcctactggtaaagtatatcaaccacatccaaagccggttggagttgcatttggaggaactccgggaaatgagaatatttatagacgaagattttgcaaaagtgaatgttcgccatcacgctattga

SEQ ID NO: 11326 - DNA, 291 bp, Glycine max
  Peptide Sequence Number=SeqID_128104
atgaggatttgggtgccacggtttggattgaaggaagtggaagcgcgtggcagagacaaacgcgactgggatggtcgcagatggagcagtgctggcaatgaggttcctccgggacttggtgggaaagtaggaaaggaagtgcagaactcttacaagaagagagaagaacttttcactgagcaaagaagaaatgttgacttaaagacattcgcaagttgggaggattcacctgagaaaatgatgatggacatgatctccgatccaaatgctgttcgaagggaagaccactga

SEQ ID NO: 11327 - DNA, 246 bp, Glycine max
  Peptide Sequence Number=SeqID_128105
atgaagactggagatgaagtttttgggagtgactataactatgttttgaggaaaatgaggtggaaatggcatgaaacgtgggcaattaaatgcaaaactttgattgtcagagaagagccggttggaggaaaaaaaaagcagtgggggaagaataaaagaggttcggtcaaaggaattcggatgcttcttcaaatgttggaagcagaaagtcggaaagcctttttgggacaggcccttatgggataa

SEQ ID NO: 11328 - DNA, 243 bp, Glycine max
  Peptide Sequence Number=SeqID_128106
atgtcggcgagctatctcctcctaaaaatctatgtactcatcctccctgagttggacgcgcctctctttgtggaacgaccatcttttgatggcctcaaagcgctgttggtgctcggcgctccgaaaacggtggctatcaaactcgagggcggcactgggaagacacaagtatgcgttctctacgggatactaggctgtgccccagttgcgcttcccgctagtctagtgcagggcatgagatga

SEQ ID NO: 11329 - DNA, 285 bp, Glycine max
  Peptide Sequence Number=SeqID_128107
atgatacgcggagataccttacggttatccgcacccttttgtcatccagaggcggcgggcccgatgacaagcagggaccaaatttggtcattctgcacccttgtatcatccagaggcggcgggcccgatgatacgcggaaatacccgagtgacagaacgcttgatagcatgcagaggctgacacagtcttctgcaccttttgttcctccgggaacaacaagtcatttacatgcggaaatttcatggtcgcccgcgactctcgtcaaccgagaggagcgaaattag

SEQ ID NO: 11330 - DNA, 786 bp, Glycine max
  Peptide Sequence Number=SeqID_128108
atggccgcaggcccccaacttcccctgctgcaggaaaagcttgtcgacattgtggtcgagctttcgcgtggcggcttaccgcacgcgcaagacactccctaccgtttggcgcgtaaatactatgccgaatcaccgacgcgcatgcgcgagttgaccgcattgctgatggaacgccttggcgatcagatgcaggggcgttgcggcagcgatctctgccatctcacctggcaacccggcgccgacttccatacgctgccggtggcggacatcacgtcccccgcacagctgcaacatttcttctttaatgaaaccggcgcgctcaaacaggggcgctatgcccagccacgagcgatggtcgacgtagcggcttgcggtgacggcactcagcttaccctgtatggcgacgacatgcgtttcaacgcgttcaccgactatcttgacgcgctattggcagatccggccgatcccgtcgccgcgcccattgttactcaacctcaaacgttgcatcgcctgagccaattcaacgcaaccgacgatgccaagctgctggcgcacgacgtcatcgctttgttccgccacgccgccgccgctcatccgcaacaggccgcgctgcatgccgatggccagatatacagctatggcgagatcgatcgcgcctcggatcagtttgcctgttggctgcttgaacacagcggggccgccagctcggtcgtcgccgtctcgatggacaagtcagcgacgctgctgatcgtgctgttggggatactgaaaagcaataaaacctat

SEQ ID NO: 11331 - DNA, 642 bp, Glycine max
  Peptide Sequence Number=SeqID_128109
atggcggggtctgcaacgccgagcgtatcagcctggtgccacactgccacggcacgcacaccgaatgcatcggccatattcttccctgaaacgcacaacgtggcggatttgccgcttgaaccgttcatcgccgccaccctgattcgcgtcaggccgcaacgcgcggacgggaccacggagagctataacgccagcgctgcctctgaagattggctgattacccgggcggcgctcgatgacgcgctggcgccgttgtcgggcgactacctgcaggctttggtgatagcggtcgagacgccgagcgatttccgcgccgcagcctgcgcgccctacttcagccatcaagctctggcgcgcatcgtcgaactcggcgtccagcatctgttggtggatattccgtcgatcgaccggctatacgacggcggacgcatggacaaccatcgccgtttttgggggcttgatgcccccgacaggccgcactccgggcgcaaatacgcctccgtgaccgagctgattcaggttcccgcacacgccgcggcgggacactattttctgaccattcaactgccggatctgagcggggatgcccttcccagtcggcccgtcctattttcgttttctacagggaaagtgacatcatga

SEQ ID NO: 11332 - DNA, 366 bp, Glycine max
  Peptide Sequence Number=SeqID_128110
atggatgcatctttaaatgaggcacatttgatgcaagacggggacgtgacgggtatagcaaggggacagacaagggacgacgttgacttcttggatacggttgaccaagatgggaatggcagtgaccttttgtggggacgtattggggatgatgttatcctacacacgcatccccacagtccaaagcaaggtggaggagatggttctggtcagagatggtgcggcacgacgacaatggtgcaacagtgttgtttggtggtcagagatgatcaagagaggatctacacctgtgaaaagatggaggaagaaaaagagaaagacaggggagagggatttggtggagaaggcgacatgacaacggagtag

SEQ ID NO: 11333 - DNA, 138 bp, Glycine max
  Peptide Sequence Number=SeqID_128111
atggtgggaaggtttgcacaaaacattactactattcttagcgatgttggttcactacctgctaacgagctgaccgtgtctgaccttctgttctgcgttattcggcatcaagatgaatttactactatcggaacatga

SEQ ID NO: 11334 - DNA, 1224 bp, Glycine max
  Peptide Sequence Number=SeqID_128112
atgctgatctctgatgaaggagatagtgatgtgttctttgactcagtggattgtttctcaccaacccgagattctgttttgacagaacaagagtttggttatgagatttgggtgaatgagcctgtgagtgtgatggaaagaagggaaaagtttttgcaggagatggggttgggtgatggatcttccaaggtttgttctcaagaaaataatgtgatgagttctgatgattcatcggagagattgggactagagaggatcagggatagtggggcagtgtcaaatgcttcttgtagttgtatcttgcctgatgatgatcaagtttctgagctggttctctcgggcagcgaggccacttctgaggcacaaggcttgtttgatgaacataaggggtgccccaaagatgaatcatgttttgaagggaaggtttatgaggtttcttgtacagatcaagaggttagacatagaaaagccgaggttcgagaaaagtatatgggggaaaaggagaagaaaaactggtggaagcactttataagcagcaagaaaggaggtgggggtaaagtcagatcaaaattgaattcatcgacaaataaaactcgaagaataaatgttaggcagaataagaagaggtggatggagctcagtgcactgtatattggacaagagattagagctcacaaaggcctaatttggactatgaagtttagtcccaatggccaatatctagctagtggaggtgaagatggtgttatacgcatatggcgtgtaaaaacactcaatacatctagtatttgcttcaatgcagaagacagtgcagctaacaaagtgaaacatgacttctctagttctcagaagaaacactcaagccagtccttcgtcgttcttcccagtaagattttcaaaattgaggaatcaccgttgcatgaattttctggtcatgccagtgatgtcttggatttggcttggtccaattcagatactctcctttcatcttcttcggataaaactgttcgcttgtggaaaattggttgtagtcaatgtctaagtgttttccatcacaaagactatgtgacttgtattcaattcaaccctgttgatgaaaattacttcatcagtggttccatagacggcaaagtccgaatatgggggatacatgaagaacgagttgttgactgggcagacataagagatgtgattagtgctataagttaccggccagatggaaaa

SEQ ID NO: 11335 - DNA, 722 bp, Glycine max
  Peptide Sequence Number=SeqID_128113
gcaaacatttccagcttgagactaagattcatgtcaatggaaagaagagtacatctggcaacaagattacaggcattcagttttctcagaaaaaccatcagagagttatgattacatctgaagattcccgagttagaatattggaaggcactgaatttgttcagacatataaaggccttccaagatccggaagtcagatgtctggttcatttacctctggtggagaacatatagtttcagttggaggggactcgcgtgtgtatatttggaacttcaatgacttgggaaacgcttcttccaaacagacaaaatccaaatattcctgtgagcacttcggctctgaaggggttactgttgcattaccttggtcttgcatgagtgcagaagaacaaagtggctcttccaatgattttgcccaccattcatcgtcacaacaccaactagaggcatctcatggcgttagggagtcggaacgattttctttcggaagttggttctccattgatggctcatgccgcggttcggtcacatggcctgaggagacgcttccccgttgggatctacctcttgtagaagttgaatttgatcaccagaagctatgtaccaaagatccttcccatgaaaaacatgtatcagaaacatggggactatccattgtggcagctggttgtgatggaaccatcaagacattccacaactttggacttcccattaggctttag

SEQ ID NO: 11336 - DNA, 261 bp, Glycine max
  Peptide Sequence Number=SeqID_128114
atggcatcgcagcagaacacaagtgaggtggtgataacgtcgcaacagaatgcaagtaaggtgatgacagcatcgcaacagaatgcggggatggcaacaagtcaaagtcgtgaaggagaggaccgtcgtgaggccgaagggctaagcacaccctacaaaaccaaatggaatacagtctgttatcacccaccgacttctatttgtcaccccactacatttgtaccagtgatgacccataccctgatatctctccttaattaa

SEQ ID NO: 11337 - DNA, 252 bp, Glycine max
  Peptide Sequence Number=SeqID_128115
atgactaatgcaatgatgaagattaacaaaaaagcagaggaaatgttcaacattgttcatgttatggatcagccttatggtgaggttagtaggccattgttagtgttttcctcctcaccatcttcaaaagcaggtctgaatcaaaagcttaccctaaatgacactccttgtatcaccaagtttctaactcagtcacttttaaagttctatactgagtacaaagtgacttgcagtagtttagtgagtaattaa

SEQ ID NO: 11338 - DNA, 465 bp, Glycine max
  Peptide Sequence Number=SeqID_128116
atggacctcaaaactggcttgcaacaacctatagctttgattgatgaggcagggtgctgttttttccctgaaatctatgctgcttctggtgatgaaccttataatttgagcaaacaagtgttcatcgatttcttcggccgcgatgtctccctgcttctacttgctcagcctcagcagaaaatttgtgacacaaatcaacacctaataagtcacccatatcagaagtatcagtgtgatgaccttcgaaaggatactgatacatctgtgaaggatactgagaaaatgttggtggcgtgtaatacattccatggccacgctcctccatttgttgggaaaattcttccgcttcaacagcctcccttcatctgccaaaaccctgagtttcaacacttgactgaagcatgtgaaactcttgtggtggaaatcgacgttctgatgttggaccatgtgccacaggctcagtga

SEQ ID NO: 11339 - DNA, 492 bp, Glycine max
  Peptide Sequence Number=SeqID_128117
atgcgagtaaaaagttattgtcgtttgaatttgctcagagctttgataatcaatttcgagcgtctcgatatattacgggactcaatcagacatccgagtgaaaagttattgtcgttcgaatttgctcagagcttcagtcttcattttcgagcgtctcgatatattacgggactcaatgagacatccgaagcttcaacattcaatttcgagcgtttcgatatattacgggactcaatcggacatccgagtaaaaagttattgtcgtttgaatttgctcagagcttcggtattccatttcgagcatctcgatatattacgggactcaatcagacatccaaagcttcgataatcaatttcgagcgtcttgatatattacgggactcagtcagacatccgagtaaaaagttattgtcgttcgaatttgctcggagcttcagtcttcaatttcgagcgtctcgacatattacgggactcaatcagacatccgagtaa

SEQ ID NO: 11340 - DNA, 1239 bp, Glycine max
  Peptide Sequence Number=SeqID_128118
atggtgaagaaatcaattggaaaatggaggatgtgtgtggattacaccaatctcaacaaagcttttcctgaggatgcttaccctttgcctaacaccgacagattagttgatagagcatatcggttcagattacacaaatttctagatgcctactcgagctacaatgaaatcaagatgtacctacctgaccaagaaaaaacaacattcatcactgacggagccaacttttgttacaagcacattcgtgacttggttgagatctttgtagagctcaaaaaacacaacatgaggttgaaccctgaaaaatacacttttgggattgggggagctgaggagctcccatctcccattttcctccatttcccttcatcttctcccttcaattttgtaattttgagggtggttgcatggtacatagatatatctgagttcggactaaaatttaagccacgaggacccattaaagctcaatgcgtggttgacttcatggcagagcttccccccaaaccaagcagtggtgatataggtgattggtggatgctctatgttgatggagcttataaccccaagggtagtagagcaggaatcactcttgaaagatctagagatatctccctcaagcaatcattgtttgatttcaaaacctcctacaatcaagttgagtatgaggctctgattgtagggataaaattagaaaaagaagttgaagtgaagaaaattagtatggacgttcttggtctctttcctgctgcaaaatggcaagcaaagttcttactagtgaccattaattacttcaccaaacatggtttcctttttgctatagttatagataatggcacccaattcacaaagaaaggcgaacaaggtcatcttgacaaagatgaagaaatagtaggcaaagcaaaaggtctttgggttgaggagttgcctagcatactatgggcataccatttcactcagctatccacaacaaaggaaacttctttcagattgacttatggtactggtgccatgattccagttaaggtgagagatcatgctcaaattcaagatgaagcttttaaaaggagagtaactcggaagcataagtcaaaattgaagaaaagagaatttctagttggcgatcttgtatggaaaatgagaggagaagcaaggaaggatcatgttgaaggaaaacttgatccaaattgggaaggactcttcagaatcattgcaacactgcaaaattgtgcatattga

SEQ ID NO: 11341 - DNA, 762 bp, Glycine max
  Peptide Sequence Number=SeqID_128119
atggttgagttggtaactgctcatgatgtccaccaagacatcatgtggggagtggtagtcggttggttaatgctgactacccataaactcatagtacacaagtccccccaagctttgagtctgatgaagacaaaagagcttgatgacaaagcaagctatgttgttaagatgacatgggagcatttctgggttagagagctttacggtgacgggttaaggatgtcttcttctggttttgatgaggataaatctctggttgtccgctggaaatccatgttagagaaagaaatcttagacatgggggaagagtcaaaatcattctctgactctattgcttctcttcctctttctgatgaggaagaattccaaaatttgatgaaaggtcctgaaatcttctatggtgttaatgtcatcgtcgttgacattgtcagtggtgatattaacaccggccttgttgattccaatagagagggttctaaagttgatgtttttgaaccatttaggaaaatggatgaggctattggtggtggaagtattaatgtggagaatcttactactgagaatagggatgttgaggtgttacaatcacattatattgataagctgactacaaactctgatgttgctaataacaatgtggagaaattgaccacttccttaatctctccaactcctctaatttctaaccaaggtcccctacgcagggctaatcatgtgattattactcgtaatcttcccccgctatggaatgttgacatctag

SEQ ID NO: 11342 - DNA, 438 bp, Glycine max
  Peptide Sequence Number=SeqID_128120
atggattttgttggggttgacaataatttggatttcattgaggttttcctctataggtcttctactattgttcgccattggagaactatctatgtcgagttgaagataaagttcaaggctagtttagaggaaatgaggaaattggtcaaggctctcaatgagaaaaactcgttaatcaagaaaattgagatcattgatgccttcataatgggtcatgaagatggttttaagaaagctcttcgccaaattgctttgttcacccctgaaatggatatgaagaattttgatgtgctgaaagatgtaaaggatggggaggcagtaagagaatttgaaataggtagttatgaagaggcttctaatagtgaaatgacttccaatgcaggtgatgttgaggcaacttcaaactttgctttgacttcaaatcatccaacaacatag

SEQ ID NO: 11343 - DNA, 825 bp, Glycine max
  Peptide Sequence Number=SeqID_128121
atggatgcattgagacatcgtgcaactggctttatccaaatagaaaagttgtccgagttccatgataaagttagaggaaaccaaaagaagtctgattctcacaaagaaaaactaaagtttgtcaaagagaaagatttcaaaaggcagccacaacaaccaaagtatgaaacatatactcttctcactgaaagtcgagcacgtatcctggagaaggcattccataaagaaatactagggtgcattcctatagccaggccaaccgcaccaaacaatgcatatatcatcgaaactttggtcatactacaaaagaaatgtatagttttgaaggataaaattgaagagttggttcataaaggatgtttaaatgattttgtcaaaggaaacaactataatcgtggtgactataggggaggaggaagaggtggctgcaaaggtagttttagaggtggatatgtcaaagacacctcgtatagtgtcttacttggcatacctactttgaacaagcttggaaccattctttctacactttatttagcaacgaaatttccctcatccacaagggaaattgtcattgtcaaagttgatcagacggatgcttgtgaatgctatgtaaagagttgcaagattgaaccatacaatataatcgatgaccaaccccaattgaagacattgttgagaatttccaaatcagaacggagtcacatgaatgcaccaaaatcgcaatgtcaattgttcgcttggagcatgtccgacatgcctggcactgaccctaacttcattctccacaagcttgcagttttccctaatgtgaaacttgtagcttag

SEQ ID NO: 11344 - DNA, 897 bp, Glycine max
  Peptide Sequence Number=SeqID_128122
atgggaggattcaccaggattctgcattctggaaatcctgacaacttgatgaatgaaattcctactgttgtggttgatccccttccagcaggtttggaccggggatacattgttttgaataggccatgggcctttgttcagtggctggaaaagactaaaatagaggaagaatatgtgttaatggcagagcctgatcacatatttttacgtcctctgcccaatctggcctttggaggacatccggctgcttttccatttttttacattagacctgatcagaacgaaaagaccataaggaagttttatcctgaggagctggggccagttacaaatgttgatccaattggaaattctcctgtaattataagaaaggatttgatcgcaaagattgcccccacatggatgaatatttctttgaagatgaaagaggacccagagactgataaagcttttggatgggtgctagaaataagaggtattggaactgataatttgatacattatgctaatggtttttttcttgtggaaccaaggtatgcttatgctgttgcatctgctgtgcatggtgtgaggcacattctgcggaaagacttcatgttacagcccccatgggatcttgaaactaacaagaagtacattctccattacacttatggatgtgactacaatatgaagggtgaattgacttatggcaaaattggtgagtggagatttgataaaaggtcacatctacgaggacctccaccaaaaaacttgcccttgcccccaccaggggttcctgaaagtgtgatatttccgaatgatcttctcgaagctagaacttttaagatgcctgtaaactttcttgtttccctcatctacctcatttattttttacactttcattggaggaagtga

SEQ ID NO: 11345 - DNA, 498 bp, Glycine max
  Peptide Sequence Number=SeqID_128123
atgacattcttgggagaaacaaacagtcagacaattgtgaactccacattagcttttatttttccaaatggttccattgttcacaacgacaatggtgtttattttcaaacctccactccaataccttttcgactacctaacgtttgtgattttcaaacgttaaaaaccaaaatacacaatacccttcaactaaccgaggaacaatatttggatgaaatttactaccggcagccattcacagatacaggtgaccatcttcgctttcaatgtatgcaactgaaaaatgatgatgatgttaacacaatgttaatgtgtaatcatcaattttcatgtgttggtccgattgagttattatgcaccattggtagaacaccagatggaaaaaattctaaaaagtttgacattccttccggatgtaccatgaatgaactgaaggatttggtcaagcaagttgcacctcaagggattcccccttatggtattcatgaaacacaaacg

SEQ ID NO: 11346 - DNA, 415 bp, Glycine max
  Peptide Sequence Number=SeqID_128124
atggcagcggcgcgcggcgatgtcgttctccgcgccgcagtgcgggcagctcttgaaccggaagcggtaatcgcactgttcgcggtggccgtcgtcgtcttccagccagccctgacagcggcggccgtagtgctcgatgatgtcgccattctcggtgcacttgccccagaacaggttggcgaagccgcaggccgggcagaacacctgcaccggctggctgtcgccgtgcggcttgctgacgccgacctccggcgtgaacagatcgtgcgggttgccggcgtagtcgaggatcaggcaatcctccttgccgggcgacagccgcagaccgcggccgacgatctgctgatacaggctgacggactcggtcgggcgcagaatagcgatcagatcgacgtgcggcgcgtcgaagccggtg

SEQ ID NO: 11347 - DNA, 588 bp, Glycine max
  Peptide Sequence Number=SeqID_128125
atggcgggacatgataacgcgatccggcacgcccatggcgcgcgcggcgcggatgtagtcaaaattgcgggtgcgcaggaattcggcgcgcaccacacccaccaggctcatccagccgaacaggatggtgatgccgagcagccaccagaaattgggctggacgatgctcgacagcagaatgatcagaaacagcgtcggcatgcccgaccacacttcgataaagcgttgcccccacagatcgaaacgcccgccgtaatacccttgcgtcgcgccgacgcacacgccgatcaggctggaaaacagcgtcagcgccaggccgaacagcatcgagatgcgaaaaccgtacagcacccgggccagcacgtcgccgccgttgctgtcggtgcccagcaggttgtgacgcgaaggcggcgaggggaagggcacttcggtggcgaagttgatggtgtcgtaactgaagcggatcggcgcccataccgcccagccgtgccgttcgatctgccgctgcacgaacggatcctgatagtcggcttcggtattcagttcgccgccgaaggcggtttcgctgtagctaatcataaacggcag

SEQ ID NO: 11348 - DNA, 710 bp, Glycine max
  Peptide Sequence Number=SeqID_128126
tgacggtcaccgccgtggcgattctggtttcgctgattgtcggctacgtcacgctggcgcgcttcctcagctatgaagtgatctggtgcggcatcctgtttggctcgttctacttcctcagtcatctgatcaacgacggttgtgaaagcctgttctccaccaacaacgcgaccggcaagcggttgcagacctcgctgaatattgacgagcgctacctgcagcaggccgcaacgctgctcagcgccgtgggtaaaactctgctggtggcatttgttgcgctggcgctgctcaacggcacgtttgcctcgtccacgccgattgagctgatccagaaagtcattgagttctggggtggcaaagggctggagtcgctcaacattgtgccggcgcacatggtgaacgccattctgtgtctggtggtgggtatctacgtgctgcgctcggtgcggcgctggctggacaaagagttcctgccgaagaccaccatggatatcggcatgcgcgtgtcgctggtgacgctgttcagcaatatcggctacgtgctgattatcctgctgacgctgtcgattatggggctgcagtggaacaagctggcgtggatcgtcagcgccctgtcggtgggtatcggtttcggcttacaggagattgtgaagaactttatctccggtctgatcctgctgaccgagcgtccggtgaaggtcggcgatctg

SEQ ID NO: 11349 - DNA, 479 bp, Glycine max
  Peptide Sequence Number=SeqID_128127
gactacacatcctcaccttcagaggactacacgtcctccccttcagaggactacacgtcctcgccttcatagggctacacgccctcgccttcagggggctacacgtcctcaccttcagaggactacatgtcctcgccttcatagggctacacgccctcgcctttagggggctacacgtcttcaccttcagaggactacacaccctcgacttcagaggactacacctcttcaccctcaaagggctacacgcccccgacttaagaggactacacgtcctcgccttcatagggctacacgccctcgccttcagggggctacacgccctcgccttcagggggctacacgtcctcaccttcagaggactacacaccctcaccttcagaggactacacgtcctcgcctttagaggactgcacgtcctcgcttttagagggctccacatctgcgccttcagagaactcaaggtcctctgcccttaa

SEQ ID NO: 11350 - DNA, 414 bp, Glycine max
  Peptide Sequence Number=SeqID_128128
atggtatcatacatacacaaatccaatctaaaagccatttttacaaacttaggcaaaaataccattgaggcatttcaccgagcacttggtgggcgcacttttgggtaccaacaacaagggaatgggggcaatgtggcttgccccatcatctcagaacacaacctatgcctaaggccatcccctacaacccctcaattcaaagaaacaaagcataaatttgccccaaattgtctcacggaattgggcaaattgtgtaccattcaaagcataaaaggcatcaatggaaagctagaaaccaaagggatactaggctgcctcccagctgcgcttcccacttgttcggagttgggcatgggacgacgatccatcgatcatgggcctagcctctactcgtgtccgtccctaagtacctga

SEQ ID NO: 11351 - DNA, 669 bp, Glycine max
  Peptide Sequence Number=SeqID_128129
atggcctgcaccaagaaaattgggcagatgacgtcagaggcaccaaaggaaattactgagaagattgatttgttggaggagcaggcatcacaacgttcctttgtctcctatggacgtcaggatgtccttattgttgccattgggcgaccagaacaccctggtcgtgtgcgtgctgttagagccggtgtgaccatcaagcaatactttgaatcgaatccacaaacctcccacacttcttcctctatggctcctgaagaactagagcagctgactcaacaaatcagggaccagttggaggagtcgatcaaagaaaaaggacttgcactgcctctggagcctaaggttggcccctcaactgctcatgttagcataaaggagagttgtgttaatccctcagggaatgatccagacacgagtgattcagacaaatgcgggttgtacatcgaagaaaatattccccacctggttgccctaggaagagtttatgagggatccataaccattcacaacatccctttgttacatgatcaagtgaaggtcagtgttgaggaggttaaagatgcagatgctcccgttcctgtacctactgacgaggttaacttaatggggcactcacttaacaccttccttgcttggctgagacatctcgccaaacgtttatcagaacaa

SEQ ID NO: 11352 - DNA, 942 bp, Glycine max
  Peptide Sequence Number=SeqID_128130
atgcaatcgacgctgaccgccgaagacgtcagcaaaaccgcagccgtttcgttaccccaactggtcacttcgctgatcccgacaaatatttttctcgacctgaccggcgcgcgcagcgtatcggttatcggcatcgttatatttaccctgctggccggagtcgcgttattgaaggtgaaaaaagaggcgccggaggaaggtcaaaaactaagtagcgggattaacgcgattcaaatttgggtgatgaagatggtgcgtatcgtgatagcgctgacgccatatggcgtcctcgcattgatggcaaaagtcttttcgacctatcagctagcgcaattcaccagcctgcttggctttattgccgcctgttatctggcggtcgctatcatgtttatcgtgcatgcgattctactgatcgttagcggtcatcatcctctgcgctactttaaaacggtgtggccggtgctcaccttcgcttttgtttcccgcagcagcgcggcttcgattccattagccattaccgcacaggaaaaattcggcgtgccgaataccatcgccaatattgccgcctcttttggttccagtatggggcaaaacggctgcgccgggatctatccggctatcatggtggccatgattgcgccaacgctgggtatcgacccactgtccttctcgtttttagccagcttacttccggctatcgcgctgggctcaattggcgtcgcaggcgtcggcggcggtgggacatttgcggcgttgattgtcctgtctacgctcaacttcccggtggcgctggtcggcatttttatcgccatcgagccaattgtcgatatggcgcgtaccgcgctgaatgtgaatgggtcgatgatgtcgggcgtactggcgtcgcggctattgaaacatcaaagtgcaaagtcgcaccatgtcgcctcgataagtgaataa

SEQ ID NO: 11353 - DNA, 277 bp, Glycine max
  Peptide Sequence Number=SeqID_128131
ttatccagaactacgtaggtatgagttcctcattggaggatacgtaggagcaagagcctcgcttttgtcgaccacaccgctttttgttgccatgacccaagaactgaggccaatgtggtcatctgcgccttttccggagatgtcagcattttccgatggagacttttcaagtctcacaagttatccagaactacgtaggtctgagttcctcattggaggatacgtaggagcaagagcctcgcttttgtcgaccgccccacaagatctgtcatactga

SEQ ID NO: 11354 - DNA, 210 bp, Glycine max
  Peptide Sequence Number=SeqID_128132
atgttggccattgaaagaaagagaaagagagagagagagagagagagaggagtgaaaaggttgaagcgggtgaggaaggacaaagaagagaggaacaagcgtgaatggctacagtcaaaggtggatagtggatgtggaaactccaacccacaagaccgcacgggagttgaattatatagatcatgcattgacatatatgcccttgattga

SEQ ID NO: 11355 - DNA, 411 bp, Glycine max
  Peptide Sequence Number=SeqID_128133
atggcttccataatatgctcctcctccacgctacgacgtcgtttgcccctcgtcggcgcgttttgcatgctcagtttgggactctccaatctctacacacccctcaaaacgggatccaagttgggtattcgaacccagtcctgcatcagaatggaagggagtaacaccaccgtgcccagcattgttgtctatgtcactgttcccaacaaagatgcaggtaagaagttggctgaaagcatcgtcaaagagaagcttgctgcttgtgtcaacagggtaccgggtattgaatcggtgtaccagtgggagggaaagatccaaactgattctgaggaacttcttataatcaagactaggcaatcccttctggaggcactgacagagcatgtcaaggctaatcatgaatatgagtaa

SEQ ID NO: 11356 - DNA, 987 bp, Glycine max
  Peptide Sequence Number=SeqID_128134
atggcaggagcagaggggctaaacagagaacagtacgtgtaccttgcgaagctgtcggagcaggcggagcggtacgaagagatggtggagttcatgcagaaggtggtggtggggtggacgccggcgtcggagctcacggtggaggagcgcaacctcctctcggtggcctacaagaacgtgatcgggtctctgcgtgccgcgtggcgcatcgtgtcctccatcgaacagaaggaggaagggcgcaagaacgacgaccacgtgtccctcgtgaagcactacagatccaaggtcgagaacgagctcacgcaggtctgcgccagcatcctcaacctcctcgactccaacctcgtaccctccgtcttcgccagcgagtccaaggtcttctacttgaagatgaagggcgattaccaccgctatctcgcagagtttaaggttggggatgagagaaaaaccgctgctgaggataccatgttgtcttacaaggctgcccaggacattgcttctggggatcttccccctactcaccccatcagattgggtctcgctctcaacttctccgtcttctactatgaaatcctcaaccagtctgacaaagcgtgtgccatggctaaacaggcttttgaggaagcaattgctgagctggacaccttgggagaagaatcctacaaagacagcacgctcataatgcagcttttaagagacaacctcaccctttggacttctgatgtccagttcgaccaatatcagaatttgaagatgacatgcaaatgcaatgctgactccgttgcattggctcagtttattgagcaagagagaatctttaagtttctctccggcttgaatcctgagtacgatcatattcgggttcgggttcaaatattgaataaggaaaaactcccttcactgttggaggtgttttatactgtgagtgatgaagaaactcgaatatcaagcatgcttgatgatggcagttccaataagggataa

SEQ ID NO: 11357 - DNA, 645 bp, Glycine max
  Peptide Sequence Number=SeqID_128135
atgagaatgatctaccactactataacctcgtagtgatgtgcagctatgtccgttgtgacgtgacagacgaagaccaagtcaaaaacctcgtggattccacggtcaacgctcacggccagctggacatcatgttcagcaacgcgggcatcctcagtccctccgaccagacaatcctcgacctcgacttctccgcgtacgaccgtctcctcgccgtgaacgcgcggggcacggcagcgtgcgtgaagcacgcagcgcggtcgatggtggagcggcgcgtgaggggcagcattgtgtgcacggcgagcgtgtcagcgtcgcacggcggcctgcggcgaaccgactacgtgatgtcgaagcacgcggtgaaggggctcatgcgcgcggccagcgcgcagcttggagcgcatggtgttagggtgaactgcgtctcgccgagtgggttgaccacgccgctgacacgtgccgcgcatgccgcgatggagacgaaggagttgcagaagcagtacgcgcagagctctaggttgaaaggtgtctttttgacgccgaagcatgtcgcggatgcggtgctgtttcttgcgtgcggtgactccgagtttgtaaccggacacgatcttgtggtggacggttgttttgacggtgtttag

SEQ ID NO: 11358 - DNA, 221 bp, Glycine max
  Peptide Sequence Number=SeqID_128136
atggataggttgacgaccatgatgagtgcactcctgtcggcccagaactctcaagctgccgccgttgctgtagagcagcctttggtgagcacaaccccgttatctacagtgacttctccacccctctttttgcctccaggttgttcctggggaatgccacctccagtctgtggaagcccccagcccgctgtatctgaagttccacctccttttgctcagca

SEQ ID NO: 11359 - DNA, 879 bp, Glycine max
  Peptide Sequence Number=SeqID_128137
gtcagaacaccccgtcgtacaccagatgttttacctccctggtttcgtcatgatttaacgtgcgctttccaccaaggggccccaggtcatgacgttgaaaactgctatgtcctgaagaatgaagtgcaaaaactagtccgggccaatttgctatccttcaaagatcagaatcccaatgttcaggcgaaccctctgccgaaccatgggcctgctgtcaacatgatacaagattgtgatgaagacggtgtcatcctgaacgtccagcatgttcgaactcccctggtcccaatacatatcaagatgtgcgaggcagctctgtttgaccatgatcatgcagcgtgtgaagtatgtcctgtgaatgtaaaaggatgcccgaaggtacaagaggacatacaaaggctgatagacaacagagaactaatcatcacgaggaaggacaaagaagtgtgcgtcattacccctgagtttcagcggttggaaataagctataacagtggggaatcaactactactccactggtgattagcttgccaggacctatgccgtatgcttctctaaaagcggtcccttacaagtatagtgccacgatgttggaaggtgggcaggaggtgcctttgccctctctaactcctgcgatttctgtggacaacattgctagtgacagtaaggttctgaggaatggacgtgttatccccacattgtttgcaaagaaagtgaatgatccggcagttaaacaggtgacagtgaacggccccggtacaaggaaggaagtaggccaatccaatgggactagcaagaattctgatcatgacgaaattctgaaactgatccagaagagtgagtataaagtagtagaccagctgctgcaactcccttaa

SEQ ID NO: 11360 - DNA, 206 bp, Glycine max
  Peptide Sequence Number=SeqID_128138
atggattactttactttattcgggctgccagttcgctacaccgtggacggcagcctgcttgcgtcccgcttccaggatctgcagcgccaatttcaccccgatcgtttcgccaaccagccggagcgcgaacgcctgatggcgttgcagcaggcggcgaccatcaacgaagcctaccaggcgctgaagcacccgttaaaacgcgcgga

SEQ ID NO: 11361 - DNA, 435 bp, Glycine max
  Peptide Sequence Number=SeqID_128139
atggaagtgagggacaaggttgaactccttccatataaggacctagatgagctagtccaactttgtataagagtggagcaacaacttaaaagaaagccttctgcaaaatctaatggctttcactcttatccaaggaaggaccaagcccatggaattttgggggctgcaccttcaaaacccaaggaagataagggtcacattgcctctcaatgccccacaaagaaaaccatgatcatgaggggtcaagacatttatagtagtcaagaggagactacttcttgcccttcctctagtggaagtgaagatgaagtaaggggtgaagagtctagtgaggaagtttacccctatgaagaaggtgacctcttaatgccaaaaccttataaacttcaatggctcaatgagcaaggggaaatgatggttaaccaacaagtgaag

SEQ ID NO: 11362 - DNA, 171 bp, Glycine max
  Peptide Sequence Number=SeqID_128140
atgacggtctttcatttcttcaactacgccattctcaccttcggcccccatgctgtcttctattttgccacgcccttatctgagtatgatacactcagaacctctatcaaagccgttgttgtttatcttgcaacgacattagtgaaagttggtgaatatactgaattctaa

SEQ ID NO: 11363 - DNA, 418 bp, Glycine max
  Peptide Sequence Number=SeqID_128141
atggagaaaagcaaaggtaaggtagaagaagagaacactatgggcgagtcccacgtggccctatctcgccatcactgtgggcgagtcccacgtagcttgtgtgtcgccatttgcattggcgacactctcctctctccctcctacgtggcttatatcgccactggtattggcggcactctcctctctccacctttgtcgccaatgggtatggcggtgtgtaatggaattggtggaagttatacatgttggacaaggcatggtgagacaagagatgaattcaaagatttagggagtaatgagaggtatcctacaaatgatactaacacaaatacatatgatgacagccaccttgaagagattgcaaaagtggttgaagaggatattcaagattgttctggaatgtttttgaagttgaaaa

SEQ ID NO: 11364 - DNA, 159 bp, Glycine max
  Peptide Sequence Number=SeqID_128142
atggtccatgacatctccgtcaaggtgaaactggaagtaacagggacatcgacagccctaaatgtatttggcagtagacgaaggagcgataaatgggtttatgatcccaacttggttggctcatggtacctaacacatgcaactaagaatgcatcatga

SEQ ID NO: 11365 - DNA, 219 bp, Glycine max
  Peptide Sequence Number=SeqID_128143
atgtgggacaaaggaactaagaccacaaactctaacattgggcatgacccttgctcgcccaagctagcctctggctcgcctgggcgtgatgggaggctgagagatgggttccaaggttcagcattgagagaaataatggaagagaagaagaaagaagagaaaacaaagtcgaggcactgccgaatcgttcttcactctatgttctttgtttgtcattcg

SEQ ID NO: 11366 - DNA, 162 bp, Glycine max
  Peptide Sequence Number=SeqID_128144
atgactaaagcacgtcaaaagggggtacggaaagaaaatgagggaggagcttgccacccagctcgcccaggcgagctaggttacttcctcctgaaggcaccgccttctggggaacttcctggaagtccgtcaataataatagtaatgttagtaaccatatga

SEQ ID NO: 11367 - DNA, 156 bp, Glycine max
  Peptide Sequence Number=SeqID_128145
atgaggagaggagctaagagaaagacgaagcagggtcaagaagccaaacacgatgcagctgaagataacaagcccaaagctcagcctcgagctaaacaagccaagacctccaagcctcaatccgaaccttattttttatttcaattcgaacgttag

SEQ ID NO: 11368 - DNA, 486 bp, Glycine max
  Peptide Sequence Number=SeqID_128146
atgccaaacgcttcgagggggcctcagtatcaatcaccaccccgaaccttgcattttgtgagaggaggagggccttccatagtacttgagaatgaaaggattgagcatatggagcagaggctatgcgccattgaaggaggaaaaagttatgtctttgctaacatggtagagttgtgcttggtacccgatgtggttattcctccaaagttcaaggtgtcaaattttgataagtacaagggaacctcttgcccaatgaatcacttgaaaatgtattgtaggaagatggaggcatatgggaaagatgaaaagttgttgatgcatttcatccatgagagtcttgttggggaagctattacctggtggagagatctggcagctcaaatagtgcccttgatgatggagagggggatgataacaatgatagtggacacattgccggtgttttactatgaaaagatgttttatcatttgggcctattggattaa

SEQ ID NO: 11369 - DNA, 309 bp, Glycine max
  Peptide Sequence Number=SeqID_128147
atgcatcaccaaaagaggaaaactctagatgaagcttttcactgttatcaagtgagttggggacccagcatgaccacagatcgacctccactccctatggctaacacaatcccaggtatagggcctaatatctcaaaaaaaagccatttggtgcaggggaagcttacccaagcgagctggttgcttaaggatgaaggcattccatggcctagacaagccagatgctggcctgggctagctcaagcctggaaacatccaaaaaatggccatttttccccctttccttgtggtttttgttcccgcatctga

SEQ ID NO: 11370 - DNA, 453 bp, Glycine max
  Peptide Sequence Number=SeqID_128148
atggataacgaggagggagtgcaagaacagatgaaggctgacctattggccttgaaagatcaaatggcttctatcacggaggccatgctaaagcttcaaaaaactatagaagataatgctacggcagccgcttccaatacagctagggaagcggaaccggtgctaccgcccataataaacttgggccaagacagaaacacgacgggtttcaatcggaggtataatcctcaagcctacccttatggtttgcctccggacttcactccccataccactccagacgatttgagccaagcccctacctttgaggggcagctccctcctcgtgccgactatcctctgcaagaagatgatgaaggagatgcccatttaggccctctacttcccctcaaggatccgaccgccccaaccaaacatagtctgccatgtcccgtctccatccacgtccgttaa

SEQ ID NO: 11371 - DNA, 1029 bp, Glycine max
  Peptide Sequence Number=SeqID_128149
atgctcaagccgggccagggcaccgacttctatcgccacaacggcgccggcgagatgctggtgttctccgccgccgacttcgaagacttcctgcagccgcgcccggatctgccgccgggcaccgaggacgagctggagcgggtggtgcgccatctggtcgagcaccgctggccgttccgcctgcacgccacctatgacgaatccatcagccgcatgctggacgtgttcgagaaggtgaaccgcgacattccgttcaacgggctgcactggctgttcgaccacgccgaaaccattaccgaacgcaatatcgaacgggtcaaggcattgggcggcggcattgcggtgcagcaccgcatggcattccagggcgaatatttcgccgagcgctacggcatcgaagccaccaaacatacgccgccggtggcgaaaatgctggcggccgagctgccggtcgggctgggcaccgacgccacccgcgtcgccagctacaacccgtggacagcgctgtactggctggtctccggccgcaccgtcggcggcatggcgatgtacgacgacagcgcgcggctggatcgcgaaacggcgctgatgctgtggacgcaaggcagcgcctggttctccaccgagcagggcaagaaaggccagatcaaggtcggccagctggcggatgtggcggtgctgtcgcaggactatttcagcgtgccggaagagcagatcaaaggcattgagtcggtaatgacggtggtggacggcaaggtggtctacgccgccggcagcttctcgccgctggcgccgccgccgctgccggtgctgccggagtggtcgccggtcacccaggtgccgggccactaccgttccgcgccgccgtcggcggcggccaaagtcggcgtgctgagccaggcgcaccaatgctgcggcccgtgcggcgtacacgcgcaccagcatgacatcgcgcgccgctccagcatcccggtgtcggatgaaaacgccttctggggcgcgttcggctgttcgtgcttctcgttctaa

SEQ ID NO: 11372 - DNA, 221 bp, Glycine max
  Peptide Sequence Number=SeqID_128150
gccgaagcaccccggactacgcggcgttcgcatcaagcgccgggcacggcatcggctttaacgatcagaagacggtggagatccgcgatctggtcaacggcatcgccgcgggcgatcgcatgtggccggactttgaagaaggctggaaggtgtcttgcgtgctggatgcgatagccgcctccgccgagcagcggcgctggctggagattaaccgcgattga

SEQ ID NO: 11373 - DNA, 336 bp, Glycine max
  Peptide Sequence Number=SeqID_128151
atgataggggtggtagtcaatgcatgcttgagtcaatcaaaatcctctttgcaccggtcatcaaaatcaaactccacctccttttgcagtagattggatagtggaaaggccacttttgtagaagcaaagcttcatggtgaatcaaaggtggtgacaaaaaagctcaaagatcaatcaaagaacaactcaagtgaatcaagaacaattcaagagttcaagaaaagaatcaagaagaattcaagactcaagaagaaagtctacagacaagaatcaagattcaaggttcaagatctcaagaatcaagatcaagattcaagactcaagattcaagaataa

SEQ ID NO: 11374 - DNA, 549 bp, Glycine max
  Peptide Sequence Number=SeqID_128152
atggatctagaaggtggaacaactcgtcgaaactccgttaagagagagtcgtggagaacggttgtgactctggcgtaccagagtttaggagtggtgtacggtgatttgagcatttcgccgttgtacgttttcagaagcacgtttgcggaggacattaagcacacggagagcaacgaggaggttttcggcgttttgtcgctggttttctggaccataacgctggtcccgctgctcaagtacgttttcgtggtgttaaaagctgacgataacggcgaaggaggcactttcgcgctttattccttgttgtgccgccacgccagagtgagttctctcccgaattgccaggtggcggacgaggagctgtcggagtacagaaaggattcccgcggcgcggctcccgagagcagctttgcggcgcggctcagaagcacgtttgagaagcacaaggttttgcagagggttttgctggttttggcgctgattgggacttgcatggtcattggagatggcatcttcaccccggctatttctggtgagattaaagagtaa

SEQ ID NO: 11375 - DNA, 216 bp, Glycine max
  Peptide Sequence Number=SeqID_128153
atggaggaatgcaatattggtgatgacaatgttggtagtactgacagttttgtggtgatggatgttggttgtgacaatggtgatagttatgacaacattaatggtaattggagtggcaattacaaagatggtggtattagtgatgataataatggtgacagtaacaataacattggtggtgatagccatgcttatagtcatggtggtgatagctaa

SEQ ID NO: 11376 - DNA, 458 bp, Glycine max
  Peptide Sequence Number=SeqID_128154
atgtcaatccttaccctcggaagcaaaaaagaagagaaggaaaatttccaatcaaagaaaaagagaaggaaaatttccaatcaaaggaaaaaaaggaagcaaggaaattcccaatcaaagagtgggagaaagaaaaaaggaaagaaagaaaattcccaaccaaagaatgggagaaaaaaacaccgagacttttcaagtctcacaagttatccagaactacgtaggtctgagttcctcattagaggatacgtaggagcaaaagcctcgcttttgtcgaccacactgctttctgttaccatgacccaagagctggtagcctgcggagacaccttacggttatccgcacctcgtcattcagtgaccccaagtgtgattgatgagcagaggccaatgtggtcatctgcaccctttccagagatgtacgcatcttctggtggagactttttcaagtctcacaa

SEQ ID NO: 11377 - DNA, 294 bp, Glycine max
  Peptide Sequence Number=SeqID_128155
atggcgaggacgtctagtcctttgaaggtgagggcgtgcagcccttttaaggcgaggatgtgtagtcctctgaaggtgagggcgtgcagccctctgatggtgaggacgtgcagtcctctaaaggcgaggtcctctagttctctgatggcgaggatgtgttgtcctctgaaggtgagggcgtgcagccctctgatggcgagggcgtgcagtcctctgatggcaaggacgtgtagtcatctgaaggtgagggcatatagccctggggtccacccttatgagaaagcaagagattga

SEQ ID NO: 11378 - DNA, 348 bp, Glycine max
  Peptide Sequence Number=SeqID_128156
atggaggagtttgaggctcaggtggactggccaggagaccaaccctcttcttctggagggggtggggcctttgcagcccaagagtctgtgactgaggagccactagcaccagcactagcactagcagaggatgaggatgagctcactcctcctaaaccttcttattttgatgcaggtacacacatggttcaggaggaggagactactccagatcagactccacagccatctctagcccctccacatatacctgaggatgttgcactagttgcgaagcctgaacagcttatacaggattcatcagcaactccatcactagatttgaatgaagaccagccacaggaataa

SEQ ID NO: 11379 - DNA, 405 bp, Glycine max
  Peptide Sequence Number=SeqID_128157
ggttaccatatggttacccgcacctttggtcaaccagtggcaaacaggcccgttgacgcacggagactaacatcgtcttctgcaccgtttgtcgtcctgtcccgtgaaggttaccttatggttacccgcacatttcgtcaaccaggggcaaacgagcttgttgacgcgcggggactaacatcgtcttctgcaccttttgtcgtcctgccccgggcaaacgcgcacgttgacgcgcggagactaacattgtttgctgcaccttttgtcgtcctgacccgtgaagtcaatggatatgcggggttaccatatggttacccgcacctttggtcaaccaggggcaaacgagcccgttggcgcgcggagactaacatcatcttctacaccttttgtcgtcctgacccgtga

SEQ ID NO: 11380 - DNA, 898 bp, Glycine max
  Peptide Sequence Number=SeqID_128158
ggctcactgggtattacagaaaattcattaaggattatggcaaaattgccaaacctttaactgaattaactaagaagaagaattttgtgtggggaaaagaagctttagttgctttcaagttacttaaacagattatgactacacctccagtgctgggattgccagatttttctgtgccgttcgaagtggagtgtgatgctgtaggaaggggcattggtgcagttctgatgcaaaagagacaaccaatagctttcttcagcaaagctttatctgatgggaatttgacaaagtctgtgtatgaaaaggagcttatggccttggtgcttgcaatccaacattggaggcactatcttttgggcaaaccttttgtggtttatacagatcataagagcttgaaacatttcctgcaacaaagagtaacttcacctgatcaacaatgttggttggctaagcttctaggttatcaatttgaagtaaaatataagcctggattagagaataaggctgctgatgctttgtcaagatgccatggtgatatggagctggctgtgatgttatcatatcccacatggttggatggagagcaattgctgcaagagggtcgtctggtgttatcctctgactttccttcaattcccgtgttgctaaaggaatttcatgaaacgcctatggggggacattcagggttcctaagaacttatagaagattggcagctaatctgtattggccaggtatgcaaaagagagttagagattttgtgagggcatgtgatacttgccagagacaaaaatatgcagcaacagcacctggaggcttgcttcaacctttgcctattcctaatgccatttgggaggatctttctttgaattttatcactggcttacccaaatctaaggg

SEQ ID NO: 11381 - DNA, 399 bp, Glycine max
  Peptide Sequence Number=SeqID_128159
atggggaatccatgggatcagtcttcctggaaggttacattttcgctcgacaatgttggatttgcgacctttggtgcacctcgccctatagaggagtttaaatggaggagaggatggttggagtgggagaaaatggtggatgaattctatgctttggttaacaacgccaatgctaaacaccaaggtgacaagagaaggtgcaaaaagctaatgatgaactcgcttagcgaggcagataggctgagcgagcctcatccgcttagcgaggcagccagcttgcttagcagatgggaaaccttagaagaggataagttagagatctatgcactaagcgtgcagccagcccgcccaacgaggatgttgtctcttcttgctcttagcgcgcctaagctcacttag

SEQ ID NO: 11382 - DNA, 774 bp, Glycine max
  Peptide Sequence Number=SeqID_128160
atggatacgatacttggtcttaccattttatatactacttgtgcgaattggtacacttgccaaaacagtcgaacagttgcaccccctgagctccgcgtggcgtgtgcccaagtttctcaccaccgtgacctcgggctcgtgccctttagttgtcttgcccttcaagtgttttccaaggttgaagcatttcccttgcttgatggtgatggtattgaaggccaaagagcactttggatagaaattaagggaggcaaaagagctaagagaaaaatatggaagactggtgtgcttgcggtcatttggttgctgattgattttgtgaagaggttgctcttggggcatcacttggcatctcctgttgaagttgttgtctatgctgtagatggcgctgatcaaaagcctgatgatgatgtcaagaacatgcctttttacttatgggagattctgtttgttgagttgaatgggattaagtgggatgagtttgtccattttgcagatccagctataggtcagatggcacatccttgtcagatacgaagaagaagcatcaacattacaccaaagattggagatgatatcgtaagtttagagagtttgacttttgcttctcatttagttaactggagcaaagcagaaaatggagttagcacaacaaccaaagtcatcaaaaagccatcattcaaagacggtgctgacgtcacgaccgtcttagaatgctggctttctaagacggtggtgacgtcagtatcgtctttgaaggttgaccttttctaa

SEQ ID NO: 11383 - DNA, 297 bp, Glycine max
  Peptide Sequence Number=SeqID_128161
atgactattgtcgcaacatgcccttttgcgggcatgcaaggcgaggctcacgggtgcgctttccaaaggaggaaagatgcgcggagtcgccaccaatgtttatttgtgggaaacgtcggaaaaaccgaaggaaactggtcgacaaatgcgaggtttttgctcctacgtaccgtctatcgaagaggaaatcagacctacgtagttctttctttgacgagaatcacacgattctctttttacttgaaaggtgatcatttaaaggcgctggaccttaaaagtgatccatctacttggtga

SEQ ID NO: 11384 - DNA, 303 bp, Glycine max
  Peptide Sequence Number=SeqID_128162
atgttctacagcactgagtcactagataaaatgaaaagcataggaaactctttgcaatatcttgtggtggcattttcaatttatgttggaaccttgttggttaatgttgtgcaccaactgactcggaagcatggtggaattgattggttgaatgatgacatcaatgctggaagattggactactattacttcctcatggctgggttagctttgattaatctcgtatatatcttgttctgtgttaaacattaccgttataaggttaatgtcgaagaaaaagttgtggagaaacttgagccttga

SEQ ID NO: 11385 - DNA, 594 bp, Glycine max
  Peptide Sequence Number=SeqID_128163
atgagggatgagccagttgagcttacagattctagtacttcagaagaaattgtgttatacgaacgatggaaaagatctaatcgtctttccattatgttcatcaaggcgcatatctatgctagtatctgtggttcaattccagaaagccaaaaagtcaaggatttcatgaaagccataaatgaacaatttgaaagttttgagaaggccttggctagcaccctaatgtataagttgtcatctatgaggctcattggagtcgtaggtgtgaaaaaacttattatgaaaatgagagatcaagcgactcaacttaagttgctccaagttgaaatttctgagtcattcatggaggaagggagacttgctcaagaaattggtgaaggtgctcttatcgtgactcaatataaggggaagaggggaaggaaggaaaagaatcatatacctcctattgccaaaattaaaaaggagtctagatttctaataccatgcaaggcttctcaagccagagggagccaaatgaaggtgaacggttcatctactctaggaatcggatccgttcacatgtggcggctattggcacatgtagacttaatttag

SEQ ID NO: 11386 - DNA, 1101 bp, Glycine max
  Peptide Sequence Number=SeqID_128164
atggatgatatggacatggacattccactccctgaagaactcgaatttctcgaatcaaattctcactttgccgaacaacaagaagaagaagaccgtcactattacttcccagacctagaccccaccgccgaaattcatgaatcaaattctcaacaatcgccgccaccgccagatctcgctgctccttcggcggagcccgaatccagcggccacaagcgatcgtgtccgccttctccttctcctcccgaagaggagaagagagcgaaagttagggttgcagttgaggaggattcctccgccgcggccgccgacgaggactggctccggtactctcctccgccggttccggagggggagccggcggtggaggaaatggcgttcgagaaggagaagacgctgtcgaggtacgcctcggagatcgacggcgagtgcatgccgatcaccgcgcccagcggcaacagggtgtacgcgaagcttaaccggtttcaaggagaggagcgcgtcacgaagcttgattacaatggatattctactgaacttagttcagaaccagttaatgttatacttgagaggttggagcaagaggcttttgctaaggccttggaagctagttctgaaggccaaagtgttctagacgttcctgaagcgcaaatggttcatgagcgactttgggttgataaatatgctccaaaatcatttactgagcttctaagtgatgaacagacaaatcgcgaggtactcttgtggttgaaacaatgggattctattgtgtttggatctgaaattcgaagcacatcagatgacgttttgtctgctttgaaacgacattcttccattgtccacaatcagaaaccattgaattcaaagtttccaaggatgagcagaggacccagatggagtaatgggaggaggtataaaaattctagaagtatggatgaaagtggtagttcaaagagtattcaagatatatggaatgcaaagtcaaggaatattggtcctccagaaccaaagcttccacctgagcattttgccctcatgttttctgattatttgatagtttatggagaaaaatacttatcttccctccaaatcatattctaa

SEQ ID NO: 11387 - DNA, 429 bp, Glycine max
  Peptide Sequence Number=SeqID_128165
atggtgagatcaaataaaggaggcaaattttatggcaaatacactgaaaatggacaagcacttggtccttttgcaaagtttcttcaagagcatgatgtggatctaacattgagaagatcaaatagaataaagaaacctgcaattcctagtgattatcaagtgtatttacaagagtctcaatatgattttggagttgaaaatgatcctgagttgtttttgcaagcgattaacagttgtaattctaagctatggtatgatactatgaaagatgaattggaatctatggcaaataataaagtatgggatcttgttgagttgcctaataggataaagcctattggatgtaaatgggttttcaaaaccaagaaggattcattaggtagcattaagagacacaaggctcgattggttggcaaaggattcgcttaa

SEQ ID NO: 11388 - DNA, 117 bp, Glycine max
  Peptide Sequence Number=SeqID_128166
atggtgatgcaggtccagtggagagtggaggcgcctgaagaagaattcggtcacaacgatggcgatgcagtgattaggcttgataatgtggcacctgtctaccacgccatcacttaa

SEQ ID NO: 11389 - DNA, 159 bp, Glycine max
  Peptide Sequence Number=SeqID_128167
atgtggatatcatgtggtggaggatgcacccactcctatgaggtatgggaacgcattcatgattattttcaaaagcaagcgatagccatagcttgccaactttgcactcagtttcgagctacgacacttgcaagcaaatcgatgcgcaagtttctttag

SEQ ID NO: 11390 - DNA, 309 bp, Glycine max
  Peptide Sequence Number=SeqID_128168
atgttttcctatggaggtgacactgaaagtgctggaaagttgaactctgaaggtggttcttttgaggttggagtggaaggaggcaaaagatattggaagaaaattgagggtgaggatggtcgacatgggaaaactgtgactatggatgttccaattgctgatacaaaaaggaatcgtagcattatattggccaggaaaagaaaaactaggaagagacaagcagctcatctgttggagcagaatcaagcacccatggcccaagtaacgatgttcatcagcagtatgcagcagctgaatctgatcccgtag

SEQ ID NO: 11391 - DNA, 225 bp, Glycine max
  Peptide Sequence Number=SeqID_128169
atgaatagcgctaggcaatcaattcatagggctccgaataagatgatggaggatgcacgaacagcgctagacaatcaattcgtggggctccggactcaatggtggaggatgcatgaatggcaatcaattcatgggctccgaataagatttgatggtggaggatgcacgaacagcgctaggcaatcaattcgtggggctccagactcgatggtggaggatgcatga

SEQ ID NO: 11392 - DNA, 702 bp, Glycine max
  Peptide Sequence Number=SeqID_128170
gctcctgcgcaggagcccgttgcgactcagacccactctctggccccgtcaatccaggccgaagtggctgacgccgtcccggctactgctcgtctccacgaagccgaagcaacaccagcgccagtccaacttgagccagacgttccagcccccctcgcagcagccgaggccgctgcgcccagggtctcagagcacgagcctccttacgcgccaccacccgtggaagcactggcggtaccaccctcaagcgcaacggcccagcaagagcccgaagcgccgcccgcccccctgctgcctacccagcctgagcatcccgatcacgccctctaccagcaggtgcgcacaggcgtagccacattagatgcaaagcacggtcgcacgttcgacgaatccagcgagcgcatgactgccagcttgctggtgctcgccaaggacaacgacctggatcgcgtggaccacgtactgctgagcaacgccaccgcggacaaacccgccggtcatactctcagttcgacgccgtcagccgcgaagcgcatcagcgcgtcatcgctaaccagctggagcagcagctggaagatcagcgcgtgcagcaggatatccagatccgtgccgccagcatgggctgagtgggtaagacacgcgcgaaatcattcacaacagcccgccctcttggtccctctgcttgccaatcggcgctattga

SEQ ID NO: 11393 - DNA, 312 bp, Glycine max
  Peptide Sequence Number=SeqID_128171
atgaccttggtgatggtggatggcaaagaggatcgcgagcactacttcttcgatacggaagctttctacctgcggcggggaccggttcccacggcagttccgctttcgcagatcacctcactcacccgaacgtccgacgtcatctatgcgcgctatgtctggcaagtatgcttcaacagagcatcgggtaaaaagtgcgtgacgttcaccaacaacctttcgctgttcaaccgcgactttctgctttttctggaggcggtgcggaaggccaatccgctcgcgaccgttgagcgagcgagtctgttcttctga

SEQ ID NO: 11394 - DNA, 231 bp, Glycine max
  Peptide Sequence Number=SeqID_128172
atggagattgctgaattaaattttcagcatggtaagaatttgtttgattcaattgtgggagtagaggttcctatctacttctcaaaggttttaaaaaaggtggtgtacaactttcttgaggatgaaatcaccaagattctgaaagtagcagatcattacagtgcaagatccaaccagactttgaaagaacgggaggctagtccgataattcatttgaaagaaactcaataa

SEQ ID NO: 11395 - DNA, 300 bp, Glycine max
  Peptide Sequence Number=SeqID_128173
atggacgaagatcaatggatgtatgacaatataatgtctcaagaagtcgatatggattatgaaaatgaacaagaatgtggtgtgaatgaaccacatgttgattgtttggatgcttttaatacttctcaagtctttggtactcgagatgatgttttacagtgggctcgatcacctcataaaaacggatttgttgcagtcattatgaggtctgacacacatactggtagtagaggaagaagttcatttgtgttaattggttgtgaaaggagtggtcgttataagtgtaggaagaaggaattt

SEQ ID NO: 11396 - DNA, 984 bp, Glycine max
  Peptide Sequence Number=SeqID_128174
atgggaatattaatgtgcagtggtgatagtaacttgattctggatgggattcatgaaaatgttttgcggctcaattatcatgacccagtgatgcagaaaactgttgagtgcttcaacaatctgggagtttatgatctaatgcatcaatatataatgcatacacaacagttgcccctttatgtatatttgcccctagtagcaattactgtacatcatattgtatctcaagttcagaaaccaaccattgagtggccaaagtcacatcagagatatcgtacaatgatgatggaaaagatggacattttgaatacctggcaccacaaaatcccaccgtatattgcaaggaacttatcagctagttcctttgttgaagacttaatttctccattattacatattctgtccccaccaactataagaccggtagcatttcaattactatcagataaggagaagaatgatcttgctcaattagttagcacaatggtatcatacactataacgtataaaactgtgaaatcagatatgctgcctcaaacccagaggtgtgaagtagctgatggcttggcactgtctcttgttcctcctatcagcgactttataaatttcaaggattatacttcaaaccataatgtgctttctgtagctatgaagcaggttttggtacatgaggttgaaaagcataagattttacaagttagtaatgacaaaactggggccttcacaaatggagggcatgaagttattgaaactggaactaacaacatcccattagccaataccaatcatgcaactgcagttgatatgaaaactaatgaaaatcaggctaatgttttatcacagcaattaaatgctaatcccacagctgtttcaccaaacttgaattccgataaaagttcaattgcagcagactgtgggaaactactaaacatgggaaatgtgaaaaaaccatccagaacttcctcaagtttctttgacaggtga

SEQ ID NO: 11397 - DNA, 423 bp, Glycine max
  Peptide Sequence Number=SeqID_128175
atgattgatgaagggtatgataagacgtcatcacatgcactgacgattcctgacgtatgttggatgccttatggtgaccaccgagtagttagggcgtttgacctcatttcatgctttcaaggtgagcttagatggggtcccattgtggtcacacatcgaccggagagggtggtgcgacaatttggctacgttcagaccattcctccaccgcctattggtcccaccttgtcatttgaggatatggacgacaggtggatgcattacttagaccatctagcagctgtaggacagatttgtgttgagcatgaccaatgtgcaacagattacatggattggttcttcgggatatctcatccattcatcacacccacacaggcagttgatccgcccaaacatccacctatcccacaacatgagacatag

SEQ ID NO: 11398 - DNA, 489 bp, Glycine max
  Peptide Sequence Number=SeqID_128176
atgtgggtgtcccttaaagctttgtgggaaaccaacggttggaggccaaggttggatggtgaagttaatgtgtggagtcacaatcttgaattagccaagtcattagttgggcacccatacgctagtcaattgactaaggacgagaagacaattattgttgatatgacaaagtcaatggtgaaaccaagaaacattctactaactttaacattgtgtttggatggagcaattaaagaattaaaattccccatccctctcttccactatcagccactcactcacgcatcaaagctctcttccgcttttcccctctcagccactctctcttcccctctcagccactctgtcacgctcttcccctctcagccactctctcacgttcttcccctctcagccacactctcttcccctctcaatcactctctcacgttcttatcctctctgccactctctcacactgtagacgcaagaacagaccttgcactctag

SEQ ID NO: 11399 - DNA, 466 bp, Glycine max
  Peptide Sequence Number=SeqID_128177
atggaggccatgaaagagcaaatgaccataatgatggaagccatgatgagtatgagaaaaatgatggaggtcaacacgactacagtcgttgccgtaagtactgccattgaggtggacccggctcacccatctggcctcaatcaagtaaatcattcagtctcagatatagtaggccagagaggcgaagcattgggaagtacgggcgacccccatttcgtgcaggtccgaagcaaacattccttcccaccatatggtttgcctcccaactatacaccacctaatgttgcatacactcctgatgagaatgtcgataactttactctcatacccattgagagccaacaaccccaatttgatcatgcacatgtctctcaacccatgagggagacacatgaagtaccttgccacactttagtcgactttgagcctcacctcggatatgccactgaaggacaagcaattggtg

SEQ ID NO: 11400 - DNA, 783 bp, Glycine max
  Peptide Sequence Number=SeqID_128178
atgaagttggagcctagcttggatgatgaagctggtctgcctgacatgcaacgacagtgccctcctacaccaacgccgctgcctaccactctcaattggacacctaacacgcatcgaagtaccatgcttggtcgtggcaaagacagtgctgaagcgctacgaagggcttctgatgcttcaaaaaaaagtgataaagggataagggaatttaacgatacgaggttggatgtgagattcaaggatgctaaggttgagtttgaagcaaacatcagaagaagaaggaaaggggggaaggttataaggaagaaaagagaaaaaagttgccatcggaaattgcctatgatggcaaggaacgatcaccggaaaatttatggaaggagattgaaggaatttgaagcggattttgactcggactatgataatgtggttttacaaatcattttgcgatcacttgagcattcaatagcgaagcaatttacgaaagagttgtgttattgtcatgatgaagattataatctaattgtcgatgttattagtgaagaacttgtgaatctaaagttgaaacatggttcaaatgatgttgtagatgacgagaataccgaatcggtgaatgtatcaattgaggatcctatcgttgccaaacctaaaggatgtgatccaaatatgcactctagtgctagaacttttaagtggaatatcaaatgccacaactgtggtggttatatggtcacaatagacattcatagagcaaatacccaaggttcgcaaccagttggtcaaatg

SEQ ID NO: 11401 - DNA, 1050 bp, Glycine max
  Peptide Sequence Number=SeqID_128179
atgaatgttgtcaatagacaagctggtggaatgtttttcatgtatggatatggaggtactgggaagacctttatgtggaagacattaacttctgcattacgttcgaaaggtgatattattttgacagttgcctcaagtggtatagcctcattgttattacccaatgacaaaattgcacatttgaaatttgctattcctgtgcctgcattagacaactccacatgtaatatcgaccaaggtacggaacaagctaaactattaaaggcaaccaagttgattatatgggatgaggctcctatggctcataagtattgttttgaagcattagataaaacattgaatgacatcatgtgcatgtctaatttcgattgtgttctatttggtggaaaagttgttgtgtttggaggtgatttcaggcaaattctttccatcatcccaagaggaagtagatccagcatattatatgctactataaatgcttcatatctatgcgactactgcacagttttaaagctgacaaaaaacataaattccatcagaattgttgattacaaacttcaccgatcctatgaagtgattgtcagccatacttacccagatatccagcataagtataaggatgaggaatttctcaaatctagagctaatctagcttcaacaaatgaggtcgtagaccaaattaatgactacatattaaacatcatcccaggtgaagagaaagaatatttcaattatgattcaattgacatgagagatgctgcaacaagtgaatgttatgaagctgttacatcagaatttctacaatcattgaagacatcaggaatatctaatcataagataagtctgaaaatagacacacctattatgttgattcggaatttagatcaagcgaaaggcctttgcaacggaacaaggataattgtctatagaatgaccaatcatgttattgaagcatggataattttggggcaaaaacataggaagtttggtgtatattccacgaatgtctttatcaccatctcaatctctatggcctttcaagatgactag

SEQ ID NO: 11402 - DNA, 645 bp, Glycine max
  Peptide Sequence Number=SeqID_128180
atgggctcaaaaatctaccctaaggttcatgagaaccctaaggccttctttagtagctctagcccaatcctcttggagcctcttgctcatggctctggaatgatatgtccattacgatgccataaagagatgcatgatgtgattaaggaacaagccagagaagatgggcaattggggccatggcagctcgctcaggtgagctggaactcacccaggcgagctggtttcttaacattgaagtcttttggtggcccaggcgagccagaggctagcctgggcgagctaaggtctaggaaactcaatgaaaacacccttttgcccctccttttggatcctgatacaagtgtgtatccaacacaagtaatgtcgcttatcgacaaacatcttctatttttaatagaaagagaaagtactgaaggtagatgtcttcaagatgttgttaactatcctaatgcatatacagtgcatgaaatctatcatgacaagcaagtgcaaagacagttgcacaaagatcatcaattgaaaaatgctaagatgattattgtgcagcctgctccacctgtagtgttaattgaatggattacaaagcaaaaggaggacctcaagtgtcaaggttttcgaggaagcaagaatgatgcaccctaa

SEQ ID NO: 11403 - DNA, 285 bp, Glycine max
  Peptide Sequence Number=SeqID_128181
atgccactgaaagactctactgagacaaagacgggctgtcaagaacgtagaggaggtaggatgggcagttggtcagatctaggtttcctcatttgggatcctggggaagaggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccaggggtcgcggaccgaccatag

SEQ ID NO: 11404 - DNA, 339 bp, Glycine max
  Peptide Sequence Number=SeqID_128182
atggggctaagctctagcttctttaggaatcttctcaaggaagcttctcaaggaggtgagtttcgtgctcccccctctctttctctctctctttcttttcctccattgaagcaccctctccaagcttcttatccaaggcactctcttggtggtgaagctccttcttccatggcttattccctagtggatggcgcctcctctcctcttgtcctttgtcttatgctgcatctccatggtgaaaaatcaccattgaaggacatcattgaagctcaaagatctagcctccatagaagctccacaagcagacttccatcaataaccctaagcttgtctatttaa

SEQ ID NO: 11405 - DNA, 201 bp, Glycine max
  Peptide Sequence Number=SeqID_128183
atgggtgtccaatctcagttggctacactctcacagataatgaaaacagttgatccaaagcttcatcatcaccttgaggatttagatggaggagaatatctctttgcatttcgcatgcttatggttcttttccgaagagaattttcttttgcagatactttgtatctttgggaggtaaggacgattcctatgacgatttaa

SEQ ID NO: 11406 - DNA, 333 bp, Glycine max
  Peptide Sequence Number=SeqID_128184
aacgcgttcgacaagaaggtgcgcccgcataagttgaacgagggggaccttgtgctgaaaaagatatcccacgctgttaaagataatcgagggaagtgggccccgaactatgaagggcctttcgttgtgaaaagggctttttctggaggggctctggtgctcaccaacatagatggcgaggagctaccctcgcccgggcagaatcgtcttaggcaacggtcagatgtcgagacaaagctaaagggtcacgaccgatggatcgtcgtcccttgcccaactctggacaaacggaaagcactgccgcaagccagcccagtatcctttaaattccca

SEQ ID NO: 11407 - DNA, 252 bp, Glycine max
  Peptide Sequence Number=SeqID_128185
atgaaggacaagtgcaatcaccctggcaagtctcaagtttacggttatgaagaacaagttaagaagtcggggggaaaaatagataggcaaaacaactgtaaagatggaggacgttcagagtttccttccagcagagagaatgttcttaatcttgaagccagatcaagtggaagagatttttacaagcataatccattaaactactttaaagatgcagtgctaaaaaggatgcaatgttataaaattaaataa

SEQ ID NO: 11408 - DNA, 384 bp, Glycine max
  Peptide Sequence Number=SeqID_128186
atgaacatgaacacaaagattgacaaactggcaagtgaaatgaagtcatcggataaagtcatagtcaacattttgtgggtagtatcagatgtggttattgaagacctaaagtgtcgctctcactctcttgctctccgcaacggttcaactcctcactctcactctcctcactatcttattctggactacgagatccggcagctggaccacaccactgggaatagagctcacactgacggtgaggttccagagcttcttttattttcctcgtttcctctcttcccaacaacaaagcatgagtgttcactggcagaagaaaatggggatagagtcacaaattccccgaagcttaatccgaagaatctacgctcccttggacaatga

SEQ ID NO: 11409 - DNA, 156 bp, Glycine max
  Peptide Sequence Number=SeqID_128187
atgtctcctgcagtctgtaaagttggtgttgacgtcttaaaagttcctctttacaagctttgtttccatttaaaaaggaagagtggcacttatattttgctttgtttatgttccgtttcaaactcaaagacttttgttggaggatgtgaaaactag

SEQ ID NO: 11410 - DNA, 309 bp, Glycine max
  Peptide Sequence Number=SeqID_128188
atgatatcgtccgggtcgatttcgggaagaacccacaccttcttgctccacacgccaaactcatacgaccacaacgtctgccccacacatttgaaggtggagagagtgcacagaaatcttagtggtgccaacattcaagtgaggacgattacacacacacacacacacaatcaggatcccatcattgtcgaaggtggcgaatctggcagcaagggagaaggcctcgtcctcgatctggtgggcgacaacagaggcctcatcgggggacattatgttgtagtgcttggagaagacaaagggggaggatag

SEQ ID NO: 11411 - DNA, 351 bp, Glycine max
  Peptide Sequence Number=SeqID_128189
atgcaaagaacagagtgtatgttagtcatttctccaagaaaaggcttcactatcggctcaatcaatttatccatgcagccacatgtctccaattggtggcaattacacttgataaagtcgatcgaaaccgcagtgccaaaatctcctcctactttgaacgcatttgcgtgctttgctttagcgtgcctcaaggggttgcaaaatattgccttgaaggaggaagcgtccacgagcaatgtagatggtgtaaccaccccaaccttgttaggattggctaattccttatcgaggtttctgcttactttaacaattttctcctgcacaattcctgtgtatttatgcttggtttag

SEQ ID NO: 11412 - DNA, 690 bp, Glycine max
  Peptide Sequence Number=SeqID_128190
atggggaaggactacatttcaacacacactcctggattcgagaggataatattgtgggtgagtttcctttacagaatcccaacctcatctaattttgttgaatcattaaagtggccatatttgacaaactacttgaatcagctaaggagtcatcagaataaagatggttttgcttcagtatcaggcattctgaagtactcatacaaagaaattcaaaaggctacacaaaacttcacaaatgcattgggagaaggatcctttggcacattttataaagccatgatgcctacaggagaggtggtagctatgaagatgcttggacccaattcaaaacaaggggagaaagaatttcaaacagaagcagtcccacccgttgttcatcgtgatttgaaatctgctaatatattgcttgatcactcaatgagagctaaggttttgatatgcaactttcaagtaagaagagaggggcgcaacaaacgaatcacggctactaaactagaagaggggaaaagcaaaccaactgcagccgccaaacaatatgaggggtgcgaagcacagtcatctaacaacaggtccctaaaaaatcaagggaagctgccaaacaagaaaagggacataacaaaacatgcgcagccaccaaagaagagggatgcaagcttggtcgctaaactagaagaggagtgcagttaa

SEQ ID NO: 11413 - DNA, 201 bp, Glycine max
  Peptide Sequence Number=SeqID_128191
atggaaactccagaggaatcagccaaaaaaagcagcaaggtgaggctggacggaggagagtcccaaacagaaaagacaaaccacaaaaaccacaatccagttgccacaagcatcactaataagacctccaaaaccctaatttcctgggttgccgaaggaactcccatccgtattgactttgatagaatccataggaggtga

SEQ ID NO: 11414 - DNA, 279 bp, Glycine max
  Peptide Sequence Number=SeqID_128192
atggcgaggattcctgacaagattaagtctattgatgggtcaaaagagacgcttaagcttgctgtcagaatcacggatctttggttcgttgggactcctaacaagtctgagcaagtggaaatggtttttgttgattctgagttcttatcctatttgaatgaacgtgggaatgatgggctgatggttattattttgacacatgctagagtaaaagatgcacaggataacttttggcgttgcatttttccgcatttacaggaagttatccaacttcaatga

SEQ ID NO: 11415 - DNA, 618 bp, Glycine max
  Peptide Sequence Number=SeqID_128193
atggagtatgaagatgaagattggctttgtgtcactatggatgagttttctcttgctactgaaaatggttgtaacaggaagaggaactttgatgatgacacgaaagagtacaaatcaaagaaccttgagactgaaaggaggaggagggagaagctcagtagcaggcttttgatgctgcggtctataatgaataaagcaatgattgttgaagatgctatcacctacattgagaagctgcaagacaaggttcagagtctcagccaagagcttcaccaaatggaagcaacttcagaggaaacagcagagacaaaaatagttgaaattgatgctgcggaagatatgaagaattgggggatacagtttctgcaggaagaggtcatagtggaagaaataaacgagaataaactctgggttaagatcattgttgagaagaaaaggggaagattcagcagattgatggaggccctcaataattttggcattgaactcattgacaccaatctcacaaccacaaaaggagcatttctgattacaagcttcataaagggcaagaacggtgaaagacttgaaattcatcaaaccaagaatttattgcaagatatcatcaatgacatatag

SEQ ID NO: 11416 - DNA, 309 bp, Glycine max
  Peptide Sequence Number=SeqID_128194
atggagtatcaagatgaggatcagttatgttttactatggaagagttttctgttgttgctactgaaaatgttagtagcaggcaaaggatgagtaggaagaggaactatgatgatgacacaagagtgtacaaatcaaagaaccttgagattgaagggaggaggagggagaaactcagtgcaagccttttgatgctgcgaggaacaattattgtagatgctatcacctacattgagaagctgcaatatgaagtgcagcgtctcagccaagagcttcaccaattggaagcaaattcagagaaaacagcatag

SEQ ID NO: 11417 - DNA, 285 bp, Glycine max
  Peptide Sequence Number=SeqID_128195
atggctaacaagctgcttaatcacgagaaaaacattcttcccatcacttcgactgacttgcttgtcagtatcctaggattctggccaatgactatcaatggccttgttcttccagaagctatggttggcccaaccttgcatgatgtggcagccatcttgaacttgccaatatatggcgaggagctgccaccgctttacaaaacatgttgttccaccactgccaacacttttagcataaaatttaccaaagatgactttgtgttggatcaagtggcctcagaataa

SEQ ID NO: 11418 - DNA, 1002 bp, Glycine max
  Peptide Sequence Number=SeqID_128196
atggtgtgtgcaatgacaatcattgctcaacggcagcaccacgaagtgcgacagaggcttgaaaaacttgtccgagagcagcatgacggtggtggagctcgtgctatggtagctgcggctaagtatgttgattggttgtctaatatagtccctatcatcaagaagaatgacaaggtggaggtctatatggacttcataaaattgaatttggctatccttaaggatgagtatgccatgccaattgcagacatgttggtagactttgcggttagcaatggaatactcacctttatggatgattattcaagtcataaccaaattttcatagccaaagaggatgttcataaaatagccttcaggaccatggaggtatacatacatgacatagttttcaagttggctacatttgatcaacacttgttgaacttggaacatgcattcaaaaggatgaggttacatggcttgaagatgaatcgtgagaagtgtgcttttgggataacgaccttagctaatttcttggcacaatattcgtgggaagatcccctagatcctttcgataggcaaatcacgtatatgggggttaagccatggataatgtcatttgatgagtccaaaatgaggtcagctataggaggtgaatatgaatccttagtcatgggcttgaagatattattggctaagtatggtaagtccattaagatcttaggtgattcacagctgaaacaagaagttaacgagctagctcaacatgcttccaagtacaaagagctacaagttgaagagctcgagtatgattggcttaatatggttgttcaagatacgaccacgactaataaggatgggcgacacaagttgatagactacttagaacaactgttagctaaacaagcgtcacactcaaactcattgttaggtgttgatttgtacaggagaatggctaatgatttgcttcttaagtgtgcaagtacaaatcggataccggagaccataacggcggattag

SEQ ID NO: 11419 - DNA, 528 bp, Glycine max
  Peptide Sequence Number=SeqID_128197
atgccatcgctaagcactcacggagcccagtgggctgaaagaatgggcactagtagacaaagaggtacccttaatacttctgtcaaattggctaattccattctaatccgtaggaagccttctattctagatgatacagttcagcctcttgaaaaacaagaaatatgtccaagacattctagtttagccatttccataggatcttgccaatattcaccttttgaggagctagcagcaattgccaaccccaacattataaataagattgagaggaaggctagtaaggcgaacatcactgctcaatttgcctttattgaggaaaaaaggcatgctgacttggaactgcaagccagaactagtgcacaggttaagcttcaagatcagttgacgactattcaaaaaaagatttctactctccaacctgttctcggagaggctgtaactagggtgaataattataatgataagagggtggaattctacgagcaagggaatcagctgataaggatatcgcctacaagattttga

SEQ ID NO: 11420 - DNA, 258 bp, Glycine max
  Peptide Sequence Number=SeqID_128198
atgtgcaagagagataatgaatcgttcaaagaatacgcccagagatggaggaatctagcagctcaagtagcgccaccaatgatggagagggagatgataacaatgatagtggacacattatcggtgttctactatgagaagatggtgggttatatgccttcaagctttgcaaacttagagtttgctggcgagaggatcgaagtgggtctgagaaaaggaaaatttgattatgctgctttgaagaaacccatgttgtga

SEQ ID NO: 11421 - DNA, 477 bp, Glycine max
  Peptide Sequence Number=SeqID_128199
atggggacaaatcaaactggcaaaaggttttatcaagtcaagattaagggcctagatatcaccagcattaaggagttggggcagttgatgggacctctccaaatgcaagccttccgcaagacgtacggaaagatcttagatttgaccatagcagagatatccacagaagccatcgcatcactcacccaatactatgaccagcccttgagatgcttcacgtttggagacttccaattagtaccgactgttgaagaatttgaggagattctaggatgtcctcttgggggaaggaaaccatatcttttctccgggtttcttccctccttgagcaagattgcagttgtggtcaaggattcggcgagaggattggaccgcgtaaagcaaactcgaaacggcatagtgggcctaccgcggaagtacttagaaggcaaggcgagggatatggcaaatcaagaggagtgggtcccatttatggat

SEQ ID NO: 11422 - DNA, 226 bp, Glycine max
  Peptide Sequence Number=SeqID_128200
atggcggaggttcccggcgacggcggcgcgacgctgtcggtgtcgggatcgttcaaggaggggagaggctcggcgaggcgacgcggcggcggaggaggagtgagaccgccgagcatggacgccgacgagttcatgaatttgttgcacggttcggatccggtgaaagtggagctcaatcgcctcgagaatgaagttcgagggaagaaaaatgcagctcgatccgaaa

SEQ ID NO: 11423 - DNA, 1037 bp, Glycine max
  Peptide Sequence Number=SeqID_128201
atggcctactacagctctgcctattctggttctgaaaattatggtgagtacaatttcaactcttatgctctcaattatgattatgctcaaattccatcctatatggcttatactagttatgagtacaatcaaaatcaaccatattatggatatgattcaagtttatattatgctcctaattaccctgctgagacttaccaaacccaaaccacatcttactcagccacaacgtatagtgacccaaaatctgttgtgtatgttcccaataacggtatgagtcagcttgtgatatcttattctaaagcggaattcaatgtgcctgaatttgatgactatgatccaacaccttatggtggtggatatgacattgatcagacctatggcaaagccctaccaccttcagataaaatttgctatcctcgttctgggtcaagtccaattactgaaccacaaccactcttttctgggcccatagttccattgcctactatagaagagggaattgaagagaaaccaatcacaccccagaatggagctatcatccaaacaaaaaccgaagagaagcctcagtcacaagatagtggcaaagatcaccctaaagaagtagaagacaacaactttgacactgagagtgagggaagtgatgaccatgaagatgataactattcagaatctggcattgatgaagggtacaatgggggacagggttatgatgagcatgagaagcaagtggttcctgttgttcctcaatatcctagtggatatggattggaagctatggacatttgtgaaagcttgtttggatattggccttgtttggatcgtatgaagaagaagagggaatgttgttgtgaggaagtgagttatagagggaacaattgtcaggagaacatgtggcaaggtactgcagattatctatttggcagtccaaatccttatggtgggagtggctatggaggagatgttgtttatggatatcaaaggcatcatccaatgcaagcacaatacaaacagattgattatactgatggatcgtg

SEQ ID NO: 11424 - DNA, 165 bp, Glycine max
  Peptide Sequence Number=SeqID_128202
atggataggcaagagcagtttaaacttcttttcgtggggcaattggagtttagcacttggatagttggatcgccacacctcgcgcttagcgcgttcagatcgcgcgctgggcgcaccatgcacgctgggcttgtgcttctattggatcacgcgctgtgcgcctag

SEQ ID NO: 11425 - DNA, 207 bp, Glycine max
  Peptide Sequence Number=SeqID_128203
atggtggttgctacttgccggcaaaatgggttttggaatttattaacattcttcaaaaagggtattgttaatactgaaacccttaaaagaacacccaataacttattaggagttgcaaatgaatccaccacgggtccccaatcatggatggttctaggttctggaaccgctaagcctacgatactgggccatgcgggttcttcataa

SEQ ID NO: 11426 - DNA, 213 bp, Glycine max
  Peptide Sequence Number=SeqID_128204
atggatgattggagaatcccagaaatccctcaggacacactgtatgtacctgagacaatcaaagataaacacagttttgattatgtaatcaagatggtagaaaataatattcctctaggacaagacatagggaaagaattccatttactctcaaaaaatccaatttatgaacatagcaaaaaatacaaatacctacacataggatgtgtcctg

SEQ ID NO: 11427 - DNA, 979 bp, Glycine max
  Peptide Sequence Number=SeqID_128205
agggagcggttttgattctgtgcttcaagaagaaacaggcataggtggtggcagccaagtttccaccgttgatgctttgaagccaatgaaccaagaattttccttggatcagcagagtctgaattctgttgttacaagcactggatcattatctggtggtttcccagttgtttcagcctcctatggttacccttcaacattgatacaaagcttatatgagcctgagcctcaaccacaacaacagaactcacttttcaccaacccctccatgtcctactcatcatcttccgcaaactatgggatatgttccaatgaactgtcaccaacttggtccaaagtttcttcccttcccaaaccctcaatgccaaagcaacagctcagtggattgcacttttccaacaacactgctttctggaattcttcagccgaagcacttaatgacataagagcaggtgtttttacttcatcacaagcccaatatcaaacggcaaaatttgaagagaaacccaactgccccaatactctattaaacaagctcaagagagaagaatcaccagacgcagcgaagaaaaattctcctgagcctgcattcaagaggcaaagaattgagactccatctccattaccaacttttaaggttaggaaagaaaagctgggggaccgcatcactgctcttcagcaattggtttcacctttcggaaagacggatacagcatccgttcttcacgaagccatcgagtacatcaagttcctccatgaccaagtcagtgttttgagcactccatatatgaaaaacaacggagctcccattcaacaccagcaggattgtgataatctgaaggactcagaaggggcaaaacaagatttgagaagccgagggctgtgtttggtgccgatttcaagcacattcccagtggctaatgagaccagtgttgatttctggacgtctacatttggaggcgcactcattggcaggtag

SEQ ID NO: 11428 - DNA, 2478 bp, Glycine max
  Peptide Sequence Number=SeqID_128206
atggagagaacagagttcacccttttatttcttgttacttgttgctatttgctatccttgtttcctacagctttggaagcagaggatgcaataactccaccacaaaccatcagtggctaccagacactagtctcaccttcccaaaattttgaactgggtttcttcagtcctggcaattccactcacatctatcttggaatatggtacaagcatatcccaaaacagacagttatttgggttgcaaatagagacaaaccattagttaactctggtggctccttaacattcagcaacaatggcaagctcatccttctcagccacacaggaagtgttgtatggtcttcaaactcatctggacctgcaagaaacccagtggcacatcttctagactctggaaactttgtgttgaaggactacggaaatgagggacatttgtgggagagttttgattatccatctgacacattgataccaggaatgaagcttggttggaacttcaaaactggcttgaaccgacatttgacttcctggaaaagctcttctaatccttcttcaggtgaatacacttacggtgtggatccccgggggattcctcagctttttcttcacaagggaaacaagaaggtcttcagaagtggaccatggtatgggcaacaattcaaaggtgatccagttctcagtgcaaatccagttttcaaacccatttttgtttttgattctgatgaagtgtcttactcttatgagaccaaagacaccattgtttcaagatttgtgctgagtcagtctggtttgattcagcatttttcatggaatgatcatcattccagttggttctcagaattctcagttcaaggggaccgctgtgatgattatggcctttgtggtgcatatggttcttgtaacatcaaaagctcccctgtttgcaaatgtttgaagggttttgatcctaagcttccgcaagaatgggagaagaatgagtggtcaggtggatgtgttaggaagaattcacaggttttcagcaatggagacacatttaagcagtttacaggaatgaaactaccagatgctgctgagtttcatacaaactacaccatcagcagtgatcactgtgaggcagaatgctccatgaactgctcttgtgttgcttatgccaaactagatgtaaatgcaagcggcaaaggctgtattgtatggtttggggatttatttgatataagagaggtttctgtgaatggagaagatttttacgtaagagttccagcttcagaagtaggtaagaagattaaaggtccaaatgttgatggaaacaaaaggaaaaaactcatactgtttcctgtgactgcatttgtaagttcaacaattattgtatcagcattatggttgataattaagaaatgcagaagaaaaagagccaaagagacagatagtcagtttagtgttggcagagctaggagtgaaagaaatgaatttaaactcccattgtttgagattgccataattgaagccgcaaccgagaatttctctctttacaacaagattggagaaggaggatttggtcatgtatacaaaggtcaacttccatcaggacaggaaatagctgtgaagaggctgtcagagaattctggacaaggcctgcaggagttcaagaatgaggtcattttgatctcccaacttcagcatcgaaatcttgtcaagcttctgggatgttgcattcatggagaagataaaatgttggtctacgaatacatgccaaacagaagcttggactccttattatttgatgaaaccaagcgttctgtgctcagttggcaaaagaggctagacataattatcggcattgctcggggacttctctaccttcacagagattcaagattgagaataatccatagagacctgaaagcaagcaatgttcttttagatggtgaaatgaacccaaaaatttctgactttggaatggcaagaatgtttgggggtgatcaaactgaagcaaagaccaagagaatagtgggaacctatggatatatgtccccagagtatgcaatagatggacacttctctttcaaatcagatgtttatagctttggggttttactcttggagctgttgagtggcaagaaaaacaaaggatttattcacccagatcacaaactgaatctcctaggccatgcatggaagctatggaatgaagatagggccttggagctgatggatgcattgcttgagaatcagtttcctacatctgaagctctaaggtgtattcaagtgggtctgtcatgcattcaacagcacccagaagataggccaacaatgtcatcagtgcttttgatgttcgacagtgagagtgtgttggtcccccaacctggaaggccaggattatattccgagagatttttctctgggacaaattcatcatcacgtggtggactgaactctggttccaatgacataactgttactttagtagagggtcgttga

SEQ ID NO: 11429 - DNA, 134 bp, Glycine max
  Peptide Sequence Number=SeqID_128207
atggcatatgcagctgatgccttgactccaacatcctccattaatgatggccaagaactaatttctgctggacaaaatttttctctaggattcttcacaccaggaatctccaaaagccgctacgtagggatatg

SEQ ID NO: 11430 - DNA, 1327 bp, Glycine max
  Peptide Sequence Number=SeqID_128208
cactgaggcactgtattgggatgaacctggagatagattgtcaaggtttgtgatgaaagatgatggaatgcttcaaaggtatatatgggacaacaaagttcttaagtggattgagatgtatgaggcaagaaaagatttttgtgatgactatggagcatgtggggtgaatggtatttgcaatattaaggatgttcctgtttactgtgattgcttgaaaggcttcaaacccaaatcacaggaagaatggaattcatttaatcggtctggtgggtgcatcaggagaacacccttaaactgcacacaaggtgataggtttcagaaattaagtgcgataaaactacccaagttgttgcaattttggactaataatagcatgaatcttgaagaatgcaaggtggagtgcttgaagaactgttcttgcaccgcatatgcaaattctgccatgaatgaagggcctcatggatgctttctttggtttggggacttgattgacattaggaagcttataaatgaagaggctggacaacttgatctttacataaagttagccgcttcagaaatagacactattctggctgctacaaacaatttttctactgcaaacaagattggagaaggtggttttggcccagtatacaggggtaaattggcagatggacaagaaatagctgtgaaaaggctatcaaaaacctcaaagcaaggcatctcagagtttatgaatgaagttggattggtagccaaactccaacaccgtaatcttgtgagtattttgggagggtgcactcaaggagatgaaagaattggttatatgtcccccgagtatgcagcaaatgggcttctttccctaaagtctgatgtattcagctttggagttatagtgttagagatactaagtggcatcagaaataataatttctaccattcagatcatgagcgcaatctgttggtgcaggcatggagattatggaaagaaggtcgagctgtggaattcatggatgctaatttagaccttgcaactattcgatcagaattactaaggtgtctgcaagttggtctcttgtgtgtgcaaaagttaccaaaagacagaccaactatgtcatctgtggttttcatgttgagcaatgaaagcattacacttgcccaaccaaagaagcctgaattcattgaagaaggattagagtttccaggagaaccagatttggatgaaagaaagagcattgtagtagtgcctcaggggtttgtgttcttggatattccagtgctcaaagatcttccttcaacacttcgaattagcggaactccaatgctcttctctgctcattttaag

SEQ ID NO: 11431 - DNA, 1272 bp, Glycine max
  Peptide Sequence Number=SeqID_128209
atgaagaggggaatgaggatgaacaaagttgttaccattatttttgctttagtttgtcaaccaatccttcagaaagcgtcatatgcaggtgctgccttgacccaaacatcatccattacagatggccaagaactcatttctgctagacaaatcttttctcttggattcttcactccaagaagatccagcagccgctacatagggatatggtacaagaacgtcaaacctcaaaccgtggtttgggtggcaaacagagataacccacttaatgacataagtggaaatttaaccattgctgcagatgggaacattgtactttttgatggagcaggaaatttagtgttgatggatgcaaagcattgtgattctgatacatacatatggcaaagctttgattacccaacagatacaatgttacctggcatgaaattgggttgggataagacctcagatctcaacagatgtttgacttcttggaagactgctaaagacccctctcctggaagctttacttacagcttcctccatatcgaatttcccgagtttttaatccgccagggaatggatattacattcagaagtgggatttgggatggcactcgttttaattcagatgattggttattcaatgaaattacagccttcaggccacacatttcagtgtctagcaatgaggtagtgtattgggatgagcctggagatagattgtcaaggtttgtgatgaggggtgatggactgcttcaaagatatatatgggacaacaaaactctaatgtggattgagatgtatgagataagaaaagacttttgtgacaattatggagtatgtggggtgaacggtgtttgcaatattgaggatgtgcctgtttactgtgattgcttgaaaggcttcataccatgttcacaggaagaatgggattcatttaacaggtctggtgggtgcatcaggagaacaccattaaattgcacacaagatgacgggtttcagaagttaagctgggtaaaactacccatgccattgcaattttgtactaataatagcatgagtattgaagaatgtagggtggagtgcttgaagaactgttcatgcaccgcatatgcaaattcggccatgaatggagggccacatggctgcttgctttggtttggggacttgattgacattaggcagcttataaatgaaaagggtgaacaacttgacctttatgtaaggttagccgcttcagaaataggtatgcatgggttctgctttaacatggcatgtaatgtttaa

SEQ ID NO: 11432 - DNA, 255 bp, Glycine max
  Peptide Sequence Number=SeqID_128210
atgttggatcaatatgaaagaaaccccggaatagaacactggaaagctacaaagaaagttcttaggtgtttacaaggagtggtatcatggagaagtgcaaaacaatccatgtttgtcacttctaccatggaggttgactttgaggccacaattcaagcattgtggttgtggaactttacttcaaggtttggaattgctaacaatattgccgaattgcttaggatttattgtgataactctgcaactatcttctag

SEQ ID NO: 11433 - DNA, 384 bp, Glycine max
  Peptide Sequence Number=SeqID_128211
atggtgaacccccggaagatctatcaatcccctttcccccgatggtacaatcccaatgcaacttgcgcctatcagagtggtgttccggggaattttatagagcaatgtgtggccgtcaagcataagataggagacgtgttaacctctaggaggttcattttggaagcactacgcgaagctggtatgattcgccttgatggggacaagggagattcttgtttaatgcatccaagggcatcacacgtgtcgcaacgtgccctttcgcgggcgagtgaaggcgaggctcacgggtgcactttccaaaggaggaaagatgcgcggagtcgccaccaacgtttatttgtgggaaacgtcggaaaaaccaaaggaaaccggtcaaaatga

SEQ ID NO: 11434 - DNA, 1122 bp, Glycine max
  Peptide Sequence Number=SeqID_128212
ggaaatactagtatgccatgttcacaggctgagaatggttttgtcaattccttttctctcttccccgagaaagtggtgcaagagcttcttcaatctccagtccaggggtcggatgaccatcttattgagttctctgaagctttaagaactgttgcgaaggctctcaggctagttgccgaagggaaagcttctgctcaagctgaggctgctgaatggaaacgtaaatatgagttggagagggatcggaatctgaagtttgaacatgcagagaaatcatgtatagagcatcaggctgaacatgaggatgtgaggacaaataaccctgccaaacaacctgttttatgtaatgaagctaatggacagtctgagaaatgttgttcaaggaatggtatttgctcccatgaagttcttagggatggaacacctggttctgattccaagatggtcaaaaaggcagcttcaatgttcaaagggccagtgcctcctattgtccccttttctttagggtctcttggctttatgacccctttctgtatcctccaacctggccccattagcatcacattacggcatcgtttgcaatgtcatgttatacgagatgcagctaaaaatgaatatgaaactgaagaacctatccttgttctaaatgaggttacaattgaccgtggaatatcttctttcctcacaaatttagaatgttactgtgacaactcctttgtcacgtgtgtgcaaggggatggattaatcttatctactacatctggcagtacagcatattctttagcagctggaggatcaatggtccatccgcaggttccaggtattttattcactccaatttgcccacattcgctatcttttaggccattgatatttccagagcatgtgactttgagggtgcaagtgccattcaacagcagaagccctgcatgggcatcatttgatggcaaggacaggaagcagttagcacctggagatgcacttgtgtgcagcatggctccatggcctgttcctacggcttgtttggatgattctactaatgacttcttgcgcagtattcatgagggcctccattggaatttgagaaagacacaatcatttgatggcccccgggaaacatga

SEQ ID NO: 11435 - DNA, 1164 bp, Glycine max
  Peptide Sequence Number=SeqID_128213
atgactctaaaggatcttgactctatgtccctcgaagaactatttgacactctcaaagttcatgaacaagaacttcaacaggatgaaggacttaagaaagaaaagtctttggctcttagtagccaaaagatcaagaaagtctcatcgtccattgagcaaaacttgccttctaatgaagaaaaagccaatctatgtcttatggcagagacaacttctcaagaatctgaattagaccaggaggatgaggtaaatattgatgatcctgaatctcttataaaggcttatcatgaattgctatcaatttcatccattcttgcaaaagcttacaaaaacttgcgaaaagatttcaaaaagatgtctaaagatcataaggaacttgaaaaaacccttcaagataaagtagatgcttcattggacgagtcaactcagatatgtgatgcgcatgaaacttttaaggaaaaagaatccaagctatgccttgagaatgagacaattgccaaagaaaaatgtactccattgaagaactttcaggagttggaaaacacactaaaagataacttgggaaagtttgactcaaaaagtgataatggaacacttctgggatactcaaaaacatctaaggcattcaaagtttataactcaagaacctcagttgttgagaaagttattcatgaaaagtttaatgaaaatgagcctgaaaaagatttatcagagctagataattctattttagatcttagactggataatggtattaaagaaaaagtgtcatccagtcaaagttttgaagttggagtgtccactcaacatctcgataatcctcaagaagaaacaagggagtccaatagacgcataatgagaagaaatcatctaaaaagccaaaccattgaattgctaaaagggaagaaggctattggagcaaaatggatcttctataaaaaattggatgaaaattgtaaggttatgaggaacaaggcaaggttggtagccaaaggcaatatgaagttgtatcagagggatgcaaaaagtgcattcttaaatggattaatgcaagaggaagtttatgttgaacaacctccaggattagagagtgacacttttcctcatcatattttaaaacttgacaaagctctatatggactcaagcaagatcctagagcttga

SEQ ID NO: 11436 - DNA, 270 bp, Glycine max
  Peptide Sequence Number=SeqID_128214
atgaagacacctgtgcatccaacaacatatcttggattggacgaagaatcaacaaagttaaatgcatttttagaaattggaacttctaatcttggtctatggttcaaaagaagggaggatttcaggctcatgagcttctgtggtgctgactatgctggagacaaagttgaaaggaaaagcacaagtggaagctaccacttcatcggtggaaacttggttacatggatatgcaagaagcaaggttcaattgtgttgtctgtaacgccctaa

SEQ ID NO: 11437 - DNA, 339 bp, Glycine max
  Peptide Sequence Number=SeqID_128215
atggatgactttttgggaagtttccagaaaagcatgtgtgtgaggaaaaaatatgctaaaaagtcttgtgttggttggtgggatcattcattgatcatggaagcagacaaatgtcatagtgtgagagccgccaataagtcaaaaatatgggatgttattgatgtagctccacgtggagcttgtaggccttggatcttcttcatcaatggagttctttgcttcttaaagatcatagtagcggaatggagaaggaagaaagatgattggagacgccacttcaaggagaagatgagtcaagcacaagctcaccaccataggaagccatggataagagcttga

SEQ ID NO: 11438 - DNA, 2553 bp, Glycine max
  Peptide Sequence Number=SeqID_128216
atgcctggtttcttattcttcctcttttgcttcttcttggcatcatcgcaacacatcacaatttcattctccgcagacacattaacctcaacacaaattcttctaaccaaccaaaccctcatatccccaagccaagtcttcgctctaggcttctttccggggaccaattccacttggtacttaggcacatggtacaacaacatcaacgacagaaccatagtatgggtagccaacagagacaaccctctcgagaactccaatggttttctaaccatcgcagaaaacggaaacatagtccttacaaatccatcaatgaagaagtaccccgtttggtcctccaacgcaacaaccaaagccaacaacaacaatcgcgtgcttcagcttctggacacaggaaacctagttctcagagaagcaaacataaccgacccaacaaaatatctctggcaaagcttcgattacccaacagacacgctcttacccggcatgaaaatggggtggaacctagacactggcgttgagaaacacttaacatcgtggaaagccacagggagcgacccttcaagcggagattactctttcaagatagacactcgtggaataccagaaattttcttaagggatgaccagaacataacatacagaagtggcccttggaatggtgagagattcagcggggtgccagagatgcaacccaacacagatactattacgtttgatttttcttacgataaagatggtgtgtactatttgttttccattggaagccgttctattttgtcgaggctggttttgacttcgggtggtgaacttcagcgtcttacttgggtgccaagtagaaacacttggaccaagttttggtacgcgcgtaaggatcagtgtgatggctacagagagtgtggtccttatggtttgtgtgactccaacgcttcgccggtttgcacgtgcgtgggagggttcaggccgaggaacttgcaagcgtggaatttgagagatggttctgatgggtgtgtgaggaacacggatttggattgtgggagggacaagtttttgcatttggagaacgtgaagctgccagagacaacctatgtgtttgcgaacaggactatgaacctaagggagtgtgaggatttgtgccgtaagaattgttcttgcactgcttatgccaacattgagatcacaaacggtggaagcgggtgcgtgacgtggactggtgaactcatagatatgaggctgtatcctgcgggtggacaagatctttatgttagattagcagcttctgacgtagatgacataggatctggaggtggctctcacaagaaaaaccatataggtgaggttgtaggaattacaatttctgcagctgtaataatattgggattggttgtcattttctggaagaagaggaaactgttgagtatatcaaatgtgaaggcaggccctagaggttctttccaaagaagtcgggatttgctgacgactgtacaaaggaagttttcaactaatagaaaaaactcaggagaaaggaacatggatgacatagagttgccaatgtttgattttaataccataacaatggccacagacaacttctctgaagcaaataaacttggacaaggaggatttggtattgtttacaggggaaggttgatggaaggccaagatattgctgtcaagaggctatcaaaaagctccatgcaaggagttgaagaatttaagaatgaaatcaagttaattgtcaggcttcaacatcgaaatcttgttcggctcttcggttgttgcattgagatgcatgagaggttgctagtgtatgagtacatggaaaatagaagtcttgattccattttgtttgacaaagccaaaaaacccatattggactggaaaagacgcttcaacattatatgcggcatagctagagggctactttatctgcaccatgattccagatttaggattatccatagggatctcaaggctagcaacattctacttgacagtgaaatgaacccaaagatatcagactttgggatggctagactttttggctcaaatcagacagaagcaaacacatcgagagttgttgggacatatggctatatgtctcctgaatatgctatggacgggaacttctcagtgaaatctgatgtttttagctttggagttttagtgctggaaattataactgggaagaaaaatagaggattctattactcaaatgaagatatgaatcttctagggaatgcatggaggcagtggagagatggcagtgcattggaactcattgattcgtccactggcgattcatattcaccatctgaagttcttagatgcatacacgttggactcttgtgtgtccaagaacgtgcagaagataggccaacaatgtcttcagtgttgttgatgctgagtagtgaatccgtgttaatgccacaacccagaaaccctgggttttccatagggaagaatcctgcggagactgattcttcttcaagcaagaaagatgaatcatggagtgtgaaccaagtcacagtcacattactagatgctaggtag

SEQ ID NO: 11439 - DNA, 1034 bp, Glycine max
  Peptide Sequence Number=SeqID_128217
atattattctggctgctacaaacaacttttctattgagaacaagattggagaaggtggttttggtccagtatacaggggtaaattatctagtagacaagaaatagctgtgaaaagactatcaaaaacctcaaagcaaggcatctcagagttcatgaatgaagttggattggtagccaaattccaacatcgtaatcttgattcaaatctaaccatcattcatagggatctaaaaactagtaacattcttctagacaaagaatttaaccctaaaatttctgattttggtctggcccacatctttgaaggagaccattctacagtaacaacaaaaagaattgttgggacagttggttatatgtcccctgagtatgcagtaaatgggcttctttccctgaagtctgatgtatttagcttcggagttatagtgttagagatattaagtggaatcaaaaataataatttcaaccatccagatgacagtaatctgttggggcaggcatggagattatggatagagggacgagctgtggaattcatggatgttaatttgaaccttgcagctattccatcagaaatactaaggtgtctgcacgtgggtctcttgtgtgttcaaaaactacctaaggacagaccaactatgtcatctgtggttttcatgttgagcaatgaaagcattacacttgcccaaccaaagcagcctggattctttgaagaagtgttacagtctcaggggtgcaacaacaaggagagttttagtaacaattctctgactattactcaattagaagctgagcaagagaggtcacgattaacgaattgtgatttacaacacaatttttttactgcgaaagcacctagtcgctaccctccaccattgtttcacgtcttagttctcatcgttatgaaacagcgaagcgcccaccacgacgacggtgagacacaaaatagcataaagattaaaaagaacgagacacaaattgacagtgagaagacacgacagaaagtggtgcggcgcaattgtgtgtgcaagtga

SEQ ID NO: 11440 - DNA, 1101 bp, Glycine max
  Peptide Sequence Number=SeqID_128218
atggcagcggcgatgatgatctccttttatctttttctcttttctttccacaatttgttttctttagcagctagttcaaagatcaggatcacgcagggtgtcacgatcagggacaaagagcatgaaactttggtctcagaagagctcaacttcgcgatgggtttcttcagcttcgacaactcctcctcccgctacgtcggaatttggtacgacaacattcccggatcagaagttatatgggtggcaaaccgcgacaaacccatcaacggcaccgtaggagccatcacaatcgcaaatgacggcaacctcgtagtcctcgatggagccatgaaccatgtctggtccaccaatgtttccattgatgataacaacaaaaactcctcagcaactcttcgtgacgatggcaatctcgtactcacatgcgaaaggaaagaggtttggcaaagcttcgagaatccaacggatacatacatgccaggtatgaaggtgtcagtgggtggattgagcactagccatgtcttcacttcatggaaatcagccacggatccttcaaagggaaactacactatgggggtggatcctgaagggttacctcagatagtggtttgggaaggggaaaaaagaaggtggagaagtgggtattgggatggtagaatgtttcaagggttgtccatcgcagcaagttatctttacggtttcacgcttaatggggatggtaaaggtggtaggtacttcatatataaccccttaaacggcactgataaggtgaggtttcaaatagggtgggatgggtatgagagagagttccgatggaatgaagatgagaaaagttggaacgagattcaaaaagggccttttcacgagtgtgatgtttataacaagtgtgggagtttcgcggcgtgtgatgtgttaacgttgtcccccgaggatttagtacctgtctgtacttgcatacgaggtttcgaaccgaagcataaggatcagtgggataaggggaactggtcaggtgggtgtacgaggatgactccactcaaggctcagaggattaatgttacttcccgggactggcgtcaagtgttggagaggatgggtccttggatc

SEQ ID NO: 11441 - DNA, 2472 bp, Glycine max
  Peptide Sequence Number=SeqID_128219
atgggattcagtactggtggaaacacgttacctgtttttctcattctgtcaaacttttacatgaattgggtcactgccttagacatcattacagtgtctcgattaatgaaagaccctgaaactgtgacctctaacgatggtgcattcaagctaggattcttcagccccggaaacacatcaaatcgctatgtaggaatctggtatctctccgaatccaatgtcatatgggtggccaacagaggccaaccactagaggattcttcaggtgttgtcaccatatccgacgacagaaaccttgtagtgctgaatggaagaaaacaagtggtttggtcatcaaatgtctcaaacattgaatccaattcaactgcccaacttctaaacaccggaaaccttgtcttgctggataacatcacaggcaagacaatatgggagagtttcaaacacccctctaacactttcacaccaaatatgataattagcactaaccaagtgacaggagagaaagttaaagttacttcgtggaaaagcctttctgatccagccattggaaccttctctggaagccttgagcgtctcagtgttcctgaagtgtttgtttggaatcaaacacaaccatgctcaggtccatggaacggtcaggtttttattggtttggctacgatgtatacttctgcatatctgaatggattcagcgtagaaagggaaaatagcgtaactgttcagataacctatactttgccaaatgattctttctttggcaccattttcttgagtccagaaggcaggatggtttacacatcctggatcaacagacaactagttgggaagcgggtaattcaacaaagtaactgcgatatttatggcttctgcggcgcttatggaagctgtgattcgaataagttgccaataatatgcagctgtctgagaggtttcgagccgagaaaccgagaggaatggaataggcaaaactggactagtggatgtgtgagaagggaagcactgcagtgtaagaggagtggagccagcaaagaagatgggtttgtgaaactgcagatgtctaaagtgccagattttgcacaccagtcatctgtttctgttgacacatgcagaactgagtgcctgaataattgctcttgtacagcatatgcatatgatgctgccattggctgtatgtcttggagtggagagttaattgacatagtaaggttctcacgtggaggagttgatctttacattcgccaagctcattcagaactcgatgtggggagaaacatgacatcaattatcatagttacagtgatagtaggaacactgcttgttgctacttgtgcatatttcttgtggacatggacttctaagagttctgcaagaatggaaagccaaccatcgttggtgctgagggaaacccctccagaaaaccgaaatgcaggtcttagtggagatctgaatcaagttaaaatccaggaccttccagtatttaactttgaaaacattgcaactgcaacaaattacttcaatttagctaataagctaggccagggtggttttggttcagtgtataagggagtattgcaagatggacaagaagtagcagtgaaaagactttcaagaacatctagacaggggacagaagaatttatgaatgaagtgactgtaatttcaaaacttcaacaccgtaatctcgtaagactcctaggttgctgtattgaaggggaggaaaagatgttgatctttgagtacatgcccaataagagtttagatttttatctgtttgatccagtcaaaaaggtagttttagattggcaaaaacgatttaatataattgaaggaatctctagaggctcgctttatctccatagagattctagattaaggataatacacagagacctgaagccaagcaatatcttgttggatggagaattgaatccaaaaatatcagattttggtatggccaaaatctttggaggcagcgaagatgaggccaatactagaagggtggtgggaacatatggctacatgtcacctgaatatgcaatggaagggctgttttcagagaaatcagatgtctttagctttggagttttgctgttggaaataattagtggtagaaaaaactcaagttttcgtaatcacgagctgtcattgagcctcttaggatatgcatggaaactatggaatgaagaggagattgtatctctggttgatccagaaatatttagtcccgataatgtctatcacacattgagatgcatacacatcggacttctatgtgtacaagaattagcaaaggagaggcctactatggccactgtggtttcaatgcttaatagtgagattgtgaattttcctcctccacagcaacccgcgttcatacaaagacaaattgagttgagaggagagtcgtctcaacagagtcacaattcaaattccatcaataatgtcactgtcacaaatttgcaaggtagatag

SEQ ID NO: 11442 - DNA, 176 bp, Glycine max
  Peptide Sequence Number=SeqID_128220
cctcctccaacgccgtctacggcctcttcgaatgtcgcgacacctcatcaacgaccaatactctcgctatgtgtcacttgtggtcacccagctcaacaacctctgtttcacctcttgctgcgacgcattgcagcttgacaactgtttcatcaagtatgacaatgcgacctttatag

SEQ ID NO: 11443 - DNA, 4507 bp, Glycine max
  Peptide Sequence Number=SeqID_128221
ttctgccaacaataccattacatcaggccaatacatcacagaccctcacactctcatctcccctaacagtgtcttcaagttaggattcttcagccctcaaaactcatcaaatcgctacctgggaatctggtatctctctgactccaatgtcatatgggtagctaacagaaaccagccactaaagacgagctcttccggaactgttcaaatttctgaggatggcaatcttgtggttctagatagcaacaaaagggttgtttggtcatcaaatgtgacacataatattgcaaccaattcaactgccaaacttttagagaccggaaatctagtcctgatagatgatgccacaggagaaagtatgtgggagagtttccgacatccttgtcatgctctcgtgccaaagatgaaactaagtattacccaaaaaacatacgagaaagtacgcataacatcatggagaagtccctctgatccttctcttgggtactactctgctactcttgaacgccccaacattccagaagtgttttactggattaatgaaacgcaaccgtattatcggactggtccatggaatggtcagatttttattggctcgcctcagatgtcacgtggttatctatatggatggaatatgatgaatgatgaagatgatggaactgtctatctttcttacaatttgccaagtcaatcttactttgcagtcatgaccttgaatccacagggtcaccctacaatcgaatggtggagggaccgaaagttagtgtggagggaggtgttgcaaggaaactcatgtgatcgttatggtcattgtggggcatttggaagctgtaattggcagagttcaccaatatgcaactgtttgagtggatataaacctaaatatgtagaggagtggaatagaaaaaattggactagtggatgtgtgaggagtgagccactgcaatgtggtgaacaaacaaatggaagtgaagtcagcaaagatgggtttttgaggcttgagaatatgaaagtttcagactttgtacaaaggttagattgtttggaagatgaatgcagagcacagtgtttggagaattgctcttgtgtggcctatgcatatgacaatggcataggatgcatggtttggagtggagacttgatcgacatacagaagttctcaagtggagggattgatctttacattcgtgtgccaccttcagaatcagaacttgttggaataactataggaatggttgccttggctggctgtgtttgtctctcacggaaatggactgctaaatcaatagaacttgtaaatgctacaaataattttcactcggccaacgagctaggtaaaggaggttttggttcagtatataagggacaattgaaagatggacacgaaatagcagtgaaaagactttcaaaaacctcaggacaagggctagaagagtgtatgaatgaggtattagtgatttcaaggcttcaacatcgcaatcttgtcagacttcttggttgctgtattgaacaggaggaaaatatgttggtatacgagtatatgcctaacaagagtttggatgtaatattatttgatccagctaaaaagcaggatctagattggccaaaacgcttcaatataattgaaggaatctctagggagctgaatccaaaaatatcagactttggtatggccaaaatatttggaggaaatgatatgcaagccaatactagaagggttgttggaacatttggttatatgcctccagaatatgcattccaagggttggtttctgagaaattagatgtctttggttttggagtcttgttgctagagattattagtgggagaaaaatcagcagctgtttcgatcatgaccaatcattgagtctcttaggatttgcttggaaattatggaatgaaaaggacatccaatcactgatagacccagaaatatctaatccaaataatgtgaatgacattgtgagatgcatacacataggacttctttgttcacaagaacttgcaaaagaaaggccacttatggctacagtagtttcaatgcttaatagtgagattgtcgatcttcctcccccattaaatcccgcattcatcaaaaggcaaattgtatcatgtgcagattcatctcaacagaatcacataacacagtccatcaacaatgttactgtcacaggcatacaagacacagtgacagtgttgagcactaatattatgggattcctaaatgctttgctcatagtatttcccatcattttcctgggtttgacctctgccacggacacccttacatcttctcaatccattagagactcagagacagtagtaacttcaaacgacagtgtcttcaaacttggtttcttcagccctcaaaattcaacacaccgctacgtaggaatctggtacctctctgactccaacgtcatatggatagctaacagaaacaaaccactcttagattcttctggggttttgaaaatctccaaagacggtaacctcgtgctagttgatggaaaaaaccatgttatttggtcgtcaaatgtgtcaaacactgcaacaatcacttccaccgctcaactttcacgttccgggaatctagtgctgaaagatgactccactggacagaccctatgggagagcttcaagcatccttgtgattcagcagtgccaaccatgaggatcagtgctaacagaatcacaggtgagaaaatacggtttgtgtcgaggaaaagcgcttctgatccttctactggctacttctctgcttcccttgaacgtttggatgctccagaagtgtttttgtggattaatggaactcgcccttattggaggactggtccatggaatggtagaatcttcattgggacaccactgatgtcaactgggtatttgtatggatggaatgtaggatatgaagggaatgaaactgtttatctaacttacagtttcgccgatccttcttcgtttggaatccttaccttgattccacaaggaaagcttaaattggtaaggtattataacagaaagcacacgttgactttggatttgggaatttctgattgtgatgtttatggcacgtgtggggcatttggaagctgtaatgggcagaattcaccaatatgcagctgtttgagtggatatgaaccaaggaatcaagaggagtggagtaggcaaaattggactagtgggtgtgtgagaaaggtgccactcaagtgtgagaggtttaaaaatgggagtgaagatgagcaagaagatcaatttttgaaacttgaaactatgaaagttccagacttcgcggagaggttggatgtcgaggaaggtcaatgtggaacgcagtgcttgcagaattgctcttgtttggcgtatgcatatgatgctggcattggatgcttgtattggactagagacttaattgacttacaaaaattccaaactgcaggagttgatctctacatccgtctcgcccgttcagaatttcaatccagtaatgcacaagagcatactaataagacaagaggcaagagattaatcattggaattacagtggcaactgctggaacaattatctttgccatctgtgcttatctagccattcgtagatttaactcgtggaagggaactgctaaagattcggaaaatcagagtcaaagggtgactgaggtccagaaaccagctaaactggatgagctaccgctatttgattttgaagtcgttgcaaatgccacagacaactttcacttagctaatacgcttggaaagggcggtttcggtccggtgtacaagggattattgccagatggccaggaaattgcagtgaaaagactcgccaaagcatctggacaaggtctagaagaatttatgaatgaagtgggggtcatttctaagctacaacatcgcaatcttgtaaaacttctcggatgctgtgttgaaggagatgaaaagatgctcatctatgagttcatgccaaataaaagtttagatgcattcatctttgacccactccggcagaaactgctagactggacaaaacgttttaatataattgaaggagttgctcgtggcttactctatcttcatagagattctagattaaaaatcatacatagagatttgaaggcaagcaatatcttgctagatgcagagatgaatccaaaaatatcagactttggtttggctagaatatataaaggcgaggatgaagcgtggaatctatggaacgaagacaatattagttttttggttgatccagagatatcagcttcaggatccgagaatcatatttttaggtgcattcacatagcatttctatgcgtgcaagaagttgcaaaaacaagaccaactatgactactgtgctttcgatgcttaatagtgagatttcccacctccctcctcctaggcaagtcggatttgttcagaagcaaagttcatcaagtttagagtcttcttctcaagaaaatcagtttaactccaacaaccatgtaactcttaccgagatgcaaggcagataa

SEQ ID NO: 11444 - DNA, 885 bp, Glycine max
  Peptide Sequence Number=SeqID_128222
atgcagagtaaagaagctgttgtggaagatggggaaataaagagtgtgactgctgtagggtctgaaattgatgggtggaccaattttggggacgatgacataatgcagcagcagtatacaattcagtctgaagaggctaagaaagaaccactgagtagcttagctgctgaatataaatcaggcagtcctatcttgctggagaaaataaaggtgcttgatgagcaatacgctgccattcgtcgtactcgaggagatggaaactgcttctttcgaagctttatgttttcatatcttgagcatgttatgaaatgtcaagaccaagcagaagttgatcgtatccaagccaatgttgaaaaaagtagaaaagcactgcagaccttgggttatgcagacttgacttttgaagatttttttgcgttattccttgagcagctggaatctgttattcaagggaaagagacttccataagtcatgaagagcttgttcttagaagccgagatcagtcagtatctgattatgtcgttatgttcttcagatttgttacctctgccgcaatacaaaagcgcacagaattttttgaaccattcatactaggcttaactaatacaacggtcgagcagttttgcaaatcatctgttgaaccaatgggtgaagagagcgaccatgtgcacattactgccctttcagatgcattgggcattccagtccgtgttgtgtaccttgaccgcagctcaagtgatactggtggtgtcagtgtaaatcatcatgatttcatgccagtggctggtgatctcccaaatgctagttgcagctctgaaaagaacattcctttcatcacactactatatcgtcctggtcactatgacatcctctatccaaaatga

SEQ ID NO: 11445 - DNA, 288 bp, Glycine max
  Peptide Sequence Number=SeqID_128223
atggaaggaaagagtgatggattggttgatgagaaattgacaatttctggtacagacgaaggggttactctttcgtggaaggtgcggggaacctcttgtagtgtgactaacgaagtggtagatgccttgatggaatggaataatgcatcatggattggaaaaagactgaggcatttactttgttggtttccttctgacaagtcctctcgtggctatataaggcacaaaagtgccaagggaagctgccgaatttctaaaaagagaagaaacaaaggagttaaatcatag

SEQ ID NO: 11446 - DNA, 558 bp, Glycine max
  Peptide Sequence Number=SeqID_128224
atgacaaaattctttcgttttaatcctccaagatccgtgaaggacagtctttcgaatgagttgggactagatcctgaaagtcaatcctctaataatctccgtttcaacaccaaactcagtcttaaacagcaagcgaaagctgaatcaagccttccaagttccaccaccaccgtcccaaccctcttcttcttcttcttaatcgaaacaacctcgtccgtactaaggaaacaaacgacagagactgcaaccatgtacgttgatcacgcgttttcgatttcggacgaggatgtcatgatgggaacctcgtacaccgtcaacaacaaaccccccatcaaggagatcgccctcgccgtttccctcctcgtttgcggcgtcctcggcatcgtcatcggttccctcatggcctacaaccatgtcggcggcgacactgctcacgggatcttctttgcaattctgggatttatcttgttcataccgggtttctactacacgcggattgcgtattatgcttacaaaggatacaaagggttctctttctctaacataccacccgtgtag

SEQ ID NO: 11447 - DNA, 396 bp, Glycine max
  Peptide Sequence Number=SeqID_128225
atgggaaaatacaaacataagattaataccgagcatcgggtgagaagtaaccctcaccttgcacatcggatttgtagggatgatataggtccaaccctaaattctaagaaggagacgatgagaaactcaaatgaaattaaatataagtactgtagaagagcaaaagctgttttcaaagagttgaaccaagttccacatgttgttgagctcgatgagagagaggatggttcaaagattcaggatatcatggttaatattgttgggaggcgtactgtgccacaagttttcatcaatggaaaacaccttggaggctcagatgatactgttgaagcttacgagagcggacacctgcataaacttctaggaatcgagaaaaaggatcatgatgatctctga

SEQ ID NO: 11448 - DNA, 282 bp, Glycine max
  Peptide Sequence Number=SeqID_128226
atggttcgcttagcgtccaaccacttactcgcattcagcttgcagacgcgctcagcgtgcaatcgtaggatttcagactcaagaaaggtttttaagaaaaaagttgggggaggggggagaagggagttcgttcacatagcaggaaaagccctaagcttgagccagaggaagaagataatcattgggagcccactctctttccccacttcatattcattccctatcccttcaccttttatacccttttgtatatttatactcgtcatgaccatgaagggctaa

SEQ ID NO: 11449 - DNA, 393 bp, Glycine max
  Peptide Sequence Number=SeqID_128227
atgaagctagctggttttggttcttgctacattcaggctatagtttattttcttcttgctattggtgcctttgttacttccattgcctatactatcacgaggactcactacttcctatacctagctgttgcattcatcattgctgttggagcatatttaggattctaccgaactcgtatgcgaaagaaattcaacatcaaggagtcaagaacacttgagatgaacaatgttcaaaacggaacatggcatggtcggggtgacacaatatgtataggtggatttagagatgaaagtaaagctctctgtgagttacgtcctccttctgttgtgtccatcatgcctaatgatgaaaattgcatggaaaagagcacagatgttagcaatggatcttga

SEQ ID NO: 11450 - DNA, 216 bp, Glycine max
  Peptide Sequence Number=SeqID_128228
atgcctaagagagccaacaccctaccaaaagctgaccactttaaatgttatcggtgtcatcgcaatcgtggccactcaatggaggagtgtaatgctttgaaggacaagataaaggagctcattatgcttggccacctaaaggaattcgttcaccagccacattcgtacaagcctgaggggaggaatagactcgagcctggccaagggagagattga

SEQ ID NO: 11451 - DNA, 612 bp, Glycine max
  Peptide Sequence Number=SeqID_128229
atgactcttcctccatccttatcggagccgccctcactctccgactcattctcgccgttaaacccagccctagccatggatagtcttcaagccacttacaaagacgaagaagatgaagaagacgagccgcagcctcaaccaccaccaaccaccgccgattcacctgaagcccctcccgccaccaccagcacaccctccgacaccccaaccgaacccccgaacgacgcccgatcggagcccgagccctccgaagatctctccgaggacgaggccgcctccgacggctccaagaaatcccccaaatccggccgcgaagaaggcgacgcctccgacgaggacccaccgccgaagaagcagaagcagctctcctctctgacggaggcaacgaaggaggacttggtagcgccgcaggatggcaccaacaacgcggcggcgacgccggcaacaaatggcgcggcgccgaagaaatcgaaaaagaaaaacaacaacgtgtgggcgacgaagtcgacgcggaaggggaagaagaaaacgaatcggaacaacaacaacaacaacagcaacaacaacaacaaccacaaccaccacgcgaacggcgaggacaaacgtgcctga

SEQ ID NO: 11452 - DNA, 261 bp, Glycine max
  Peptide Sequence Number=SeqID_128230
atgaggaaattctcatatgcctctatcattttcactcaggatcttcacggtggtcgttactatcctgctgcttcaatgtttactctccccaatgaaccaaactgcacggtgaagttcaactttggtcccgactttgagtgttttcctgaggatttcaatgaacggccaattcccaggccaatgagtgaagttccttatcttggttttgacaataaagttgaaaatgaagagtctaacgagaagaaatcccagaaagagtga

SEQ ID NO: 11453 - DNA, 159 bp, Glycine max
  Peptide Sequence Number=SeqID_128231
atgtcaataacaacgggatcgttatcaactgcagcaatcaaagcaacactcatagagaaataccgatggtcagagcacgcaaccactgcaagagcaagaatcaaagaaatatcaagcattttaaccaggctgtggaagaagaaaactattgggaaataa

SEQ ID NO: 11454 - DNA, 711 bp, Glycine max
  Peptide Sequence Number=SeqID_128232
atgtctggaaatgtgcttttaaatggaaagaagaggagattagactatggagtcgtagcatatgtgacccaagaagacatagtgttgggaacactaacagtgagagagacaatatcttactcagctaatctaaggcttccatctagcatgacaaaagaagaggtgaatggcatcatagaggggacaattatggagatgggtcttcaagactgtggtgatcggctaatagggaattggcacttgagaggtataagcggtggagaaaagaaaaggctaagcatagcacttgaaatcctcacaaggccaagcctcttgttccttgatgaacccaccagcggtctagatagtgcctcagcatattttgttgcccaaactttgagaaacttaggtcatgatggcaagactgttatctcttctatacaccaaccaagtagtgaggtttttgcactctttgacgatctctttcttctttctggaggtcaaacaatttattttggaccggccaaaaaggcagttgagataattatccatctatttgcgcagttctttgccaaagcgggattcccatgtccaagtagaagaaacccttcagatcatttcctccgttgtattaattcagactttgacgctgtcacaacaactatgatggcctgccaaagagtacatgatcctcaaaagatcatagaagctcaaaaggtagcttacatgtag

SEQ ID NO: 11455 - DNA, 318 bp, Glycine max
  Peptide Sequence Number=SeqID_128233
atggagatagaacaagccactaccaatgaaaagggtgttaccgactatggtgatgctgaaatgatttcagataataataagagagggatgtatcttgtgtgggaagatttaactgttgtagttccaaattttgggaatgggcacacaagaagattgcttgatgggttgagtggatttgctgaacctaacagaatcatggctatcatgggtccttctggctctggaaaatctactcttcttgatgctctagcaggtctctctccctacctctctccgctacttggaagcacatatgaaaataatggggagtggaagtaa

SEQ ID NO: 11456 - DNA, 1812 bp, Glycine max
  Peptide Sequence Number=SeqID_128234
atggttgcagaagcttggattgtaaagatgggtaaccaggtaagttccaatctcaagcatgcccttcttcttgaaactttgacaaagagaaaacagagccacaagaggtcagatactaaagaaaccataggtattctttcttttgaggtagcaaatgtgatgtcaaaaactgtgcacctccacaggtcactgtcagagtctgagatctcaaagctgaggaatgagatcttgggctcagagggtgttaggaatttggtgtcctctgatgagggctatctccttgagctggctctggcagagaagcttgaggagttgaatagggttgctagtgtggtctctaggttggggaagaagtgctctgagcctgccttgcaagggtttgagcatgtgtatggggacattgttggtgggtttatagatgtcaaggaattgggattccttgttaagcatatggagggaatggtgaggaaaatggatagatatgttactgtcactaggaatttgtacagtgagatggaggtgttgaatgagttggagcaagcagtgaagaagtttcagcataaccagcacgaggagagtaggagggcttttgagcagaagctcatgtggcagaagcaagatgtgaggcatcttaaggatgtttctctttggaatcagaactttgataaggttgttgagttgttggcaaggacagtttgtaccatttatgccaggatttctgtgatctttggcgaatctgctttaaggaagaacgcccttgggctcggtggaggctccccgggtacacaaaatgaattggggtttgtgtctggccatgttaatgttccgaggagttcggagaagttgaagcgcaatcagagcaagagaaatggatttcatttgggttcggttgggagaatggctgtggcggagagaaggggaactactagtaggcctcagattgatttgaggagaggtgagttggtgcctattcgacctgaagattttggttttccatgtggaacaagtccaggaagacttttcatggaatgcctaagtttgagtagctcagtttcaaaatttgatgatgttgatgatggctatgctgtcaatagggaggaccatcatagtagctgtcgcagtgttgggatagggaataacagcatgaagagggatcacacgtgccattctggtattctaagtcatagccaaagtggtgttcctttcactggagatcttagacaagccaaatctggtgtgcaatgttgctcaacattaggccccaaaagtaggttagctatttatgctcctccttccactcttggtggctgtgctctagcgttgcactatgccaatgtcataattgtcattgagaagctgcttcgctacccacatatagttggcgaggaagcaagggatgatctatatcagatgctacctacgagcttaaggttatctctcaaggccaaactgaagtcctatgtcaagaatttggccatatatgatgcccctcttgcccatgattggaaggagaatcttgatgggatattcaagtggctggccccgcttgcccataacatgatcagatggcaaagtgagcgtaattttgagcaacaccaaatcgttagcaggacaaatgttctgctacttcagacattatactttgctgacagggaaaagactgaggaatcaatctgcaaaattcttgttgggttgaattacatatgccggtatgagcaccaacaaaatgctctactggattgtgcaagcagttttgattttgaagattgtgtggagtggcaattgcaatgtggagattcttttctcaattga

SEQ ID NO: 11457 - DNA, 777 bp, Glycine max
  Peptide Sequence Number=SeqID_128235
atggagtttgatcttgaagacccactagtcagcttggaagaagagcaaacctttactatatcagaactctttgcctccgaatctgaacacgtgccctcaccaaactgcttaagttcaacacattttcacgttttctgtggtgaagccatatctctcattcttcaggttcaggtttcttgcaaattggaccaatttgtagcttatcttgctataaattacttgcaccgtttcatgtcatgccaagaaattccgcagggaaagccgtggtttctcaggcttcttgtcatatcatgtctttctcttgcttcaaagatgaagaacacaactttatcaattttggatatgcaaaaagaaggttgttactttaaggctcagagtattcagagaatggagcttcttattctcggggctctgaaatggcgcatgaggtcaattacgcctttttctttccttcatttctttatctctttagctgaaattaaagaccaatcactaaagcaaacacttaaaaatagagcttcagagataatcttcaatgctcaaaatggcattaagtttttagagtataaaccttcaactattgctgcaactagccttatctttgcatctcatgaactattcccacagcaatattctactctgagagcttcaattacagcctgtgagtacctagatgaggagacattgtccaagtgcttcgatttgatgcaagacatgatgagaatggaagcaaaggagttaatgtcagatacaagctttttaagcacagaaactcta

SEQ ID NO: 11458 - DNA, 138 bp, Glycine max
  Peptide Sequence Number=SeqID_128236
atgccagaaacttccagaattatcactcaacaccaggacttagtgctaggtgctacaatgcatcaagccaaagtgccaggcatttcctcatactgccaagcgtggaagtgtcaactgtcaaatggcctttgttcgtga

SEQ ID NO: 11459 - DNA, 216 bp, Glycine max
  Peptide Sequence Number=SeqID_128237
atggaaatcttccggaagaagcttctttcggaaacattccggatgacgttcttccagaagttgtttgtgagtacttccggaagacacaaattcttcttccggaagaaggttcttccggaaaagttccggaaagaagtttttcgaaaagtttccggaagaagaattgctgaagggcagtttcgccacttcattgtttgctgggtgccccagcaataa

SEQ ID NO: 11460 - DNA, 2154 bp, Glycine max
  Peptide Sequence Number=SeqID_128238
atggcagttatttctgctagtactgtctctgggacctcaggattgagcaagtttcttcctatttccagaagagtattaaaggggctcaaggaatatggaaggaaaatggttgacttggagttattcactcaatatattgaggagtgggtcttggagaatctaaatggtgattcagctgatgggatgcaaagttttcgttctcccttcacgactgatgaattgtgcaaacttgatttggcattggagggggttccatttcagcaactcatccgtatgccattcttcactgacgtttctgatgaggttatagaagatcagtatctagccactgaagatttccttcatgctattatcattggactttggcgtacgttttggcataaaagtggaccactgccattatgtgtctcgtgcccctctcatattggttcgaggttcagtagtgttgaaaaggcaatatcaaggggcaggctgagggaaatgcgtggtttagcattaatatcaaaaactgctactgattcaaaatttaaatgggatcatatggtagagtttgctttattcaagtcagaagtattcttggacaatgattcaagactatcagccagcactatttgtgaagctctcttttatggtttccatgttcttgtttcccggagtttgagcaagattatttctatcaacagtgattctgttttccttctagttctagattctaaatgtggagcagtgatgaagttcagtggtgaccttgggaaacttgatttattgaattcaagcgatccatatctatctgtggctgaatggatcaaaacttatgctgaaatttgtgtcaccccagtggaaccgatatggaaccgattaggaaatccaaattggggagatataggaaccctacaggttctattggcaactttctactccattgcacaatggaatggacctccacgaaaatcagtagcctcattgatttcagatcatagtctccgccttcagaagcggaggacagaatgctgcatcattgagactgaaaatgcattggtaccttatcatggtacaactgaccatcaaacaggagagattgttgagcttgatcaaaacgaattattttcccataaccgagcatcacgtttgaagctcaagtgtggtgacatattggccttggatgatccacagcagggacagaaaagtttccaaattcatgaatctctggtaggagggaactattacctctatagtgcagtttgtcttgatcatccatcagagttattgactttatatgtgggtgctcatccatctagattagagccttctttggaggatatgagcctctggtaccaagtgcaacgtcaaacaaaagttctaaacattttgaggaatcagggaatcttgagcaaatacttacctgaaattgtcgcctctggtaggattttacattctggaccttgcaagaaagagagccctgggggaaggtgtgatcacccttggtgtgggactccagtactggtgacatctccaataggggagccactatcacccatggttgctaatgaggggtcattttctgcagatgaagcaacacgcttgtgcagggactgtctagctgctctaagaagtgcagccatggctaatgtccagcatggtgatatttgtccagagaacataatacgtgttgttgaaagacaaggtgtcagaaaccaagctatttatgttcccatatcttggggccgtgctgtgttggaagatagggacagccctgccataaatttgcagttctcatcatctcatgctcttcagcatgggaagctgtgtccttcttctgatgctgaaagcattatctacattctctattttatttgcggagggactatgtctctacaagattctattgagtctgctttgcaatggagagagagaagctgggcgaagcgttcaatccagcaacatatcggtcaggtttctgctctcttgaaagcatttgctgattatgtggctagcctttgtggaactccataccctgttgactatgatatatggttgaaaaggttgaacaaggctgtggaagtttcagcggataaaggtaaaatgattgaagaagtacctataacattaagattagaggatgctgctgagtcttcaggagcttctggcccttga

SEQ ID NO: 11461 - DNA, 381 bp, Glycine max
  Peptide Sequence Number=SeqID_128239
atgaagataaggacaaaagggtcaaattttcgcattgccattagtagaatgaaaagcaaggaagttgtcataatcaaaccaaaagtaattccagagaatggaagacatattaagcgtccaaccagaagagaaacaacaacaacgtggaacgacaccgaaagtgaaaacgaccaatgtggcactagatctcaacaaggcattattactaatgacacaggaaaacaaacaagttgggaacatgaagcactgttacggattcagagagacattgtagttgtaggtgcgagtaagaagaagagaaaggggaagcagaagcagaacaaagcaggaacaaaagtaaaaaacattcagcaagagcaacgacaggatgggaagctataa

SEQ ID NO: 11462 - DNA, 585 bp, Glycine max
  Peptide Sequence Number=SeqID_128240
atgacatgccaaaaactagtgcaaagtccgattcgtcagttgattaggtatttccacaaggaaccaattccagtggcatggaagaaaccaagaattggatggaccaaattaaattttgatgggtcttgcaaatgtttaagtggaaaagctagcattggaggggttgttagaaatcacaatgcagaatttttgcttggctatgctgaatccattggacaagccaatagcaccatcgctgaacttactgcacttcggaaaggcctcgaattagtgcttgaaaatggttggaatgatatttggcttgaaggagatgccaaaacactggttgaaattatagtgaaaaggagaaaagttagatgcacggaagtacaaagacatataaatcatataaataccattctgccagagtttaacaacttctttgtgagtcatatatacagggaagggaatagggcagctgataaatttgctcaaatgggccatcacttggaccagcctagaatttggagacatcctcctgatgaattgttggctcaattacttgaagatgctcaaggcaaaactgttcttagaaggaaaggataa

SEQ ID NO: 11463 - DNA, 540 bp, Glycine max
  Peptide Sequence Number=SeqID_128241
atggggaaaaaatcgaatccggcggagggagaagaagcggtgccggagcatctgcggtgcagccgtacggacgggcggcaatggcggtgccggcggcgagtgaaggaaaacctaaagctgtgcgagattcactatgtgcaagctcggcgtcggcagcacaagaagacgctgaagctgaagagaaagaggcaaaacgacgccgttgaggctcagattggggcaaagcgggaccgaaaatcgagagaggcattggtgaataggaggaaccaattggagctcataaggatggttctgcagagagaggttgagaagaagaagaagaaggaatcgcaattgaatttgaatttgaatttgcatttgtattccaatcacgagttgaagaaggaacttccgaatggtgttatggctattgcgtccaatgtggcttcttctcgttacttcaggtccaagaatgctgacagcggctctgttagttgtgcagtgtggacgaagcatgaacaaggggaggaggaagaagtgtcattggtgtcagagaagtga

SEQ ID NO: 11464 - DNA, 204 bp, Glycine max
  Peptide Sequence Number=SeqID_128242
atggaagcaagcaaagagatcttcacttcagtgccacgaatcaactccagtaccttcaacactggactcgtgcagaagcaattggtctccaccaagtcaacaattcatcaagtgctaagacagcactatttcaaggcttccctacacccagagtggcagaagcttgggcactataccaatccattaattggtttaaagagctga

SEQ ID NO: 11465 - DNA, 1908 bp, Glycine max
  Peptide Sequence Number=SeqID_128243
atggaggagacattgtctgcaaagcgagataaaaaccatgtgttatttggtggaactaaaatattgcagcacactccagataagagttttcctctaaaaacacctgatggtggctgcttggctgttatcttgagaacggggtttgaaacaagtcaaggaaagttgatgcgaacaatcttattctctacagaaagggtgactgctaatagctgggaaagtggattcttcattttattcctggttgtatttgcccttattgctgctggctatgtgcttgttaaggggttagaagatcccacaaggagcaagtataaacttatactaagttgttcacttattgttacttctgtgatacctcctgagttaccaatggaattatcaatagctgttaatacttctctgattgcactggcacggcgtgggattttttgcacagagccttttcgaataccatttgctggaaaggttgatatatgctgttttgacaagacagggacacttacatctgatgacatggaattttctggagttgttgggttgaatggaactacagatttggaatctgatacgagtaaagtgcctgtgcgaacagtggaaatcctggcttcttgccatgcattggtatttgttgaaaataagctggttggtgatcctcttgagaaggctgcacttaggggaattgactggagttataaatctgatgacaaggctgttccaaaaaagggaactggccaacctgtccaaattgtacatcggtaccattttgcatctcacttaaaacgaatggcagttgttgttcgcattcaggaggaattttttgcctttgtgaagggtgcccctgaagttatacaagataggctcattgatataccaccatcatatgttgagacctacaaaaaatacacacgtcaagggtctcgtgttcttgctctggcttacaagtctcttgatgacatgacagtcagtgaagctagaagcttggatagggatatagtggagagtagacttacttttgcaggttttgtggtatttaattgtcccataagatcagattcagccactgttttatctgaattgaaagaatcctcacatgacttagctttatccttagtaagatgtggaattgaagatgatgtctctttaatgtggggtagagggagaccaataaaggcatgttgttcaagtaccttggatcaatttaaccctgttaaggtgatgattaccggtgaccaagctttgacagcttgccatgttgctagccaagttcatattatatcaaaaccaacattaatccttggcccgacacgaaatggtgagggatataattgggtgtcccctgatgagactgaaaacattcactacagctttagacaagtatttgttgaatgtataattggtttcagtgagaaagaggtcgagtctttatcagaaactcatgatctctgtattgggggtgattgcattgagatgttgcaacagacatcagctcatcttcgggtcattccttatgttaaggtttttgctagagttgctcctgagcaaaaagaacttatcatgaccactttcaaaacggtgggacggttaactttgatgtgtggggatggaaccaatgatgttggagctttgaaacaggcccatgtaggaattgctcttctgaatgcattgcctccaactcaaagtggaaactcctcttcagattcatctaaggaagaaggttcaaaatctggcaagcaaaagaaatctaagcctgctagtgaaggcacttcaaaagccaaagttgcttcaaaatcagattccactagtcactcatctggtaaccgtcatcaggcagctgttgagatgcaacggcagaagcttaaaaagatgatggacgagcttaatgaggagggagatggtcgtgcacccatt

SEQ ID NO: 11466 - DNA, 873 bp, Glycine max
  Peptide Sequence Number=SeqID_128244
atggcatatagcatggacattcctctctctacagatcaacttgctaaaataagtaagttgttgaaaaaacacaaaactctatgtcagaaggtgtcatctaaaactactagtgagcattcagaagacagggaacaaaatggaatgcatagtatagtaaaagaaggaactgactttctcaggagagtcaatagaacatcttccatctctactgaagccaaaacgatatctaatcagaagttagacaccaatatttctgatgatgaagaatgtggttccgattctgaaactgaaaaggcacaaagctctttaccttcccacaggagggttctaagcactgaacggtctccagatcataatcctagaaatccctttgaaaactcaaacagtgataaagggaagaagtttactgagaattctgctgctcattgggatgtctttcgaagacaagatgtgcccaagctcttagaatacctcaaaagacactctgatgaattttcttatactagtgaatgtcatgagaagatggttcatccaattctggatcagagcttctttcttgacaatactcacaagatgagacttaaggaggagtttaaaattgaaccatggacttttgagcaacatgttggagaagctgtcatcattccttctggatgtccataccagattaggaatcctaagtgttgtgtacatgtggaattggaatttgtgtcccctgagaatgtctccgagtgtatccagttgattgatgaggtccggctgcttcctgaagaccataaagcaaaagtagaaaagctggaggtgaaaaaaatggctctttatagcatgagtacagcaataaaagaaatacgtgagcttacatgcaaaacatga

SEQ ID NO: 11467 - DNA, 1861 bp, Glycine max
  Peptide Sequence Number=SeqID_128245
gagagctgcccagtctgtttgtagaatcaatagcagatacctggaagtgagtaaaaatgggccagttgtctcagttggaccgaatatccaccactgccggttgtacatgcaatataagtttccaagtgaagcatgcagttcattcttgtggcatgggacaagggaaggctttcgtaaacgtggttctttcaggaacttttctgtaacctcagcaagtaatacagtcacgcaccattcccagattgcttggaaaaggctgtacagaaagtattgttccagtggtgatggtacatttcctcctaccgtaaatatgattgctcaggcagtaagcttggctttggctcgttcttatttgctagttcctggtattttggcatttacatgtggagagcttgcattagctcagcaaaattgggcagatgcagaacgttacccatcacagaatggtttgtatatgcgtgcacaagatgggtataattacatgtttacatttgcattcataatagttgaaggacttatcttattgatgagggctctctatctggcaatattattctctcctagcattgtgatggcaccatttgcagattgttttggaccaaactttaggaaactgtggctccatgtagttcatcgcacactagaaaaatcaggtccagcattcataaaatggggtcagtgggcagctacacggcctgatctctttcctcgagatctatgcactaagctttcagaacttcataccaaagctcctgagcatagtttctgctacacaaagaaaactatagaaagagcatttggccgaaaaatttctgaaatttttgacaattttgaagaacttcctgttgcatctggaagcattgctcaagttcaccgtgcttcactaaaatgtcgttatcctggtcagcaggcaaagccactattggttgcagttaaggttagacatcctggcgtgggagagtcaattagacgggattttgctattattaatttggcggcaaaaatttcaaagttcattcctgctcttaattggttacgattagatgagagtgtacaacaatttgcagttttcatgatgtctcaagttgaccttgctagggaagctgcccatttgagtcgctttatttataatttccgtagatggaaggatgtttctttccccaagcctgtctatccacttgtgcacccggctgttttggtggaaacatatgaaaagggtgaaagtgtctcatattatgttgatgatcttcaaggacatgaacgggttaaatctgctcttgcccacattggtactcatgcacttttgaaaatgcttctggtggacaacttcattcatgcagatatgcatcctggaaatatccttgttcgagtgtctcagaacaagtctcgaaaacggctcttcaaatcaaagcctcatgtagttttccttgatgtaggcatgactgccgaactctctggtagtgatagagtaaatttactggaattttttaaagctgttgcccgccgagatggccggactgctgcagaatgtgccctgaacttgtcaaatcaacagaactgtccaaatccggaggccttcattgaggaggtggaagagtcatttactttttggggcaccccagaaggtgatattgttcatcctgcagagtgcatggaacaattacttgagaaagttaggcgtcatagagttaatattgatggcaatgtttgtactgtcatggtgacaaccttagttcttgagggttggcagcgaaaacttgatcctgggtacaatgtgatgcagacattgcagacattgctacttagagctgattgggcaaagtctctttcgtacacaattgacggactcatggccccttag

SEQ ID NO: 11468 - DNA, 207 bp, Glycine max
  Peptide Sequence Number=SeqID_128246
atggtgaagatgaaaggagggatgaagggaggggagaacaaaagggattcgtgtcagtacaacaggaagaacgaaaaatggaacacaggggaggatatgtgtagaagaaggtcttctaatacaggaagaataaatcgacatggaaaaattagcgagtgggaggaaaaggataaaatgttcctgatcatgaagcccaattttagatga

SEQ ID NO: 11469 - DNA, 207 bp, Glycine max
  Peptide Sequence Number=SeqID_128247
atgaataacttacccatgaatcatgcaaatatgaattcgattctagttcttaatggtgcaaattttaaggacgggaaagagaacatgcaaattgttcttggctggatggatcaagaccttgcattaaggattgagaaaccccattctcctacggattccagtccctctggaaacttcattagaagtgggatcactcaaatcgcatga

SEQ ID NO: 11470 - DNA, 708 bp, Glycine max
  Peptide Sequence Number=SeqID_128248
atggcgattgatatcctgcgttcacctgtctccgccgtccgattctttaacggtgccgccactcgcagtcgttgctgtagtagcaccttccgcttcaaccaaaacgcaaagcattacaaagagcttgaagccgctgttgacgtagttcgcagggcttgccgtctctgtcttaatgtgaaatcatccttgttctcaactgatgagaaggttcttgaaaaaaatgaccagactccagtgaccgtggcagattttggagttcaagctctcataagtttggagttaaataagctgttcccttctatacctttggtggccgaggaggactctgctttcttgctatcaagaaacttggcagatactgttcttaatgaagtaactgacacacttagttccacttgtaaaccattgacacaagatgatgtactcgaagcaattgatagagggggcaaggatgcttttgtatttggatcaaagccggccacatattgggtgctcaacccaatcgatggcccacatggttttctaaaggctggcaaagccttatatgtggttggtttggctcttgtggttgaaggagagattgttgttggtgttatgggctgccctaactgggaggaagacttatctgagaaatcctctactgagattgaggagggttgggattctcttggtggatcaggaactgtaatgattgctcataacggctga

SEQ ID NO: 11471 - DNA, 849 bp, Glycine max
  Peptide Sequence Number=SeqID_128249
atgtctaccactaaacacgatgccatcgccatccgcggctacgagctacgcatcattcgttgcaccctcacttcctcacagccgtcggattcccgccacgaacgtgaatcgttggatggcctcataaacgacctcttgaattccatcgagcgcggcaactacgccgaagcactcacctccgaaccctcctcctccctcgtcttccgactcaatggccatgactcgctgcctctcgacgccgccgaccgagtctactccgagttggtccaccgcgccgagtccttcatcagagacgccgccgccgccgccgaacagcgtcgcagggcaatactcgtcatgtgcattgccgtcgccgcatttctagggttcactcaatccaacttcaccgggcctttgaaaggagcagagctaccgaaatgtcctctgggtttggatggaagtgatgaatgggacaattgggcgcggaatcagcttatgtctgctggttccgacttgcttggaaagttctccaatcttcagtatattgtttttgcgaagatgttgcttatgcggatgaaggatttgtccgttgagattggaagcctttcgtggtggctcgccagggttttgcttcttcagcagagagttttggacgagcggtcttcgtccttgtctgatctcttgcatgtctttatgggtgaagccttgcagcaattcagcacttcagaattggttcagggttactgggaggatcatttacgccatggggagagctcggcgattgtctccgtgcttcatttagaggctggcattatggaatatttatatggacgagttgactcttgcaggttagttgctatggacagttaa

SEQ ID NO: 11472 - DNA, 1026 bp, Glycine max
  Peptide Sequence Number=SeqID_128250
atgagcttgaggtacatgagcagggtgatataccaaggtgggatgagaatgcttcagggcatgaaggagcaattagggtctaataagtgtgactcaaccataaagtctctgaacctgagggattcatcctctaagcagaatcgcttcttgtcatcaggcacatccttcaaacctcccaacaatgacaacaagctaaaacaggcagaagactctctcaggactgtcatgaaagcaacaccacgtagaatagaagtcaaatgcagtggtgcagaaaataagggtgagagaacgtttttgacactggaggaagctggtttggttgagatatcaggcttgagcacacatgaacgctttctatgccgtttaacgatatcgtcgttgaacttgctaagagtgatatcggagcaagaagggtgtccaattgaggagctcaatgctgccaagatatgtgattggttcctcaaagataagctcaaaagagaacagaacttaggctctgcgccgggcaagcaggctaagagtgccgtcaggattaaaaacaccagcaaatccaatgtagctttcaagtttcaaacaaatgcacccaagagctgtttcatgcgacctcctgggggaattctagcacctggcgagagtataattgcaactgtgttcaagtttatagagcatccactgaataatgaaaagccacaaaaaactggagtcaaatttaaaatcacgagcttgaaggtcaaaggaccaattgattatgtccctgaaatgtttgatgagctgaaggatcaagtaacagtggagcagattttgcaggttgtttttctggatccagagcgtagctgtcctgctttggaaaaactgaagcttcagctggctgaggctgatgctgctgttgttgaggcacgtaagagagccccagaagatgcaggtcctaagattctcggcgaagggcttgtcatagatgaatggaaagagaggagggaaagatacctggccaagcagcagggtgaagtagtagtggactctatatag

SEQ ID NO: 11473 - DNA, 1080 bp, Glycine max
  Peptide Sequence Number=SeqID_128251
atgaaagtgtggtgctccctgggtgacactaccgctaacgatgcatgctatgaaaaagctctggaagtttcaaacaataggtctgctagagcaaagcgttctctggctcgcagtgcatacaacagaggagattatgagacatctaaaattttgtgggagtctgcaatgtcaatgaactctatgtatccagatggttggtttgcactaggtgctgctgcattgaaggcgcgggatatagaaaaggctttggatgcgtttactcgtgctgttcaacttgatcctgaaaatggggaagcttggaataacattgcttgcttgcatatgatcaagaaaaagagcaaggaggccttcattgcatttaaagaagccttgaaattcaaacgaaacagctggcaactatgggagaactacagccatgttgctgttgacactggcaatatcagtcaggcactggaaggtgtccaaatgattttggacatgagcaataacaagagagttgattgtgaattattagaaagaatcacaagggaggtggaaaagaagctttcaacaagtaacgtgccccagttggtaactgatgataataagcctaaaacagatcaactctgcattgttgattctggatcaaaatatcaagagcaagtgtctggagtatctattgcaggaagatcacgtgaaactgaacaattattgttattacttggaaaagttttacaacagataattaaaagtgggagtggatgtggaccagaaatctggggcttatatgccaaatggcacagaattaatggagatctcatgatgtgttctgaagccctcttaaagcaagttaggtcactccagggatccgatacatggaaggaccgagatcgtttcaaaaagtttgcaaaagcatctttggaactttgccaggtgtacgtggaaatattttcatctgctggtagtattaaacaattgactacagctgagatgcacttgaagaatgctcagagcttcaccgatacagaagagttcagggatcttcaggcttgctatgatgaagtgaaaattaaactccaatcgaactcaatggctaactaa

SEQ ID NO: 11474 - DNA, 1761 bp, Glycine max
  Peptide Sequence Number=SeqID_128252
atgtcgagtatcactttcttccaccgtctctctagtgctttccgtgacaaccagtcgcatcttaagcttgtactgctctgcaccgccgtaagtggtggtggcctttgggcttatggtgagagtgttgcacctgaagaggcagttacggagaagaagaaggtggtggtgctgggaactggttgggcggccacaagttttatgaagaatttgaacaatccaaaatatgagattcaagtagtttcgcctcgtaattactttgcattcacccctttgctgcctagcgttacgtgcgggacagtcgaagcgcgcagcattgttgaaccagttcgcaatatttttaaggtgtacgtctttgacctgatgtgggagtttcagaaaaaggtggacgtacaattcagtgaagcagaatgtttcaagattgatgcagaaaataggaaagtttactgtcgatctagtgtgaacaataatttggatgggaaagaagaatttgttgtggattatgactacctaatagtggcggtgggcgctaatgtcaatacgtttaatactccaggagtgacggagaattgccattttttgaaggaagttgaagatgctcaaaagattagaagaacagttattgactgctttgaaagagcaaatttgcctgatgttagtgaagatgagaagaagagaattcttcattttgctattgttggaggtggacctactggagtggagtttgcagcctcacttcatgattttgtcaatgaggatttggtccgtttatatcctggaattaaagatttagttaaaattacacttttggaggcgggcaatcatatcttgggcatgtttgacaagagaatcactgcttttgctgaagacaagtttcgaagagatgggattgatgtgaaaacaggatccatggttgttaaggtatctgagaaagaaatttccactaaagaactgaaaaatggagagattaagacaattccgtatggaatggctgtctggtcaactggtattggcactcgtccatttattaaagattttatggcacaaattggtcaggctagcaggcgtgccctagctacagacgaatggttgagagttgaggggtgcaacaatgtctacgcgctcggtgactgtgccacaataaaccagcgaaaagtcatggaagatattgtggcgatctttaagaaggctgacaaagacaattctggaacacttacggtcatacaatttcaagaggtcatgaaagatatctgtgaaagataccctcaggttgagctatatctgaagaataaacagatgggcaacattgctgatttattgaaggaagccaagggagatgataaaaaagaatcaattgagctgaatattgaagaactcaaaactgcactttccaaagtggattctcaaatgaaatttcttcctgctacagcccaggttgcatctcagcaaggcacttacctggccaagtgttttaaccggatggaagagtgtgaaaaaaatccagagggtcctctcaggttcaggggagaaggtcaccatcggttcaaaccctttaggtacaagcatttaggtcaatttgctcctttgggaggagagcagacagctgcccagcttcctggagattgggtttcaattggccatagcagtcaatggctgtggtattctgtctatgcaagtaagcaagtaagctggcgtacaagagcgttagtagtttcagactggacaagacgttttatttttggaagggactcaagtagcatctga

SEQ ID NO: 11475 - DNA, 1758 bp, Glycine max
  Peptide Sequence Number=SeqID_128253
atggcttcgaacaaaaggcatttcgcggagaaagacgacgatcctcactcgttatccaagaaggcgaaggaatctgaatctgaatctgaatctgaatccgttgcatctccttcttctctgcaagttcttctcaatcctgcggactgtgacttggaagggtttgcttattactggtctggtgcccgagctaaggtgggaataaccagaggtagatattgttttgcctgcaaagtggtttctgcacagacggttaacatggaggacactgcccctgagcagcagcatatttgttgcctcgggatttccagaggggacaatgcgtttggtgttggtgatacaatagtttgttgtgttgacctcgaaagcaaaccgctggcttctattggtttctccaagactgggaaattgttgggtgctgcgactcaatttgatgtagctcgccttggagtggcggattcttctccagggaacttacaatggacatcagccctttttccacatgtgctgttgaaaaatgttgtgggcagaaacatagtgatcggaccttctttttctgaacctagggattgcgaagtgataatgatggtgggattaccagcttcaggcaagactacatgggcagaaaaatgggtgaaagatcatccagagaagcgttatgtgttgcttgggacaaactcaattcttgatcagatgaagtttttgctgaaagtcaatgttacgctggtacctggactattgtggagaaacaactatggtgaaagatttgatcttttgatggatagggctactcgaattttcaatgtactgctatccagggcagctaatatacctcgcaattatataattgaccagacaaatgtctataaaagtgcgcgtaagcctaagcttgagccatttgctgattatcagaagtttgctgttgttgtattcccaaagccggaagagctcaagatacggtatgataaaagatttacagaaatggggaaagaagtgccacctgatgctgtgaataaaatgatagctaattatgttctgcctaaaagcaacgatatgccttgttctgatgaatttttttatcaggtatttagcaacctagtctacttcattggtcttcatctgccaggctcttattctcctatcactcttcccatctatgggacccctggtcaagttagtcaggttaatgcaaatgatcatgtgactgaacttaatgggagtatgaattcattttctggagtatatccaggaagtcaaattccgcatgttgccagagcgcccacttcttgtgaaccctattccaataaagaatcaagttgttttgctagagatattgccggttataatcaaacttacggtgccattctgactggtgatatccggaattacaacaactctgttgtgggtggcccatacagaccaaacattgtagagaacaatatggtttctcgggatgcttttcctgatgcctacatgagtggcatgaatgaaccctctccaatagcaagtgcaagggcaatatcttttgattttagcacttgtaaggaaccttatcctggtgcctacaggagtggcatgaatgaatcctctccagtagcaagggctagggcaatgtctttcgattatcctagagaggtttccagccatttctacagagattcactttccccatatgggacaccgactacaagacctacatatggaagttcacctattaacacgccgtattcaggaagatatgcctctcagcgtccaagataa

SEQ ID NO: 11476 - DNA, 1004 bp, Glycine max
  Peptide Sequence Number=SeqID_128254
tggcttacgagacgtcttcatttttgttggtctcagctgttgtgatgtacttgcccaagtcacaagcagataaaaagaaaagtctgttgggaggttcaccagattctagtgaggctcaagtgacatccaaggtggttgatgaatctgaagatgatgattctaatgatgatggtcctgtggagtgggcttcatattggaaaccaaatataacaataaacttggttgctgacttcactcagttgaaacctaaacttctattcatggcttctgcattgattcttactatggtttctcctccttcctccccaccaccacagcaactctgtcggcgagttgaacctgctattcatagtcatcatcttgaaggctacatcgctaatccgaaaattccacagaagtatgcttcaatcgaagatcacaatgctaataaagtcaatggtgagtttactgtttggtacgaacaagaccaatttcttcttgcgtggttgcaatccaccatctttggcaacattcttccacgaatgtttgttaacgagttgacttcaattggtgaaactattttcaattctgaacatcttgacctaattctcgatggtcttcctgatgacgaatcatctatttctcttgttactagtcattttcatccgtttactgttgatgaagttgaaacattgttgcttgcccgtgaatctatgaacactaactctcaagctcaagttaatttgaccactttgacctcttctgaggacaattctgcaaatgattacagtggaaatcgatttttcagtggtcgtggtggttggaatcttggccgaagcaactgtgacggtcgtggttcaggccgtggtagtggtagaagtagactagaggagaattatgttcctactcttcctccaccagcttcacttgcttctactcaatctacttcagcttccaatgctcagacttctctgcaagttcagtatgctcaacctattcagtatgtgcttgcttcacctcagtag

SEQ ID NO: 11477 - DNA, 432 bp, Glycine max
  Peptide Sequence Number=SeqID_128255
atgaaagctagtatgaaaaaattgaatttcggtgaagaggcaggactttgttttcatgaatcctacatcagagatgctattggtagtcagttgcttccaaattctctgatgcctgcacatgcagttgtccttggcgaagagaggttccatgggatagccagcttgtcatttggtattactttgacaaaacctgcattgatgtttaacaaaaaagccattctttcactgtttacaggtgatgcaaaaggtgcacatgatttgcaaacttacctgctatcaagagatcatttgaagttgaagtctgaatttcaagatggaaatggaaagaaaattgtcgattcaattgaacagctacctgctgtggaagtggttcttggtgagcatatcttttttactgtgggggaccattaccttgctgcaaaatctgactga

SEQ ID NO: 11478 - DNA, 465 bp, Glycine max
  Peptide Sequence Number=SeqID_128256
atgtatggtcccgtactctgtgaggaactattgatggaaatcctgtcatgggttcccgtgatggttatgatgcgattaaggtgtgtttccaagtcttggaattctcttattttcaatcctacgttcattaaattgcaccttgaaaggtcctctagaaacaccgatatcctattaacattccgtgcattccacgacaaagagacaggtgatatctgtttggtttactggagagcccttcatccaccattcacaatgctttttggcaccgattcaatcaattcaaggatctatgaatcgtggatgtctgcaatggcttggtttgcttgtgtaattcttgctctagatattcatatcagtttcttgtttggaacccggccacaaggatcatctcctaagcttctccttggttaccttgctcttccaaaaagtttcatcacatgtttgggtttggttacgatgatttga

SEQ ID NO: 11479 - DNA, 1929 bp, Glycine max
  Peptide Sequence Number=SeqID_128257
atgtgtcttttcaaaaagttttttctgaaattcttcactgtgttttctgaagtgccgttgctggcaaagggtagactggttaaatctggagcttttacacattcttatccattctgctggagatctcagacccctcttatctacagagctgttccaagctggtttgttagagtggagtcgttgaaagagaaattgttggaaaacaacaagaagacctactgggtccctgattttgtcaagggaagaatacaataccaggacaacatcatcctaatgcgagaaactgataagcgatttcacaattggctggaaaatgcaagagattgggcaattagtcgtagtaggttttgggggactcctctccctttatggattagtgaggatgaggaggaagtagttgtcatagattctgttgcaaaacttgaagaactttcaggtgtaaaggtgtttgaccttcatcgccacaacattgatcatattacaattaagtctgacagtggccgtgtacttcgacgtgttgatgatgtgtttgactgctggtttgagagtgggtccatgccatatgcatatatccattatccttttgaaaatgttgagctttttgagaagaattttcctggccattttgttgctgaagggctggatcaaacacgtggttggttttatacccttatggtgctggctactgctttatttggcaagcctgcgtttaggaatctaatctgcaatggacttgtcctggctgaagatgggaaaaagatgagtaaaagtttgaaaaattatccttcaccgatggaagttattaatgattatggagcagatgccttgcgattgtaccttatcaactctcctgttgtgcgtgctgagccacttcgtttcaagaaagaaggagtttatggtgttgttagggatgttttcctcccttggtataatgcatatcggttccttgttcaaaatgcaaagaggcttgaagttgaaggtctagcaccttttgtcccctttgatcatgccacacttctgaactcaacgaatgttcttgatcaatggattaactcagccacccaaagccttattcattttgtccgacaagaaatggatggttatcgcctttacacggtggttccttatcttctgaagtttcttgataaccttacaaatatttatgtaaggttcaatcgtaagagacttaaaggtcgttctggggaagaagactgcaggatagcactatcaactctttacaattattaccagaaaatgatggtgcttttgttatcctgtaaagttatggctccctttacacctttcttcactgaggtgctctatcaaaatatgcgaaaagtttctaatggatcagaggaaagcatacactattgcagttttcctacagaagaaggaaggaggggagaacgaattgagcagagtgtttcaaggatgatgacaataattgatctggcgagaaacattcgtgagcggcacaacaagcctcttaagactccactaagggagatggttatagttcatcccgatgcagacttccttgatgacataaatggaaaattgaaggagtatgtgctggaggaactcaatgtacgatcccttgtaccatgtaatgatactttaaaatatgcatctttacgcgctgagcctgaatttagtgttttaggtaagagactaggaaaatcaatgggcattgttgccaaagaaatcaaagcaatgtcacaggaaaatattttggcttttgagaatgctggagaagtcgtcattgcaaatcagtgtttgaagctgactgatattaaggttctccgtgattttaaacgacctgatggtatgactgagaaggaggttgatgctgctggagatggtgatgttctggtgatattggacttacgtcctgatgagtcattgtttgaggctggtgctgctcgagag

SEQ ID NO: 11480 - DNA, 1317 bp, Glycine max
  Peptide Sequence Number=SeqID_128258
atgctctctcgtttaattcccaaaccctctcatctccgtcgctttctctctattccgttgaaaccgtcccacacggctgtgaatcccttcttcaccgtcgtcgttcccaaacacttctccaccaaccgtggcggcggcaacgacggcgatggcaaggaccccttttcctcccgcgtgtggaaggatttccgggagaccgaggagaagcttgacgcgttcttcgaggaggaggaggagtgcgggagcctcgccggaatgaacgacgacggaagcagtggtgggaggagaagggaggagcgggggtggctgcaagaggaagaacaggggtggttgcaagagaagggtttggatgatgcagatgaagatgctatatttaaagggatcgacgaggaaagcggagacgccggtggtggtggttttgatgagagcaattttggagtgagagcaggagaggacttcaaaccttggagcatgaagggggaggaggacgacaaaaaggatgtgtttgatttcaaagaggatgtggggcatgaagggaacttcactgctttggatattaatcctaaagtcgatgttgaacagcttgagaaggaagaacaagctctcactgctgttgtcaaagtttttacggtgccaggttctgatatgttggtcttactagccaagagtatactcaggatgtttcttttagacctctatcaaggcccaaaacgtgcatttggtgatttgattgctgcttctggaatcacggatgagatgcttgacagtttgattgcgttgaaagactttgatggggttcatgggttgccccctcttagtgtaattgaagacatgaggtatgagaagaatactagaaaatccactagaggtgaaatggagcgtctgaagcaagaggaagctgctaaagctagagtgaagcaggttgatgataaaggacgtgcttatggaacaggaagaagaaaatgcagtgttgcccgtgtctgggttcagcctggtaatggtcaatttactgttaatgataaagagtttgatgtctattttccaatgcttgagcatcgtgctactctccttcgacctttctccgagacaaagactttggggctctgggatgtcgattgtactgtgaaaggaggtggtgtgtcagggcaagttggagctatacgattggggatcagcaaggctttgcaaaactgggaaccagatttgcggcctgcacttagaaatgctggtttcctgacaagggactcacgagtggtagaaaggaaaaagccaggaaaggccaaagcaagaaaaagtttccaatgggtcaagcgttga

SEQ ID NO: 11481 - DNA, 696 bp, Glycine max
  Peptide Sequence Number=SeqID_128259
atgcatctgcaacttggtgaaacttcacagccagtttgggttgaattctcggctacactcaatcaaatcaaagataatgatcaggagaaaaattctttgatattgatgaagtctggtgtggtgtcagatgatgggcaaagaggttatttctgtacaaagaatggaacactggtagaaattgatgtggctgagtctccaagatggacaaatcatggccaaccagctggagcaaatgttgcagctatagctgctgttgcttctaaacgaaaagtagtatacaccataagttctgccggagatctttatgaatatgatagaaaatcaaaaccatcgtggaagaaacacatatggcaagaaaaaaaagcaaaagtttcacctttgatgccatctaaagggtgcattttacatggattgagtggtgatcattccgaatctctgtttcttttaaccaagagatatttgataattgtacaggaaggtactttggtggagagaagattacatcaaagaaagtggaaatgggtagtccatggaagtcctgaacatcaaactttgacgtccatcacaccacctttgcaagatgaatcatgggaaacattcatttctttattttttacttcttcagccggatctgtttttgaatatcaaatgccaaaacaattaggtcagtcatccaattgtgctaaatctatttaa

SEQ ID NO: 11482 - DNA, 1533 bp, Glycine max
  Peptide Sequence Number=SeqID_128260
actctgaattctctcatgaaaacaggcactgcgctgaataatcagtttccagaagcatggggaagtcatgaacatcccttacatgcaaaagcagcaagaggtatagctggcttaccattacaagttgggaggatactgtttgcactagatgatggtagacttgcagaattgcatctagcaggactaggtggtgaaaattcaggaccatctgttccacaaaactttcgaaggaaagcatcaactaaatatgtttggactatattagatgtgccagagagtgaaggatggaatgcagaatattgcacagaagaacgtggcccccggaattgcatgacaggaacaaaagatgagtcaaatgattcaggaataagttcagtaacaggcaggagaaagcaaagccaagcacagaattattacttgcctctaggcacaggtggtgaaccgaatagatcttcagaagaatacaatcttccggatgactggattagtaataacttccgcttaagattgttgtatgaaggcaagtcattcttcttaataacgaatgatggttgggttttcgaatatgtttgtattgagaatgtatgggtatggttgaggcatgatagctcctcaactatgaatggtatagtggggagctataatggaagtttattcatggctgatacatttgggagtttgttccttagagaatggagtgataatgagatagcatggaggaattgcactgctatgaggaaaggaagaagtattgttgcaggtcaaccatgggatagattaccaggtaaagcaaggagggctacaactgaagattcaatcttctttgtgagcaaaaatggaagattactgcagttcatggtttacatgaggaagtttaaatggaaagactgcaaaaatcctcaaaatgttaaagttgcaagtatagttgaccaagaattgttcagggaaaatatagtctttgtcattggaagaaatggtcggctatatcagtataacaaagtgactgatctgtggcatgagcattaccaatctcaacatttgattctatcacagtttcctggaacagttattagaccatcaacaaaatcactctcaggctctctcttcatgctttcaagagaaggtggtcttgttgagtaccagtggactacatggtatggatggaactgggtagaacatggaacaccctataaaggtgtaaaactggttggttcacctggtcctagctttgaaggcaatcaactacttttaattggttcagatggaaaagtatacctaagatacctagacaaagatgcatggaagtggaaggattgtagtttcccctctatgggaaataaaattgttgaaacacatagtggaggaatcaatgaggagaaaccagttcggatcgatgaaaattgtgcatctggcttaagtaaggaccaagataaccttgctgaccttaacttaaattgtgaaccaaaggtggcatccacaagaccaattccattttctgaaggttctgtcatatttgagctcagagatggcagg

SEQ ID NO: 11483 - DNA, 1413 bp, Glycine max
  Peptide Sequence Number=SeqID_128261
atggccaacacaatacttgatcagggaggttgcacgaacctatggccattcagagtggacgagctaagagattcgaagcaattggtgaagaaactgagcatcccccaagacacgaagcaattcgtattcgcgctgcgtgatccccatacccaatccatcatttacattctctcctctctcaatttatcggagcgatcagcctccgatgccatgtgtctcatcaaggagatcaaacccgacgccgttttggtgcaagccgccgtttcccccttctccgagcttcagtccgaagaggactccgttccggtaccgacctcttctttcggggtaatcaaacgttgttttcttgataaaattggtagggacatgtacgagagtgttgcatgtaactttgtgttgagggagattttcgggaccagttttcatggtcccttgttggctgctaagagggctgctgaggatgttggatcttcgtttcttgttatagagtctccttcttcttggggggggagtcattttcggagtcttattaatagtttggttcctaagcagcatgctgcttcttgggctccttcggctttgaagaggttttctcttgataaggaacttaggatgatgttggccaaggctttatctggttctttggatccacttttgcttagtagtggtgctaatgctggttctgttttggagaagggtaatgaggaaattcagccatcgagtagttatgagacccctggttttgccaggtctatttatgctttgcttgaggatttgtatagtatatttggtgatcttccgtcgcttgggaaggcactggcacatgtgcagaagatgctgttggatgtgaatagaggggaggggttgaggccgagtaataggaaaggtgctgcaaagtcagataacattgagttctcggagattctggctgatgacaagttgcacactctatttgcgcaggccattcggagtcagactgataagtttaagaccattgtggcggtggtagatgctattgccttggctggtcttaggaagcactgggatactcctcttcctgttgaagtcaaagagttggttggagagctgatcacaaattctgaggtcaaaggggttatgatgaatcatagtgagaagaagtggttattaacagataaacctatggtggcagtaggggctggagcgacagcagtttttggagcttcatcactgaccaaagtagtccctgcatcaacactggtgaaggttatcactttcaaaattccaacttcactcaaaatcagtctcagccagatgcagaaagtgctggcttttgcctttggccattataaagttgtggctccagggattgcgacttcaggagccaaaacatctggcatcatgaaggcagcagtatctgctgaaaagatttga

SEQ ID NO: 11484 - DNA, 657 bp, Glycine max
  Peptide Sequence Number=SeqID_128262
atggagaccctctgctctgcattggtgttcccatctttcagaatcagaacttcagctttctccaaatgtggcatcagggcttccattgccgttgagcaacaaacttcccagactaaggttgctctcctcagaattggtaccagaggaagtccactagctctggctcaggcatatgagaccagagacaagctcatggcatcacatgcagagctagcagaagaaggggctattcagattgtaataataaaaacaactggtgacaaaatactatcacagccacttgcagacattggtgggaagggcctattcacaaaagaaatagatgaggcactcataaacggtgacattgacatcgctgtccactcaatgaaagatgttcctacgtacttacctgataaaacaattctaccatgcaaccttccacgtgaggatgtaagagatgcatttatatccttgagtgcagcttcactggctgatctaccctcaggaagtattgttggtactgcttcactcagacgaaagtcacagatactgcacagatacccatctctaaatgtggtatcaaatatggtaatagggcttaatacaatcagggcaatgagtgtaaactgtaaagtgatagacagtgtcatgattgagagtcttttactaggataa

SEQ ID NO: 11485 - DNA, 177 bp, Glycine max
  Peptide Sequence Number=SeqID_128263
atggtattgctacgtggaatgttggacactgagtactcttccatgcatagagctatgcccgtgaggattgaggaatacttgatttgtaggcttgtagccttaccacaaaggttctgcaaccgtaaatgggaagttaaaggagacaaacgaaacgccgatagcatgggtaaaaactga

SEQ ID NO: 11486 - DNA, 234 bp, Glycine max
  Peptide Sequence Number=SeqID_128264
atgtctgagtgtatttcaaagaacttaagcggatcaagaatccagctttgggctattggaattggtatcattcttgtggctgtcgggggatttgttgatttcatcatcgaacctaattcgaagtttgtcattaaccttattcaaaatagttgttcctcgacgcaggaatgcgctcatcttcttgtttttatccctgagaaggtagtctccttagagaagccaaccaagcgatag

SEQ ID NO: 11487 - DNA, 276 bp, Glycine max
  Peptide Sequence Number=SeqID_128265
atgaccaagattgtgctgaaggtcacgatttcaccaaatattattttaaacaccgttaacgttaaggatcagatttactatgaagttagtatgtcatttgctgtgagatggaaagatgaaaattttcataagaaattaaaaattggtgataatggactagtgacgtgtgtacgtgcatttgagtgtgaaggagccagctgggaggaatttcgtaaaatatttagaagtcccaaacaagtgggcaacaaacttctgagttctgacccttccaattaa

SEQ ID NO: 11488 - DNA, 126 bp, Glycine max
  Peptide Sequence Number=SeqID_128266
atggaggataagaaaacatccctgatgggagaaattgagcatgaggacacaactctcgaggaggacgtgagccctaacacaagtccaggtggtggtgggatggtccagtggtgggtttggggttga

SEQ ID NO: 11489 - DNA, 1980 bp, Glycine max
  Peptide Sequence Number=SeqID_128267
atggatgtgtcaccgtatcaggaaaagctgtctgaaaatgaaagatcgagggaagattctttggcatccaatgagtcatttagtgttgataacaacaatattgttaatgattcagaaccaacatcttttattgatcccattgatgaagatctaattgccgcggcaaagagcttggatataaatgggggtgatgttgcacacagagacacaaaggaggaaagttcagaggatcaaatgcgtgaaaatagttgtgttgaagacccaaaggacgagtcaatttccggggttgaaactgaaagctttaagtctgccaatgatgaagtggacataactagtgatgtgactggtgtatcagcagaaactggagcccatgatagtgatagaatgttgcatcttgaaagtgctttgagttcaagaaatgtaaatgggtctggcttcacatttgctgctgcttcttcgactgaagctcaatcatgtagcccaaaacgtcttcacaaaaagaaaaatgttggtcacgattcttacaactacacaccaaacataaaggttccttattcatcaacttcagtggcattttctccattttctgggacttcatctcttttcacaccagggcaaagtttaaaacccaaagtatcctctcctccgcccaaaacaagtgattctgatgagaatcaggagaaggagataaaggaggctgaggaagcctgtgaacggtggaggctccgtaccttaccaacattgcaaccattattcaaaatactgaatatgctctatatcagaggaaaccaagcctataaaaagggggatctgtctacggctgagaattgttacaaacaaggacttagttgtatatctaaagaagcatctcgtagctgtctcagggctttgctgctatgttatagcaaccttgctgccacacacatgtctcttggtaggatgagagatgcactagaagattgtaagatggctgctgaaatagatcaaaatttcctcaaggtgcaacttagagctgcaaattgttaccttgctctgggggaagttgaaggtgcatcacaatattttaaaaggtgcttgcaatcaggaactaatgtttgtgtggatcgaaaaattgctgtggaagcctctgatggcttacaaaaggcacagcttgaggtgctctatggagattgtgacaagatggtgtttgagagttggaaagtatcagatgtcatcaatcattctgctcagcttttgcaaagaagaacagcctcttatgcagagagagcattagaacatattaatgaggcgttaataataagttcatactctgaaaaattgcttgaaatgaaagcagaggctctcctaatgctttgtagatatgaggaggtgattcaactgtgtgacaagacccttgattctgctgaaaagaatgcctgtcctttggatgctggttgcaaagtcacggatcttgataattcacaactctcaaaaggtttctacttcagaatatggcgatgctcaatgatgcttaaagcatacattcacctaggaaaatttgaagagggtctttctttgctggagcaacaagaggaaaaggtgtctgccataaacaagagtggaagcaaggttttggattcactcacacctcttgctgccatcatacgtgagcccttgcatcataaggtgacagtccttatgcacatgctcgtttttatttgtagaaatatattcaagggggtaaaaactgctccatattatagaatgggattcaccaagacactagggaatgcagcatttcaggctggaaggcatgcagaagctgttgaatactatacatctgctttgtcatgtaatgtggagtctcgtccatttgcagctgtctgttattgtaatcgtgctgctgcgtataaagctttaggtcaaataactgatgctattgcagattgcagtctagctatagctcttgatggaaattatttgaaggataaaaacacttag

SEQ ID NO: 11490 - DNA, 249 bp, Glycine max
  Peptide Sequence Number=SeqID_128268
atgacgaatgcaatgtgcacgtttttcagatctgtaggaattgcaacagctgcttttgcacttgcaattcttgaaggaagcacgcagccaggagtttggtttcctgaagaggctcaaggaattccaattgaagcaagagaagttcttctcaagcgtgctagccagggaacgtttaactttataatgaacaggtcaccatggatggttgaaacgaatccaaaagagtttgggttaggaatatacttataa

SEQ ID NO: 11491 - DNA, 2634 bp, Glycine max
  Peptide Sequence Number=SeqID_128269
atgagtagaaacgattccaagtacttctccaccaccaagaagggtgaaatccctgagctcaaagaagagctcaattcgcagtacaaggataaaagaaaagatgccgtgaaaaaggtgattgccgcaatgactgtcggtaaggatgtctcgtcattgttcacagatgtggtgaattgcatgcaaacagagaatttggagctgaaaaagttggtttacttatatctgatcaattatgcaaagagccagcctgatcttgcgatacttgcagtgaatacatttgtgaaggattcacaagatccaaatcctttaattcgtgccttagctgtacggacaatgggctgtattcgtgtcgataaaattactgagtatctatgtgatccccttcaaagatgcctaaaggacgatgatccatatgttcgtaagacagcagctatttgtgttgcaaagctttatgatataaatgcagagttagttgaggacaggggttttttggattctctgaaggatttgatatctgataacaatccaatggttgtagctaatgcggtggcagcgcttgctgaaattcaggaaaatagtagtagacccatctttgagctcactagtagcacactctcaaagctcctcactgctttaaatgaatgtacagaatggggtcaagtttttatactggatgctctttctagatacaaggcagctgatgctcgtgaggcagaaaacatagtagaaagagttacacctcggttacagcatgccaattgtgcagttgtactatcagctgttaagatgatccttcaacaaatggagctcatcaccagtactgatgttgctcggaatctttgcaaaaagatggctcctcctcttgtgacattactctcggcagaacctgagatacagtatgttgccctgcggaatatcaatcttatagtacaaagaagaccaacaattcttgcacatgaaattaaggttttattggaatttaaggagtatgctactgaagttgatgtagatttcgttagaaaagctgttcgtgcaattggtcgttgtgccatcaaattagaaagagcagctgaaagatgtattagtgttttgcttgaattgatcaagataaaagtaaattacgtggttcaagaggctatcattgttatcaaagatatatttagaagataccccaacacatatgagtccataattgcaacactttgtgagaacttagataccctggatgagcctgaagccaaggcatcgatgatctgggttattggtgaatatgcggagagaattgacaatgctgatgagcttcttgaaagtttcttggaaagtttccctgaagaacctgcacaagtccaactacaattgttgacagctactgtaaaacttttccttaagaagccaactgaaggcccacagcagatgattcaggttgttttgaacaatgccactgtggaaacagataatcctgatttggagatcgtgcatacatatattggcgtctcctctcaactgaccctgagttccttgatgtaccttgcttatcttctgcaggcagctaaggatgttgtgttagctgagaagcctgtgataactgatgactcaaaccaacttgatccttctctacttgacgagcttcttgtcaacattgctacattatcttctgtctatcacaagcccccagatgcatttgtaacccgcacacactcgtctgcccagaaaaccgaagacgatgactatcctgagggaagtgaaacagggtattctgagtcacctggaaatcctgctaatggccctgcttcacctcctagtgccagctattcagcacctgcgtctgttgcaccggcatcgcctccacctactgcgcctgtgcctgatttacttggtgatttgatgggcacagataatagttctattgttcctcttgatgagccagctacttctactggacctccattgtctattgtacttcccacctcagttggtcatggttttcaaatcagtgcacagctgaccaggcaagatggccaaatattttacagcatgttgtttgagaacaatactcatgttccacttgatggcttcatgattcaatttaacaagaacacatttggtctagcagctgctggacccctccaggttccacaattgcaacctggaacctcaactaggacactccttcctatggttatgttccagaacatgtcccaaggtcctcctagctcacttttgcaggttgctgtaaaaaacaaccaacagcctgtgtggtattttaatgataaattctcattccatgtactttttactgaggatggtagaatggaacgttccgctttcttagagacttggaggtcccttcctgattcaaacgaggtttccaaggacttcccagacattgtgattggcggtgtggaagcgacactggatcgactagctgcatcaaacgtgttctttattgcaaagcgcaagaatgcaaaccaggatgtgttttacttctcagctaagattcctcgagggataccattattaattgaacttaccacaatggccggaaaccctggcgtcaaatgtgcaatcaagacaccaagccctgaaatgtcagcatttttcttcgaagccatcgagactcttctcaggagctaa

SEQ ID NO: 11492 - DNA, 960 bp, Glycine max
  Peptide Sequence Number=SeqID_128270
atggcgccactttcattgcctctgaatttgaaatggacgccgttgagtgtgaaggccaccgccaccgccaccaccaccagcaaggtccctgaggtgccgctgccggagaagatccgcaactctagaatcctcgtcctcggcggaacgggtcgggtcggaggatccactgccattgcactctccaacttatgtcccgatcttcaaatcctcgtcgccggcagaaacagggagaaaggtgaagttctcactgcaaaacttggcggcaattcagaattcgctcgcgttgacatcgacgacgtgaattcgctggaaactgcattgaagagtaaaattgcactcgctaccagtcaccgttgttctttgtcttgtgcttatgaattgaaaatcgatcatgaatgttgttattttcatgccgctggtcccttccaacaagcagaaaggtgtagcgtgcttgaagctgcaataaatactcagactgcgtatcttgatgtctgtgatgacacaagctatgcatggcgcgcaaaatccttcatgaatagggcgttggatgcaaatgttccggctataacaaccggaggaatataccctggaattagcaatggtgcttacctatctatccgcattgttcttctgttcccaaataggaaccagaattattatgaaaatcatttgatcaccaagttaggggaggtcgtgatttatgttgaacgagaatctttttgcatctgctgtattttggttgctaacacttcctacaattttgtcacagtcatggcagcagagctagtccgtgctgcaaatgaaagtgaagataagcctgagaggctaagatcgtgtaagataattgagaatccacttataagctactatggtcaaatcagattctactactacacagctggaactggtggtgctggcccaaccatcttagccacaagcttcttgctgttgggagaggaa

SEQ ID NO: 11493 - DNA, 282 bp, Glycine max
  Peptide Sequence Number=SeqID_128271
atggagaccttgttgactcctttagaagcaactttggttccatttgctagggttttgaaggacctcaaggctccaaagatatttggcaccacagacttccacaataaggcacaaagctggaagtcaagccttttccattatcttgactttctattggtgtcacatagaaagaaattgtgggaccaacaaaagaagaatcgtacaagatgttgtagaggccatcttataatgaggagttatgcaaaccaatatgtcaaactcccacaaataaaaccttcatga

SEQ ID NO: 11494 - DNA, 604 bp, Glycine max
  Peptide Sequence Number=SeqID_128272
agtgatggtgggagtggcggtggggctggcggcggtggcgtgtgcggtggcggcggtggcggtggggcagaggatgaggagcagagggaattggaagagagtggcgagggtgttgaaggaggttgaggaagggtgcgagacatcggttgggaggctgaggcaggtggtggatgctatggccgttgagatgcacgctgggttggcatcagaaggtggttccaagctcaaaatgcttctcacatatgttcataatctccctaatgggactgagaaaggaacatattatgcactagatcttgggggtactaattttcgggttttgcgggttcatttgcatggtcaacaatcttctgttttggaacatgaagtagagcgacagcccattcctcaaaatctaatgaccagcacaagtgaggatctctttgatttcattgcttcttcattaaaggaattcattgagaaagaaggagacggttccgagctttcaccggacagaagaagggaacttggattcacattttctttccctgtaggaatagatgttcctgcatgtttgcaggaagcattgacaagaaaaggactagacgtgcgggtggctgcattg

SEQ ID NO: 11495 - DNA, 1545 bp, Glycine max
  Peptide Sequence Number=SeqID_128273
atgctgctaaatgcaaggcattctgctctgaccatatttgtgagagaattgagaaaaaaagttagagagctttattcaaacataaggtggcatgatattgagaacaactattccctatatgtgttggacaaggaatctagaaaatcagtcaggctgttcaaaaaatcaatcgtacgcaggaagtgcactgaagggggatctgtgaaattccttattgattttgggaagagaagggctattccagatgttgttattaaacatggttctttgttagaacaatctgctagtgagagaaaaaaatattggctggaggagtcttatgttccattgcatcttctaaagaattttgaagaaaaaagaattgtccgcaagtccactgataagaaacttggaaaaattcttgagattggtagagtaaacaagaaaattcctcaacaaaggggattttcatatttgtttaccagattggaaagatctgattgtcatcagtgcaggcactgcaacaaagatgttgcaatgagggatgctgtgaggtgccttcattgcaaaggatatttccacaagagacatgcaaggaaatcaggtggcaaaagaactactggaagctcttattcatgtcacagatgtcaagatgggttgcatgcaaagactaatactaataaaaggaaagttgactcaaaactgcagaagattcaagcaaagaaacgtaaaactgtgccttcagtttgtaaaccagtgaatctcaagggcaataaaaaggcattgagtaataataagatacgacaggcgagatctcgaaacagtaagaatatcccatcaagtatacctcttcgccgttctactaggaaggccaaatccttgtatatgcaaagtcaattgaatggaggacataaaaaaggaaaaaagaatgtgggacgtaaaaagggaaagcaaggtaaaaccaagaaggtgattcctcaaaagtccaaagaaactactggtcaatataagaagtcggaagttactactgcacgtaagaagagaacaaaaatctgtaacagttattggcttaatggtcttcagttgtctagaaagccaaatgatgaacgagtaatgctgtttaaagagaaaaagcgtgttgcctcctctaaagatttctctggctctcttgatcatcctaaatgctgcctttgttgtggaaatgaatgcaccttgaattatattgcgtgtgaaatctgtggagattggtttcatggtgatgcttttggcctcaatgtggagaatgccagacaacttattggatttaagtgccatgtttgtcttgatagaactgctccaatctgtccccatttgaaggttaatgcattgtcttgcactgaaagcaatgctgcaattgagtgtggagaggagttatccaatcctgtttctctccaacctttaagtgaggtgaatgtaactctttttcctggggctaaacttttgaaaaattatttaaagaatttagttttgttgcactgtgaatgtgataggaataactcccatagattgagattatgcacagaatga

SEQ ID NO: 11496 - DNA, 570 bp, Glycine max
  Peptide Sequence Number=SeqID_128274
atggctgccactaataacattcatgggaacactgaatctgctcaatccaacattgctcctcccactaagcagcctctacatccttctaagactgttgattctcaatctgtactcaaaaggctgcaatctgaattgatggctttgatgatgagtggagattctgggatatctgcgtttcctgaggaggacaacatattcttctggaagggaacaataacaggaagcaaagatactgtgtttgaaggcacagagtataagctatcactctccttccccaatgactaccctttcaagcctccaaaagtcaagtttgaaacaacctgcttccaccccaattttgatgtgcatggcaacatatgcttggacatactccaggataaatggtcatctgcttatgatgtcagaacaattcttctatctatccaaagtctgcttggagagccaaacattagttcaccactaaaccaacaagcagcacagctttggagcaatcaagaaggagagaagaaggaagggtccatagagtctgcttctgagaagagaaaggatgaagccgttatttgtttttag

SEQ ID NO: 11497 - DNA, 3471 bp, Glycine max
  Peptide Sequence Number=SeqID_128275
ttaggaaagaggtgaagggggttgggtttatctctggaacagtgaaatcctacgacccttcctctggttttttcgagatcgtttacgaggatggtgattctgaggaattggagtcttctgaggtggcttctcttctgcaatttcaaccggagagtgtcaaggccaagcctcgggttggtcggaaacctaagaagcgccgccgtgtcgagcagaagccggatgctggatcccgttcaggtaatgttagcgagaatttggtggaggatggtagtgactttaggggggatttggatgggaatgtttcttctgctggtggtggggatttggatttaggatgtgcggggattgatagagccattgatgtcgatgttgggaatggagggaattctattgtcaatgttaatgggagtgtgaaggaaaacgggggtggagaggacattggttttgaggatagtttgaacaagagtgtcgatgctaatggtagttgtgtcaaggatgcgcttgatttgaatgctaggcttaatctcaatgaggattttaatctgaatgatgcttgtactttgcctcttgacactgaggatggttttaatagaagagattgtattgatttgaatttggatgtaaataatgaggatgatgtcggcgtgaatgtgggttacctgggttgttctggtggggaggtgttgcagcgggaatgtaattttgatttgaatgtcgaggcatgtgaggaaggtagggaaactcggtgtgatgatgacggaaatggacattctgaggtgggtgatgctttgtttagtaggatggggcagctccaaaaggaagaagaggtaaatgttaataatagttctgaagaaaatgaaggtgttaacggtaatttgaatcatgtctctgatgctgtcaaattggagggaattcatgtttctgctgcccatgcagctaaagatggttctttgtgtttggttgaggaaaatggaggtgatgatggcaaagatgtggcagctattgattctcatcagatttcaaatgcaatttcggttagggattctgattctgtggaggctcagcgagttgattggccttctgaaggtggtgttgccgtaattcatgaactccaagatgatccaggaagtccgtgtaaacaaggaaatggccgaaggaaaagaagaaaagtatcagataatccacaagccacgccagagacagttttaaggaggagttctcgtcgggcatcagctagaaaacgggtttcaagcaccatactagtggaggtgactgatgatcctttgatgtccttggaaaccagtgccttaacaggagaaaagcctctaatctccaattctcagaaatatgaacaatgcagtgatcctcttccaaagctgcaatttcccccgtcttctacaaatttgaatttagatggcgttcctgatcttgtagctgccctgaagtctgaaatcccaagtatattatttgacagcattcatgtttctattttgcaaactctgagaaagaatttggaatacctttccaatgagggttgccaatctgcatccaattgccttaggaatcttagctgggattttttggacctggtcacatggcctattttcatggccgagtaccttctgattcatggctcaggatttaaaactggttttgatcttaaacatctaatgttcaaaactgattactacaaacaacctgtaactgcaaaggttgagattcttcagtatctatgtaatgatatgattgaatcggaagccataaggtcagagcttaacagaagatctttggtaactgagactgatgtgggctttgatcagaatatgtattttgacactggcaagaaaaagagagctgtaatggatgtgtctggtggctcttgcttgactgaggagaatgtggatgatacaactgactggaacagtgatgaatgttgcctgtgcaagatggatggtagtttaatatgctgtgatggttgccctgcagcattccactcaagatgtgtgggaattgccagtgaccatctccctgaaggtgactggtattgccccgagtgtgtaattggcaaacacatggcttggatgaaatcacgaagatcacttcgaggagcagacttattagggatggatctggatggccgtctctattttaacagctgtggttacctgtcaaactcatctgaagcagggtcattgttcaattattaccacagaaatgatctacatgtagtaattgaagctctaaaatctatggatcctttatatgaaggcatactaatgactatctataagcattgggatatcagtgctaacttgagtgtgggggatagtgtctttaatcgggctaatgatcaaagaaagttggacgaaaattcaactattgacagttgtatgcatcttgtccaagagtttccaaaagctgggaaccgcctagactcaacgaccaccatagaaagtccttgtgttgcttcagatggatcagctgataccacacagactagaacaggcatcgacaatgttcagataaatgggctcaatgattccaatagatgtgatgaatccttgaatcagccaggaataccagaaagatgccatcctgttggtgactgttctttgacatcttccagcttagatgtgggacgtaaaataaacttaagatctgtaggttctagtattaccccctccatggacaataaggatacttcagaagtacctcgtggaattgactacataaactattacagctttgcccgaacagcttcatttgtagcacaggagttgatgtgtaagtcacctgaaaagatgaataagatttttgcaatgtctgaagaagaagttatgtcagaccaagcaaaggtcattacgaagaaatctactaacttttgctggccaagtattcagaacctgaatgcagctgcccacaaggaaaaatgtgggtggtgcttcacttgcaaaggtgaaaatgaagacagggattgcttgtttaattctgtggtgaagcctgtttgggaagtgcctaataatattttagttgggcttcaacccaggaagatccagaatggacgtcttagagatatcatatgtcttatcttctctcttgagttagaatccaatttgtgccttcttgcactttcagcagattggttaaagcatgtggattctgttgctacaatgggatctgctacacatattgtggtcagttcatcacgcacatcttcaaggcatggtattggaaggaaaagggccaggaactcagatattgaaaccagttcatcttcaaacactgctagtggtttgggaatgtactggtggagaggtggcaggctttcccgaaaattgtttaattgtaaggctttgcctcattccctggttaccaaggctgctagacaaggcattttatatcctgagaattcagattttgcacggagaagcagatttgttgcctggcgagctgctgttgagatgtcaacaa

SEQ ID NO: 11498 - DNA, 216 bp, Glycine max
  Peptide Sequence Number=SeqID_128276
atgaggctgttatctaaaatgcatgtcatttgttgtatgccaataaaccgcaaggatatgggatttggaaaagtccttaatctgacaaagtatagtaaggaagtgctggtagcaatttatgaaggtgtagaaagcgacagtccaagtgtttgggtaaaagcgttatcagatttggtgatggactccggtgtaggatatgtgtttataacagtgtaa

SEQ ID NO: 11499 - DNA, 333 bp, Glycine max
  Peptide Sequence Number=SeqID_128277
atggcaagtggtggcacttatttgtccttggcaatgttggtggttgcaggatctttaatatataacacaaaagaggtttcaggtcaatgtggaggaagtctttcagatcttatagcacaatgctcacagtatgtgcaaaagtcaggaccaaagattccaccttcagcgacgtgctgtgcagcgttgagaaagtttaatgtgccatgcgcatgcaaactcgttactaaagaagctgcaagccttgtgagcattccaaaggtcgtctttgttggacgctcttgtggattgaaccttccccccggaatgcaatgtggagtacattttaatcaataa

SEQ ID NO: 11500 - DNA, 318 bp, Glycine max
  Peptide Sequence Number=SeqID_128278
atgtcccattccaaggtggccgtgctccggtgcgttgatgggttctcaaacgctcagaatcaggcagaggtgcaacaattcagtagtttccataacttggtgtttgatgttgtgacctttgaggagcagagccacgaaaggtctggtgaggctgtgagagccacagagttcacactaattcacatgttgacgacgactttctggttggtgatgatttcttcggtggagttgaggagggagaaactatcgatgttgtcgagtagaggggaaacatggttttcttcctcgaagaagaatgacatcataattattttttaa

SEQ ID NO: 11501 - DNA, 1110 bp, Glycine max
  Peptide Sequence Number=SeqID_128279
atggggaaagctttttttgttaacagtggatcagaagccaatgacactcaggtgaaacttgtatggtattataacaatgcacttggaagaccagataagaagaaattcatagctcgtgctaaatcgtatcatggttcaacactgatagcagccagtctttctggccttccggctctgcatcaaaaatttgatttgccagctccttttgtattgcacactgactgtccacattactggcggtatcatcttccaggtgagacagaggaagaattttcaaccagattagccaaaaatttggagcagctgattctgaaagagggaccagagacaattgctgcatttattgctgaacctgtaatgggggcaggaggtgtaatagttccaccatcaacttattttgagaaggtccaagccgttgtcaagaagtatgacattctttttattgcagatgaggtaatctgtgcctttggaaggcttgggacaatgtttggatgtgacaaatacaacattaagccagaccttgtatcccttgctaaggcactatcttcggcatatttgccaattggagctgtccttgtaagcccagaaatttcagacgttatacacgcacaaagcaacaaacttggttcattttctcatggttttacttattctggacaccctgcagcctgtgctgtggcaattgaagcactcaagatctataatatgattatgcctcttcttcgcagggaaagaaatattgttgaccaagttaacaagattgccccaaggttccaagatggcataaaagctttttctgacagtcccatcattggagagatacggggaactggcttgattctgggcactgagttcacagacaacaagtcacctaatgatccgtttcctcctgaatggggcaatttgatgtatactacaggagtaggtgcctattttggagcacaatgtgagaagcatgggatgttggttcgtgtagcaggggataacatcatgatgtctcctccatatattatatctcaaggagaagttgatgagttaatcagcatttatgggaaagctttgaaagaaacggaaaagaaggtacaggaactcaagtctcagcgcaagtag

SEQ ID NO: 11502 - DNA, 411 bp, Glycine max
  Peptide Sequence Number=SeqID_128280
atgtctgctccgtttaagctatttccttcgggttgcttagagtatctgactgcttcatctttagcatatgctgcggtttccagaagtgctcaagaaaatctccttcaggctcccttattgtctagatcaaatagcacggaggcttccttggcaaaggatacttcctctaatgatgtgaaaaatggtcaagggttcaaaggccatagtatgcttgctcctttcacggctgggtggcagactactgatttgcatcctctggtcatagaaaagtcagagggaagctatgtatatgacattaatgggaagaaatatcttgatgcactggctggtctatgggccacttctttagctatccaccaaatcatgcctaagttgcctggggatccatctccttccctatatttagtctag

SEQ ID NO: 11503 - DNA, 2445 bp, Glycine max
  Peptide Sequence Number=SeqID_128281
atggaaatttgtggtatgacatcttttcccattcttattttcaattcatattccttgtctctagctaaaattgcaatgcttatattttgtcttactcttagtttagcgaaaatcctttgtttccaatgtttgtccccaaagctcaatcaaaactatatcatccgcaaaaatcatgctattaaggataatcttttgaaagtccttggtcttgccttctggagttctaacacctgtatttgccccatcgtacatgtcttgaatagctctgatgttgttgcgatcactgtattctgcttattggtgattgctttctatgctttccttgctcccttcatcggaggaggtcatatatgggaatacaccttcattgctgtttactctcctgtggctctcattgtgttcattctttacgtcagatgcactgcaattaaccctgcagatccgggcattatgtctaaatttgaccctagagtgggaaataagttcaattctgctcacaatttatcagggaagcatcttggttctgaacatgaacacgttgctgctagagagcaatattctccatcatctgctgcttccaaaaggtctatgacaaatatcagcaagaagagctcagtggaagatcttgacagactagatagttcaaggaaagagaataaccaaaactcatgtaatgcaattggaggaattttctgcatattattttcacatgaagattgccggaaacaggaagcaacggctgatgagcagggtggtggtgaagatgctctgttctgcactttgtgcaatgctgaggtgcgcaagttcagcaaacattgtagaagttgtgataaatgtgttgatggcttcgatcaccattgtcggtggcttaacaattgtgtgggtcacaaaaattacagttcttttattgctctcatggcttttagtcttgcgtggctagttattgaagctggagtgggtgttgctgtttttgtgcgtttctttgttaacaagagaggaatggaatctgaaatcattgatagactcggaaatggattttctcggcccccatttgcagccgttgtggttgtatgtactgtagtttctatcttggcttgtgtgcctttgggtgagcttttctttttccacatgatactaatcaggaagggcatcactacctatgaatatgttgtagcaatgagagccatgagtgaagcacctgcaggagcatccgtagatgaggatttgccaaatatacttttctctccaacaggctcagccacaactggattgagtggaggaagttctcttggtttgcagtataaaggggcttggtgtacccctcctagggtattcgtggattatcaggatgaagttgtgcctcacttggagcctggaatgctaccatcaactgttgatccagatgcagctgggattgccgaaagagggcaaaagatgccaaaaagacctgttcgtattagtgcttggaagcttgctaagttggattcacaagaggcagtgagagcagctgcaaaggccagggcatcttcttcagttttgcgacctgtagataaccaccgtctaccagatgtagaattgagttctagtgggaacatgagcatcagaagtagtttgagcacagagactggaactaacaaggaaataaaagccgagttgagattgtctccagtgagaaattctattgctcctagtcaaggaagtcgtgatgagtatgagactggaactcaaagtatgagtagttttagtagtcctagccatgttcaagaggcagttacactcagccctcttccacagagtcacaatttgggtggcttcagggcaggtacctcaattcctagtttggtgcctgagcgtcctttaacttgtaaagcaacattgtcaaacttcaggaacccgatatctaattcttctcttggatttgatgggaggacagcaatgccaaaaggaattggcaatgatccactgttgctttcaacttctaacacttctattctaagagatgtgaaacggacatcagttgtttgggatcaagaagctggcagatatgtttcggttcctttattgccctcagaagctcgaaataggtcatccatgcgcatagaattgccaaatgtaaatgccgaaacaagcagtattgggcgaaaaccagtgattcctcagcaggagttgtcatcgtctgcacccaagtctccaggccagcacaaacagaatctgatgtatacaggagattctatcttttatggaggtccatttttgagtgccgctgttaaagatggtttgagaaatgaaagacatttgacatcaacggatgcccaagatggcagcatatcagtgaacttgccccaagagccaagatataaaagggattcactttcaaatcagcttcctgtgtttgtccctggtggatttgagaataaccttcaacctcgttctggcatgaattaa

SEQ ID NO: 11504 - DNA, 2829 bp, Glycine max
  Peptide Sequence Number=SeqID_128282
gaaaagctaaagctctcaggcgaaaattttcttagaacagattctcttttatcccaggcactttcaaacaatgcagagcttgagcagaaggtgaagtctttggaagatctccataatgaatctggagctgctgcagctactgctactcaaaggagtcttgaacttgagggacatattcagacatcaactgcagctgcagaagaggcaaaatcacaattgagggagctggaaacacgcttcatagcagcagagcagaggaacgtggagcttgagcaacaattaaacttagtacaattgaaaaccagtgatgctgagagagaagtggctgaattatctgagcaaatatctaatctcaacgctaaattagaagaggccaaggaagagaagagtcttcttaatagccagctacaggagtacaccgaaaaagtagctctacttgaatccgacttaaatcagtcatctttgcggagttcacaattagaagaggagttgaagaatgtcaacgaaaaatgtgccgagcacgaagaccgagccagtatgaaccatgagcgtagccgagaactggaagatttaatccagagctctcactccaaattggaagattctgataaaaaggtgagtgagttggagttgttacttgaagcagagaaatacagaattcaggaactagaacaacaaataagcacactagaagagaagcgtggtgcttcagaagggcaagccaataaataccttgatgatgtatctaatctgacatcagaacttgaggcaattcaagcacgagcctcaaccctcgaaactactctgcaagcggctaatgaaagaggaaaggaattagaagattctttgaatgcagtgacagaagaaaagaaaaatttagaagatgcttctatcagtttgaatgagaagcttgctgagaaagaaaacctattggaaattttgagggatgatttaaatcttacacaagataaattgcaaagcactgaaagtgatctcagggaagctgaattgagagagagtgaaataattgagaaacttaaagcttcagaagaaaaccttgtcgtaagaggaagagatatagaggagacagctgcaagacactcagaacttcaattgttgcacgagtctctgacgagagattcagaacagaaattccaagaagctatagaaaaattcaacaacaaggactctgaggttcagtccctgcttgagaaaattaagattttggaggaacagatagcaaaggctggggaacaatctacatctgtgaagaatgaatttgaagagagtttgagcaaactggcttctttggaaagtgaaaatgaagatttgaaacggaaaattttagaagccgagagcaaaagttcccagtcttttagtgaaaatgaattactggttggaacaaacattcaactgaaaaccaagattgatgaacttgaggaatcattgaaccatgctctatccgagaaggaagccgctgctcaagaacttgtgtctcataagaacagtataactgaactgaatgatttacaatcaaaatcctctgaaattcaatgtgcaaatgaagctctcattctaaaagtagaatcacaattacaagaagcattgcagaggcatactgagaaggaatccgaaaccaaagaattgaatgagaagctgaatacactagaaggccaaataaagcttttcgaagaacatgcacgtgaagcagttgcaacttctggaactcataaagctgaactggagcagagtctcataaaattaaagcatcttgaaattgtcattgaggaacttcaaaacaagtcactccaccatgaaaaagaaactgcagggctaaatgaagaaaattcaaagcttaatcaggaaatagctagctatgaatccaaattaagtgatttacaggagaagctctctgcagcacttgttgagaaggaggaaacagataaagagctactcaccttgaaggatgccatggaaaaattagggacaaagcatagtgcagaagtacagacattaaattcacagatatcttcactggtggatgagaagaacttgctcaatgatactaatcaggatttaaagaaggaacttcagtctctgatatttgaccttgaagagaagttgaaggaacaacagaaaattgaaggctccctgagatccgaggtcgaaactctcaaaattgagattgctgagaaatctgcattgcgaagtcagctgcaggaaattgaagggaaactgacaaaagctgaatctagactaaacgaagaggttggaagtgttcaagctgctgcttctcaaagagaggcagaattaagttcaaagttggaagactatgcacaaaaattcaatgatagaaatgtgttgaatgataaggttgcagcacttgagaaagagttgcaacttgcacgggatggtaatgtgaaccaggaaggagcagagtctcagaagttggaacttgaggcagccttgaaaaattctcttgaagaacttgaaactaagaaaaatgatatctctcttttacagaaacaagtgacagatctagagcagaaattgcgagttgctggtgataaatcctcagttaagggtgatgagagtgttgatcagaaagaagggttggaagtaaaatccagggacattggttcaagcctctcgattccatcaaaaagaaagagcaagaaaaagtcagaagtaacaagtggtcagacatcatcttcatccgagactcatgttcaaactggccatgattctcctgtcataaatttcaagttcatcttgggtgtagctcttgtgtccattgtctttggcataattcttggaaagcgttactag

SEQ ID NO: 11505 - DNA, 1338 bp, Glycine max
  Peptide Sequence Number=SeqID_128283
atgcttcaaagcttggtcccgcgatcccctcgcacttcaaaccctaacgctatgaaaactaagcgccccgttgacgccagtgacctttcccccgccgacgagccttccttcaagcgaaccaacttctccgccgacagaactgcagcggaagcggtggaggagcaagccttcgatcccgaacctcacggcggcgagtccaccggtctcaaactccttggtcttctcctccaatgcgcggagtgcatcgccatggacaacctcgacttcgccaacgacctcctcccggagatcgctgagctctcgtcgccgtacgggacctcgccggagcgcgtcggcgcgtacttcgcacaggcgctgcaggcgcgcgtgttgagctcctgcatcggctcctactcgccgctgaccgcgaaatcggtagccctaactcagtcgcagcgaatcttcaacgcgttccaatcctacaactcggtgtcgccgctggtgaagttctcgcacttcaccgcgaaccaggcgatcttccagtccctggacggcgaggatagcgtccacatcatcgacctcgacatcatgcaaggcctccaatggccaggattattccacatcctcgcctctcgctccaaaaagatccgctccgtgagaatcaccggattcggatcctcctcggagctcctcgactccaccggtcggcgactcgccgatttcgcgagctcgctcggccttcccttcgagttcttcccggtggaaggcaaaatcggaagcgtcacggaactgagtcaactcggtgttagacctaacgaggcaatcgtggtgcactggatgcaccactgcttatacgacataaccgggagcgacttagggacgttgagattgctgactcagcttcggccgaaactgataacgaccgtagagcaggatctgagccacgcagggagcttcctggcgcggttcgtggaggcattgcattattacagcgcgttgttcgacgcgctgggggatgggttgggtgaggacagcctggagaggcacacggtggagcagcatctgttgggctgcgagatcaggaacatcgtggcagtgggagggcccaagaggaccggcgaggttaaggtggagaggtggggggaagagttgaaacgggccgggtttgggccagtttggctacggggcaacccggccgcacaagcgaatttgttgctgggaatgttcccttggagaggttatactcttctccaagagaatgcctccctcaagcttgcttggaaggatttctctctcttgatcgcctccgcttggcaaccccaatataaaaatatttgtttcattcattcctcccattag

SEQ ID NO: 11506 - DNA, 204 bp, Glycine max
  Peptide Sequence Number=SeqID_128284
atggaagagaatagtcaatctggttatatttcctacttcgctggcaagactgtgtataagagagtcgttattcttccttcggaatttggaatccacgctgggatttcgttccaaccttcaacccatgctaagggttatagcttgaacttcaaatttgaactcacactagagaatcaaaattttgacaacattttcaaatattga

SEQ ID NO: 11507 - DNA, 819 bp, Glycine max
  Peptide Sequence Number=SeqID_128285
atgggaacaaggggctgtattaattataatcccatcctcgccataagacagcttggataccccatgagaggagcgccatcgaaggaaagcatcacgcctttcatcgcacggggtttcagtgaccccaacacaagggtacttcaaggagttcgcaaggcatgggatacggtgcgaaggaaggacaaagagcttaggggaagcagtaatgggatcatcggtggctatcataaggggatgagagttcggacacaaggattggattggctcccaaagctaaaggctgtgagagacgaagaggctgaagctctagaagaaagtgaggaggtacaagccctaaaggcggagcttgaaagagcccgggtagtcaaagagaagttcaagtcaatagccatcaaagtccaaagagagtacgatgaactaagggatgtcaatatggccaccgccaaagccttggaacgagaaaccaagagggcccgaaaggaagaacacgaccgaaacaagttccaaggggctttattcgatagcaacagtgagctcaagctccgaagagatgaaagggatcagtcgcaggtcaaaggcatgatcttgaaggacgagttaaaggattgccttaggtcgaaaagaaatttgtcccaacagttaagcgagactgaagggaatatgtgggccatcatcgatgaatacaaagagaagctaaacctagcagtgactcacgagcaaaggctagaggatgagtacgccaagcaatcagcggaaagggaagcaatggaaaggcccccaaagaaattcatgggctcctcagctattgccagcacatga

SEQ ID NO: 11508 - DNA, 534 bp, Glycine max
  Peptide Sequence Number=SeqID_128286
atgggtgatgtagaggaagtgcaagagcagatgaaagccaacatgtcgactctaaaagatcaaatggcttccatgatggaagccatgctaggaatgaaaagattgatagagagtaatgcaaccacagttgtcgccgccagcaacaccgccgaagtagacccggtcctttcgtctacagcaaatccagtgcatcaactcgccccagatataatgggacgaggaagagacacattggggaataccaacagcccacatttagggtacaaccgaagtgcttacccctatggtctaccccccaactttacgccacctgccatgcatgagaacatggatcacactgctccccctactttcgaagggcaacctccccagcctacagggggtgcccgcgaagacccttgggagcgtgcccaaggggatgacgactcttacccccttttcaccaccgagggaccgacacccaatgccttgccacagcccaatatcatgggatctctcaacctcgctcgatgcaaccactactcctctccgtag

SEQ ID NO: 11509 - DNA, 399 bp, Glycine max
  Peptide Sequence Number=SeqID_128287
atggcttggaagtggcagaaagaggtgacaaattaccaaatgaagagaatcctatggccaaagactcaagaaaatgtagcaaaagcagagaagaagggtcactttgttgtgtatagctcagataagaggcgctttgtgcttcctttgctgtatttgaacaacaaaatcttcagggagcttttcaaattggcagaagaggagtttggtctctctagcaacgtgcccctaacgttgccatgtgaagccacgttaatagagtacgtaataacgttgatccagagaaacgtaactaaggatctggaggaagctgtgttaatgttcgtagctactagtcgatgccaatcgcatgttgatcttcatcgtgaacgaaccaatcaacatttgctttgcagctattaa

SEQ ID NO: 11510 - DNA, 381 bp, Glycine max
  Peptide Sequence Number=SeqID_128288
atgaccctacaagctcaattccctgttatgtggtttgtgtatgatgccacgtggcacatgcaccatatcagcacaacacccccaaacaagggacacttgcttgtttatataccccttaaatatcttagcacaaacgtgttcagggagctactaaattggtacgaagaggagtttgggttaccttccaatggacctattacgttgccttgtgatagcgtgttattggactacgtaatcttgttatttcgagaacacgttcctgaacaagttgagaaggctttgatcacttcaatggttgcatgtcatcacgaggcttcatcatcatcatcttcgcttgctcttaggcagagcaacgagccaatgattatctatggcttttga

SEQ ID NO: 11511 - DNA, 363 bp, Glycine max
  Peptide Sequence Number=SeqID_128289
atgactaatgcacagccagcttgtgtgggtgttgaggctgtaggtttggtgggatgttgggatccaattacaagcttccctctaattcttctatgcctttttttattcaaaacaaaacaaaatctgcatatggaagtgcactcatgcacacatggactctgtaaccttataagcaaagctaaggaaatacttaatgaacttgaaggtctattgggggatgtaacaaatgctattcagactacagatggaaatctattagccctctctgatctagattttgatgttgaattgaatgagcaggttgaagcaatcatctctggcattcagcctggtctaactatggttgtggggccacctgactga

SEQ ID NO: 11512 - DNA, 402 bp, Glycine max
  Peptide Sequence Number=SeqID_128290
atgacgaaagtttacggcacggggttatacgatttctggcgccaccgcgtcgctgagtatccggtggcggcggcaccagcagagtcgaaagaggtagttccaaagaccggcggcggtggcggcgttccgagtagcatcactctgtcggagattcagcgcgaccagctgacgaagattgcggaggcgaactggttgaaaagcagcgatgcggggaggcctaagaaggacttcgaccctgagcttgttcgcaagatctacgaaaccgaattgttggtgaaagagggttcggaacctgttgaatatccccctccaccaccaccctccgccgtcaaatacgacacatcgatcactagttgtgccgctcgtgttttcctgctcctcactccgtcggagacttgcacg

SEQ ID NO: 11513 - DNA, 186 bp, Glycine max
  Peptide Sequence Number=SeqID_128291
atgccgagttcgtcgagaccacccggttgtgcacgtaactgcccccccccccatagcaagtgccaaaaccctggaaggtcagtgcacttcgccccccacgaatatacacaacatccaacgtatgaacgtggcccaaagcaagtgccaaagaccctggaaggtcagtgcacttcgccctcaacatag

SEQ ID NO: 11514 - DNA, 664 bp, Glycine max
  Peptide Sequence Number=SeqID_128292
atggcagaggtctccacagaggccattgcctccctcacccagtattatgaccagcctttgaggtgtttcacctttggggacttccagttaacactcacggtagaagagtttgaagagatcctgggatgctctctgggaggaaggaaaccgtatcttctcttagggttttatccctccttggctagaatttccaaaatagtcaaaatctcggcacaggaattggaccgggggaagcaagtcgaaaatggggcggttggagtaccaaggaaaggtttggaagcaaaggcgagaaccttggcaagtcaagacgaatgggctctgttcatggacgtcctgacgctcttgatcttcgaagtggtcctctttccaaacgtagatgggttggtggacttggcagcaattgatgtttttcttgcctttcacgaccgcaaggaaagcctggttgttgctatcttagctgatctatatgacacatttgaccaaagatgtgagaagaacagtgcaaggatcgtttgctgtacaccggtcctctatgtattggttggtttcacaccttttctgccaagaggtgagacacatttgtccactagaaggccaccgctcatgcaccgagaagaaggaggcaaactgggatcgactcttagcaagcaaagaaggaccgtct

SEQ ID NO: 11515 - DNA, 276 bp, Glycine max
  Peptide Sequence Number=SeqID_128293
atgttgcggaaccttacggattacgtaatcatcccatttttgccttccggaacgttacggaactttacggattgtgcactaacacttccttttaatttccgacatgtcacggagcttcacggattgtgctacaacacttttcttttggcttcctgcatgtctcggaacttcacatattgcctaacgatgggtgccaaatacctcgaagtggtcaaacgagggtcgcatcccaacaacggatggttcccggacgaaattagggattcaaaggcttag

SEQ ID NO: 11516 - DNA, 174 bp, Glycine max
  Peptide Sequence Number=SeqID_128294
caaaagaatgtttatacggataaccactcggatatttccgcccgtcagcgcgactcaaaagtcagtatgacagatcttgtgagcgcagaagatgacgcttttcgtcttacaaatagcaaaaaggtttatacggatgaccactcgggtatctccgcccgtcagcgtgactcaaaa

SEQ ID NO: 11517 - DNA, 335 bp, Glycine max
  Peptide Sequence Number=SeqID_128295
gatcccacggtttccagctctggttacgggcctctgtcagtcctacagggtgcccgttcccccagcgaggggtcacgcccgcaagacactcagtggacccgaagaagtccgacaggtcttggagttgccagctctgattacaaacctctgtcagttctatgaagtgcctgtcgcccccagcaagcctggggatggccggcagcgggcaacagacgcaccgccatcacctctagagttcacctcagctcatccacaaaaaggttatagtgttgcttacgacccatggccgaccaataggcgaccaagtccaaagtcaaagggaaggaaagtactag

SEQ ID NO: 11518 - DNA, 1510 bp, Glycine max
  Peptide Sequence Number=SeqID_128296
atggctaccatgtgggcagacaagaaaataacgaatgcagtatgggtggcagatcaatggcagagcgtcgattgggccgatattgctgatgccatacaaactgggcaagtttcggaattgaatgtggtgctcccttttgctgagcgcagcgtccacatacagtataaaaaacaatttcgctggcaattctggcgaaaagcatacacattggaaacgttgttacagcagttagaaacgacattgtccaccatcagtaattttgagaccctgttggcgcagggtttgccacccttgctggcacggctgctggcagcaagggcggtcagcgcggatgactgggtcttacaagagatgcctcatttgctcaagccagatgcacttaccggcgctacccagatggcgcaattgctggcagatgcgattgcacaacaaaagcgcatcctgatcattggcgattatgatgcggatggcgctaccgcaaccagcgttgccatgcgtggcttgcttatgatgggtgcccaggtggattttctagtccccaaccgatttgaatatggatacggcctgacgccagaaatcgtcgccttggcagcgacacagcagcccgatgtgattttaactgtggataacggtattgccagcattgatggcgtgatagctgcaaaagcactagggatgcaagtgctgattactgatcaccatttgcccgcagaacaaacacccgccgcggattgcatcgttaaccccaatcagcggggatgtgatttccccagcaaacatttagcaggggtaggcgtcatgttctatgtactgatcgccttgcgtgccgagcttaagcagcgtggcatgctggcagaagaccgggtgcatttgggcagtttgcttgatctggtcgctttgggtacggtggccgatctggtcaagctggatgccaataaccgcatcctggtcaggcaaggacttaaacgcatcaggcaaggacaagcttgtcctggcattctagctattctcaaactggcgggacgtgaccctgaacaagtcaatgcacaagacttggggttttacgtgggcccacgtctcaatgcggccggcaggctggacgacatgaccataggcatacgctgcctgcttgctgaaacgccgcaagaggccatgcaatatgcgcagcaattgcatgtgctcaatgcagagcgcaagcagattgaagccgaaatgcaatgggatgccatggcagacctcgcacaagatttcaaagacacgcaatatacgattagcgttttccagccagactggcatcagggtgtgatcgggatcctggcttctcgtatcaaggagcgttaccatcgcccggtcattgcattcgctgatgccggagaagcgctcatcaaaggctctggccgttccattgccggtttgcatctgcgcgatgcattggacctcgtcaccaagcaacagcctgatttgattgtcaaattcggagggcatgcgatggctgccgtcaagagtatcc

SEQ ID NO: 11519 - DNA, 1023 bp, Glycine max
  Peptide Sequence Number=SeqID_128297
atgctgaagaccctgcggctggggcatgaacgccaccggcccgccgggctgctgtcccacgggcaaaaacagtttctcgagatcggcatgctgctggtgcaggagccgcacctgctgctgctcgacgagccggcggccggcatgaccgacgccgaaaccgactacaccgccgaactgttccgcgagctggcgggcaagcattcgctgatggtggtggagcacgatatggggtttgtggaaaccatcgccgatcgcgtgacggtgctgcaccaggggcaggtgctggcggaaggatcgctggcgcaggtgcaggccgacgaacgggtgattgaggtagaagaattgaatcagtattacggcggcagccacattctgcgcggcctgtcgttcgaggcgcgcattggcgaggtgacctgcctgctggggcgcaacggcgtgggcaagaccacgctgctgaaatgcctgatgggattggttccggcgcgcagcggcagcgtgcgttggcagggcgaaatcatcaccggtaaaaagccgcatcagcgggtgcgggcgggcatcgcctatgtgccgcaggggcgggagattttcccgcgcctgacggtcgaggaaaatctgctgatggggctggcgcgcttttccggcgccgccgcgcgcacggtgccggatccgatctatgaactgtttccggtgctgcggcaaatgaaggatcggcgcggcggcgatctctccggcgggcagcagcagcagttggcgatcggccgggcgctggcctgccggccgcagctactgatcctcgacgagccgacggaagggatccagccttcggtgatcaaggagatcggcgcggtgatcaaacagctggcggcgaagggcgatatggcgatcctgctggtggagcagttctatgactttgccgccgacctggcggacagctatctggtgatgtcgcgcggcagcatcgtgcagcgcggcgccggcagcaatatggaacaggacggcgtacgtgggctggtggcgatttga

SEQ ID NO: 11520 - DNA, 702 bp, Glycine max
  Peptide Sequence Number=SeqID_128298
atggcggcctgctgtggcgtgcccaccgggcgggtggatatgctggccttcgggctgggatccggcatcgccgggctcggcggggtggcgctgtcgcagttgggcaacgtcgggccggagctgggacaaggttacatcatcgattcgttcctggtggtggtgctcggcggcgtcggccagctggcggggacggtggcggcggccttcggcctcggcatcgtcaacaagatcctcgagccgcagatcggcgccgtgttgggcaagatcctgatcctggtgctgatcgttctgtttattcaaaagcgtccgcaggggctgttcgccctcaagggcaggaaagcgccccggctggcgttgagcatcggcgcgctggcgttgctggcgctgctggtcatgccgttcatgacgctgttgccggcggatcatccgctggcggtgtctacctataccctgacgctggcgggcaagatcctgtgctacgcggtggtggcggtggcgctcgatctggtgtggggctatgccgggctgctgtcgctcggccacgggctgttcttcgcgctcggcggctacgccatgggccatgtacctgagtgcggcaggcggcgggcgacgggctgccggcgtttatggcgttcctctcctggaatgagctgccgtggttctggagcggcacccagcatttcgcctgggcgctgtgcctga

SEQ ID NO: 11521 - DNA, 171 bp, Glycine max
  Peptide Sequence Number=SeqID_128299
atgaggaatgccttgcgcttagatagcatgaaaaagcccttcgataatatgtatgaaatgccactgaggaagatctccgcaaagagatctaggagggacgccgcggccgaaggaaccagcgccgctcttgagtttgacagccatcgtttcaggagcgcagagcaccagtag

SEQ ID NO: 11522 - DNA, 309 bp, Glycine max
  Peptide Sequence Number=SeqID_128300
atgggtttatatgagacattttctatgctgatttcctgcacgtcctgcacgtcctgcaccggcctaccatttttgaaactcgccagtcaaacctgcggtttcaacaacagtgacgaactcgccaatgcaagtggcgagatgcccttccacgtgaagtcgccagcagtactggcagtttgcccagacacgtgctgtgttgcagccaaatcgctattggcaatggcggtttgcatgaaaaatgcatgcagctcacgtaaaaaagaacaccatgccggaattagttacaaaaggaccccatttggggaataa

SEQ ID NO: 11523 - DNA, 318 bp, Glycine max
  Peptide Sequence Number=SeqID_128301
atggcttttgtgtcttgcacgtcctgcaccctaggcttgccatttttgaaactcgccagtcaaacctgcagtttcagcagcagtgacaaactctccagtgcaagtggcgagatgcctttccacgtgaagtcgccagcagtgctagcggtttgcccagacacgtgtcgtgttgcagccaaatcgctattggcaatggcggtttgcttggaaactgcatgcaactcatgttattttgataataatttagtcccacctgcaaaacaccagccacccggggatagagaatttgcatatcaaaaaatgatgcttgtaaaataa

SEQ ID NO: 11524 - DNA, 513 bp, Glycine max
  Peptide Sequence Number=SeqID_128302
atgagggaaataattgtcattgttattatggttcatgaggaaccttttagtattgttgaggatgaggtttggatgtgggccccccatatgctaaaccagaatttcagaagtatggaaacttcaaaagagagttttgagttttgtgaaagtgcgtcctccaaggcgtggaatagatgtggctattgcaattttcaaatgtttaaaagcttgggggttgaaaataaggttttttctatatctgttgataatgcttcttataatgattcttgcttgaaaaatctaaaggataacttatcatcgagtatgcaagatggacttagtcagattaaggaaagcatttctaatgttcgtgaaagtgtgaagtatattaatcacgatgacgcaaggttgaatagaaggcaactcataatttcaggaagtgactatcttactgtgaatttgtatcttgaagaagtgtggagggtgaaaaaggtaattgatgatgcgactgaagataaagatttcttcatgtga

SEQ ID NO: 11525 - DNA, 234 bp, Glycine max
  Peptide Sequence Number=SeqID_128303
atggcttccccatctattcctgcaactgctaatgaggtcaacacggtgaatgcacatgacaaagatcaagtcaatgaagatgtcattaagaggagaataggcaaaaaacatcagcagtttggaatgattttgaggaaattggaacttcctgaaggtttaaagaaagctgatttcaagtattgtaaagagaaacttgctactatggtggtaaaggatcctgcactagccctttga

SEQ ID NO: 11526 - DNA, 636 bp, Glycine max
  Peptide Sequence Number=SeqID_128304
atgacacaccagcagatgctagcacagatcacatctcaggctgtgccagcccacttcaatgtgcaaattcactctgaacatccattctctatatcagcagtgtctgctacctctttgacacagtttcctacaggatccagtactagggtgaaagaatcccttcattattctcactctgaacaaaaattgcagtcttcttctgtgaatgctgataagcctaatgatgatggctacaattggaggaagtatgggcaaaaacatgtgaaaggtagagacttctcaagaagttattacaaatgcacacatccaaattgtcctgtcaagaaaaaacttgagcgttctcttgaaggtcatgtgactgcaattatctataaaggagagcacaatcatcaacgtcctcatcccaataagatcacgaaagaaacacagacttcgaatataaattcagtgtctaagatggatctagaatctagtcaggcaacaggtgaacatgggtcaggaacaagtgatagtgaggaagtaggtgatcatgaaagtgaagaagatgagaaaaatgatgaacctgatgccaagagaagttttatgattctgcagaaacacagaagtcaggctccaggatccagcctctttacatag

SEQ ID NO: 11527 - DNA, 369 bp, Glycine max
  Peptide Sequence Number=SeqID_128305
atggcgcaaatatgggcagaaagttgtcaaaggcaacccatatccaaggaaaagaaggtgatgcatgtttttatgatatgtaggagctattacaaatgtgcaacccaaggttgcaatgttcggaagcatgttgagagggcttcaatggatcctaaagctgtcctaacaacatacgaaggaaaacacaatcatgatgtgccggtagctaagactaatagccacacacttgccaacaatagtgcatcacagctaaaagcacaaaatattgccatacccgacgacaagcatagtttcagcagtaggggtgttcgggggaatgaacagcgacctttgggaagtctaagattgaaggaagagcagataacatag

SEQ ID NO: 11528 - DNA, 183 bp, Glycine max
  Peptide Sequence Number=SeqID_128306
atgggaaagcaaggttggaaccttttggccaacccagacagtatggtggcttggatcttcaaagcaaaatattatccaaatggagatttcatggaggctaaaatgggatgtaatctgatgaagaagaagaaggttgaagcagttggtgtctcgctaagcgaggcagatgtgcttagtgagtaa

SEQ ID NO: 11529 - DNA, 429 bp, Glycine max
  Peptide Sequence Number=SeqID_128307
atggttggagtgaagggttttgtgatttcagattccaagtgtgaaagaagtattgaacagattgcgagggagggaaaattacccgatactgaaatggacaaggaagttaagggtggcttggtcatgatgtggaagggatcgatcaaaggggaggttatgagtttagctaagaactttattaatctaaaagtcatggatgagttactgaggagtttggctagtaggatctccaatccttggtgcatcattggagacttcaacaacctgcttatgaagaaggacaagtgtgaagctatggagaattgtggtttgaaagatatcattgcagaaggatatcctttcacttggttcaatagtcgtggcattggaagaatagttggacagagctatggcaacttccaagtggttgagtttattccccgaggctag

SEQ ID NO: 11530 - DNA, 309 bp, Glycine max
  Peptide Sequence Number=SeqID_128308
atggcggacgaaaaactcaaaggacaaaaggttaaattttttggtgttcctgagccttctccgacgtacccaaaggctaaagcttttttgctgggacaaaaggttaaattttttggtgttcctgagccttctccgacgtaccgaaaggctgaagcttttttgctgggtttggcagttctttgcttgatttggcctaaaaatgatttatgggacaaaaggttaaattttttggtgttcttgagccttctccgacataaagttgtcaccgagagcaaattgtgttcggcatttgaaggacagtcttattga

SEQ ID NO: 11531 - DNA, 204 bp, Glycine max
  Peptide Sequence Number=SeqID_128309
atgttttgcgagaatgctccaaccatatgggatcaacataggcttaaaggagcactcaaacctggtgacaccaaggcctacactccaaagagtccgtcatggcctctccctcctgattcagcttacaacacaaataatgtcacatcaagagttaatcacacacttattcacaaccaaaactcattcacaattcacatctcataa

SEQ ID NO: 11532 - DNA, 969 bp, Glycine max
  Peptide Sequence Number=SeqID_128310
atgatgagcaattatattttgcaggaaaaaaccatgaggatgcctgatggttttccctttgtgagtaatgctttgggaagtgtcccaaacactcagttactccaatatgaaaatgcatcatgcgttgtagattcaggatataaatatgatgggttatgtgatagctacttcaaagcaggtgaacctgagagatttctttatcgtcctagagctggccttcagattctaaatacaactcaagagaagccatgccctggttcttggtctgcagtttcaccttcagttttcaacctccgcggagtaaattttttcaggcatgtcagcaaattagataagcaaaagtgtcctgctccagattttagcccttatataccaataggtgttgatttatttgcatgtccccggaagttgccaacatatgctgctagcatgttccctggtgatgctgatggggaaggcatgagccttgtattatattttaaattgtctgagaattttgccaaagatacctctcctcactttcaggagagcatcaagagattagtagatgatgagatggaaaaggtgaaagggtttgcacaagaaagcttggttccctttagtgaaaggctaaaaattttggcaggggtggttaatccagaggaccttcagctaaattccgcagaaagaaagcttatacatgcttacaatggcaagccagtgctttcacgccctcaacacaaattctttaagggacctaactattttgaaattgacttggatatacatcgctttagctatatatcaaggaaagcacttcattcactacgagaccgtacaaagaatgtagtacttaatctgggcttaactatccaggcacagaagcaagaggaactgccagagcaagtcttatgctgcttacagctgaataaaattgattttgctaacgatggtcaaattcctaccattgtggctcttgatgataattaa

SEQ ID NO: 11533 - DNA, 300 bp, Glycine max
  Peptide Sequence Number=SeqID_128311
atgatgaaacataaacttgacaaatgtctcttggaaattgggcaatctacggacagcaacaacagaacccatcatattttgggatttgaagaagatgattcatgcacagtgttggaccatacattcatttataagctgaagcacacaaagttgctcgaacatgttaaggcttccacccccaacccctccttttgcctttctcgcctgccatttattagggtagttagtagaaaggaattggttggcttcagatgctggaaaactcatgaaaccaaccccagaatgtgggaaagaccataa

SEQ ID NO: 11534 - DNA, 231 bp, Glycine max
  Peptide Sequence Number=SeqID_128312
atgagaaccaaaactggatgtttcaatggtactccagaacctaaagaagttgaggtttgggacttatatcatgcacttcaatggatagttgagttggggattcaaaacgtagaatatgagctagattgcaagatcgtggttgaagctctatcatctaaatctactggcacttatgattttcatgttattttatctttcatctttatcaaacttactagtgaattttgttag

SEQ ID NO: 11535 - DNA, 555 bp, Glycine max
  Peptide Sequence Number=SeqID_128313
atggacgctgtgagctctgctagggtttcaactgatgcaacttcttcccatgcaaaaccctcaacgaaagaatatgatccattacgtcgcagcaacagaaaggtcaaaaggaagtctaatggaggcgaagaagattgtgatatggatatagagaaggagaatgtaggggacccgattactacaaacaaaagttgttgtccaatgggactcttcaatgacaagataacatcacttcaggtcaaaggaagattcacaagaatttgcgtagatctcgagttagacaaaccgctacagcccaaagtcattgcacgaggatacctgatcaaccttcagtatgaaggaagggcttcgtgcgatctgtttcaaatgtgggaaatatggtcacaaggagtcgcagtgtggtgcagatccatcgccaagcgtagagaagcagaattcaggggtcaccggagacacagaaacagcgcggcaacaacccgcggtggattccaatattggggggatctccgttgtagcacaataagccccacagaatcagcaaacgacggaatctaa

SEQ ID NO: 11536 - DNA, 408 bp, Glycine max
  Peptide Sequence Number=SeqID_128314
atggaaaacattagtcaaggcagaacttctgtggataactacatcatcttgcaagagttggtgcactcatttacaaacctgaaaggggcaaaagtgcatcttctactggcattaactagaatggagcccagatggagaacttttgccctcaaggggactgcggcaaggatatggagaacttttacgttttggacggattgctggatcccgggcttcaagcctctgagctcgatgacgcaaattcaaattcctcagcatgaactcgggttgctggtctcagcctatgcaacaccggaggggtggaactggaatctactgggacagcttcggccccctcatgtctgctatgttattgctgcggtcaacccaccaaacccagagaagcaaatggttgtgctgactttttag

SEQ ID NO: 11537 - DNA, 378 bp, Glycine max
  Peptide Sequence Number=SeqID_128315
atgtggacaattaagcttgatgaaaggatcaaaatgacaaaggacaaattacagatgtggaatatgaaaaagtcaaggagaacagtgaacgaccaggagctggacgatcgtaacaccactgtccccaaagtgcagacccgtgccggtcgtggtggtggggagatggtggcgggtgtggcggaggacgtcgacgctgatgatggacagagcaagagattgaggggcgacgacgtgaatgacgacgagaacaacaggtgcaagaaggagcctgatagagacagagcgagagaccgtgattgcgaacattcctctggactaggtggcatgattatgcgtgacttcattacggagcttccatgggaagctgccatggagtga

SEQ ID NO: 11538 - DNA, 1647 bp, Glycine max
  Peptide Sequence Number=SeqID_128316
atggggtgcttcactgtattgaagagcaaaaagaaaaagtccgatccaattacatacataaaacatgtaagccataatgagaacgtacctacagtactgcctgaacctcaaactcgtactcgctcactgcagtctgctcctcctagttttaggaccagagtgaaacccattcaacccattaataaagccagtaacaacagaacgcgaacattatctgctccatcaactcttgatgcagcagaacaagatgctttggcttcaattgagtatgaggaacaagaagagtcaagacaccgagctggatcaatgaaggagcagcgttcatctagtccccaacctttaccacttccatcccctcagggaggtagtgcattgaaggctattggcagctttaagtcagtggcctcaagcagtcctctccatgcttctggacctttgccactcccacctactggatcacttcggaattttctgtatgaggaaattgctgctgcttgccaccatttctcttctgatagatgcatgtcagaatgtctttcgtccaccatatacaaggcttcctttggtgacgacgtttcaagttcgaagaagtttgaagccactgtcacacggcttcacccatcatctcagggcttgaaggaattcataaatgaagttaatactcttgcatctttgcaacatccaaacctctgtaaattgctaggatttcatgcacgagagggttcagaacatagaatgttggtttatgaaaggctataccatggaagcttggatcgcttattgtatgggagatctgatgggccatcaattgattggaatacaagaatgaaaattgctatatgtgctgcacaaggtctaaccttcttgcacgaagaggggccttttcaggctatgtataatgagttctcaacagccaacatacagattgacaaagatttcagcgcaaagctttcaggatatggttgtgttggacatattcccgaagaagagatttcaagcagctcatctgctgttggaaacctatcaatggaaacactggagaaaggaatgctcactccaaagagcaacgtatggagttttggaatttttcttctggagctacttactggaagaaagaatcttgatagccgtcaccccaaggaagagaggaatttagtcaagtggagccggcctttcttagccgataactaccgtctgtcgttgatcatggatcctcaactcaaaggccgctttccttctaaagcagcaagaacaatagctgatattgcacaaagatgccttcaaaaggagccatcagacagacctaccatgaggactgttgttgagcatctcaagataatacaggatttgaaatattcgtgccggttccctctgcaagaaccagcatcaaactctggaaaacatatgtcaagatcaccaagtctcaatggcatcatctgccctgcaccaaggttgagtttctcaccatcaccaccatcaggagttccggtatctgtttcgcctccaagatggtctggtggagggcccattctcctcccgccgccacgtgcttgtgcttcgagcctctctttggaggagcttgataggcaggaaagccgcaagtcatcatcctcagcctctagaagggctagtgttgaaggattttga

SEQ ID NO: 11539 - DNA, 699 bp, Glycine max
  Peptide Sequence Number=SeqID_128317
atggtggcgggaactgcaaccttgaagcttagcctctccgctttttcttctccaatgtcaaatttcagcgcttcctcttcattcccctctcgtctcccaatgcgaaccccttcttcttctaaacctcgatttctcagtgagtctcttcgctccttaatttccacgctttctctaacaacccttcgcttttcgctaacttgcgcttttctttcagggatttacgccttgaccagcaacgacatcaaggtcggcaccaacctcgaagtcgatggtgctccttggcgtgtgttagagtttcttcacgttaagccgggaaaaggcgcggcgtttgtcaggaccaagatgaagaattatattacggggaacacggtggagaaaacatttagagcgggaagctcgattgagcaagcagatgtattcaaggaaacaaagcagtttacatataaagatggtgctcaatttgtcttcatggacttgaatacatatgaggagtttcgtctgggtgaaaaggaaattggagacagaacaaagtggctaaaagaaggaatggactgcaatttgctgttgtggaatggaaaagttattgatgttgaactccctatcacaatcaagcttgctgtagttgatgtggatccaggacttaagggtgacacagcccaaggtggtacattttgtttatactgcaaacttctattttga

SEQ ID NO: 11540 - DNA, 336 bp, Glycine max
  Peptide Sequence Number=SeqID_128318
atggccgcgagcgatcgcacagtgttgcaattctcttcatcatcttcttcttcgcagagcttgtccgcgaaggtccaccctctggtcatcttcaacatctgtgattgctacgttcgacgccctgaccaagccgatcgtgtcatcggaaccctactcggctccgtccttcccgatggaaccgtcgatatccgcaattcctatgctgttcctcacaacgaatctatcgaacaggatttggcttcatatttagcacgtgtggatgtcactaactttatattggaaattttggtgaattcttcgtttagattgttagaaggaggagatggaatggaatga

SEQ ID NO: 11541 - DNA, 681 bp, Glycine max
  Peptide Sequence Number=SeqID_128319
atgaattatgatttcgttgagttgttggagaatcaaaaaacaaaaacagaatcattattccattgcgttcggtgcacaagggagaactttgtgagacaagagaaagagaaagggaagaagggaagaaagaaaggattgtgggaaagggttggtgccaataaggatattatggtctctgcaatgtactgctcgatcacaatgagaacacacgcgttactggcacttttgttcttgtttctgattatgtttgatgtttctgacgcttcctttgttctgaaactccgaaagttgattggtcctgatccaaatgatactaaaacaaaggatccaaaccatgttggtgaaacaaacaaggacaatgggagtggtcctatttcttccccagttccacagccacaaccacaacctttgcccaaagtgatgaagaatacaaatgatgatataaaaaaggacaatgattcagctcctccagtgagtatacctcctccaccgaaaaatgatgatggtggtgacacgggtatgcataaagggaaggacaaaactgagggcatgaagttttcacatcatagcaccactgagacttgtgacgggttcaagaagtgcaccgacgatgatgggggcatggttgcttgcatttcgaaaattggtactcactgttcattgcttttgattattcattaa

SEQ ID NO: 11542 - DNA, 540 bp, Glycine max
  Peptide Sequence Number=SeqID_128320
atggaagagggcatgtcagagttttttagtagcggtgtaagtgttggtggtaacagtggcagtgctactactggcaccaagtgtgggcgttggaatcccactactgaacaggttaaggttctgactgaacttttcagttctggactacgcacccccagcactgatcagattcaaaagatctctaatcagcttagtttttatggtaagattgagagcaagaacgtgttctattggtttcagaaccataaggctagggagagacaaaagcgtcgcaaggttgataaggatgtgattcgtagtgaaaactctatctccatcaattcttttacacaaaattttaatcagctatatcaggtttctgagcccgagagggtgattgagactcttcagctcttccccttgaattcatttggtgaatcagaatcaaagaatatgagggtccatgcaagtgatcaatgcagggatagcactatgttttcatacacagtgggggaacaaatggatcacccaccattagatcttcgcttgagttttatgtga

SEQ ID NO: 11543 - DNA, 552 bp, Glycine max
  Peptide Sequence Number=SeqID_128321
atggaagaacatggtgatctttcatgtaaaaatcacttatctcctgttgtttttgtacatgctgtctcaaaatcatctgttcaagcttgtggtcctgttactcatgtcaacatcacacgaagtagcagtgaaagtacccaactgactttaaatgctggaaaaggggattgtgtgcttcacatggtttcaaatatacctgaagagaatttcattctgcgtcttccttcttatgacaaaattttaacaccagtaaatggtgcctatttcctcatattgatggtactagtctttggagggacatgggcttgctgtgcatgcaggaagaaacatcgcaatgaggttccatatcaagagcttgaaatggcactgcccgagtctgcttcagctaccaatgtggaatccgccgaaggttgggatcaggactgggacgatgattgggacgtcaatgtggcagtgaagtcaccggcagcacttgcaggaagcatctctgcgaatggccttacttctagatcttcaaacaaagatggatgggagaataactgggatgattag

SEQ ID NO: 11544 - DNA, 2904 bp, Glycine max
  Peptide Sequence Number=SeqID_128322
atgcaattcagcatgtgtgtgttgtttctgatcctccttgcaccggttatgttggtgttttctgtggaccctggtttcaatgatgatgtgttggggttgattgtgttcaaggctggtttggatgaccccaaaaggaaactctcttcttggaatgaggatgataacagcccttgcaactgggaaggtgtgaagtgtgatccttcatctaatagggtcactggtcttgttcttgatggtttctctctttctgggcatgttgataggggcttgttgaggttgcaatcccttcaaattctctcactttcaaggaacaacttcactgggcctataaaccctgatcttcacctccttgggagtttacaggttgtggacttgagtgacaacaacctctctggggagatcgcagaagggtttttccaacaatgtggttctctaagaacagtttcatttgccaagaacaatctcactggtaagattcccgagtccttgagctcatgctccaatttggcaagtgttaacttctcctctaatcagctccatggggaattgcctaatggggtgtggtttttaagggggctgcagtcacttgatctgtcagataacttgcttgagggagagattcctgaagggattcagaatttgtatgatatcagggagttgagtcttcagaggaaccggttcagtggaaggcttcctggggacattggagggtgcattcttctgaaatcacttgacttgagtggtaattttctctccggggagctgcctcagtcattgcaaagactcacttcatgcacatcacttagtctgcagggaaattcattcactggaggcattcctgaatggattggagaattgaagaatctagaggtgttggatctttctgccaatggattctctggttggattccaaagtcattagggaatcttgactctttgcatagattgaatttgtccaggaatcagttgacaggaaacttgcctgattccatgatgaactgcactaggcttttggctcttgacatcagtcacaatcacttggcaggctatgttccttcatggatttttaggatgggtgtgcaaagtatctctctttctgggaatggcttcagcaagggcaattatccttcactcaagcccacacctgcatcttatcatggtcttgaggttttggatttgtcatccaatgcattttctggcgtgcttccatctggcattaggggacttagtagcctccaagtctttaatatttccaccaacaatatctctggttctattcctgtgggtataggagaccttaagtctttgtacattgttgacctaagtgacaacaagcttaatggaagcattccttctgaaatagaaggggcaacttcactcagtgagctaaggctgcaaaagaacttcttgggtgggagaattccagcccaaattgacaagtgctcatctctaacatttttgatactttctcacaacaagcttactggttcaatcccagcagccattgcaaacctcaccaatcttcagtatgtagatttgtcatggaatgaactctctggaagtttaccaaaggagttaacaaatctttcccatcttttctcatttaatgtatcctacaaccaccttgaaggtgaactacctgtcggaggcttcttcaacaccatctcctcctcatctgtctccggtaacccgttgttgtgtggttctgtcgtcaaccactcctgtccatctgttcatcccaaacctattgtcctaaaccccaattcttctggttccaactccagcatttcctcgcagaaccatcggcataagatcatactaagtatctccgctcttattgctattggagcagctgcttttattgccattggtgttgtggctgttactgtcctaaatatccacgttcgttcctcaatggaacattcagctgctccttttgcattttctggtggtgaggactatagctgctcaccggcaaatgatccaaactatggcaagcttgtcatgttttctggtgatgcagactttgctgatggagctcataatcttctcaataaagaaagtgaaataggccgtggtggatttggagttgtttatcgaactttccttcgtgatgggcatgcggttgcaatcaagaagctcacagtctccagtttgatcaagtcccaagaagactttgatagagaaattaaaaaacttgggaatgtcaagcacccgaatctcgtggcacttgaaggttattattggacttcatccttgcagctccttatttatgagtacctatccagtgggagtttgcataaagttctacatgatgatagcagcaaaaatgtcttctcttggccacaaaggttcaagatcattcttggcatggcaaaagggttggcccatttgcaccaaatgaacataatccactacaatcttaaatcaaccaacgtgctgattgattgttctggtgagccaaaggtcggagactttggcttggtgaaactcttgccaatgctagaccattgtgttttgagcagcaaagttcaaagtgcactcggatacatggcgcccgagtttgcttgccgtacagtcaagataactgagaaatgtgacgtatatggtttcgggatcctggtgctggagatcgtgacaggaaaaaggcctgtggagtacatggaggatgatgtggtggttctttgtgacatggtgaggggtgcattggaagaaggcaaggtggagcaatgtgttgatggaaggctccttggtaactttgcagcagaggaagcaattcctgtgataaaattggggttgatttgtgcatcacaagtgccatcaaaccgtccagaaatggctgaggtagtcaacatattagagttaatccaatgcccttcagaaggacaagaggaattagaatga

SEQ ID NO: 11545 - DNA, 249 bp, Glycine max
  Peptide Sequence Number=SeqID_128323
atggttacaggaacaaggcaagtctctacagaggaaggggaagcaaagtcccgagagctaaacgttatgtttattgaggctagtgcaaaagccggctttaatataaaggccctctttcgaaaaattgctgctgcattacccggaatggaaacactatctacaacaaaacaggaagatatggtcgacgtgaacctgaggtcttctggtagccatgattcccaacctcagtcagggggatgttcttgctga

SEQ ID NO: 11546 - DNA, 114 bp, Glycine max
  Peptide Sequence Number=SeqID_128324
atggaggaagaattgtgggaggtctgtggaactgatccaaagtattacttgattgtcacaccggctccagtatcacgcacacgaccaggatgttctggtcgcctgatcgaggcc

SEQ ID NO: 11547 - DNA, 465 bp, Glycine max
  Peptide Sequence Number=SeqID_128325
atgcaatcacacgaacttgcactgcctctggagcctaaggttggtccctcagctgcttgtgtcagcacaaaaggaagttgtgttgatccctcaccaaccgatccagagacgggtgactcagacaaatgcgggttgtacatcgaagaaaatctatcccacctggttgcccaaggaagagtttatgagggatccacaatagttcacaacatccctttgttgcatggccaagtgatggttggtgttgaggaggttaaagatgcagaggctcctgttcttgtacccactgacgaggttattttagtggggcaagtacttaacaccttccttgcttggccgacacatctcgtgaagcgtttatcacaacagttgtgtctccagcaaaacctacagatgggccggatgctcaggttaagtgggatgctaccatgttcggggtgtttaatgaacacttctcattgtacataa

SEQ ID NO: 11548 - DNA, 99 bp, Glycine max
  Peptide Sequence Number=SeqID_128326
atggatctattgattacaacgaccttagagctttcaggtgctgacgcacataattctagcggctggagtagtgtcaatggaggttctatacttggctga

SEQ ID NO: 11549 - DNA, 309 bp, Glycine max
  Peptide Sequence Number=SeqID_128327
atggatgtggaacctagaagaattcaaagttctgttggttgtctaggatccttctttgaaggtttatgcaagcttgctcattacaacaagtttgaagagtgtggcagattaagaaatagagatttgcttagttctgccaatgtaatgtgtgttttaagttttgaccgtgatgaggatcacattgcagcaggaggagtttcaaagaaaatcaagatttttgacctcaatgctatttcaagcgattctgttgacatccagtacccattagttgagatgccaaataaatcaaagcttagttgtgtcaaataa

SEQ ID NO: 11550 - DNA, 282 bp, Glycine max
  Peptide Sequence Number=SeqID_128328
atggagaacaatgatggtttgtggtggctaatggtggttgtgggtgatggagaaagtgtttgggacaaatgctctcgggaacggaagcttcgagcacactccagacatcttctcaaagatcccaacagtcagatcatgggcaagtgtcttgtgaagctgcagaccaaatttcgagaagatccaacggttaacaaaggctgggaagaatttttaccgaggcagcttcatgtagcttcctcaagaagtttcattaagaggctttctcaagaagcttccccatga

SEQ ID NO: 11551 - DNA, 374 bp, Glycine max
  Peptide Sequence Number=SeqID_128329
atgatctcctccaccctggcattgatctggtgctggaggcgcttctcctccaccaaccatgcgttctggtgcgaggcaaagaatgaagggggggtagtggaagcgcatgaagaagaaggcagcaacaacaatgaacaaggtggaagcaacccagctcgcttgggcagcaaccacctccctcctttccttataaaatggcgtgaagagggggattttcaggggagcaagcgactctgcgcgttttcctcccttgtaagatgcacccgtgagcctcacgccgcccttctgtcgaagggccctgtggaaggagaagtgagtgtgaacattggtattgcacaagagaagactaagcgtcagaaaggggataaagctag

SEQ ID NO: 11552 - DNA, 387 bp, Glycine max
  Peptide Sequence Number=SeqID_128330
atggaggtcaagaaggaaggcccaaccaagatctctactctcattaccaaacaactaggaatcaattgttctattttaatgggggccaacatagcaaatgaggtcgaagatgttgaaggggtcgaattttgtggaactctaaaaaatgtagtggccatagctgcaggttttgctgatggcttggagatgggaaataatacaaaatgggtgggagaaataggaaagttgtcgatgcttatgatagaaattgaggaaagagggcatgctagtttttactcactagtccttttgaaaatctcaacattttgcttttctgagtactttagcttaccagcagtggagggcatgctagtttcaagaatttatcccaccaatatgcttggctaa

SEQ ID NO: 11553 - DNA, 456 bp, Glycine max
  Peptide Sequence Number=SeqID_128331
atggcgatgagtagtgatgatggtgacaacggtggtaatagtgatggttgcagtgacgacaataataatgatggtggttgcggcaataataatggcggtgatggctatgacgaagatggtggtggttgttatggtggtaagggtggagttgtggcgacgacagtggtgatggtggttgcggtggtgacaatggtgaagtgtgacgacagtggtggtggttgttatggcaacgatggtggtagtgattgttatggtgacgatggtggtggtggtgatgatggtggttgtggtggtggtggcggcgacaacaatagtgaaagtggtggtgacaaggttagtggtggtgacaatggtgatgactacaatgataatggtagtggcatgggtggtgaggggaagggagtgagagagaaggattatcctaacttgttgctttttaacccaactccctattag

SEQ ID NO: 11554 - DNA, 357 bp, Glycine max
  Peptide Sequence Number=SeqID_128332
atggatcatggaagccaaggtttcttataccaacccttccttttatatggagttgagcctaatgatactggtatggggaataataatgatgaaaatgtgggtgtggtttttaaaaagtggcaaaatatcatggatgcttgggaactattgttgcaatctctggatgaagaatcatataatgaacgcttgaaaagctttacaaaccggtgtgtacattataaagtatttgttgactatgtccaaaatgcatggttgacaccttttaaggagaagtttgtacaagcatggattcatcgggtgatgcatcttggaaacacagcaacaaatagggttgaaggtggacatgcaagattgtag

SEQ ID NO: 11555 - DNA, 399 bp, Glycine max
  Peptide Sequence Number=SeqID_128333
gacaaggacttgagtcataggacactattgcagtatccaaaactgtatggttcaggtcataggcaagaagcttataatatgcaattattttggatcacaatgatggacacagtatggcagagccttgttcttttctacatcccattgttcacctataaggacagttcaattgatatatggagcatgggcagtttgtggacaattgcagttgttatccttgtaaatgtacaccttgctatggacatcaaccgttgggactatttatcatctggcaaggtcccctacatattggataacaattttgcttataattattgtggcattgctcccacgctttacttgcaaagttgtttatcaaattttttggccttcggatattcagatagccagagaagctaa

SEQ ID NO: 11556 - DNA, 2934 bp, Glycine max
  Peptide Sequence Number=SeqID_128334
atggaactgggtgatgccgatagccggagtgtgccatttgagatatctggagcttcatcccaggtgcaggacagcaggttgaatagtaaatcacagagaattcggcacaaaagtgtgcaatttgatgatgctgccttacatgaggacagtgccaggttgatccatatcaatgatccgaggaggacgaatggtaagtatgagttcactggaaatgagatccggactagcagatacacctttgttacctttttgcccaagaatctgttcattcagtttcatcgggtggcttatctgtatttccttgctattgctgcgctcaatcagcttcctccactggctgtgtttgggaggacagtgtctcttttcccgcttttgtttgtgctttgtgtcacagctattaaggatggctatgaggattggcggaggcacaggtcagatcgcaatgagaacaaccgggagtctctggtgcttcagtctggtgatttccgatcaaagaaatggaaaaaaatacaagctggtgaggttgttaagatctttgcggatgagaccattccggctgacatggtcttgttggggacgagtgatcaaagtgggcttgcctatattcagacaatgaatttggatggagaatcaaatttgaagacaaggtatgctaggcaggaaacagctatggtagttgcatccgaagcttgtgatgtttttggtgtaattagatgtgagcaacccaaccggaatatttatgagttcacggccaacatggagttcaatggactaaagttttcccttagccagtcaaacattgttctgcgtggctgccaactgaagaacacagattggataattggtgttgtagtttatgcaggacaagaaacaaaagcaatgttgaacagtgcagcttctccttccaagagaagcagactagaaacttacatgaaccgagaaaccctttggttgtcaatttttctttttatcatgtgtttggttgtggctgttgggatgggtctttggctggtacggcacaagaaccagcttgataccttgccttactacagaaaaagatacttcaccaatggatcagataatggaaagaaatataagtattatgggataccaatggaagcatttttctcctttttgagttctgttatagtgtttcagataatgataccaatatctctttacatcacaatggagttagttcgattgggtcagtcatatttcatgattgaagacagggatatgtatgatgccagctctgggtcaaggtttcagtgtagatcattaaatataaatgaggatttgggtcaaatacgctatgtattttcagacaagacaggaacactaacagaaaacaaaatggaattccagagggctagtgtgcatgggaagaattacgggagctccttgcctatggttgataatacagcagcggaagatgttattcctaaacggaaatggaagctcaaatctgaaattgcagttgattctgaactgatgacattgttgcagaaagactcaaatagagaagaaaaaattgctgcaaatgagttttttcttacattggctgcttgtaacactgtaatccctatacttagtgatgatggattttccagtcttggaactaatgaattaaatgaagatactagacgcattgattaccagggagaatctcctgatgaacaagctctagtttctgcagcctctgcatatggatatactctttttgaacgcacatctggacatattgttattgacgtcaacggtgagaaactcagattggacgtattgggtctgcatgagtttgatagtgtgcgaaaaagaatgtctgttgttattcggtttcctgacaacgcggtaaaggtgttagtcaaaggtgctgatacttcaatgtttagcattttggaaaatggcagtgagagtaacatatggcatgcaactgaaagccatttgaatgaatattcttcacaaggtttgcgcactcttgtagttgcctccagggatctttctgatgctgaacttgaggagtggcaaagcaagtatgaagaggcaagcacttcattgactgacagagctactaaactacggcaaacagcagctcttatagaaagcaatttaaagttacttggagcaactggaattgaggacaagctacaagagggtgtaccagaagcaattgaggctctacggcaagctggaatcaaggtctgggttcttactggtgataagcaagagacggcaatttcaattggtctttcttgcaaacttcttagtggagacatgcagcagattactataaatggcacttcagaggtcgaatgtagaaatcttttggccgatgctaaagccaaatatggcgtgaaaccatcaagtggagggcatcggaatctgaagcacaaaaccaatgctggacatggtgatctggatattcccaatggttcaaagtctttgagctttcccaaatggaatcctggaaatgaagaaggaactaatgctccattggcactcataattgatggaaacagtttggtttatattttggagaaggaactggagtcagagcttttcgaccttgcaacttcctgtagggttgtgctgtgttgtcgagttgcacccttgcaaaaggcaggaattgttgatttgataaagagccgcacagatgatatgacactggccataggtgatggggccaatgacgtgtcaatgatccaaatggcagatgttggtgtagggatatgtgggcaggaagggcgccaagcagtgatggcatcagattttgctatgggacagtttcagttcttgaaaaaattacttctggttcatgggcactggaattatcagcgtgttggttatttagttctgtacaacttctaccgcaatgctgtctttgtaatgatgttgttttggtatgtatggttgtccttggatatcacataa

SEQ ID NO: 11557 - DNA, 1293 bp, Glycine max
  Peptide Sequence Number=SeqID_128335
atgcctgcaaaattgttgctcacaactttgtatatcctcttggtgtctcttcctattcacatgtcaccacatgatgttaacatagacacacacaaattcagaagtagtagtggccacagaagcaaaactgttggtggtggctcagccaaaggttgcaacaacaaccaatttgacacaaacacaacaccatgtcaaaaatcgacaaccattcaagcagttccagcttcttcacctccccttgtgtttgcagaccaaagacttgaagtagtgtatccaataatccaaaaattcaagtccaccatcacctcagatccactaggagtgaccaaaacttgggtaggatcagatatatgcagctacaaaggcttctactgtgacattcccccagacaatagttctgccactgctttggcttctattgacttaaatggtttccaactatctgcttccacccttgatggcttcattgataatctccctgatattgctctcttccatgctaattccaacaattttggtggcacaatctcaccccaaatagccaaactcccttacctatatgagcttgatgttagcaacaaccaattatctggtccatttcccactgctgttctaggcatgaactctttaacattcttggacttaaggttcaattctttttctggggaagttccaccacaaattttcacacaaaacctccaagtccttttcataaacaacaacatcttcactcaagggttgcctgataacttagcctccactcatattctcttgctcaccttagcaaacaacaagttcatgggtccaattccaagaagtcttcccaaggctttggccactctaagtgaagtgcttttactaaacaaccagttaacaggttgtttgccttatgagattggttttctcgaagaggccacagtgtttgatgctggcaacaaccagttaactggtcctttgcctttatctttgagttgtcttgagaaggtggaggtgctcaatttgggtggtaatatgttgtatggcatggtgccagaagtggtgtgtgtaggattggtgaatttggtaaacttttcattatctgataactatttcacacatgtggggccactttgtaggatgctgattcagagaggggttcttgatgttaggaacaattgtattcctgatcttccgtttcagagatcagtgatggagtgtgctgagttctttgcaacaccaaggatgtgtcccttcatgtggtttcatggtctcatcccttgtaagcttccttttcaacattccattcacaattag

SEQ ID NO: 11558 - DNA, 162 bp, Glycine max
  Peptide Sequence Number=SeqID_128336
atggagaagtcggctaagtgggttcatctcatgggaatgccgcagtttatggatgaaaagatgaagaagaaaaagagggtgagaatagcagcccttaatggatgtgactgtcctgcgagtattgcaaatgggtcaacttctaggcttagcccaaggatataa

SEQ ID NO: 11559 - DNA, 579 bp, Glycine max
  Peptide Sequence Number=SeqID_128337
ggaaactctccaaattcattgaaacactatgcggaagacatcaaggaacctttatctccagagtctgtgccagtacagaaacagcgcaaatatatgccaggcatcactaatggccaagtgagggaatcagcagcatttgtagatcagagtagaacggatgtgagatttgctatcaatgcagatgatacccattgggcaactgtcaatgaaaaaactagcaattgtaggacaagcttctggcaagctatggaggtggaaaagaagccaccatcagtggctagctttgccgcatataatgtgaatctgaatgttattgtgatcatccatttgctttggctcagtgttcattttttaacctacaagaatgatcctagaaatcaggcaataaagaaccaaaaactaggtgcagcccttgatgcacagcagtcaaaccaaaaccgtgcagcaccctgcccacggtctgtgacaccctctacttccaacggtgagaatgctcggaattggatttcgaacctggtgttcaaatttcatgacgatccaacggtgaatgaatccgagatcgtcatttttctgagatag

SEQ ID NO: 11560 - DNA, 291 bp, Glycine max
  Peptide Sequence Number=SeqID_128338
atggcgtacgaagacctcttgccatccctcgtcgccaaccaaatggctatgatatctcccggaaggatctaccagcctcctttcccaaagtggtataaccctgaagaggaaatccctaccgaggggagagggcataatagggctttgcatgtgtcagtcaaatgcatagaccacgttgtggccaaggttacgttccaagtgatggatattaacctggcttacaactatcttttgggacgcccgtggatccactcggtgggagtcgttccctctacactccaccaaaaatag

SEQ ID NO: 11561 - DNA, 2076 bp, Glycine max
  Peptide Sequence Number=SeqID_128339
atgtgtccaaccagtcgttcacatgctatcttcaccatcacattagaacaaatgcggaagctcaatagtcatggtgagatcagtttaaatgatacaatgaatgaagaatatctttgtgccaagttgcacttggtagatcttgctggatcagaacgagctaaaagaaccgggtctgatggtctgcgctttaaggaaggagttcacattaacaaaggccttctagcgctcggcaatgttattagtgcacttggtgatgaaaagaagagaaaggaaggtgttcatgttccttatagggatagtaaacttactaggcttttgcaggattcacttggtggtaacagcagaactgttatgatagcctgcataagtcctgctgatattaatgctgaggaaacacttaacactttgaagtatgcaaaccgtgcacggaacatccaaaataagcctgttgtcaatagagatcccatgtccaacgagatgctaaaaatgcgacaacaacttgagtatctgcaagcggaactttgtgctcgttctggtggctctcctgaggaagttcaggtcctcaaggaaaggattgcttggcttgaagctgctaatgaggatcttcgatgtgaacttcatgaatatcgtagtagatgctctactgtagaacaatgcgaaaaggatgcatatgaaaatagcacatgtaatgtaaagactgatgggcacaagaggggcttacctatcacagcatctgattatccaatgagtgaaacaacaggggattcaagggaaattgaagaagtagaaaaagagtgggagcatactcttctgcaaaatagtatggatagagagttacatgaattgaataaacgcttggagcaaaaagaggtttctgagatgaagctttttggaatacctgatgctgaggcactcaagcagcattttggaaggaagataatggaactagaggatgagaaaagaactgtacagcgagagagggatcgtcttttggctgaagttgaaaatcttgctgccaattctgatggacaaatgcagaaatcagaggatatccatgcccaaaaattaaaaacacttgaagcccagattctggatctaaagaagaaacaggagagtcaggtccagctcttgaagcaaaagcaaaaaagtgatgaagcagcgaagcgattacaagatgaaatacaatctataaaagcccaaaaggttcaactgcaacataggataaaacaagaggctgaacagtttcggcaatggaaggcttctagagagaaagagcttctgcaattaaagaaggaaggaaggagaaatgagtttgaacgccataagctgcaagctttaaatcagcgccagaaaatggtccttcaaagaaagactgaagaagctgcaatggccactaagaggttaaaggagttgttagaagctcgtaaatcttccagccgagacatttcaggttcaatgaatggaagtggaacaaatggacagagcaatgagaagtccttacaacggtggcttgatcatgagctggaagtcatggtaaaagagcatgaagttcgttttgagtatgagaagcagagccaagtgcgagctgcgcttgctgaggagttggccatactaaagcaagtaaacggggttgctgccaagggtctccctcctcccagaggaaagaatggatttgctagagcatcctccatgtccccaaatgcaagaatggccagaatagcttcacttgagagcatgctgaacatatcatctaattcacttgtagcaatggcttctcaactttctgaggcagaagaacgagaacgggccttcactaatcgtggacgctggaaccagttgcgctcaatgggagaagccaagaatttgcttcaatatttgttcaattctgttggagatgctaggtgccaactgtgggaaaaggacactgagatcaaggaaataaaagatcaaatcaaagaacttgtaggtctattacggcaaagtgaaatgaaaagaaaggaaactgagaaggaactaaaagcgagagagcaagctgttgcaaccacattggcgaccccaacttctgtaagatcttag

SEQ ID NO: 11562 - DNA, 117 bp, Glycine max
  Peptide Sequence Number=SeqID_128340
atgggacaagggagaagtgatggcctgtcaggcgttactagtagtggtggcctgccaggcgctaccagtagtggtggcctgccaggcgcgaccactagtggtagcctgtcagattga

SEQ ID NO: 11563 - DNA, 984 bp, Glycine max
  Peptide Sequence Number=SeqID_128341
atgcctgactttcttgccacaaacccccttaccatttcagctgcagaatctccaagattccccttcctccattcatgcccaactcttacaccaagaccccaactcaacccgaatttccgtatccccttttctcccaaaccatctaaaaacaagagcgtctctttggcactgagctccaggtcgaatgaagggtcatcaaggggttatggcttttacaacgagcttgagtttgaggacagaaaggacaagacttttgggttggagatgaaccctgttgttggtgaagattcccagagtgaaactgggtcaatcccctttgatggggtggagggtggtgatgataagggagaggatgatttggttcgggctcagggggatgcagatggggatggggatggtttgaagaaaggttatgatgatgaagaaggtgagaatgagaaatttggaggtaaacttagagtcagaagaggtaaagaggtgaggccaaacttgctttctggggattcagagaaattccttctggatgatattagtcaggttggagatgttgtccttgtccaggatgaaagtgtgacagacaatgaatttaaaatggttggcttggagacactggttggatacaaagttgtaacaccctctcgacggaatattggaaaggtgcgtgggtacactttcggcatcaattcaggtgctgttgaagaacttgaacttgattcatttggactatccatcattccgtcaagtttggacgtgctggaagtagtatctgacgcagttgttgtgcatgaagctgcagctttacgaattcaaaggctttctaagaatgtgagagtttcagtggatgattttgaagattttgactctgaacaatctgacacatacggtcctatttcaaggagaagaaaaagtttcggaagaaagaaacccagtcatagagattgggatgatgaagataattgggagcttccaatggactatctctga

SEQ ID NO: 11564 - DNA, 186 bp, Glycine max
  Peptide Sequence Number=SeqID_128342
atgaagaaaatgatgaatgaaaaacaagatattttattccaattcacgaatgcgatgctcgatgggatgaagcttgcttttccattcggcaatgaacttgtgaatgtggagttcaaggatgcgctgcaggagacgttgctggcagaactcaacgcgatcaagaaaaaatcggagagtgagaattga

SEQ ID NO: 11565 - DNA, 606 bp, Glycine max
  Peptide Sequence Number=SeqID_128343
atgtggatggagaatgcatcggatatctggaatactttcaagaaatgttattatcaaggagatgtatttcgaatcagtgacttacaagaagaaatttatctacttaaacaagacaaagttttttctatccttattcaacaagagaggcaattggttattcaatttgatgattatagagtttttgctcaattggataccaacaatggtacttatggcagaggcagaggtcgtggaggccatacatctggtggaaaaggtagaggcagaagcacaaaaatatgcacttattgtaacaaatcaagtcatatggtagacacttgctacaagaaacatggttaccttcctcacttgcatagaggaggtcctatcaaccagtattctatggatgatcaagaaattaaagatgatctacaatctctaggaaaaaaagaggtatctgcagatgcttcatctgtagctttcacaccagagcaacataagactattctttccttgttacagcaaacctctcaagcctctccttctcacgccactaatcaattagttagttctcataagaatggtaattcaggacaactcctccacgaggataattggagcaactga

SEQ ID NO: 11566 - DNA, 1362 bp, Glycine max
  Peptide Sequence Number=SeqID_128344
atggataagttcgaggtgatctattcagatgtctgtggccctattcaaactaaatctcttggtggaaataggtattttgtttccttcatcgatgatttaactagaaaagtgtggatctacttgattaaaaggaagagtgatgtatttgatgtgttcaaaaagtttaaaaggatggttgagaaacaaagtggcaaacatataaaagtgttaagaacaaatggaggtggtgagtatgtgtcagatgtgttacaaaaattttgtgaggcagaagggataatgcatgaagtaacaccatcgtacactccgcaacataatggcactgatgagagaaagagcagaaccattacgaatatggtaaggagcatactcaagagtaagaaagttcctaattatttatggggagaaacatcatccactactactcatattacaaatagaagtccaactaagaggttaagtggaaagacacaagaacaagcatgggcatgcaccaaatcaaatgtgactcactttagagtgtttggctctatatgcttcagatgtgtgccaaatcaattaaggagaaagctggacgacaagggtaagcagatggttcttgtagcatatcattctacaggtggttacaagttgtatgacccaagacataaacaaattgtaatcagtagatacgtgattgatgaatcaaagagttgggattggaacacaaaaagctttgttaaatgcgcatttaagcatggagtgtatctaaaggtcttgaaagtggtcaccggtacaaatttgcttatagtctatctctatgtagatgacttacaagtgactggaagtaatgaaggggagattgaagagttcaagaagaaaatgaaaaaggagtttgagataagtgatctaaggctcttgtcctactttcttgggattgaattcaaaacaatagataatgcagttgaaactagaatggcacttgagaaggaaggggatgaggaacttataaatcctacctacttcaagaagatcgttggatcacttagatatcgatgtaacaccagacctaatttagaatttagtgttggattaataagcatatttatggagacaccaagaatgcctcacttactaatagccaagagaataattcactatgtgaaagggactttagactatggaattctatttcctatagggagtgacaactcaaaagtttatttgcttgggtactcttattcagattggtgtggtgacaaatccgatcaaaagagtactgcaagttatgtttttatgtgcgaaggaacaccaatctcttggtgtttgaagaaggaatttgtagtggttttatccttatgtgaagttgagcatatcacagcttga

SEQ ID NO: 11567 - DNA, 834 bp, Glycine max
  Peptide Sequence Number=SeqID_128345
atgggaaaccctgcaggcttcaaattgaatgctgagttggctggagtacttggcatggcttctttgaatgcagtccagatatggtcaacactctggatctttgtgggttacatcttcaattatattattcaagggctttctgtcttaggaatcctttgtggattcactgttcctgctgctttggtcatagacatgattgcactggcaactttacacatttcaactcttcattggtttatttcacttgtatattcatcacagatacaggcattagctgccttgtggcggcttttcaggggtcggaaatggaatcctctgaggcagcggttagatagctttgactatactgtgaagcaacacattgttggatcacttttatttacaccacttctacttcttttaccaactacttctgttttctatatattctttagtatcatggacacaaccattaaccttgtctgtctactgattgaagtcactatttcggtaattcatgttaccccttataccaagatatttctttggttggtaagaccaagaagattcccttctggaatatggcttgaaattattggttgtcagagtaatagtactgcttctccaagtgctgatattactgatgaaatgacctcatacaaggagtcattgcatctaaaggatttcaatagagaaaaatctagtaatctagtttctgctctccacagcaactacttgagcttaggtgaggcccgaagcttttacttgtgggttcagactgatgcttgtattcggttgtcaagatatgtctctatgttaattaatagggaaactgaatgtgatatcatgtggtaa

SEQ ID NO: 11568 - DNA, 1761 bp, Glycine max
  Peptide Sequence Number=SeqID_128346
atggctcaactacagctaccaccactctcgagtcgcagttcttcaactgtgactcgaattaatttggtggtggctcaaagttgcatcggcaaatattttaagcttgtcgagcgcaacaccaccttcaccactgagctccgtgctggtaccgccacgtttctcacaatggcctacattcttgctgtcaacgccaccattattgctgactcgggtggcacatgcagcgtctccgattgcacccctctctgctctgacccgaaaacctcaccctcccattgcccgacccatcttttaacccgacccgactcctcatgcaagtacccgcctgtcaacccgggctacgcggcgtgcgtggaacgcacgcgccgtgacctcatcgtggccaccgtggcctcctccctcatgggctccgccgtaatgggcctcttagcgaacctccccttagccctagcgcccggcatgggcgccaacgcgtacttcgcctactccgtggtcgggttccacgggtcgggttccgtaccctacaaaaccgcattaaccgccatcttcttggaaggcctaatcttcctcgtaatctcagccgtcggattccgcgccaaattggccaaactcgttcccaaacccgtccgagtctcctccgccgccggaatcggtctcttcttagccttcattgggcttcaaagcaacgaaggcattggactcatcggattcagcccatcaacactagtcactctcggaggctgcccgaggaacaaactaacggcgttagctccggtcatcacaattaacggcaccgttagtttaatccccggcgccaccgtctccgacaagatactatgttccgggaaccgcatggagagcccaaccctatggcttggtttggtcgggtttttcattattgcttactgtttaatgaagaacataaagggggctatgatatacggcatcgttttcgtaaccgtgatctcgtggttcaggaacacgccggttacggtgttcccgaataccgaactcggtgacgcggggtatgagtattttaaaaaggtggttgacgtgcacgtgataaaaaccaccgcaggagcgttgagttttgatagcatgtggaaaggtgcattctgggaagctttgttcacgtttctgtacgttgatatattggacaccacggggacgctgtattccatggccagatttgcagggtttgttgacgccaacggtgatttcgaggggcaatatttcgcgttcatggcggacgcgtcgtcgatcgtggtggggtcgctgctggggacatcgccggtgacggcgtttatcgagtcgtcgacggggatacgggagggggggaggacggggctgacggcggtgacggtggcggggtatttcttgatggcgttttttttcacgccgttgctggcgtcgattccggcgtgggcggtggggccgccgctgatagtggtgggggtgatgatggtgaggtgtgtggtggagattgattgggaggatatgagagaagcgataccggcgtttgtgacgattgtgttgatgccgctgacgtattctattgcttatgggttgatagggggcattgggacgtaccttgtgttgcatgcgtgggactggggaaaggaggtggtgaagaatttttttactaaggagaactttaaggataataataataataataatatacctaattcaaatataaatgtaaatgcaaatagtcgtgttgttgatcatgaagaaggatatgatgataacaaggtgtag

SEQ ID NO: 11569 - DNA, 222 bp, Glycine max
  Peptide Sequence Number=SeqID_128347
atggctttgctagtagggataggctcttcatttttcaagcatgtgggagttgtggagtgtgtctttgagttgagtgatgaggccattgaagctcaaattgcaaggataatttgccaatttgaggcactcaaagaagaaaatatgaggctcttaggagtattatatgagaaggacaacatgattgaaatgctcaaggaagatttagataaatgtagggattga

SEQ ID NO: 11570 - DNA, 264 bp, Glycine max
  Peptide Sequence Number=SeqID_128348
atgaattactccacggaagaagcagtctttcacagttgtaatgtcaactgcggaagacagcttcttccgtggagtcttgcggaagacgtcttccgtgagattccacggaacaagtttttttcttccgcaattagcacaagcacaaccagcaccgacaaaaatcgcacagcacaagcaccagaacggagaaaacgcaccagaatggagaaaacgcgcaccggaatggaggaaacgcaggagagagaaagcaaaaaggaagaatga

SEQ ID NO: 11571 - DNA, 375 bp, Glycine max
  Peptide Sequence Number=SeqID_128349
atggttagaacacgaggtttaggtcgtgcgttaggagctggtagaggtagaggcattagtgaggatacgcatgaggttgatgttcctctgcatcgcagacttactgcttcagcacgtaggcaacgggttcgtctgcgtgaggacgtgacagagagacatgaggatgtgcctcagttgcatgaggatgttcctcatgtgtctgatgccacccaagagatgacaggcgccgccgatgctgttcagacagagggagtggctactgatgggagcttggggtcacctgctgcagatgagggtttcctcggtggaccacgcgacccatcgattttgaccgattttgccgagcatgtcgcacacaacatctggagtggacag

SEQ ID NO: 11572 - DNA, 255 bp, Glycine max
  Peptide Sequence Number=SeqID_128350
atggaggagtttgatactcagatggcctgtccaagagaccagccctcttcttctagagggggtggagcctctgtagcccaggagcctgtgactgatgagccaccagcaccagcagaggaggagaccactccagatcacactcctcagccatctccatcctctgcatctactcctgaggagactcagccatcagcactggatcataatgaagaccaccataggaggagcaggaccttttatgtttcagttctttaa

SEQ ID NO: 11573 - DNA, 400 bp, Glycine max
  Peptide Sequence Number=SeqID_128351
atgaattcctcctccatttatattcttgtctttgtccagctttggttgttgagcttaccatgcagagagagtgtgtgcatcccaagtgagcgtgagacacttttgaagtttaagaataatctcatagatccttccaataggctttggtcttggaatcataatcataccaactgttgccactggtatggagtcctctgccacaacgtcacttcccatcttcttcagcttcacctcaactcttcactttctgatgctttctattatgactatgatggctactatcacttcgatgaggaagcttatcggagatggagctttggtggagagataagtccttgtttggctgatttaaagcatttgaattacttggacttgagcggcaatgtattccttagagaag

SEQ ID NO: 11574 - DNA, 249 bp, Glycine max
  Peptide Sequence Number=SeqID_128352
atggaagtaaccatcttgcaaaaattggggcaaaagatggatcaagttacatcgttgcttcatctaatgccaaacacatttaggactgttgatgtccttgttacttccagtttcaccttgacaaagatgtcatggaccataaaagaacacgctttacggtgccattaccaaacccgtgctagagctagagtaatgggtgaagtagaggaggtgcaagagaagataaaggccgacatggaggccatgtaa

SEQ ID NO: 11575 - DNA, 942 bp, Glycine max
  Peptide Sequence Number=SeqID_128353
atggtgatggtgagccccgagaagatctaccaatttctcttccctcaatggtacaaccccaacgcaacctgcgcttatgatggaggtgtcccggggcattcaatagaacaatgtgtggctttcaaacacaagctccaaagtttgattgacgaagggtggttgacatttcaagaggacaacccaaataggccaaagtggatgaaagatgtgttaacctctaggaggctcatattggaggcactacgcgaagcgggcatgattttccttgatgggggcaagggagatgtttgtttgatacatctgggagtagcacacgatgtaaaggcatgccctatggtggaggaattgttacaaggattgatggacaaaagcttgtttgagattggtaccgcgagaaaggagggagaagatgtatgcatgcaatcggctgataagaacccgagtaaacccaagccattggtgatccacttcactagggatgtggccacgcaaaagccccgaggcttcaaacctataccggttaataaacccgcaccgttcccttacaaaagtgacaaggcggtgccatggaggtacgccacacaagggcctgatggaaggaaggacgagtccgtccgagggtgggtcttcgtagcatctgagccgttggtgcggtccaaggactcgaagggaaaggtgaaggcgggcatggaagagagagacaagccgagcccgattctggatgaagaggtcctagccggaaggtttgctaaggagagcgacaaggcaatgcttatgtggagtctcccccagctcacgggtgcgctttccaaaggaggaaaggtgcgcggagtcgccaccaacgaaggtattagcacctctcacgtcgacaaaagcggggctcttgctcctacgtaccctccatcgaagaggaaatcagacctacgtagttcttttttaaag

SEQ ID NO: 11576 - DNA, 321 bp, Glycine max
  Peptide Sequence Number=SeqID_128354
atgcataagaaagaactacgtaggtctgatttcctctctaaaggagggattatgaggtacattcgaagtgaggaaagctctactggagatgtagttgagcacatcatacttgatttgtcagtgactaatgtgaccaagatagggactaaaatgaaaaacatgatgtcaggaactagattgacagtcgaggcagagcttttgctttcaacgactctgatccatgagcaagatggtgccccagatccagaggtgagccatctcaagttctttgctgccttactcattattagcatcatttgttacactattagtggggaatga

SEQ ID NO: 11577 - DNA, 108 bp, Glycine max
  Peptide Sequence Number=SeqID_128355
atggaggatacgattatgaggtacattcgaagtgaggaaagctctactggagatgtagttgagcacatcatacttgatttgtcagggatgaatggaaaagatgggtga

SEQ ID NO: 11578 - DNA, 249 bp, Glycine max
  Peptide Sequence Number=SeqID_128356
atggagaagaagttggctgtgatggctcaggagatggagaagcttcatgaaaagattgcaaatgcagagaaaagagcacgggatgctgcagtgacttggaatccaggtcaagggtatgatgcaaattatggaaatgctgatgctggaaatccttaccctggcatttatggcatgaatccacctggagtggagaattttcctcagtatggacctgggcctgctgcttggggcgcatatgacatgcagtga

SEQ ID NO: 11579 - DNA, 936 bp, Glycine max
  Peptide Sequence Number=SeqID_128357
agaggactacacgtcctcaccttcggaggactacgcgttctcgcattcaaagggctacccgtcctcctcttaagaggactacacgtcctcaccttcagagggctacacgcccttacctttagaggactacacgtcctcgccatcagaggactacacgtccttgcctttagagggctccaggccctcacctttagaggactacacgtccaccccatcaaaggactacatgtcctccaaatcagaggactacagatcctcactttcagaaaactacacgtcctccccttcagaggactacacgtcctcaccttcagaggacttcatgtcctcgccttcataggattacacgtcctcgccatcagaggactgcacatcctctccttcagacggttacacgtcttcaccatcagaggaccacacgtcctcacctttagaggactacacgtcctcgccttcagaggactacacctcctagcctttagagggctacgtgtcctccccttcagaggactacacatcctcgtcttcagagggctacatgccctcacctccagaggattacacgtcctcgccatcagaggactacacgtcctcccattgagaggagtacacgtcctcaccttcagaggactacacgtcctcgccttcagaggtttacacatcctccccgtcagaggaatgcaagccgtcaccattagaggagtacataggactacacgtcctcgcattcgaagggctacacgtcctcgccttcagagggctacacgtcctctccttcagtgggctacatgtcctcgccttcagagggctacacgtcctctccttcagagcactacacgtcctcgccttcagagggctacacgtcctcgccttcagaggcctacacgtcctcgttcactttcggttttcttttcttctgtttttaacgagctttaa

SEQ ID NO: 11580 - DNA, 111 bp, Glycine max
  Peptide Sequence Number=SeqID_128358
atggaaacaacaactttggcttctgttcccaggatccttaaacaacgtcgatatcaagagaaatgtggtgatatgcaacataggggaaaggggaagaggcctagaccttaa

SEQ ID NO: 11581 - DNA, 363 bp, Glycine max
  Peptide Sequence Number=SeqID_128359
atggccgagacaggccaatgtgatggaccatacgccctgcgtgacctcactcttactaggcggtatgcatggggagctgctggcctcgtccatatgtacgatcagcttaatgatgccaatctcagcaccagtcgacagcttgctggttacatcaccttgttacaatgttggatatacaagcactttccgtcagttgcagagtgcaatgttgatccgaactatgacgaggtgtcaccacatgcgtgtcgatggattgtgacaaagaagattgtgaagaatatacagactagaaagggttatgcgccagttcggctatgtccagtgcattcctggacaccttgtccattcatgggtgtcatatga

SEQ ID NO: 11582 - DNA, 669 bp, Glycine max
  Peptide Sequence Number=SeqID_128360
atgtacgatcagcttaatgatgccaatctcagcaccagtcgacagcttgctggttacatcaccttgttacaatgttggatatacaagcactttccgtcagttgcagagtgcaatgttgatccgaactatgacgaggtgtcaccacatgcgtgtcgatggattgtgacaaagaagattgtgaagaatgtatctacagtgacgtacaggcaacgcctggatcgtctgaggatcccagatgtctattggatgccatatgcggagcaccgacctgtgcaggactttcattcgatttcgtgcttctcgggacagctccgttgggggcctgttgttgtcagatacagactagaaagggttatgcgccagttcggctatgtccagtgcattcctggacaccttgtccattcatgggtgtcatatgatgacatggacgatacatggacgcactactcagaccatctggcggcagcagatgatctatgtgttgtgccaggtcagtgtgcgcctgactacatagactggttctttgccatatcgcattcattcatgactgtgccacaaaatgatcctcctcgagatgcatatgagacgcagcccaatcatatccctcataaggcagcactgacatcgacacatgcggatcctgacgcgaatgagcctaaacatgcagtg

SEQ ID NO: 11583 - DNA, 2892 bp, Glycine max
  Peptide Sequence Number=SeqID_128361
atggaagcacgaaagcaaaaggcacgaaacgcttacctcgacggagaagcaccaacgaagaagaaaaagaacgaaagtaccaccacgacgctgtcaacaatggtgaacaacaacaccaccacttcgccggaagcaacaacaccagtggtcgcggaagcagcaaagcgcaagagaagacgagagaaacgcagaagaagaagacgaactgagcttgcagaagagaagaataggaacgcggaaaagaagaggaataggcgttggggttctgaagtttctgcgtctgactctggtggatatatatttggaggaggggggaagtggtctcgccgggttgctacaatgctgccttggttggttattccgttaattggtctctgggcgctctctcagcttctgccgcccgcttttcgattcgagattacttcgcctcgtcttgcttgtgtctttgtcttgttggttactctcttttggtatgagattttgatgccttggctgtcagcttggcgtgtgcggaggaatgctaggattagggagaggaagaggtttgaggccatagaaatgcagaagttgaggaagacagctacgaggcggtgccgcaactgcttgagtccctatagggatcagaaccctggtgggggtaggtttatgtgttttaactgtggccatgtatctaagagaccggttctagacttgcctgtgccgccggggttggggatttctaattccagtatagttaaggacttggttggaaaaggtggcaaaatattgaatagcaaggtttggtctgaaaatggatggatgtgcggtcaggactggttggagaatggaaattgggttggtgggtctgttccaggtaatcctagcaactggaggacgagtgagaatgctggtgtttttggaggagatgagcattgtttgacggagaggtcttattgtggtcttttgtttttggtttgcaagcttttgacatctttcttcaagagcattagatggctctggggaaaggcttttacagttagttcaagggaagaatgcccttctgatgctgaggcactcttagctaaaaggggtgaaaatgaggcaagcctcaatgaaagtagaggggaaaaagcacgtaggaaagctgaggagaaaaggcaggctaggctagagaaagaactattggaggaggaagagagaaaacagagggaggaggtttcaaggttagtggaggagcgtaggaaactgagagatgaaaaagtggaagctgaaaaagatcacagcagatcatcaaatctcagtaaggagaaggaccgtcagaaggaagctgaaaagaagcgtcaggaaaaaagaaaagagaaagataaggggtctagtaagagcaactctgatgttgaagaattggaaagaagagctggcaaggaaagtgaacggaagcgggatttcgacaaaaagagtgaaatggatcgtagggagcatcagaaatctgggttagagagtggcaagggacagaataccaacaatgcacaaaataaaaatgtcactgcaaacaattataaccgaggaggtactggaacaaggggtattaatgttcctagcactgtggtgaaagaaaacaagtttaatagttctgtagatcatgttcatagcaggagagaaatatgtcctcctgagcgtccagctgcaaaatccaatgtaaatggagatgataggaatatcaatcaccctgtactccctgaaccacaaccatggacagcagcacctaaaaagtcatggcagcaattatttactcgatcttcacctgctcctcaatcttcaaattcaaatgtaatatgcaggccaaattccaaaattcaagcagaagtcaaaagccctcagttgtctgcccagtcaccagttacacagtcatttactaatcctattcagtttggtcttccatcaccatttaatatttccacccatgcaagtggaccaaccagtagtagtctaggtttttctcctgctattgaaccattttttcctccagttggaaatacatcacatgactttagacaagatgagcaagagctttttgaagatccctgttatgttccagatccagtatccttgcttgggcctgtttctgagtcacttgataattttcagttggacttgggaattggctttggaacagacaatgaaatgacaaaacctcactctttgaaaagcatatctgctggttctgatgttaataagccatctctgattgaatccccatcatcccgagaaaagcatagctgttctaattggtttccaagtaccccgaatggccaagacaagcatggttttcctctggatgatgcagctgcaaatgagaagggaacatggcagatgtggagtacttctccacttgggcaagaaggtttaggtttagttggtggcgcaggaagctggctgttatcctcacaaaggaacataccaaacaaggatgattttgtgctttcttcatctcagaagactatggcttctctttttaacaaagaagataacataatttccagtacccattctccacaaaatgtttttcttcctaatggccaaagtggtgagaacttcagccctgttacaggttcaagtggttatgatccttggttacaaagtgctctcttcccaccattgtcaggtggcccttcagctcaggagggagccactcaaaatgaaactatatatggtagcccaagtggatctgctagtagccatgggcttgatggttctccagctaactgttggtccaacccacatgctctagctacttgcggtacttgcactgccgctccatccacaggacacatcgcctggactcatcaccaggaagactttcgatacaagggatccccaaggccaagatccattgccgccatcttacttgtctga

SEQ ID NO: 11584 - DNA, 1423 bp, Glycine max
  Peptide Sequence Number=SeqID_128362
atgcgtggtttgaagctaactgaacgtttcaagagcactcaagttcatgctctcagttcttcttcatcacaaacaaatggcagcaatagcagaaaagcctcagtggctgccaccaccaaacctcacaacaaccttaacagaaacaaaaccatgttaccatcatggtcaaaaaccaaatccagaactaccaacaacaaaaactcgacctcatcattagcaaaccttgctcctcttcgcctcccttcgaccgacaccattgaaccatccatagaacctcaccttaagcccatcaaccttgtggagaccttatcagaactctatcatcggttggagtgttgttcacagtccaacaaagccttaatgtgtgtggaacagtactctctcttgcgtggccttggtgatcagaaaatactcagaagatgtctcaggacagcatgtcaaaatgccgaggatgtgctctccaaggttgtgttgtctgcgtggttgaggtttgagaggagggatgatgagcttgttggtgtgtgttcaatggattgtggtggttttgttcttgagtgtccaaagaagaatttggaacatgggttgagtccttgttcagttagtgatcactgccagtgtcagaaagagccaaatcagaaaacctgcactgagactgagagtgtgtgtttgttagatgaggaaagtgacattttgttctgtgttgggagtgaagaaatcagttgtgttaggtgcaggatagcttcactttcagacccttttaatgctatgctctatggtggctttgctgaatccaaaatcaacaagattgatttctcaggaaatgggatatgtccaaaggggatgagggcagtggagttttacagcaggaacaaaagattggaccttttctgtccaatgactgttttggagcttctgtcctttgccaataggttttgttgtgaggatatgaaatctgcttgtgatgcacatttggcttcaattgttgtgaacgttgaagatgcattggtgcttattgagtatggattggaagagagagccacacttcttgtaggggcttgcttacaagtgttgcttagggagcttccaaattctctgtacaatccaaaggtggcaaaaatattctgtagttttgaggtaaaggaaaggttggccaatgtggggtgtgcttctttcttattgtactactttttgagtcaggtggcaattgaggaaaacatggtatctaaaaccacaatgatgttggtggagagaatgggggagtgcgctacagaaagatggcagaaggcactagcattccatcaattggggtgtgtgcttcttgaaaggaatgaatacgtagaagctcaacattgttttgaggcagcacttgaggaaggtcatgtttattctttggctggtctggccagaactaagcacaagcagg

SEQ ID NO: 11585 - DNA, 252 bp, Glycine max
  Peptide Sequence Number=SeqID_128363
atggttattttgaaggaaaacgaaaggtcagagaacaacggtggtttgtggtggctaatggtggctgtgggtgatggagaaagagcttgggtcgttggaaatggttttggaagaaagaaagagaagaaaatggtgtttttcctaagctacttggactacaaggctcaaaacgcacaagtgagcagtgctcttggaaacgaaaacgtcacgcacactccagatatcttgtcaaagatcccaatgaccagatag

SEQ ID NO: 11586 - DNA, 450 bp, Glycine max
  Peptide Sequence Number=SeqID_128364
atggttcacaacatgcagggattttgttcttgcacttgtcatttttcttctacacccagcacctatatggattgtcaatccgtaaggtcattacggattgccaaccctccaagtcacaaaacccctaagcacttcatcatggaccttacacaaaccacgcccactccctctccctccctggccagcaccgtcacaaggatctcagtagcctcgcgtgactccggcgtggcaatgccatcgagcgggacgagaggaagggtgatggccatgaaggacacaagggaggagagtgctatggggtccaacctcgccttggaggcgtcgagggcagagatggtggcggcaaagtatgcgggtggcatgagggggaggcgctccgtggcaaggttggagcaaagggggacaacggtggtgaggtggtggtgctgcgatgtggcgaagttggtgtag

SEQ ID NO: 11587 - DNA, 823 bp, Glycine max
  Peptide Sequence Number=SeqID_128365
attaaactatcaaaaggctgcaatgcgcagtttgcggttggccagaaaccattccagcccaatgcaagagaggctaatttatgaaggatggatcctatatgacactggctatcgtgaagaagcagtggcacgggctgacagatccattgcgattcagagatcatttgaagctttttttctaaaagcatatgtgttggcagataccactctggatcctgaatcttcttcctatgttattcagcttctaaaagaagcacttaaatgtccttcagatggtcttcgaaaaggacaggcattgaataacttagggagtatttatgtggattgtggtaagctagagcttgcaaaagaatgctacaagaatgctcttgcaattaggcacacaagagctcatcaaggtctagcacgcgtttatcatcagaaaaatcaaagaaaagctgcatatgatgagatgaccaagctaattgagaaggcagagagcaatgcctcagcatatgagaaaagatcagaatactgtgatcgtgagatggcaaaggctgatcttgatgttgcaactcaacttgatcctttaaggacctatccatatagatacagggcagcggtgatgatggatgagcaaaaggaaactgaagcagtggaagaactcactaaggccataaagttcaagcctgacctgcagatgcttcatctaagagcagcattttatgagtcaacgggggacctatcatctgctcttcaagattgtcaggcagctctttgcttagacccgaaccatacaggcacacttgatgtatatcgaaggatacaaaaattgaacttctaa

SEQ ID NO: 11588 - DNA, 948 bp, Glycine max
  Peptide Sequence Number=SeqID_128366
atgtatgatttaggtgttccgagtctgaagcgaacagaacttgaagtcgcttgcgaagatttcagcaatattattggctcactacctgaggggactatttataaggggactctctccagtggagttgagattgctgtagcatcctctgcagtgacttcatcccaagactggtccaaaaagatggaaactcagttccgaaagaagatagagatgttgtcaagagtgaaccacaagaattttgtgaatcttattggatattgtgaagagaataagccattcacaaggatgatggtttttgagtatgctccaaatggaacgctatttgagcatctacacattagagaagcagaacaactagactggggaatgagaatgaggatcgctgtgggaatagcctattgtctggagcacttgcatcaactgacaccacccattgcctacagaaacatactatcttcctctatgtacctgactgaagactatgctgctaaattatcagaccttagtttgtggactgatatagtctccacaaagaagggctctgaagctccacagctgttggaaacagcttcagcatatataaaggccaatgtttacagctttggagtactattgtttgaattgattactggaagaattccctttgctatggagaatggcttatttgaagattgggcagcggaatatatgaaggggcaaccattgaaagacttggtggacacaagcctcaactctttgcaagcaaatgaaattgagaaatgggaagaagtgatcaacagctgtgtacatcaagatcctgaaaaaaggcctactatgagagaggttactgctaagttgaaggaaatcactgccatggggccggacggagcaactccgaaagcatctcctctttggtgggcagaaatagaaatcatgcccagtgacttaagttcagaggttaaaccatga

SEQ ID NO: 11589 - DNA, 408 bp, Glycine max
  Peptide Sequence Number=SeqID_128367
atggggccaaatgcccagaaatatatagcccatgtctttgcaaggaacttgaaagatctatgtctccatggaatactagcacctgaaattgggaagctggttcacattaaatcaatcattttccgtaacaattatttctacggagacatccctaaggagatactacaattagaggacctggaagttcttgacttaggatttaacaactttagtgggcaatttccatttcatgaccttgcaagttatccatccctgactacccttttattggacaacaatgacaatcttgctagcttaactccagaagtttatgagctcaagacattttctgaattgcatgtagatgaagaacaactaactggtgccaccactagagaagcatgtgctagcataactaataactggtaa

SEQ ID NO: 11590 - DNA, 261 bp, Glycine max
  Peptide Sequence Number=SeqID_128368
atggaagaacggtggagattcatcacttggttgaagctcttacgcgtgtttgtggcggttgtgtctctgtcccccttcagcatgcaacctatttggtgtacgactctcaacaatgaagggttggctctacaaaagatgagggagagggtggtgatagatcgattgggtggtttatcaagttggaatagcaaagagggagagattgatccctgttcctggttcggagttgagtgctcccacggcaatgttgtatccttgtaa

SEQ ID NO: 11591 - DNA, 143 bp, Glycine max
  Peptide Sequence Number=SeqID_128369
gaaccatggaggggagaatgggactcttgtttcttcttgtattgggtggtgcatgggcttgtgatggaagagaactcgcaaactgcgatcaattgagcagtaatacagcaaactctggctcttctgataacattgttcactaa

SEQ ID NO: 11592 - DNA, 303 bp, Glycine max
  Peptide Sequence Number=SeqID_128370
atgtggactgatggatgtccaaaaattgacagcaggtcttctatcagctttcgaacacccggtaacaatagtgcatgcgaccctttatgctctccaatgaaccgagatgagggatatgagacaacaatgggagatagctgccaagccaccctcaagaatcagatgagtcatttgaggatcaaggatgaagagttacataaaaatgggaagttgagcaagaagaatagcaaaaacaacaaaactgacattcaattgctgccattgcagtcaaggagaatctttgacaagttatggagcgtgtga

SEQ ID NO: 11593 - DNA, 224 bp, Glycine max
  Peptide Sequence Number=SeqID_128371
gggttcccatgaactctaagagaataaaggttattcctgagtggcctactccaccaacaccactcactaagttcatgaggaaccatgttccgtcatgggaagatgcccaggaaatgggtgttgaggaaagaaacctagagtttcaagaacctcaggatttgaggtcaaatccttttcaagggggagggaatgatgcaatcctaccccgcaagggcattggatag

SEQ ID NO: 11594 - DNA, 450 bp, Glycine max
  Peptide Sequence Number=SeqID_128372
atggaggagttgattaataaaacacaactctctcccaaaataatcccaacgtcatcacgtcggctcggcggctccacaaaagaatctcacttctcgcactctactgttgtcattctgctcccacgaacaaaggttcgcgatcatcacaggtaccaaccacacggtacaaaaattgcgaggggaaatagcctaagtgtgtccacacaacactctcacttaggaaaactaggcagtaagtgtcgaggtcaccctatcctgcacaggcaactccccaccatgatgatcaacctaagtctcaagggagttccaaaccgagtgacatacccccaagtacaagtattcctcctcatgagaaactacaagtacttactgacaaagtttatactatttccatgtcatatgaagtatgaaacatgggcactttcaaatgcactaatcgtggataattaa

SEQ ID NO: 11595 - DNA, 126 bp, Glycine max
  Peptide Sequence Number=SeqID_128373
atgaaaactggtgttaagatcattcacgcaagggtgtctgtggctcagtggtattttgggttcaatcgcatacaattggggatatattctgatacagggtatgaacacatcaaccttaagctttga

SEQ ID NO: 11596 - DNA, 252 bp, Glycine max
  Peptide Sequence Number=SeqID_128374
atggacgatgaaaaaagagaggaagatacagacaataagactgagatatccttggtaggaaaaggtcaaggtttaagctggtacctggacaatagatgcttaagacacatgacaagggaaaggtctatgttcctagatttaaagccacacgagggaggagcaattgcctttggagacataggtaaaggaaaactctctggtatagacaaagaactaaggtggaatgatactttttcagaactaaaacaataa

SEQ ID NO: 11597 - DNA, 1494 bp, Glycine max
  Peptide Sequence Number=SeqID_128375
atggccatacctcaccacagagaagaggtcagcgctgaaaaactggaggagcaggctgtggtactggagaaagaactgatcttgaaagaaagggaaactcttgatgtgttgaaagaactggaaagtaccaaaaggcttgttgaagatttgaaatcaaagatacagaaggaagagtctgaagcaaatttgaatcttcagatgggaaaatatgataagaaatcggttgttgatgagaatgtagaaaaggaaaaccaaatgagtcaattgaatgttcttcaaccttccagggaaggttttatcccctacccttcatctactccaggcttaatactaatggaattgaagcaggccaaattgaatttaactaaaactactaatgaccttgctgacgtccaaacttctgttgaatcgcttaataagaagttagagaaggaaagaatctcacttgagaaaacacgtgataggttagctcaaaatactttgaagatatcttctctcgaggaagagctaaaccagaccagattaaggcttcaaatagcaaaagatgctgaaattaaaggtgctttagatgacccttcagatattacaagagagctccagcaattaagttctgaggcagagaatttcaaaagaatgggagaatttgcaaaatcagaagttttgagatcaatgtctgagattgaacagacaaaaaccatgataagaactgctgaaatcagattgctagcagccagaaaaatgaaagaagccgctagagctgccgaagcttttgcccttgcagaaattaatgctctatctaatcatgacagttcacctggaaatcaggttactctttcatttgaggagtatactgctctgatgggcaaagctcgagatgcagaggaacaatctaagcagagagttgcaagtgctacgcttgaagttgacgaagcaaatttagcaaacatggacattttgaaaagggtagaagaagctacaggacaagttaaaaccagcaagaaggcccttgaagaagctctagaaagggtagaagctgcaaatagagacaaggtagcagttgaagaggctttaaggaattggcggtccgagggtcaaaaaaagcgttcttctatacacaactctactaagttcaaaaactgttgcttgtctcatcatcggagagatcctcgattactcgatgtgaatggaatgcatttggtaaatgatgaagccaggccagttctaaagccaaccctatcaataggacaaatacttagcaggaagctgcttcaaccacaagagtttgaagccagagaaggaatctcgatgaaacagaatgtgtcactgggtaagatgcttggcaaacagaacaatgatcggccagttgacagacaagttgagaaagaaactggccataagctgttttctaccaagagaaagaaatttggatttgcacgattctcacatattttgtcaaaacagaagaagaagaagccaaccctgaatttgaggtga

SEQ ID NO: 11598 - DNA, 204 bp, Glycine max
  Peptide Sequence Number=SeqID_128376
atggaagccgctgacgtggtcgaaacgacgacgaatcatgccgaacggggtttggagaagaagaacaacaagagtggtttgagaacggagattgatacttcagcgccctttgaatcggtgaaggaagctgttactatgttcgggggtggttactggaaatcaccccttcacagtaatattacgtgtgtggcttctggttctgag

SEQ ID NO: 11599 - DNA, 243 bp, Glycine max
  Peptide Sequence Number=SeqID_128377
atggagagtgtatatgttgttgtgtattgtgaaggtgacatgatttcatcatctgaaggaatattgtttgaatgtcctagtggtcctaatgtcatcacaataagtgaggatatgtcgctagattctttaaggaaaacaattatggatgccatcggaggtgatggttgtgttgaatacaagtatatagagcttaaacatgacaatggtgagggaaaaatgttcatttatcttttcgaaagttag

SEQ ID NO: 11600 - DNA, 480 bp, Glycine max
  Peptide Sequence Number=SeqID_128378
atgggctcaaaaatctaccctaaggttcatgagaaccctagggccttctttagtagctctagcacaagcctcttggagtcttctatccaatacccttgggagcttgaccaagaagattgttcaaacatgagcttgaggcttttaaacaaaaacaagagctttccatcgggattggatgcggaaaaaacccaagcggaggggcaaaaaggtcatttcaagcatgttttgggccctggctcgcctgggccccctaatagcttagggggtaggttgcgacagtatgctatgaagaattcttcagacttagagctcactcctcaagctccatctgatccaaccatacttgttgttacagtctatgattcttcacccttcaaggagtatgttagactcattaaggttgagcttcttagaacgagggaagcacttgcacaagctcttgaggatcatgcccatgctgagaacaaaattatggagtga

SEQ ID NO: 11601 - DNA, 168 bp, Glycine max
  Peptide Sequence Number=SeqID_128379
atgggagagaaacgccttcataagaaggcacttgtccactggttccatgtagtgatgttgttctcagtttcatctcaccgtattagtcaacttgatgaacttcctcaagtgttgcgtaggatcttcatggatagtgccactgaatgggttgttctcgagcatttgtag

SEQ ID NO: 11602 - DNA, 408 bp, Glycine max
  Peptide Sequence Number=SeqID_128380
atgcagttgaggtttcagcttcaggggagaagctctgtaacgaagggaaaacaagggagggttaaggagacagagggtgttttgaatggagcagtttattctcactgccatggcttcttctcagttcagaagattctcagtgcttacaccaccatcaccgccgatgccattgctcgcttccagaacaagatgcacggtatcacgcacatggatgctgccctggacgcaatgcgtccacttggatttaggacacaactgattcttcgaacggagcttcttcaggtgtatggtggaaatcaaggatggtgctttattgaagaggcctattacaagctcctaatggaggccctacttagcaaacaacaaggttctgcagaatataaggtgggaatggaacttaccaaatag

SEQ ID NO: 11603 - DNA, 828 bp, Glycine max
  Peptide Sequence Number=SeqID_128381
gatgatggggaaattgaaggggatgtgaatcatcgcattcaagcaggatggatgaaatggagaaaagcatcgggggtgttatgtgatgcaaaggtaccgatcaagctaaagggaaagttttatcggactgcggtaagactggcgattttgtacggaacagaatgttgggtggtcaagagccaacatgagaataaagtaggtgtagcggagatgaggatgttgcggtggatgtgtggtaagactcgacaggataaaattagaaacgaagctattagagagagggttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagagaggttatcaaaaaggatctcgaaattaatggtttggatagaagtatgtcatggatgtttgcgcatcttcccagtgttggctattccgagggtgggaccggtgctctagatgatctagtagccaacaagaggggtccttgggcttgcacatctgactatttaccttggttttacaaggtttcccacccctatgtcaatcctccaaggatggatagccaccacgtcctcctgagggcttcgaagcttggtgtaactcagaaaggcaaaggaaaagggctgcctaggccaaggacaaggatggtgacaagggtgacaagatgggtggcagaggcggatgatttcattattatttttacatgtagtatggaaaattttttgttgttttga

SEQ ID NO: 11604 - DNA, 363 bp, Glycine max
  Peptide Sequence Number=SeqID_128382
atgccacaatctatgcccggaggaaggcaaatggagccaccaatggtggaatcaatgggagaacaaagctcgaaggaagaaaaatcatacaaatcaaaaggaacaaacaatatcgatgaaaacattgctttgaagggcatcatcgtcgatgaagatgaaataaggaggagaagaaagagtcagagaagaagggaggaagaggaaatcaaattgagcgggttggaggttgtttgtgccctttttcaaattcaaatttcactaacaccagaagttgcaattagcacacactttccttactctggctatagtacaacagatgttgctgctagtggtcccttaaaaaccaaaacaaagtcaacttag

SEQ ID NO: 11605 - DNA, 261 bp, Glycine max
  Peptide Sequence Number=SeqID_128383
atgcctctgcctgtggctttgctagctgctattgtcgaccgcatgctaacgcagtcagccttcgatgcctctcttcaacatgatccccgtcatgtgaggggcccaggccctaatgagagggatcgcatgcaacaatatacaaaggttggggaagggaagggttgcgcgaagaagggagaagggaaggttggggaggaggtgggagtgtttgtcgtggttagggatagggttagagcacgaggaaggggaagggggtgctag

SEQ ID NO: 11606 - DNA, 403 bp, Glycine max
  Peptide Sequence Number=SeqID_128384
atgggggtagcaacgttgagtgcagcggtgaaggtgaagtttccggcgtcaagctttgcggtggtcggtggcagcaaacgaggtacgcagatggtgtttgttcgtcgtggacgtacggatgacttccggatcaagttgatctgtaaaaagcttacggatcaacttgatccggaaggatgttacagatcaaatgagtggatgtatgaaataatgtctgaacgagcggatatggattatgaaaatgcagaatcatgtggtgcgaatgaaccacatgttgattgttcggatgcgttcaagacttctcaggtgtttgagtgccgagaggatgttttgcggtgggctcgatccgtggctcatgaaaacggatttgtggcggtgattttaaggtcagacacaaacacag

SEQ ID NO: 11607 - DNA, 792 bp, Glycine max
  Peptide Sequence Number=SeqID_128385
atgagcagcatcggaacaggttacgatctctccgtcaccactttctcccccgatggccgtgttttccagatcgagtatgctgccaaagccgtcgataacagcgggactgttattgggatcaagtgcaaagatggggttgtgttgggcgttgagaagcttattccgtcgaaaatgatgcttccgggttccaatagaagaatacactccgttcatcgtcactctgggatggctgtagcaggattagcagctgatggcaggcaaattgttgctagggccaagtctgaagcaactaactatgacagtgtatatggcgaaccaattcctgttaaggaacttgctgaccgtgtggctagttatgtgcacctctgtacgctatattggtggctcagaccttttggatgtggtgtcatactaggaggttatgacagggatgaaccacagttgtacatggtcgaaccttctggtgtttcttatagatatttcggtgctgcaattggcaagggcaggcaggctgctaaaacagagattgaaaagttaaagcttgctgatatgacatgtcgacaagggcttattgaagtggctaaaattatatatggagttcatgacgaggccaaggacaaagatttcgaattagaaatgagctgggtgtgtgatgaatcaaaccgccaacatgagaagcttgttgttaatctatatgctgctgaattaattcttttacaggtaccagatgagcttcttgaattagcaaaggcagcggccaaagcagctcttgaagaaatggatgcagattaa

SEQ ID NO: 11608 - DNA, 1053 bp, Glycine max
  Peptide Sequence Number=SeqID_128386
atggctcataaaaataggatctcaatcaaatatgaggctctttgggaagccatgaagcttgcaaacaatgttgatgaaaagttgagcaactttgtgagcagtaaagtggctttggtggttagtgatgatggtaaaggagtttacaaggagcttggggaagaactgttagctaaagaaagtgatggggtgcaccagagcttgagtcatagctcgtttgagatgttcaaatgcaacaagagagttggggccccaaacaaagttatccttattgagaagggaagtcaaaggagtggtgatgcaagcacaaaaccaccatgtgccatcctttttacgaacaaagaggacagtgaggatatcaatatagttttattttcacaagggctgccccaggaagaacataaatggcatgatctgtatgttgaggagggggaaggacatgaggtgcatttaaaactgatttgggccaaatgggggtctagaggatcgcagatgtctggggtggaagacttagtctctagcgggggtgaagtgaagggggtagagttggtacacgaaacaaatggtggggattttaaggaaaatgcggttgggttatggggagataagggtgagaggcttgagagcttgaacttcacggtggatgtcgggggacaagccaaaaatgaaacaactcaacaaaaagaagtggggagacccacaatgcaattggccaagctctcaaaatcagcaagggagcaaaacgcaggtcaagtgcttgctagaatgactgccaagactgcatctgcgggggacatcgagcttcatatgatatttagagcccaagggagaaaggggatcaattttagtattggatcctttagattcgaggaaagagaagctattaagaacctcatcaagtttggagtggaaggagctctaggtagtggtgagagaggtttgggcatagcaccaaatgataggtgttggatctacaatcaagagaaaaaggataatcatgtattcaaggtcaagattgtacctctagaatataaggaaagaaagagatatttatga

SEQ ID NO: 11609 - DNA, 489 bp, Glycine max
  Peptide Sequence Number=SeqID_128387
atgtcacatgactttagacatgaagaacaagagctttttgaagacccctgttatatacctgatcctgtatccttgcttggtcctgtttctgagtcacttgataattttcaattggacttgggaagtggctttgtgacggacacggagataccaaagcctcactctttaaaaaacacagctgctggctctgacatcaataaaccatctccaattgagtctccattgtcccgagaaaagaatatctgttctaatcggtttccaagtatctcccaggcccaggatatgcatccatttcctttggataatgcagctgcaaatgagaagggaacatggcagatgtggaatactttgccacttggtcaggaagtggtgggaccttcagcccagttactggttcaaatggttatgatccttggttacagaatgctttatttccacgattgtccggtggacttaaagctcaggagagtgctactcagaatgaaatga

SEQ ID NO: 11610 - DNA, 483 bp, Glycine max
  Peptide Sequence Number=SeqID_128388
atgggtaagggttggggtcctggcactgctggtatagggtatactggtagaaactattgttcaaatgcacctaatccctatgattggctgcctgctggtcagccaaatgctgcatgtagagctccatcctctacatgtgagtcaagatggactctagagatggtggttgctgtagaggtggaggtggtgcgtctgcggccgactattgttgttggtcttgccccgactcctaactggcaaagacatgtgatcaaggctgaaaatcctaatgctctgttggacttctctgggtccactgggtgccttggaggcatgatacctacaaactggaaggatgttgctgaggagaagtgtcatccagatttgtgtcaaggtggtcatgctagtgcatatgatccgcacctgcctccccgtcacgctttgtgcaaagtcttgtcccatggagcacaacagttgtcccatgacctcctcatcaaatcctga

SEQ ID NO: 11611 - DNA, 156 bp, Glycine max
  Peptide Sequence Number=SeqID_128389
atgtttggctcaaaagacaagttcacagatttagaagatcctggtcgagaggctcagtctcctcaaaggaaaaaatccatgacatctgccatgtcaccgtcttccttagctccgtcttctcctcctggggcctctacgggacctgcccctgcctaa

SEQ ID NO: 11612 - DNA, 258 bp, Glycine max
  Peptide Sequence Number=SeqID_128390
atgactgtacatctgaggttggatgtagattgccattatggggcctggcaacagatgaattccctaagccttccacagtaccttttacaggccattcatttctgcaaagtttcagatttcaagccgttaaactaccagaggaagaccatgaattacaggatcaaggaaagaacacacccaagacaatgtcagcacagacaacaagccagaagacttcacaacacacgttggctttaccattaccttgcattaggttaa

SEQ ID NO: 11613 - DNA, 239 bp, Glycine max
  Peptide Sequence Number=SeqID_128391
acacactccctcctcaagatgagcatactccttcacctcctcctcagcgtgaagattcagcactcctgaatgaagtccttaccgaattacgaggtcttcgttcttatgttggtgaacgtttcgactcattggatacacgctttgccagcatggatattcgcctcacacaagttgaagaagatgtctccttcatccgtacttgctttgatccaccaccaccgcctccatcatcctcttag

SEQ ID NO: 11614 - DNA, 842 bp, Glycine max
  Peptide Sequence Number=SeqID_128392
atgtccatagcaggccttatagacccagaaatgaatcacaacaagtccttccaccggcgaaataactccggcgagctcgatgtgtttgaggcagcaaggtacttctcaggatacagtgaagttcttggctccaccaccaccacctacactcagaagatcaatatgagagaagaaaggcaccatcatcatcatcatcatggacatagagctgccagaatcagcttagacatgccaatgagaagcttgctcccacagcaattccatggcatggagaagcaaatcatcatgaaggagaagaagcacaagcagcctagctctcctggtggaaggcttgcaagcttcttgaactctctcttcagccaatcagcatcaaagaagaagaagtcaaataagtcaagctcacagtccatgaaagatgaagatgagagccctggtggaaggaggagaagaaggagcagcattagccatttcagaagctcaagcactgcagattcaaagtccttgtactcctccttgagttcagggtttagaactcctccttatgtacaaacaccaacaaagagctgcaaggaattcagaaccttctcttcagaaaacaagcatgcactgtccttttcagcaaagtacaacaataacaagaacaacaatggacaacatgtaagatcatcaacagcaaccaccactttgcaaaatgagtttttgtgggatgagaagaaaaagagggaaccaacaacaacaacaaccttgttggatgataatagcaaccacaaacacttatcagagaaacaaaagaacaacaacaacaagggaagtcatgagttattacttgagaaagataggat

SEQ ID NO: 11615 - DNA, 192 bp, Glycine max
  Peptide Sequence Number=SeqID_128393
atgggggttgcacacactggttggcggacgagtatggggttgcactatagtgatggaggatggggtggggttgtgcgattgtggtggacaggggttgggttgtgcgcggtgctgatggatgaggattgggtcacatgcggtggtggatcgaggtttggtggtgggaatagtagttctcattcccatgcataa

SEQ ID NO: 11616 - DNA, 435 bp, Glycine max
  Peptide Sequence Number=SeqID_128394
atggaaatgatgatcaatgacgcatttgaacaatataggcaacatgaccctaatgtaggtgcatcacaaccattaaatgaagatgaaatagtaaatgatgaaccaagagaagatcataatggcttttatgagcttctaaacgatgggagccaaacattgtatgaaggaagcaattatgctaagactcaagcctatatgcaatgtggtaccatgtcagtgaaaaacctcgtcgggcgcctaggagtacatgacaagacaaaccacacactagaaagtaaatcagagtcacagtgttttgcgagaatgctccaaccatatgggatcaacataggcttaaaggagctctcaaaccgtgtgacccccaaggcctacactccgaagagtccgttagggcctcttcctcctgattcaggtccaacccagaaaatattttag

SEQ ID NO: 11617 - DNA, 517 bp, Glycine max
  Peptide Sequence Number=SeqID_128395
atggaggaagctgctcaatctggaagcactgacaccgtgattgatccttcatctcccattagacgacacaagaagtggaagatggctcgcaccaagaaaactaggcaaatgacgtatgaggcagcaaaggaaattgctaacaagattgcctcacagggttcctttgtcgcacatgaacgtcaggatggactcgcactgcctcttgagccaaaggttggtccttcagctggtcgtgtcagcacaaaggagagttgtgttgatccctcagggaacaactcagacacgggtgacttagaaaaatgtgggttgtacgttgaaggaaatcctccccgcttggttgccttaggaagactttatgaagggtccataaccgttcacaacatggctttatgccatgatcaacccaaggttggtcatgtacccattcatgtacccactcaagaggttcagttagtagggcagacacttaaccttcgttgcttggttgatacatcttgtgaagcgtttatcattacag

SEQ ID NO: 11618 - DNA, 195 bp, Glycine max
  Peptide Sequence Number=SeqID_128396
atgaagcctttacagggaaccactcagacgttgacacgtggcattgacacgtggcagtcaacgggggccaaatccgtaattggagataaagtaggggaccaattttgcaatttttccaaaaatcaaggagattcaagtgaagattcaagagaagactcaagatatgcaagaacctcgagaaaaacatcaagataa

SEQ ID NO: 11619 - DNA, 822 bp, Glycine max
  Peptide Sequence Number=SeqID_128397
atgaatttggccaacgtcgatctcaacttgctggtggtgttcgaggcgttatatcagacgcgcaacgtcaccgccgcaggccggcgtcttaaccgcgcccagccctccgtcagcaatgccttggcacggctgcgcacgctgctgaacgatccgctgtttgttcgcagcggcggcggcatggcgcctacgccacgcgcccatcagcttatgccgcagatacagcaggtgcttgaacagatccatctggcgttggcgccccctgcccgtttcgatccggccaccgccgggcaacggcgctttacgctggcggccggcgactatgccgatatcctgctgctgcccgctatcatcagtcggttacgtcagacagcacccggcatcgatattcgcgtttcgcgcctggatcgccacaatatttaccggcaactggatcgcggcgaggtggatatcgcgctgggagggcacctttccggagcggaaagccactatgtgcgcacgttgtttgaagaacatctgcctgccgcatgggctgtacgcaccggcagacgacggctctgccaggggattggtcgaccggcgcctggcggaaatcggcggtcaacggcgcgtcgccgtaaccttttcacatattgccgctctgccggctgtggtcgccgacagcgatctgatcgccaccctggccgccagcgcggcccggcatttttccgatccgcaacgcgtacgcattctcccgctgcccgacgagtgggcatcgcgcctttccccattgagctgatcgccggcagctggcgcaacgcaaccggcgttaatctggctctgtga

SEQ ID NO: 11620 - DNA, 418 bp, Glycine max
  Peptide Sequence Number=SeqID_128398
atgatgaacaaagtcttgatcaccggcattgagccgttcgatggcgatgcggtgaatccttcctggcagattgcgcaggcgttggccggtgaacatattgccggcgcggagatcgcggcgctcgagctgccttgcgtgttgggcgaggccaatcagcaattgatcgcggcgattgaggcgctgcagccgctggcggtgatttgtctgggcctggccggcggccgggccgagatatcgctggaacgggtggccatcaatctgatcgatgcccgcattcccgacaatgccggtaaacagccggtcgatataccggtggtggccggcgggccggtggggtatttcagcacgttgccggtcaaggccgcagtgcagcagctgcgccgacaggggatcccggcggcggtctcttatacggcag

SEQ ID NO: 11621 - DNA, 804 bp, Glycine max
  Peptide Sequence Number=SeqID_128399
atggctaaaagtggacttttctggcaacaagcatttgcttccaaattgtcatgcaacgaaggatgtgatgcatcagtactattggatgacacatcgagtttcaagggtgagaagacagcaggtcccaacgctggttcgattagaggttttaatgtaatagacaccataaagtctaaagtggagagcttatgccctggtgttgtttcttgtgctgatatccttgctgtagcagcaagagactcggttgtagctcttggtggacctacttggactgtgcaattgggtagaagagactcaaccactgcaagtttaagttctgctaactcagacttgcctgctcccacttcaagtttaagtgcccttatcagttctttctccaacaaaggtttttcatctaaagaactggttgctctttcaggatcgcacacaattgggcaagctcaatgttcaagtttcagaacaaggatttacaacgacaccaacatagattcctcttttgcaaaatcattgcaaggaaattgccctagcacaggtggtggcagcacattggcccctcttgacaccaccagcccaaacaccttcgacaatgcttacttcaagaacttgcagagcaaaaagggtctcttgcactcagatcaagagctcttcaacggaggatccacagactctcaagtaaattcctacagcagtaatcctgcaagtttcaaaactgactttgccaatgcaatgattaaaatggggaaccttagtccactcactgggtctagtggccaaattaggaccaattgtaggaagaccaactaa

SEQ ID NO: 11622 - DNA, 231 bp, Glycine max
  Peptide Sequence Number=SeqID_128400
atgacaggggactttgagtcctatgaaggtgaggactttgagtcctctaaaggcgaggactttgagtctaaggaaagcgaggactttgagtcctatgaaggcgaggactttgagtcttatgaaggcaacgaccttgagtcctttaaggcgaggactttgagtcctttgaaggcgaggaccttgagtccaataaaggagaggactttgagtcctctaaggaaaggaatttga

SEQ ID NO: 11623 - DNA, 183 bp, Glycine max
  Peptide Sequence Number=SeqID_128401
atgtcagaattcacgagcgattctcctcaaatttcagccagccaacatcaattagaccttgcaccttatgtttcagggtcctacaatgctcaatggaatgccccgaagctcctccatggggtggcctttgtggctgatttagggttcctggctaatagggcgacgggtaatgagaagggctga

SEQ ID NO: 11624 - DNA, 366 bp, Glycine max
  Peptide Sequence Number=SeqID_128402
atggcgaatttggaggtggcgaagtacaacggagccatggggactagcgaaggtggtggtggtgggaagaataggaaagttgaaagtatccggaagcattactttgcaatgcaaagaagacttccccgatgccggcacttcgatacaacaaacgcgactgaagagtgtaaagtgatgttcctatgtgaaaaaactattgaggatttttctttgcctgatatacctgttagttttcaaggtaaaggtcgcagtttagaagggagagtgaattcgaatgacgagtgtggcaatgatgggttgagaataaatgctcctgttgttacttggataatttttttgtgcaacggaacaaatatcacctcataa

SEQ ID NO: 11625 - DNA, 780 bp, Glycine max
  Peptide Sequence Number=SeqID_128403
atggcacagtatggtaagctttacacggatgctgctgagaaggaaaaacgtttccaaatattcaaaaacaatgtgcagttcattgagtctttcaatgctgctggggacaaacctttcaacctaagcattaatcaatttgctgaccttcataatgaagaatttaaggcttcactaattaatgttcagaaaaaggaaagtggggtggagacagcaacagaaacatcttttaggtatgagagtataactaagattcctgttaccatggactggagaaaaagaggtgctgtcactccaatcaaggaccaaggcaattgcggcagttgctgggcattttcaactgtggcggcgatcgagggtatccaccaaatcacaacaggtaaattggtgtctctctcggagcaagaactggtagattgtgttaaaggtaagagcgaagggtgcaattttggttataaagaagaagcctttgaatttgtggccaagaatggaggattagcaagtgaaataagctacccctacaaagcaaataacaagacttgtatggttaagaaggaaactcaaggggtggctcagattaaagggtatgaaaatgttccttctaatagcgaaaaggcactcctaaaagctgtggcaaatcaaccagtatcagtttatattgatgctggagctttacaattttactcgagtgggatttttacaggaaagtgcggaactgctccaaaccatgctgttactgtgattggttatggaaaagctcgtggtggtgccaagtattggctg

SEQ ID NO: 11626 - DNA, 162 bp, Glycine max
  Peptide Sequence Number=SeqID_128404
atgaaacgagtcaaactcggtgacttgatggtcaaaaaccttttcggcaatgtcgttgccagtataatcctatcggataggggtaagaataggtcaggtcaggctttgaaaggcctgagcctagcctacaatgaatctttgaggcctaagcctggcctatag

SEQ ID NO: 11627 - DNA, 147 bp, Glycine max
  Peptide Sequence Number=SeqID_128405
atgaagagaggcatgacggaatcaaggaatatgccagagaaaactctagatgaggcttcactgtcatcaagcgattcggagactcagcatgaccacagattgacctccactccttatggctcacatagacccgggtatagggcctaa

SEQ ID NO: 11628 - DNA, 567 bp, Glycine max
  Peptide Sequence Number=SeqID_128406
atggatatggtggaactggcaaaacatttgtttggacaaccttatcatctgctatatgctccaatggtggaattgtttgtacagttgcttcaagtggaattgcttcattactctagcctggtggccaacaatgaagagctcaaacaattttcagaatggctacttgacataggagatggaaaaattggacaacataatgacggattttcagaaatcaccatcccatatgagtttcttataatggattatggtgatcctatccatgttattgttgaagccacttatcccaacttgatggataactatagtaacacatattacttgcaaaaaagagttgttcttgctactaaaaaggaaattgttgacaaaataaatgattatgtcttatcacttatacccaataacgaaagggagtattgcagcgcagatagtatcgataaatcagatgaactgctcaatcctgctttcgcattattgccacctgaattcttgtattcattgcaaacatcatgtatacctaatcataaattaaaacttaaggtcgggactccaatcatgctaatatga

SEQ ID NO: 11629 - DNA, 417 bp, Glycine max
  Peptide Sequence Number=SeqID_128407
atggaagctcctcagaaaagatcttaccactctggctcagacatggagcgtcttcttgtactcaaactagctcctacctcccgcacttcagatttgaacacagacagagctaggttggtctatggcttaatcacaaggatggacatgaacattggcgatttgatctctggacatatgaccatgatggctcagtctaactcttctcgcttaggctttccagctttaatcacaaccttgtgtagatcaaggggagtgggatctgatgcccttacctcctatgaaaacttaaggctggccattgacttagcttatatcataaggaactgtggaatgcgaatgaccaaacagttaaatttccagaggcaaggaagaccaagctcagagcagctaatgctccctcttcctttgggccaatag

SEQ ID NO: 11630 - DNA, 396 bp, Glycine max
  Peptide Sequence Number=SeqID_128408
atggcgtttgtgcgtcgcggacgtacggatggctttcggatcaagttgatcatggatgaagatgagtggatgtatgaaataatgtctaaacgagcggatatggattatgaaaatccagaatcatgtggtgcgaatgaatcacatgttgattgttcggaagcgttcaagacttctcaggtgtttgagtgccgagaggatgttttgcggtggactcgattcgtggctcatgaaaacggatttgtggcggtgattttaaggtcggacacaaacacaggagtgacgagtataagtgtaggaaaaaagaatttatcagaagagacactgagactacgaaatgtgggtgtcccttcaagcttcgttgcaagccagtggctagaggagaaggctggatggtga

SEQ ID NO: 11631 - DNA, 660 bp, Glycine max
  Peptide Sequence Number=SeqID_128409
atggcctatggattcagcgtattctggaagccgctaggcaatgcattgactggtgcagacggtaagcctgtggaggcttgcgccgccggggcaagcaccttcggtgacaaactcgcagggacagcaaaagccctcttcgctactgactgtaactggacccagtttgacctcggttggatgtataccctcttcttcgtactgttggggtgttcggctgcgctgtggggagggtggctggagcgggctggcccacgcaaagccggcttggtagcgatgttgtgctggtgtggtggattactgctctcagccttgggtgtttaccagcaccagttatggatgatgtggctgggtagtggcgtcataggcggtatagggcttggactgggctatatttcgccggtctctaccctgatcaaatggtttcctgatcgccgtggtatggcgaccggcctcgctattatgggttttggtggtggggctatgataggttcgccactggccaccaagctcatgagcatctttgcgacgcctgcatcacctggtgtctggcagacttttgtcgtattggcactgatttatgccgtattcatgaccttaggctcactgggctatcgtgtgccggcagccaactggaagccagcaggctggacaccgccagat

SEQ ID NO: 11632 - DNA, 339 bp, Glycine max
  Peptide Sequence Number=SeqID_128410
atgggcccaaaatctaccctaaggctcatgagacccctaggaccttctcttgcctttttggcccaatcttctcggagtcttctatccaatgcccttggggggcatggcacccgcgcggggtgggggcggggagtactccctcgccccccgtccgcgaaccttaccctgctccccactccccgtggtcggggtattttttgcctcgtctatggcagcaatgttttccaagtttattttgatgatgccaaagactcaagtcaagaatcaagagtcaagcaagtttcaagaatcaaagagtcattcaatcaaagtaagtttcaagaatcaagattaaagtga

SEQ ID NO: 11633 - DNA, 726 bp, Glycine max
  Peptide Sequence Number=SeqID_128411
ctgttgcttggccaccggacggccgcgccggtgcatcagcgcggtcagcaccgccagttcgcgcggcgtcagcgccagcggcttgccctccagcagaaaatagccttcgtcgtgataggtcaacgcgccgtactgcaacgccggctgcggggcgccgacgctgcggcgcagcagcgcccggatgcgcgcttccagctcgtccagttcgaacggcttggtgaggtaatcgtccgcccccagattcaggcctttcacccggtcggccacgtcggtgcgtgccgtcagcagcagcaccggcagatcctgcccgcgcttgcgcaggcgcgccaacaaatccaggccgttcatacgcggcagcgccacatccagcaccgcgagcgcatagcgttcgttgagcagcaggtgatccgccgccacgccgtccggggcgacgtcaacggcaaagccggcgccgggtcagcgccttttgcaaccatcgcatgttcccattccattgatttacctgaacaacctggcgccgacacggcgcctgttaacaggccgataacagagaatggcatggaaaataaggggataaaagagcgccgcgccgccagttttggggagctggcgcacaattatgcgtatggggcgcgatcgcagggcgggtgtcagatcagcggaatggggctatcggcaacggcaatgtccagcacccgggcgcagtttgtcggcggtaaacggtga

SEQ ID NO: 11634 - DNA, 583 bp, Glycine max
  Peptide Sequence Number=SeqID_128412
atgacattgcgcgccgaacgctccaaggttgcccgctcagccattccgtggcttactgccgccaccctgatactggccgccctcgccgccgccgcacaggcacagccccttcccccgcgcagccaatggcaggccagcagttcctcgcagcaggtgccggcgatggcgatcagccacctgatcgacggcgacccgaagaccgtcaccggcggcgccttcagccccggccactggttccagatcgatctgggcacgccaaccctgctggctggcgcacgactcacctgggatgtctccaacccggaaggctattcactgcagacctcaatggatggtacgcagtggcagaccgcgtacacgatggccgattcactgggcgatgtggaaacgctgtacttcgcgccgcggcaggcgcgctatctacgactggccagtccgcagcgcacctccgactggggtgtgtcgatcttcgagatggagccgctggacagcacgctcagcgcacgcatcgccgatgtcgatgcaacacaggcagccgcgctctggcaaggcggcggcaccattgcggttccgaccggaaaag

SEQ ID NO: 11635 - DNA, 1173 bp, Glycine max
  Peptide Sequence Number=SeqID_128413
atgccgacgtgcgccgacgcatcggcggcagcgctcgcgaggagctgcagcgctacccggcgcaggcctttgctgccccggtgggcgccttcgtgctgctgctgcgcgacggggtggcgatttccggcggtgcgttcatgccgcaccgcgatccggataccgccgaattcaagcgcatctggacactgcccgggctgcgtcgccagggcattgcgcggcgcgtgctgcaggagctggaagagcaggcggcgcggcaagggtaccggagggccgacccggaaacggttgcgcatctgccgttcgagaagcacctgcgggcgacgacgcccgtcgttgcacctgcacaggcactgctgcacggagcccacgcatgagcacaccgtcgaccgcgctggagggcatcgccgctcgtccggcgcccggacaggcactgaagatcgtgccggcccgacatccgctgcaggtcttcggcacggtgctggcactggcgctgatcctgatcgggctgcagtccgtgctgggcaatccgcgctggggttggggcaccttcgccgagtggttcttcgcacgcccggtgctggaaggcctgggtcgcacgctgctgctgaccgcgcttggcaccggcctcggtttcgcgctgggtacgctgctcgcgctggcacgcgtctccggttcgccgctgctgtcggcggtgtcgtggggctatgtgtggttgttccgttcgatcccgttgctggtgctgttgctgctgttgaacaacctgggctatctgtacagcaccatcgaactgggcgtgccgttcaccggcatcagcctgttctcgtacccgaccacgcagctgatcggcgtgttcaccgccgcggtgctgggcctgaccctgaaccaggcagcgttctcggccgaggtgatccgcggtggcatcctctcggtcgaccacggccagtacgaggccgcggccgcgctcggcctgccgcgtggccgccaggtgcgccgcatcatcctgccgcaggcgatgcgttcgatcctgccggcggcgttcaacgatgtgatcggcctggccaagagcacctcggtggtctacgtgctggcgctgccggagctgttctacaccgtgcaggtgatctatcggcgcaacctggaagtggtgccgctgctgatggtggccacggtctg

SEQ ID NO: 11636 - DNA, 297 bp, Glycine max
  Peptide Sequence Number=SeqID_128414
atgatgttgacgttcaacaaatgttcaacattttttacaataacccatcaagcctatatgcaatatggtaccttgtcagtgaaaaacctcgtcaggcgcctaggagtacatgacaagacaaaccacacaatagaagaccagtcagggtcacagtgttttgcgagaatgctccaaccatatgggatcaacataggcttaaaggagcactcaaaccgtgtgacccccaaggcctacactccgaagagtccgtcagggcctctccctcctgattcaggtccaacccaggaaacattttag

SEQ ID NO: 11637 - DNA, 2898 bp, Glycine max
  Peptide Sequence Number=SeqID_128415
atgagtgagagagatttacaaacacctggtgtggatagctttctttacttgcatccaagcaaaaatccagcggtatcacttgtttcaccagttcttgattcttcgaactatcattcatggaggggatcaatgatgactgctctgagtgcaaagaataagcttgaattcatcgatggaggtgcgccggaaccgctaaaggttgatcgaacttatggagcatggaggcgctgcaacaacatggtggtttcatggatcgttcattcggtatccatgactattaggcaaagtattttgtggatggataaggcagaggaaatctggaaagacctaaattcagatatgcgcagagtgatctttttaggatctttgatctccaacaagaggcaacttcaattaggcaagcttgaggataaagcaattcaatttctcaaaggattgaatgaacaatatggaaatgtgcagtcacatgtcctcctcatggatccactacctgaagtatcaaggatattttcctatgttgcacaacaggaaaggcaaattggaagcaatttgatagctgctaataacatagacatgaaaggtagtttaattaatgcagtgaaattggcctgtaattactgtgggaagactggacatactgagaatgtttgctataagaaacatggagttccttcaaataacagtgaaaggaacaagtccagcagccataggagtgggaatcatggattcccaccaggttacaggttttctaacccaaggagaagtgctaacagcttggtggcaggagatgatgcagtcaccaatgatcaaacacagcttttagagtccaaggagattcgtttttcacttgagcaatacaaagcattgcttgctttaatccaacaaccaactgatgggaactcagctaacatgtcatccaatcttaaacagatagcctcctgttctgctgacacaacaccagctcatgcaactgatcatgtaccagcctcacttgatctttttaaatcctacactcagctgaatcctcctactgtagttagactaccaaatggccatcatgtcactgctacttactctggtgacatatgcatttcagattccatcatcctgtcaacagatgtgatcactcaagcgaagattggtacaattgaagtgagaaatggattgtactacctcaccccaaactatatggccatatccaacattgaaaccaacattgttcatccacattgtaccattacacctatagatctttggcactttagaatgggacatctttcctctgaacgtttacgaaatatgcagtcaacctatcctttcacacatgatgttgtgcctataagcttacccacatctagtgcacatatagaaaataattcagccacacctttacgtcgttccacacgagatagaagacctcctacataccttcacgactatcatgcatttcttattgcaactgctaataccaattcagcttcagtgagccatcctctcggttattcagcttcagtgtgtcatcctctcgattttgtactatcttatttgcatctatcatcatcccacagacattttgttctttccatttctacatctactgagcctaagacatatgatgaagcatctcaacatggttgttggcttaaagcgatgcaagccgagttacaagctttacaaacgaataacacttggacccttacagatttaccagctaataagaaagctattgggtgtcgttgggtttataagattaagtatcatgctgatggctccgttgaacgatataaggctcgacttgtagccaaggggtatactcaaatggaaggattggatttccttgatactttttctccagttgcgaagctcacagcagtccgattattgttagcattggctgctattcatggttggcaccttcgtcagctcgatgttaacaatgcagtccttcatggagaattaaatgaagaagtctatatgcagctgcctccaggaatgcaactctcacaccttaatcaagtttgtcgattacaacgatcactttatggtttgaaacaggctagtcgacagtggtttcatcgtttgtcctcatttcttcttactcatggtttcactcaagcttcaactgatcattccctctttctttgtttcaatgataactcatttactgcacttttggtgtatgttgatgatatagttctaataggaaatgatataatggctatcaatcgtattaccatatttctggaccaaaccttcaagattaaagatcttggcactttaaaatttttccttcgcattgaggttgcttgttcccaacaaggcatccatctatgtcaaaggaaatatgttctagatattctctctgattctggaatgcttgcttgtcgtccagcttcaacacctatggattgtactactcgtcttcaagcaggcataggagatcctttacccgttgaagactcctcttcatatcgtcggcttgttggtaggctcatctatcttactaacactagaccagatatttcttacgctatgcagcaattgagccaattcatggctaacccaactaccgatcactcaaaagccgcctctcgaattcttcgctatctcaagagttcaccgggatgtggcattttctttcctacaactggttcaactcgtcttcaagcttttagtgattcagactgggccggttttcgtgacacacgtcgctctattacaggcttctccatcttccttgaaaaatcactaaatggccttctcaagcttcttctagttagatcctccatgcagcttgttgatgtttttaccaagcctttatctcctactcaattcaagactctagtttccaaactaggaatgatgaacatctattcccagcttgaggagggctcttag

SEQ ID NO: 11638 - DNA, 321 bp, Glycine max
  Peptide Sequence Number=SeqID_128416
atgttcagccgtcaaggtcttggccgtgccaaccattgttcacaactctggctccctcttgtttcttcttcttctaaccatgcaacaacaatatctcttcaatttggtgaattcccttcagggcttgcacccgtgggagcagcaattagagctgttggtgttttcgcaagccacaaccaaacagagaaaaggtgcagggataggattaatgctctgcggtgtaggtcaccactcaaccccctcattgtcacgatgttggtaaccctcgaggaacaagtagcagaccagcaacgcaccattggagacgcagcagcagactag

SEQ ID NO: 11639 - DNA, 219 bp, Glycine max
  Peptide Sequence Number=SeqID_128417
atggctgccactgaaacagagcagcaggttaccttgaagcttatggttagcaaagaaagaaatgaagttttcttaatcaaggcagcaaaggactttggggaagttatgcttagcttcttaacatttcctttaggaaacattgctatacaaatggaaaaggagccaattgaggttggatcactgagctcactttatcaaagtgtggcaaatattgaataa

SEQ ID NO: 11640 - DNA, 723 bp, Glycine max
  Peptide Sequence Number=SeqID_128418
atggaaagtgtcaaacatctttttttcaagtgtggatatcttggccaaattaagcttcctttcacaaccatagaccaaccacactgcggcttattggctatacatgactgtgaacagcactaccaacacgctcccagaaccgtccaactaagcaactcaacatcgaaacagtacactgttctacagatagaacctcgtaccataattatcacagatgatgaacaagatcattatttgcgaaacaaaagttgcaaaaccttcagcaacaattttactcttcatcacaacactcctttagcttctttctacatcaaatataatatcactatcttcagatgcaatcactctctcagaggatcccttcatgaaggttttaataaatattcaaactgttctcatcagtaccatatctactatggctatccaaataccgaaactcctctggattccaagtggccgagatccttagcaccatgttcaaccattcagcttgcaacacaagcaacgtctactgttgacccctttcaatttctatctggtaatatcgctattgaagtacaattaactgatgattgtgaaaggtgtcttcttgatggaaaaccccaatgttcacttgacactgaaggaaaactcaattgcgccaaagttttggccaaggagacacaccttcatgtagtccaaaaaagagctgaacgagttaagggaacaagtaaagaatgctga

SEQ ID NO: 11641 - DNA, 451 bp, Glycine max
  Peptide Sequence Number=SeqID_128419
atggggaaacctgtggagatgacgagtttaagggaaagtacgggctgcagaccacatgtgtacacttacactgttcttgctagtagaccacatgtgtacgcttattcaaatggtgaggatatggaagaggctcacaagatcttcgtagaagcaaaaaagaagcatgttaaattggggcatctgatgtttcacgctctgattcatggatattgcaagttgtctcttggtgcaagattatggtgtcgtccaagcgttgatgagtatgacaagttaatacagtctctctgcttgaaggctttggattgggaaatggcagaaaagctacatgaggaaatgaaagggagtggtttgcgtctaaagtgcatgatgaggggtttgattagagctgttaaagagatggacaaggaggttgttgaggctttagagcattgtcgcagtggtgtaaacattg

SEQ ID NO: 11642 - DNA, 1122 bp, Glycine max
  Peptide Sequence Number=SeqID_128420
atggtgagtatctcaagggcacttcaaactttctacctgactatcttacccgtaaattcttacagaaaaattgttatactgcctaaggcatccagtacctccttgcggggaggaaagagtaacggaaaaggtttcaagttggctctaccaaagccatccttaaagaagatttcatccttaaagactgggtcatcaacccaatctaggtcatcaacccagaaatgtaaacaacaagatgggtcatttacccaactcgttgaaatcaaacttgagttagccactcaggaaccttcaaagaaccaaacatcaaaacaagccaaggttgaccatgcctttccaattgagacatttttggtccttcaggatattggcctgacaaaactcccaaagaaaacatgggctgacatagcctctaaatcatatgatgaatatgaaattgatctaaaaaccttaatccaaaaagccaaagacacaaaagttatctacaattctccaaaagaaaaacatataataaccccaatagcaacaccagccccaaaacccactaacaattatatttacaaaaataaattttcaactgttttgcagatggagctcgaatattggaacaataatccctttaaagctacagttaaggcatttcctcccgaattccatttcaaaccggaatcaagaattctggcagatttaaaatatttttccagttttgctctatcctggatattttcctggcaatacaagtatagaaaaacggaaagcaacaagatatttccatcccttcagcgacatgcatttgtcaagtggtggaatcaatttgacacatcaaaagcagaaccagacaaggtgaaaatctggtttaaagctcatctagagttcctaaaagcaactgatccagagatttctttgtttctcaatcagaagtcccaactagcttcccttatgaatggatccaactccaaggaacatctcaccaaaaacttaaaagaagttttgcaattactccaaagccaagaagaaaggagttcttcctccaggaaagaatacgccaattcttttaatcatgatgatgatttttaccaaaacgaagatgattgttttggtatttgtttggatgaagattaa

SEQ ID NO: 11643 - DNA, 726 bp, Glycine max
  Peptide Sequence Number=SeqID_128421
atgaggcttcaatccaagaagattcaagagtcattaagtggacattctgataatgaggagtcagatacatttatctctgaaaaatcatttcaaggcacaaaatcactcctagaagttaattttccagatactaattctcattctgagctaattaaggatgatggtttagaaaaagagatagaatcccatgaaaaactgtgtgctgacaagtcagatggtaaggatggaaatgagtttgggagcagtgtcatagatacttgtggaacaccaccaagtattgacaacaccaatgacaattcattgaccaaggtaaattgtaccaccgaggattccctaacctcacttcttgactcttccattgtggataatccacttaagtttgaccatgaggaaaattacaaggtactttatggagaaaggtctaatggagataccaatggagaaagaaaaatgttacctgattctaatgcctgcaagcttgccaccagtgatcaagtcgaagaacctaaagtcactgagaatggagtaccattctcagttgatgcttatgttaacaactccaacaaggcttcagaggaaagtggcgctgtttcagaccaaaaacattttgtggttcttgaggccaaaagggtttcttttattgcagggttaactgttgttgattccaggcataaggaagaggagagttacaagaataaaattgaaaacattatgttagcattttga

SEQ ID NO: 11644 - DNA, 417 bp, Glycine max
  Peptide Sequence Number=SeqID_128422
atggggtctgttccaaaagaaataacggagggggtttgttttgcggaggaaaccgccattgccactggcgccatggctgaacccgccattgccagttgcggcaaagctggagagaggggccacgtagatggagagaggagggtgtcgccaatgagaacggcgacacacacccagctggagccgccatcacgactggcgggcactgttaggacacgttattttatcaattctaggccattgttagggcagatttttgcttcagaaggatgcagtaatagcaggtctaggcatgtggagagtaaacttccaacgacactcaacactcaaaaatttaacattgaagagagtatcagtgtggaagaggaagaaaaagtttcatttgaagagagtattttgaagtttgctgcttctatatag

SEQ ID NO: 11645 - DNA, 482 bp, Glycine max
  Peptide Sequence Number=SeqID_128423
cttgtggttacgtgagcatgaactactaccaatatatagatgttgtttacaccaatgagcacatcttaaaagcatactccgcacagtggtggcctcttgggaatgaagcggaaattcctccttctgatgaggcatggacactaatccctgacccaactacaattcgtgcgaaagggcacaataggcgccgatgtccaatgcaatctgaccgtgggacggccgccaccgcgggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacacggggaccgctacacttgccagcgctgatgtccggcgggtgctttttgccgttacgcaccaccccgtcagtagctga

SEQ ID NO: 11646 - DNA, 370 bp, Glycine max
  Peptide Sequence Number=SeqID_128424
atgcagatcgatactccaagtagaacccttacccggtggaaacctgaactgaaaaggatcatggcttctccacctgcctccaatcctcctcctcctccttctcctcctcctcctcctcttactccttccgacgcatcggcttcgccgtctaccataaagcagacacacaaagcctcacgtctaagatcgttgtctactagaccacttggtgcagagagaccagtggtccatgtttatcctgctaccggcaaggccgacggtcctcacaggaagaaattaagaacatatttggggattgtggcgagtgataaggtggacatcacctacgagaactggaaggtgggcgtcacatatttgggaggatattcag

SEQ ID NO: 11647 - DNA, 408 bp, Glycine max
  Peptide Sequence Number=SeqID_128425
atggcgggttcagccatgccgccagtggcaatggcggtttcctccgcaaaacaaaccccctccgttatttcttttggaacagaccccatcccggtggcactagctaattggagtctcacacctcaaagtgaaaagatgctggtttcggctttggaaagggtgtgtttttgtaatgataatgatgatagtatcactgatgacaataacagcaatgtcagaagtgttagtgatggtgatagtttttgtgttgatagcaaagttaatggtggtggtgtcaatggtggtggtgatgacaaccctgacgataaaggtgatggtgtcatgccagcggtgatgttggtaccgatgacaatggtgatagtgataatagtgataatgatgatggtgacggtgattgtgcaatactga

SEQ ID NO: 11648 - DNA, 165 bp, Glycine max
  Peptide Sequence Number=SeqID_128426
atggagatatttggccttggcattgagagcaaggtattgcaggaattgattagacagttaatagttgtagaggttaaaaagaggcatattagctttgacaaccttgctgctaggaaaaatgaaaatgttaattcattggcaagtgtaacaaattgtctcaagtaa

SEQ ID NO: 11649 - DNA, 1792 bp, Glycine max
  Peptide Sequence Number=SeqID_128427
gcgtcatcattctcgcgaagggatcatacttgctgatgtcgcttcgcaccgcctctccttatgtgcccaacacggcacgtaaaagtcacttattgccttcggcatcatttggtaggcgggccgacctagcggcaatcatggtgaagaatgcagcagtaaccaaacgcaacaaccgtaaaattcacgctcgtaagtttattgcaacaccggaagtattaatgaccgcctttgatgtaaatcatcgtagttccatgactcgttctatatctcaggcttacctgatgtctgccgagcgtagccgcgaatttggtgtgttttctcgtgaggcacaaccgtatcttcgctggttctattgtgaagcattactggaaaaaacagctatcaatcttgggttggattttcacgccgcaccaaatgcagcccgtaactgccgacacttatcgattaagtctaacaactggactctcacggctcaccatgttaacggaccgggacaattaccgcgtaaggctcgctaccgagctgcatatgcacaaagcatgaattacgatctttttgaaggattcgaagacagcgataatgcgcttctaagtgtaggtggtcacgtttatctattacatgatggggttggtagttccttgggggcgataagtttgaccattcctactccagatttgcgtgctgtgctgtatgctgaaccattagagttggtttcttcttatgaagttgaggaagaaactattgaagatgaacttgatgaaaaaatcgcccttaggaatcgtgacaaattaatcaatcctgaacgtcttaccgaggcaagggaggctaaagggttaactatggctgaccttgcgcgtttgcttgagatctctcggcaagctatttctgcgtttgagaaaggactgaaaaacccatcccatgagacattaaatcagatttcaagggtattgagtttccctgaggctttctttttagctgccgagtcttcacccagtattaaaggtgctgtccattttcgtagtcgcgcttctgcaagtaaaaaggaacgcttgatgggcacaacgaagggaagatgggtgtcaggtatactctctaatctgcttcaatatgcaattttgcctgaattgaaattaccgcctattgatattgatgattttgaaatgctcacgccaagcgatcttgagcatatcgcaacgcaaacccgtagatattggggattgggtgatggtccgattaaaaaccttactcaacttcttgaaaataaaggtgttgttgtctcaaatattcatgccggagatagggtggatgccttttcattttggactaactccgggccagtcatcgttgctgataaaaatagtacggcagtgcggttgagatttactattgctcatgaattgggacatttgatattgcaccgttcggttcaggacgattatcttgacgataaagagcttttcaagaaagtggagaaacaagcggattactttgcttcttgcttcttgcttcctgcttccacatttggcaatgagtttttctcaccaaatttgcagggattaataaagttaaaagaacgttggggagtttcgataggagcaatcactatgcgagcatcgagcttgcatctgataaatgacaatcaaaaagagtatgttttcagacaactagcaccttaccgtaaaaaagagcctttggatgacattatcaagcatgaagagcctaagttaatcaatagacttgctcatcttcttgatgaaaataatataatttctaaaggtgaactttacgagat

SEQ ID NO: 11650 - DNA, 318 bp, Glycine max
  Peptide Sequence Number=SeqID_128428
atggctttggtaaaaaccgtcatagatggggcaactttaaagacggttgtacctaaaattgttgttgtaatgcattcatcaccatcctgttctcatcaccatcatgctgccatcaacatcaaagctgtgaacccaactagcaacgtgctctcatcattagaagtgggcgtggccattgataatatttggttttggggtgcggcaaaaggagcgttggggtttgggttgttgtctaggccgtggcgtaggagtgttggggtttggggttgtggtccaggccatagtggaggaacgttggagtttggggttcttcattaa

SEQ ID NO: 11651 - DNA, 399 bp, Glycine max
  Peptide Sequence Number=SeqID_128429
atgtacagcaaggtttggaaaatcttaaaagaagtcgctatcgggatacttttagtactgtctctttggctcgtaataaatggtgcattggaaaaatccaaaggtcacttcgaatttggtagcttgatggatttcttcaatactgcgggtactcttggtacattatttgttgcatatctagtttatagaaatgcccctaagtggataaaccaaaagttagacgatcatgcattgaacatcgccaaagagcttattacccatgacttacctactttatttcttaagctcagagaaacaagcatatatatacaaacattccatgactgctataaaaataacatcacagactcttacaaagttaaagatatcatctttagaaaagttagggtggagttttaa

SEQ ID NO: 11652 - DNA, 306 bp, Glycine max
  Peptide Sequence Number=SeqID_128430
atggatggggcaattttaaagacggttatacttaaaatcgttgtcgttttgcatgtaaagattaaaattggtgatcaagtgaagcactctagctctcatgcgcctgaaacactcaagctctttcatcaccatcgtgttgccatcaacatcaaagttgtgaacccctccagcaatgtgctctcatcattagaaggctacagcggaggagtgttggggtttggggttatggtccaagtcgtagtggaggaacaatggggtttaggattctttgttaaggatttatcttcattcatgtggccttcctga

SEQ ID NO: 11653 - DNA, 378 bp, Glycine max
  Peptide Sequence Number=SeqID_128431
atgctccaaccatatgggatcaacataggcttaaaggagcactcaaaccgggtgacccccaaggcctacactccgaagagtccatcagggtctcaccctcctgattcagttcatagctcacagctcaatacacacatctcaatacacatctatttcaccattaatcacagggttcccaaacgtcagagagaagaaaggattgaagcctccattttatactgtcttgatgcgattctattttctctctccgtggatattatttcccaaatcccaatgatgaaggtttggtggtctacgggaaaaagagaaggttttgggagcagaagagagaaaaacgaaaatgaggagaagaggaggcatcgtcagtctgaaaactga

SEQ ID NO: 11654 - DNA, 435 bp, Glycine max
  Peptide Sequence Number=SeqID_128432
atgttgccatggagacgtgctagtcatgcttgcctagagaatgtgattcgatggatcaagatcacacagttgcaattgcaagtgtcccacttgacagaacaattggcttctcttcatctgcaaccacaacaccatgttcatgaagtgggatttaaggtcaatatgcttgattttgatgttgacattggacctattattgtagctgatgatgaaattgttatggatgctaatgaagaacctgatggctcttattcgccagaagatgatcatattggtaatttaaccttccagtgcacgattatagatttgaggatgaacctctacgaggaagtagggaatgatgtagaaatttggtgcaaccatgggctaagaagggatcaaagaggatgtcagggctttagtatagaaatccaacgtcccaagagatctgtatag

SEQ ID NO: 11655 - DNA, 433 bp, Glycine max
  Peptide Sequence Number=SeqID_128433
atgtttacttcatttccaaaaaaattctgggtagaggctgcaagcacttctatatttttgctgaacagattgccaacaaaagctctttcaaaatcgaccctatttgaagcttggtatggtttcaaaccaaaattgatgaacttgaaagtctttggctacttgtgtttctcttatattccacagtttaagagagacaaacttgataaaaaggcggaagcgggaatctttgtaggctatagctcatcatcaaaagcctatagaatattcttgccacaaagtaataaagttattgttagaagagatgtgatattctttgaagaagaaaaatggagcaaggaaagtgagaagcttcaagttcaggaggagagcgaagaagatatggatgaccagccagttagaggaactagatctctctctgatatttatcaaagat

SEQ ID NO: 11656 - DNA, 1143 bp, Glycine max
  Peptide Sequence Number=SeqID_128434
atggaagcatatcttgatgctaatgatgtatgggaagtagtagaagaggactacgaagttcctcctttgccaaataatcccactaataatgatgatgaaaacgactccaaaatctataattttttgaaggaagagtatgaaggcagtgagaaaatcaaaggaatgcaagctttgaatctgattcgagaacttgagatgcaaaggatgaaagattcggatacagtcaaagattatgtggacaagcttctcagcattgcaaacaaaatatgtcttcttggcactgacattcctaactctcgaattgttcaaaaaatacttgctttggaacaaagaagactcatgagacaagaaggtactactgaaggggatttggtagctaaatcacaggacaaaaaaaagaagggcaagctatatgtgaaatgccataaatgtggacaattagggcatgtggagaaaatctgcaagtcatcacaaaaacaagagaatgtacaagctgctgttgaagaagtggatgaagaagaactttttgttgtttcttgctttgctaccacaagatcaacagaaagttggctaattgatagtggttgcatgcaccacatgacttacgatcaagaattattcaaagatcttgatgcaacctacaacacaaaagtcagaattggaaacggagcaaaaatagcagtgaagggcaaaggaaccatcgtgatcaaaggttgcacaggtctgaaattaattcctgatgttctatacgttcctgaaattaaccaaaacttgttgagtattggtcaacttctagagaaaggctataaagttctatttgaagataaaagttgcatgattaaagattcagataataaagaattattcagagttcaaatgaaaggcaaaagctttgtcttgaatttgattgatgaagagcagcttgttgtgcacaaggttgaagataacatgctggtttggcataaaaggatgggtcattttcatcatggcactttgctatatttgaggaagaatgatcttgtacaagggctgcctgaattggaagagaaatcacccgtatgggttgcttgtcatatggaaaacaaacgaggtttccttttccaaaaggcaaatcttggagagcaacaagcaagctacagttag

SEQ ID NO: 11657 - DNA, 942 bp, Glycine max
  Peptide Sequence Number=SeqID_128435
atgggagctcacgagaaacctaaagataaaaatgtcattggagtgaaatgggcttatagaaccaagcttaatgctgatgaaactttttcttcggttgctaggttggatgccataaggctgttgttagctcttgctgcacaaaaaggttggattatacatcacatggatgttaaatcggcctttttgaatgggcacttggaagaagaaatttttgtagagcagcctgaaggatttgtagttcatggacaggaggagaaagtctatcgactgaaaaagaccttgtatggcttaaagcaggccccaaggtcttggtacggcagaattgatgcatatttgataagcttaggcttcgaaaaaagtctaagtaagtttaccttgtatgtcaagaagacggatgttgaaatagtcattgtttctttgtatgttgatgacttacttatgacaggaagttcgaagctgattgaagagtttaaaggaggaatgaaagaagcctttgaaatgactaatcttggaaaaatgtcctttttccttggtatacaggtgcaacaagatataggtgaagtctttgtaagtcaagaaaaatatgcaaaggaaattcttagaaagttcaagatggaggaatgcaagccaattgcaacaccaatgaatcaaaaggagaaattcagcaatgaagatggagctgaaaagccagtaaaagatttcagtctttatggatattcagatagtgattgggccgggagtaatgatgacatgaaaagcacttcaggctactgtttcgcatttggttctggagttttttcatggcgttcaaagaagcaagatgccatagcacaatctgtcgttaaagctgaatacgtagcagctgttacagctgcaaatcaagcaatttggctaagaaaacttatggttgatatacacatggagcaaaaggagagtacatag

SEQ ID NO: 11658 - DNA, 1074 bp, Glycine max
  Peptide Sequence Number=SeqID_128436
atggccaagagagctagaagcgactcactggcattgtcatcagtgtcatcagtgtcactgcttcctcgcattttcgaagaacttcctcttgaaattttgttgcacgttttctctttcttgcccattaaagtggcagcgcagaattgcacccagggatccaagttccggaattgcaagcaattcaatcgcaaattcatattcggcagagagttagcgatgcgacgcaaccgcgaatccgtcgctaaattagtggatcacctgttcgacacacacaagggtgatctgatcgattcatttcagctccacatcgacccagttgaaattgaagagttgcttgacaagtggctcagaatctgtgtcgagaagaaaatccaggatctcgaattgtattttctccgaccgggatacacactcaccgaggattttctcaaccagctcaaaaatttgagctctttgaagcttgtccactgcgaattcgagttaccactcaagctccaaagtttgaccaatctgagaagtttgattctgtggcatgtcccgctcaggaatgaaaggcttcagactttgatagtccgatgtaggatgcttcagacaattgatttgcttcactgcgctgaactttcccgtgtggagatctatgcggccgagcatagatatttcaagatgttgagaatagctgggtgtaataatttgtcaatggttgaggttgtttccccaactcttcggtgtgtgcactattgtgggcacgtaccaagcacaataacattccaggcacctcaattgagtgaggccttgttcaattttgtgcctgctgggaacagaaggtacttgcgggcttctgtgctggaaaagctggtctgtgatatctctaatgtcactgttctttcagcttcagtccttattcctgaggctttgacggctaagattcatcatggagtttttggagaaatatgttataattttttgaatctccgggagcttcacctgataatgaatggaggacttttttgtaatccatacgatatcatcatgttaatgaaacggtgtcctattctggagaaattattcatcgat

SEQ ID NO: 11659 - DNA, 1641 bp, Glycine max
  Peptide Sequence Number=SeqID_128437
atggatctccttactggagtcatgactgctgttttttctgttgcttcagtagatgttaagcaatggagctctgcttttgaagaaggaaggttctgtgagatttttcactcaaatgcttctggttggaggagttgtgagacttgtctaaagcggattcattgtgggtgtattgtttcaagtcatgcttttatgttgttggatcctggaggaattgaatgttatgcatgtgcccgcaaaagtattattttgccatctaacctgccatggccacagtccttttcccttcaaaatcgtttatctgatcgacttagagacctatctgccaaaggttggagtcagctagctggatcaggtcctgtaccatggaagcaagcacccagtctgttcaattctgcttcttcatctgacctgatcccagaagtgccttctttagttgagttatccaatagctttgacaaaatgtattgcaatgaaaggttacctgcctcagccttggaaaagaaaaatgaggacttgtctggaataccagttaattggaacgtcaagcttggctcacgggagatgatgcttatgaatggaatgaggaatgaggacaaatcaagttcatgtttaaatatgtgtcaacagccttcttctctgaaggaagagtcatctcctcaaccatttggtttggctgtgcctaattcatgccaaaatgaaagaaatggtcaacttggggtaactggaagtcatccacaacaaactccaccacctccaggaaagcaatttaatggcactatgcatttagcacctgattcatcaggtgaggctcagattcgcaatgggcggcctcgagcagattcccgaggaagaaaccagttattgccacggtactggccaaggtgtacagatctggagctacagcaaatttctatagagtatccttcaaatcaaatgattgtagtgttgaaaactttgagtgctagtgatgctgggcgaattgggcgtttagtgctacccaagaagtgtgctgagacctacttcccaccaatttctcagcctgaaggattgcctcttaaaatccttgatgcaaaaggcaaggaatggatatttcaatttcgcttctggccaaacaataacagcagaatgtatgttttagagggtgtcactccatgcatacagtccatgcagttgcaggctggtgatactgtaacatttagccggttggagccagagggaaggttggttatgggatttagaaaggcttcaagtgtcatgccatctgatcaggacaatgagaccaagactggaaatggattttctgcacatggtgaagttgaattggcagatcctaattcatggtctaaagttgataagtcaggatacatagcaaaagaagcactggggagcaaatcattaatctctagaaaaagaaagagcaacatattgagctcaaagagtaaacgtctaagaattgaaaatgaggatttaatagagctgaagattacatggcaagaagctcaaggtctgctccgaccccctcctagccacattccaagtattgtggtgattgaaggttttgaatttgaggaatatgaggtacctgtattcttgcttcatatcagaaagggttatggattgctgatgttattatacttttag

SEQ ID NO: 11660 - DNA, 558 bp, Glycine max
  Peptide Sequence Number=SeqID_128438
atggtgatcggatggactcccacggtgtttgtcgatcgaaaaggacgtcctcgggatcgtggcctgtgggccctacatcaaaatcaagagcctcgtggagacccgagacggatgcttcatcagcagttcccctgcaaggctcgtcgtcctaagagtttgttggtttttgttaatccgtttggtggcaagcaatccgctaagaagattttcgctgaacaagtgaaatctcttcttgaagatgctcaaatccaaatcacagtccaagagaccaagcatgagctccatgcaaaggaagtggctcgttcgctggatattactaagtaccatgggattgtttgtgttagtggagatggaattttggttgaggttgtaaatggacttcttcaaagagaggattgggatacggcaataaagatgccccttggggtagttcctgcaggaaatggcatggcaaaatctcttcttgattcagttggggatccttgtgaagtagctaatgccgttcttgccattatacgaggcagtaaacgaccacttgatgtggctaccatcacataa

SEQ ID NO: 11661 - DNA, 741 bp, Glycine max
  Peptide Sequence Number=SeqID_128439
atggtaattgcgcaagatttgtatccatcagaagacgaccttttgtacgaagaggagttgcttcgaaaccctttcagcctcaagctatggtggcgctacctgattgcgcgttcggaagctccgttcaagaagcgcttcgtcatttacgagcgggcactcaaggcgcttcctggaagctacaagttgtggcacgcctacctccgcgagcgcctcgacctcgttcgcaatcttccggtgattcactcacagtacgacacgctcaacaacaccttcgagcgcgccctcgtaacgatgcacaaaatgccgcgaatttggatcatgtacctgcaaaccctaacgaatcagaaattgatcactcgcacacgcaggaccttcgatagggctctatgcgcgctccctgttacccagcatgaccgcatttgggaaccctatcttgtgtttgtgagccagaaaggtattcctattgagacttctcttcgggtttatcgcaggtatttgaagtatgatccttctcacattgaggattttattgagtttttgcttaattcgagtctctggcaagagtcttctgagaggctggcttctgtgctcaatgatgaccagttttactcgattaagggtaagaccaagcaccggctttggttggagttgtgtgatttgctcactcgccatgcgaatgaggtgtctgggttgaatgtggatgctatcattaggggtgggattaggaagttcactgatgag

SEQ ID NO: 11662 - DNA, 558 bp, Glycine max
  Peptide Sequence Number=SeqID_128440
atgaaaataaaagaagataagaacgatgactcgtccaaaagagacctacttgcacaagatttcatcgcacactctataaagcggaagatatttactacgcctgcgcctgcaagtgaaacaatcataatggcgttctgtaataaggttggaaatgtcttgaggcagggtgctgctcgcagcacacatgcccctgttgcgtccatgcttaattacatccgctgcatgtcttcaagcaagcttttcattggaggcctttcatatggagttgatgaccagtctcttaaggatgcattttctggctttggagatgtggttgatgcaaaagttataactgatagagacagtggaagatcaaggggatttggatttgtcaacttctccaatgatgagtctgcaagttcggcactctctgcaatggacgggaaggatctaaatgggcgaagcattcgggtatcctatgcaaatgataaaccatctgcacctcgacctggtggcggtggcggttatcgtggcggggattatgatggtgattttgcttctcgtagtggtggttggtga

SEQ ID NO: 11663 - DNA, 1653 bp, Glycine max
  Peptide Sequence Number=SeqID_128441
atggagaggaggcctgaattggctaacagtgtgcttttgcgtcaaaatcctcataatgtagaacagtggcaccggagggtgaagctctttgaagggaatcctaccaagcagatactgacttacacggaagcggtgaggacaattgatcccatgaaggcagtgggaaagcctcatacattgtgggttgcttttgccaaactgtatgagcagcacaaagatatagccaatgcccgggtcatatttgacaaggcagtgcaggtgaactacaaaactgtggataatctggctagtgtctggtgtgagtgggctgaaatggagttgaagtataaaaatttcaaaggagcacttgagctgatgaggcgggctacggcagagccatccgttgaggtcaagcgaagagtggctgctgatgggaatgaaccagtccagatgaaactgcataaatccttgagattgtggacattttatgttgatttggaggaaagcctaggtactttggagtctacatgtgctgtttatgagcggatcttggatttacgaatagccacgccgcaaataatcatcaattatgcatacttcctggaggaacataaatactttgaagatgcttttaaagtttatgaaagaggtgtaaagatatttaagtacccacatgttaaagacatatgggttacatatctctctaaatttgtgaagagatatggaaagaataaattggagagagcaagagaactatttgaaaatgcagttgaatcggccccagctgatcaagtgaaaccactttacctgcaatatgccaagctggaggaggactatggactagcgaagcgagctatgaaggtttatgatcaagcaactaaggctgttcctaacaatgagaagttaagcatgtatgaaatatatattgctcgtgcagctgagatatttggtgtacccaaaacaagggagatctatgaacaggcaattgaatctggtcttccagacaaggatgtcaaaaccatgtgtttgaagtatgctgagttggaaaaaagtttgggagaaattgaccgggcccgtggaatatttgtttttgcctctcagtttgcagatccacgatctgatccagaattttggaataagtggcacgagtttgaggttcagcatgggaacgaagatactttcagagaaatgcttcgtattaagcgaagtgtctctgcaagctacagccagacacattttatactgcctgagtatctgatgcagaaggatcaaactgtgaatcttgatgaggccaaagacaaactgaaacaggctggaatccctgaggacgaaatggctgctttagaaagacaattagccccagcagttgacaatacagtgacaaaagataggaaggttgggtttgtgagtgctggagtggaatctcagcttgatagaggggtaaaaactagtgcaaatcatgaggatattgagttaccagaagaaagtgattctgatgatgatgatgataagattgaaattgcacaaaaagatgttccttctgctgtgtttggtggtttgattagaaagagagatgagaatgaaaataatggagaagtagatgctgcaaaagataaggataatggaatacggcttggtgctcttgagagaatgaagaggctaaaacaaaattaa

SEQ ID NO: 11664 - DNA, 1765 bp, Glycine max
  Peptide Sequence Number=SeqID_128442
cataatggtggtagcatgcattgtgcaatggtctgtcaagtttttgtatgacccttcaagaaaattcgctggataccagaaaaggaacatgatgaatttaaaaccgtggtctgagctgaggatgctggtgtgcattcataaaccaagtcacatatcgtcaatgatagatgtgcttgacctgtgttgtccaacaacagaaagtccaatcattgtggaagtattgcatctaatagagctagttggacgcgccctacccatttttattccccatcgccttcgaaggcaagcatcaggattgcaacacaagtcatactctgatgatgtcattcttacttttgacatttatgagcatgacaacccacatgctgtatctgcatacccttgcacagcaatagctccacccaacctcatgcatgaagatgtttgcaaccttgcctttgacaaagttgcttccatcataattcttccatttcatcaaagatggtctagtgatggggaagttcaatttgatgacaagaacataaggacactaaataatagggtcctagaaatatctccatgctcggttggaatacttgtgactcgtgcctctcaccaaattagaggttcaaccactcgattagcactaatttatttgggcggacatgatgatgaagaggcattgtgcatagctaggagagcaattaggaacccagaggtgaaccttgttgtttaccaccttgtttttaaagaagatgatgagtggggacaagaagtggatgatgagctagaagatgtgaagcatgcacatgaacataatataaggtatcaacaaatcatagcaaaagaaggggcccagacagctgcttttcttagtgacatagtgaaagagcatgacttctttctagttgggaggcgccatgggattgagtcccctcaaactgatggacttacagactggagcgaattcccagaattaggtgtcattggtgattttcttgcttcaccagatttggagagtcgtgcatcaattttggtcgtgcaacaacaactctcatcaaaggcacattctggctgggtatactttttcgttcttatgttgcagcaattcgaacttgataataagattgatgaaatgaagttggttctaaagtctctacagaatcttcagtttacagtcaaatggtttgaagttgtagagcagattgagtatgcattcatggagctaaaagtgcttgcattcggtgagaattgcattaggttgtcgttgcagacttatatgccaacatttgtgggcatttcctacctaccgagagttgaagctaccgttgatacagctgaactgaatcatgagttattaattgaagtttttgagggaactatgaggtcaaagaatgttcaggtttttccaaatgatatatatgtgaacgacattgttgatactgcaaagtttgtcagcaagtcttcattgcagtggtttatacagaaagtgcaagatagaattatactaagcacacttaggcatcttgtagtaaaggatgctaataaatcaagatattcgcttgaatacttggacaaagataagactattgtggttcatatggctggaggaatcgatgcgtacataaaattgtcacttggttggcctatatttgtttctccattgaaactgatatgtataaagggatcagatgatttgaagagaacttctctaagttttcgttgcaaagttgaggcattctcagtgtggcatcagggttttaagctcaaaaatgttcatacttaa

SEQ ID NO: 11665 - DNA, 591 bp, Glycine max
  Peptide Sequence Number=SeqID_128443
atgccgattgtcagatatgtcatagacataaagacagcttcttttaattcaagtgtctgtgccttagtggtgaatccatacttggttcaaggtggctttcagtcttggatgcaacaaggtctccgcatcaaggaactcaaacctgagacagcactttccatactcaatgaggaagctgaagcaattctggaggatgttagtccttctcctgggcaacttttaggttatggtacagtacttattgcagggctttatgcattactagaatgggagaagacattacagttgattggtgcttttggcctcggtttgaccatctatttgcgggtttcttcatatgaaaagtcagaagatctaaaacaagatgtgaggttgttgctttctcctgttagacttggagctcaagcattttcatgggctgctggaaaattagaatcaaatggcttaggattacctacatcaccatcatcatcagatgttcagaaccgggtgttgcaggctgctgccaaacatgaatcccaaccatccgatagtgaaggtaaccaagatccagtacctgaaccgacagttcctctcaatcagaatgtatga

SEQ ID NO: 11666 - DNA, 558 bp, Glycine max
  Peptide Sequence Number=SeqID_128444
gtttccaggcacagctgtgagaaatctgctgttggggaaaatctcaagaaacggaaggacattgaatcaaatggaattatgcatgcaaatgacagttggcccagtaagttgccaaagccctctccatctctctctcatctcactgaaaatgggaggatattggaaccctgccaaatttcccttcagaatacatctgataggctagcagcagcctctaatatcaaggttgataacaaagaacgcaagataaatggcatcatcgaagctctaccatccacagtttcctcaaaaactcccactcccattgctaccatgccagctccagtcagtgaagcatctgcaaaaccacctcatccagatagcaaatacataagtcaggtatattccgtgcccaaagtagatgagtggtctgattttgatgaccaagagtggttgtttggcagcagccattggcaaggaagaacacctgcagtgaaatcttcagaggttgaggatacactacaggtggcacatgatacttcaaaaatacctgatctgctcaaggaaccctctatttga

SEQ ID NO: 11667 - DNA, 855 bp, Glycine max
  Peptide Sequence Number=SeqID_128445
atggttagacttggacgtttgtggatgtctcttcttccatttggatttctcttgttctttagttcagctttcatcagagtacctggtgcccttgcctggagcaaagagggtcatgtcatgacatgccaaattgcgcaggcacttttagagcctgaggcatcagaagccgtgtaccaattgttacctgactatgtcaaaggggactgccatgattcccatggcgttgaggatatgtgtgttgcaggtgctgtgaaaaatttcacttctcaactcatgcattacaaagaggggacatctgatcggagatataatatgactgaggcgttattgttcttgtcacacttcatgggagatatacatcagccaatgcacgttggatttacaactgacgaaggaggaaacacgatagaactacactggtttaggcacaaatcaaatctgcaccatgtgtgggacagagaaataattctcactgcattagcagactattatgataaggatgtgagtctccttctccaagacattgagaggaactacactgatgggatatggtcagatgatattacatcctggaaacattgtaatgatatctctcaatgtgtaaataattgggccaaagagagcatacaaatagcttgcaaatggggttacgaaggagttgaagctggagcaactctggcagtatatcagcatgagatgagtagactttgtgcgcatgatgcttttgtagatgattacttcgactcaagggtgccatttgtcatgaaacgaattgctcagggtggaattcgattagccatgattctgaacaaggtgtttgctgactctgaagaaagatttgcaacagcaacttag

SEQ ID NO: 11668 - DNA, 1347 bp, Glycine max
  Peptide Sequence Number=SeqID_128446
atgaagaaaaagaagcaggtgccggagtggatgaacagttctctgtggtccaccccctccgaccctcctgcttctgtttctgttagagaagaacccccgacaatcccaaccaatcagaatgcctctcctcctctttcttcttcttcatccgtttcttctcctactgctactgccgatgacatctcccggcatgctcaggctcaggttcagttgttggccgagttgtctaggaaggtgatagacatgcgcgagttgaggagagtcgtcgcttctcaaggaatatctgatgctggtgctttgcgccccacgctctggaagcttttgcttggatatcttccgcccgatcgttccctttggtcctctgaattagccaaaaagaggtcccagtacaaaaatttcaaagacgacctcctcacgaatccttcagaaatcacgaggaggatgtacaactccaactctgctgctcttggtatcgatgatgcaaaatctcatactcagactaggctcttgctttctagatcacgtatcactcatcaggaccaccctttgagtcttgtcaagaccagcatatggaatcagttcttccaggacacagagatcatagaccagattgaccgagatgtcaatcgtactcatccagatatacacttcttctctggtgattctctttttgcaaaatctaatcaggaggctttaaagaccatattaattgtttttgcaaagttgaactcgggtataagatattttcaagggatgaatgaagtattggctcctctcttctatgtgttcaaaaatgaccctgacgaggaaaatgaagcctttgctgaagcagacacattcttttgttttgttgagctgttgagtaggttccaagataatttttgtcaacaacttgacaatagtattgttggaatccgttccactattacaagattgtcccagcttttaaaagaacatgatgaagaactgtggcgtcatcttgaggtcaccactaaggaatttaattttgccgacatccttcatatttgggacgtcattttaagtgatccagagggtccacaggtcacactaaaagttccttataggcagcgtgactcattttcatccctaatgagaatgtccacaacaatcatccctaatgagaatgtccacaacaagctgcagcaggacttaagtgcttccacatgttgtgtctttacaccaagaaatgcatatcttcgtgcctcaaatccagctgagttccttttgattttgcatgtcctgtgcattcatgacagcaacagtatacccattgtgctcatccattttatacactggaccctgtgtcccatgatagccatcttctag

SEQ ID NO: 11669 - DNA, 264 bp, Glycine max
  Peptide Sequence Number=SeqID_128447
atggcggaaatgcagccatcacccatggaacatcacgccagaagctggaagcccctaccgaatggcttcctcaaatgcaatttggatgctgcaattttcaacgagttgaattcctttagagtgggagtatgcgtcagaggtgaacaagacaacttcatcaaagcaaagacaacactttttaaaaggtatcccaacatcaacagaagcttaaagctggaccttacactgtgctattcaatggatcacgcagttcggtttcaatga

SEQ ID NO: 11670 - DNA, 828 bp, Glycine max
  Peptide Sequence Number=SeqID_128448
atgaattcgaacccaaatgaaaccatgttcctttcaattacaccagtggatgaggcgacgcacaggtacactgtatgccttgctgcgccaccccatattgtgtcagatgggttatggggtagtgctgcagcaaataggaaaccaatgaaatcttttctcccattgtttgagttacagatgttggctggcctcattcttcaagcttgttttgcgttggatccatttgcctcatacatgaggctcttgtttccgtatggaactcacgacaccattaccacaatatcatctattggttttgttctcttcatttttataaacggtgtacaaatggattttggtttgataacaaggatgggtaagagggcatggaccattgccatatccggattgctagtacccatattttgtgccatttccatactaagcttatttccatttggccactctggaaactacgatgatttggttgttgcattggtctcccacaccgtaatttcatttgcggtcatttcttcctttcttaatgaacttcaaatccaaaactccgaacttgggaaattggcattatcttcagcattgatcagtgacgtattgtgcacaatcgttacctccaccggcactgctgttatggttactgaggattctaatgtcaaagaggttacaagaaacatcttgtctttgatatgcatgggtatcttaatcccattagtgtgtcgcccagcaatgttatggatcatcaaacataccccggaagggagagctgtgaaggatggttacgtttatgttatcatcgtactgctcttcattttaggttggctttccagttaa

SEQ ID NO: 11671 - DNA, 1121 bp, Glycine max
  Peptide Sequence Number=SeqID_128449
acagcaccgtcgagtactcgtctccctctccctctccccctccccctccccctgccttcgtctttctcctcgatctctccactccccaagacgaacttcctcccctcaagaaccagctcctccacctcctccaccacttgcccgaccactccctcgtctctctcatcaccttcgactccatggtctatctccaccatctctcttcttcccacttttcctctctcctcgtctttcacggcaaccgccatctctcctccaatcagatccgccacttccttaacccccaccgccaccaggcttttcttttgcctatttccgaatgccaattctccatcactactgccattgaagagatccattctacatccaactccaccatctccgcctctcgccctcccaggtgcaccggctctgcaatctccgtcgcccttggtcttttggagtcttgccccatcaatacaggctccaggatcttggtcttcacctctggacctgctactctgggacccggaatcgttgtcgattctgatcgccgccaacccatcagaacccaccatcacatcttcaacgcccaagcaacacactatgctaagtcttccgctttctataatcaactctccaagaggctatccggtgcatctgttgttctcgatctctttgcctgttcccttgatcaagttggggcagccgagctccgaggacccgttgagcactccggtggattcatcgttctctctgagtcttttgattccgatcagttcaagaattgtctgaggcagatgttcagatgtgatgaccagggccacttgagaatgaattttgatgcgactattgaaatagtcaccaccaaagacgtgaaaatctgtggagcgcttggtccttgtgtgtcccttgagagaaacaactgtttggtgagcgaggctgaggttggagaaggtggcacctctgtctggaagttaaacacgctcacccacaaaacttgcattgcgtttttcttccaagtgaatcaggagcagaaaatgaaaattcaaccgggctctgcatttttaatccagtttataacgcgatacaggccgggaaacatgatccggaaaagagtgacgactgctgcaaggcgatgg

SEQ ID NO: 11672 - DNA, 396 bp, Glycine max
  Peptide Sequence Number=SeqID_128450
atggaggagagaccagaagcagaactgatatctataccggcgacacctagggtgtcgacgccggagatactgacaccgggacagaggtcgccaagagcagcatcaaaggaaggaaaatcatggaccccaacttcttttatatcaccaaggtttctgagtccaatagggacgccaatgaagagagtgcttgtaaacatgaagggttacttggaggaggtgggacaccttaccaaactcaaccctcaagatgcttggcttcccatcaccgagtctcgcaatggaaatgctcactatgctgcatttcacaacctcaatgctggtgttggcttccaggccctctttttgccagttgcttttgcttatcttggctggagaaactttactttcattctctag

SEQ ID NO: 11673 - DNA, 303 bp, Glycine max
  Peptide Sequence Number=SeqID_128451
atgggcgaaacgcggggcactttggtaagatggggtctatataatagcgaaacgtggaagctctggaagtggaaggaacatagaagcatcacaagaagaggagcagaaagaactgagagtgtgatggcaggtggaatgatcaacgatggaaaaagcttcccaaggaggttctctgggcgtccaattccaaagaggggacaagtgaaggttgcaattgttttggggttggctcattcgcttgctgccatcttctcacgcactactacatcatgtgttgcacctcctcaccacctctcccactag

SEQ ID NO: 11674 - DNA, 1626 bp, Glycine max
  Peptide Sequence Number=SeqID_128452
atgggttgggttatagtgtgtatgttgttttctctaagttgtgtcattgttgatggcggagttccaacaactctggatggacccttcaagcctgtgaccgttcctcttgatcagagcttccgaggaaacgccgtggacctgacagatacagatcctctggttcaaagaaccgttgaagggttccagccagaacaaatctctctctcactctctgcttctcatgattctgtttggatttcttggattacaggggaattccaaattggggacaatatagaacccttagatcctgaaactgttgctagcatagttcaatatggaaggttcggaaggtccatgagacaccaagcaacgggttattccctcgtttacagtcaactttatccttttgaaggccttcagaactacacctctggaattatacatcatgttcgtctcacaggattgagacccaacacactatatcaatataaatgtggagatccttctttgtcaggaatgagtgacgttcattatttcaggactatgccagcttcaggccccaagagctaccctagcagaatagcagtggttggagacttgggtcttacatacaataccacatccactgttaatcatatgaccagtaaccatcctgatcttattctgttggttggagatgttagctgtgccaacctctatcttactaatggcactggggcagactgctactcttgctcatttcctaacactcccatccatgaaacctatcagcctcgttgggattattggggaaggtacatgcagcctctgatttctagtgtcccaataatggtaatagaagggaatcatgagatagaagaacaagctgaaaaccagacatttgttgcttatagttctcgatttgcattcccatcagaagagagtggatcatcatccactttctattattctttcaatgctggggggatacattttataatgctgggggcctacatatcctatgacaaatcaggggaccagtacaagtggttggagagagacttggcttctgttgacagggaagtaactccgtggttgatagctacatggcatgcaccttggtatagcacctacaaggctcattatagagaagcagagtgtatgagggtggagatggaagacttattatataaatatggcgttgacattgtcttcaatggacatgttcatgcgtatgagagatcaaacagggtatacaactacacattggatccttgtggtcctgtttatatcacggttggagacggtggtaacagggaaaagatggcaatcacacatgctgatgaacctggacagtgtccagaaccatcaactacaccagatgactatatgggtggcttctgtgcctttaattttacttccggtccagcagaaggtaacttctgttgggaccgacagcctgattatagtgctttcagagaaagtagcttcggtcatggcattctagaggtgaaaaatgaaacccatgcactgtggatttggcatcgcaatcaagacttttatggcagtgctggagatgagatttacattgttagggaacctcaaaactgcccaccaatcaagccagaggagggtgctaaaatatttaacttcaagatgcattaa

SEQ ID NO: 11675 - DNA, 405 bp, Glycine max
  Peptide Sequence Number=SeqID_128453
atggcttttggcggttcgggtaaaggatctaggaagggggggtcctgtgttggatcatcatcttcctctatgatgaggagaaacaccttggagtgggaggaagaggctttccacaagacaaatgtgaaaggtcttgaaacttctcctcgggcaatcgagccaagcctacgacctgaaccaatgtcagaggctggagcacttgaacctcttgacgaatttgaagggcacccgtggggtcgtcatactatgaagatgcaaatcgagtctccaaagcttgcaaaaacccaggccaagaagccaattgtccattgtgagtcaaccactgaaaccacgctaatgttggaccatccatgtaaaaggaggaaatggtcaaacgatcctggtctagtgttaagtggtatttga

SEQ ID NO: 11676 - DNA, 252 bp, Glycine max
  Peptide Sequence Number=SeqID_128454
atgagaaggaaatctaaaaatgaggtggttattgtgttcgaattaggtgatgatgtagaattttcagggattggagggttcattccatttcctgcaccatccccgccatggattggagttgttgtggtaggtgctgccacattcggcatcgctgtaggtgttgtcactgttgtatttgtatttgtatttgtatttgtaactccagcaccagcagtaatacacagtcattataaagaattgaaaccaaattaa

SEQ ID NO: 11677 - DNA, 1854 bp, Glycine max
  Peptide Sequence Number=SeqID_128455
atggctaaagatgtgtggacccgaacatcctcttccaacaccagtaggcaacgtagtagaaggcagcagtactgggaccgcagcgttgacatggaagagctattagcggcaattggacagacccagaacgaggatgaactgtatgcggttatgtctccctacaacgggaggcagttatccatgcgcttcatggtttccctgctgtcccgcgagcccgattggcaacgtgctcttgcccttctcgattggatcaacgacaaggccctctattctccctccctcttcgcctacaacgtccttctccgcaacgtccttcgggccaagcagtggcacctcgcacacggcctgttcgatgaaatgcgccaaaagggcctctccccagataggtacacttactccaccctcatcacttctttcggcaaacacggcttgtttgattcttccctcttttggctccagcagatggagcaagacaatgtctccggcgaccttgtcctctacagtaacttgattgaccttgcccgcaagttgtccgattattccaaggccatttccatcttctccagattgaaagcctccactatttcccccgacctcattgcttataactccatgatcaatgtctttggaaaagccaagctcttccgcgaggctcgccttcttcttcaagagatgagagacaatgccgttcaacccgacaccgtcagctattccacccttcttgccatctacgttgacaaccaaaagtttgttgaagcactttctttattcttcgaaatgaatgaagccaaatgccctcttgatctcaccacttgtaacatcatgattgatgtttatggccagcttcacatgcccaaggaagccgaccgcctcttctggagtatgaggaaaatggggattcaacccaacgtcgttagctataatacgctcttgagggtttatggagaggctgacctatttggggaagccatccatctgttccgtttgatgcaaagtaaggatgtacaacagaatgtcgtcacctacaacactatgattaatatttatggcaagactcttgagcacgagaaggctaccaatctcattcaagaaatgaagaaaaggggtattgaacccaatgccatcacctattccaccataatttctatatgggagaaggcagggaaactggaccgcgctgccatcttgtttcagaaattaaggagttcaggagttcgaattgatgaggttctttaccagacaatgattgtagcctacgagagggcaggtttagttgctcatgcaaagcgtctacttcatgagctcaagcgaccagataacattcccagggacactgcgatcggaattcttgccagagctggtagaattgaagaggctacctgggttttccggcaggcttttgatgctcgagaggtcaaagatatatctgtgtttggttgcatgattaatcttttctctaagaacaaaaagtatggcaatgtagttgaagtgtttgagaagatgagagtggtgggatattttcctgattctgatgttattgctcttgtgttgaatgcttttggaaagttgcgtgaatttgataaagcagatgctttatatagacagatgcatgaagaagggtgtgtttttccagatgaagttcatttccagatgctgagtctatatggtgcaagaaaagatttcgtgatggtagagtcattgtttgagaagctggattccaatcctaatatcaacaagaaagagttgcatcttgttgttgctagcatttatgagagagcagatagacttaatgatgcttcccgaataatgaataggatgaatcaaaaagcaaacagaagtcattatcatgcttag

SEQ ID NO: 11678 - DNA, 2349 bp, Glycine max
  Peptide Sequence Number=SeqID_128456
atgagtgctgagattgattcaacttgtgctcctgaacctcacaaaatgtctggccaaaagctctctatattttctgccaaatctggatttgtcatccctaaaaacaaattgtcagggtcactggtccctattttccgaggggctaaaaagcatggggtcactgttggtgccaccaatgaagaaagttcaaaacaaattgagaggaaatcaaaatggggacctgatctcacacaagatgcagctgtcaggaggggaaaagttttagctttgcagattcgagtggaccaaattacaaagcagttggaatcagaaaaactggaagttggggacactcagaacttgaatccagatcaaagcaaatctggccctcgaattaccagcaagaagtcagaaatgctcgaacttgaaaagcgggaagcaataggtgaaatactaaaattagatcccagttacaagcctccacgtggttttaaaccattgttaaaagaagccagcattcctttgcctgtccaagaatatcctgggtacaattttgttggtctaatatatgggcttgaaggtgataatcaaaaacaacttgaaaaggaaactggtgcaaagataaaaattcatggaatcaaagcagacacaggagagaaaggtgaaattaaacctggaactgatatccagtgcaattacaaagagatgcatgttaacctatcagctgatagttttgaaaaagtggatgctgcaatgtcaatcattgaactgctagttacctctgtaattgggaatttagctgctggttctactccctctatatcagtttctaggtacagcactaatgttctgagtcaaagccacgaatgccccccttctcatgcagattctctatctctggaaaaccaggctgtgttgcaaccagtagctgttacacaaatgcatggtgataacttccaatactctagtccatggttttcagtggttccatctcattcccctgtgtttgcttcgtctggcagtgtagccctcccaaatccattaggtcttgctagaactccccattttccatcacacacttcaaacatgacttcgccttttggtgctcaacctggacctgctggatttcagccgattattccaaatcaacatgtttctgtgcaagcaccaccaccaagacaggttttacagtattcacatatgactcagacaagtcctttgggtcacattgggcccccaagaaaccctgtacagaatttgttaactccaacaaatgcttcactttcatttcctgttactttaagccaaccaacgccaataggacaacatcagacatctgtgtcttcaatgcatctacctatgtctggtatatcgtcatcaatacctaaccagtcattgacccatctaggggtctcttctggccagaacgaagcccctgtcactgttaaaatgtctgttggtcccagcaatatggtgccaatggcttcaccagtggttccacctgcaagacctgtttctctacatcaacagccagatgttgcatttaagccaccacagtcaaatatgtcaatgatgccacgatctgccacctttcctccacatcaagtaggaatatcccctggacaaccatcttctttgagaccaatgcctgtaccaatatctgcaaaccatttattgggacctgtttcatttccttcacctggaatatccccttcacttccattgcctcagcaagcaggaatacctaatcttgcttttggagttgctccttatcacacccatgtaaaaccaccagtcttggggacatcaaaatctggaaattttacttttcaatcacatctgcccaatgcagactatggtcaagtctattctggaccaaacagtcaatcaggtgctacacaagaaccaccttctggtccacgacctccaccatttggttttgctgtgcctgatcagcctcgtcaaatctttccaaggacacaattccctggtcaagtggatcaagccgttgcctttgggggaagatcaggttccatctcgaactcaattccaccacccagacatggtgtgtttccatatgctggtcaacctgcacctagatcatcagccgcacaaatgggtatgaagaacttcatttctgccccacaaattccaaatttgaccagtgctggttcccaaagaggcatgcctattcgaaaaagctatgctactcagatggcatgggcagatatctcaatgcctctgaatcaaaagtttgtcagcaatccccccatggcttctggtaagattgcatatgctacagaccaaatttatgatcccttttcacccacttctgcacctccacaacacaaaggtaatcctggaaaatga

SEQ ID NO: 11679 - DNA, 1173 bp, Glycine max
  Peptide Sequence Number=SeqID_128457
atgatgagtttatcattttgttcgctgatagcaaagccttgttccatgatcaatgggagcaataggaaaccatgttgtggtcgtacaagatttggtgttataattaggtcggaagtaaacgtggctcccaagcaaagaggaattccccaattgtcaaaacaaggagttcctcttgctgtacaagaggttgttcacaggcagtctcagatcataaatcattgtagcaagcctaggccactgttcgagcccacttttctttatgatgcctatgaaatgtgcagaaatatttgcgccgaatatgccaagaccttttatctaggtagaacttttcttcccattctaaacaggaaccttgcttatgacggaagaaagacagaaagctatatgggcaatttatggaggacggatgaacttgttgatggtcctaacgctgggtatatgagctcttctgttcttgataggtgggaagatagattgcacgacattttcaatggacaaccctatgatatgcttgatgccgctcttactgatacagtctccaagtttcccttggatattaagcctttcaaggacatgatacaaggcatgagaatggatacaaggaaagcccgatacaacaatttccaagagttatatctttactgctactatgtggcgggaactgtgggcttaatgactgttccaataatgggcattgcccaggagtctgtcatcccagttcaaagtgtatatgatgctgcactatatctgggtgtaggaaatcaactcacaaacattcttagagatgtgggggaggatgcattaagaggtagagtgtaccttccccaagacgaactagcccagtttggattatgtgacaaggatgttttttcaagaaacgtcagtgaaagatggagaaagtttatgaaatatcagatcacaagggcaagattctacttcaaccgggcagaagaaggagtttctcagctccaaaaggccagccgttggccggtttggtcatcattaatattgtatcgtaagatcttggatgcaattgaagacaacgattacgacaatttgactaaacgagcttacgtgggacgagctaagaaatttttaacgttgcctctagcttacactagatctctctcaaatcacaaaacgaaatttcgttctttaacaaggcctatctag

SEQ ID NO: 11680 - DNA, 240 bp, Glycine max
  Peptide Sequence Number=SeqID_128458
atggcttttgtgactcaagttgcttatggtggtggagaaggatcacttacgccccaagaatgtccgggggcatgcgattatcgttgttcaaaggctcgggctaggaaggcgtgtttgtacttctgtaacttgtgctgtgcaaaatgtttgtgtgttccatcgggaacctatggtcacaaggaagaatgtccatgttataacaattggaaaaccaataaaggaacacccaagtgcccctaa

SEQ ID NO: 11681 - DNA, 264 bp, Glycine max
  Peptide Sequence Number=SeqID_128459
atgaagattgaagaagaaggaggagagaaacataacgggttgaaggatgtaggattgatgctggacatgataatgatggcgcacactaacttcggcaaagagcgcacacttaaagagtgggaatatgtcatcaaaatggcaggatttagctcatacactgtcaaaccaattatattcatgctgtgcagtccgtcattatggcttctactaaaatatccaccaaaaattacccttgcaagtttgccactaaaatgcattaaataa

SEQ ID NO: 11682 - DNA, 384 bp, Glycine max
  Peptide Sequence Number=SeqID_128460
atggatgtgaaaacgatattccttaatggtcatctagaggaaaaggtttacatgaaacaactagaaggattctcctctagtgataatgaacacttagtttgcaagcttaataaatccatctacggattgaaacaagtctcccgccaatggtatttggaatttcatgaggtcctcacttcattcgattttgaagataacatcatggatcaatgtatataccagaaggtttgcaccaaaccaaacattacatatgatgatggagttttgggaagatatcagagtaatctaggtgttgaccaccgaaaagatgcaaagaaggtgatcagatatcttcaaggaacaaaagactacatgctcatgtacagacaaactaatgatctgtag

SEQ ID NO: 11683 - DNA, 969 bp, Glycine max
  Peptide Sequence Number=SeqID_128461
ggcaggaagctacattggatgagtcaaaggaaactctcaagaaacaagaaagatggtggcttgggctttagatttgttcatgtgtttaatgaaacccttctagccaaacaatggtggagaataatgacacaagaagactccctcgtggctaggatgatgaaggcaagatacttccttaattcctctatttgggaatctagggtgaactatagacctaacttcacatggtctagcattctaagtcgcaaatcaatcatagaggaagattgtatgtggtgtgcatgtgatggaaaaacaataccaaccatgaaggacaaatggctaccaaacttgcctagggctcgcatccttccttatgaagggggacatattcatgaatctataatgggagttttccaaaatcacaagcttgaatgtcaccaagtcttggtgaagatgttccagaatatgccaaaggagaatatccaggatggtgaggctgggattcaacaaacaaaaaatgtgttttggaaggaacccacatatgggagatacaagattaatttcgacacatcagtttctaagaatggtggaacatggatagtttttatatctagagataaggaaggacatgtgctagcatctactaccaaactacttgacttcgtccttgagccaagggaggtagaagcttatgcttttagatgggaaatttgcttagctgttgaactgctttttgaaaacgtaatctttgagaccgattgtttacaacaggtcaaacaatcgatacttaaggaaaagaatggtcatgccctctttcatggaatagtttatgactgtcaaagaacgattcataggactagctccttggtccataaagtacacttggcaatctacatagcactccattacgcacgtcagccctccatgtcagccctaacacaagagcacggacgtccagtccttattagtcgagctctcaatagacaa

SEQ ID NO: 11684 - DNA, 198 bp, Glycine max
  Peptide Sequence Number=SeqID_128462
atgaagcaaagtttaaaaaccttggagggccccactggtggaaagggaaaggggacagagggagggtggggcggcttcacggaggttttcgtggcctccaaagaccccttgatccttgcctcgttctacacaccgtcgtcacgcagcgacggtagcacgtgtaacaaggaacttgtcaagaacttgaatcttatatga

SEQ ID NO: 11685 - DNA, 573 bp, Glycine max
  Peptide Sequence Number=SeqID_128463
atgggggtctgttttctccatggatgccgcaagttggaatggcgagatagctattccaccatctgcaatgacgagataggatgggtgccgccattgttacaggcgagaaggctgcttacatggagggtgtcgccagtggcacgggcgagaagcttccacgttggatccaccaatgctgctggcgagaaccctgctgacttggcacctcgtgagcagggggtaggttctagccctaggcttgcatgcttctgcatttttgaacgttgctttttgaatgttaggaaccactggcggaatgcctacgtggaggagtatctcactggaagaaatggcggaatctccctagcctatctcgcaggcaccactggtgggattgctgcctacgtggaggagtatctcgctagaagcactggcgggattgctgcctacgtggagtatcccgccattgctgttggcgacttcagtagttctcgcttctatgaatggcggcacgcctatgtcgccaatgctattggcggcaccaccccaagaagataccccatccgtaaattgttaaagaagggacccctttac

SEQ ID NO: 11686 - DNA, 489 bp, Glycine max
  Peptide Sequence Number=SeqID_128464
atggaagaaaaaaactcagcaaaggcaaagcaccaacagcaccaagaacactctaagaaatttaagaacggagaaaagcaaagcgtatacaatggtcaaatcctactctgcatccctaaacaatgttgctgcatccctaaacaatggagagcagaactgaaaagctataaaggtgtctcgccagtcctgtggacgagaccgaagctgcaggctgtctcgccagccgtgtgggcgagtcccacgtgggctatatcgccagtcggactggcggctccagctgggtgtgtcgccgttcccattggcgacaccctcctctctccatcctacgtggccatatcgccaccgctagtgacaatacacccttctctccagctttgccgccactggcaatggcgggttgagccatgccgccagtggcaatggcggtttcctccgcaaaacaaaccccctccgttatttcttttggaacagaccccatcccgtaaatag

SEQ ID NO: 11687 - DNA, 297 bp, Glycine max
  Peptide Sequence Number=SeqID_128465
atggggaggaccatagggttgaggggctctgtggtggcggtggtgttgagccagggctttaacagtggtgttggtggtggaggagtgaggctagggaatcaactttgtttccccaaacaattcttggaacatcttgactcgatactttcagtgaacatggccagtgaaatggataaatatgtctgtagaagcataaaagaaccacactcacaagtgaagcataattccaagtcaacaacaagagaacaaggagctttcaaattacagactagaaacaccatttcacaagctgaatag

SEQ ID NO: 11688 - DNA, 768 bp, Glycine max
  Peptide Sequence Number=SeqID_128466
atgtacggacagagtagtagtagcagtagttcttacgaatcggatttggcgctgttggattcgattcggcaccacttgctgggcgagtccgaatccatattcggcgccccgaatttcgggtcgggtcggagctccagtttcagcagcttggactcgtgtttgagcgacaattggggcgagcttccgtttaaggaggacgatacagaagacatggtgttgtacggcgttctccgtgacgccgttaacgtcgggtgggtcccatctctcgatgccgggtcgcccgagagcgtgtcgtcgggttttccggcggtgaagctggagccggacttgatgccggcgctgataagtccgtgtccgcctccggcggctgcggcggaggagaagaaggttgttccggcgaaggggaagcactaccgcggcgtgcggcagcggccgtgggggaagttcgcggcggagatccgcgacccggcgaagaacggagcaagggtttggctggggacgtttgagacggcggaggacgcggcgttggcgtacgaccgcgccgcctaccggatgagggggtcgagggcgttgctgaattttccgttgagggttaactccggcgagcccgatccggtgagggtgaagtcgaagcggtcgtcgtcgccagagagtgcggcggcgctgccggcgaagagaaagaaagttgtggtggtggggacggtgcaagagcaagtggggagtcaagtggcagagtgtacacgtggcgagcagttattggttagctga

SEQ ID NO: 11689 - DNA, 234 bp, Glycine max
  Peptide Sequence Number=SeqID_128467
atgacatcacaagagtacaaatatgttggttcaaagaggggatgcaaggtgtacaagggaagatacttggtgttgcaaagacagaaaaataaaggtaacatttgctatttggatgatcaagtcttgaaaaggaaccatgatagcaaaatgaagaagaaagtgaagttttctaatgttgtggaagtattgggagatacttccgttggagggggagtttgttcattttcaaattga

SEQ ID NO: 11690 - DNA, 813 bp, Glycine max
  Peptide Sequence Number=SeqID_128468
atggccactttagacgaacgcccttctgcgaaaaggtggcttcctcttgaagctaaccctgaagtcatgaaccagttcctttggggtcttggccttccactggacgaggcagagtgctgtgatgtgtttggcttagatgaagagcttctggaaatggttccgaagcccgtcctcgccgtgctttttctttatccaattaccgcaaagtccgaagaagaaaggttgcaacaggaaaacgaaaaaaaggattatagcagcaaagtgtattttatgaagcaaaccgtgggtaatgcttgtggtacaatagggttgcttcatgcacttgggaacataacctccgaagtcaagcttgttgaggggtcattctttgataagttttttaaatctactgcaagcatggatccattgcagcgggctgtatttcttgagaatgacagagagatggaagttgctcattcagtagccgccactgctggtgatacagtgataactgatgtagtgatgaaaggtttagtttggctttcttatcttgaaaatctggcatcagataatgtggacactcatttcatctgctttgcttgtgtggatggtgaattgtatgagctagatggaagaaagtcaggaccaatatctcatggtccatcctcaccaagtactttgttgaggctacttgcattaagtgctacctcctataatgaccaagatcctatccaacactccccctcaaccctgttgttagcccaaaagaattggacaggtgttgactatgctttggtgaataagtccgctttgtggtgtcctgttggaatgtga

SEQ ID NO: 11691 - DNA, 594 bp, Glycine max
  Peptide Sequence Number=SeqID_128469
atgtctaagagcttcgatgtgtctttgcgcaaggttaggatgagtggatatgccattaaaggccatggagcttgcaaatttgcaactccttatcatttcggcctagctagagttctgtttcagttgggccaaagtgtgacaaagtggaacattaagctccagggtggtttcgaccctgcaagagttggtgctaggtgggctctcaacctagcgctaaatgttttcgtagtgactaacaagaatggacctatagagtatacgagtgggcgaatccctataaatgtatggtcttgcaatcctacagagaaactccatttttgtgacttaatgttgaatccaactcagtttcaagccaaagaagagaagattgaagcagctgatgactcgcttagcgaggttgatccgctcagcgaaatgcctcagcttagcgaggcatccagcttgcttagcggatgggaaaccctagaagaggataacgagccttcggaagctgaagagtccaagagcttaagcattgaggttggcggagtttcaaaagagagacgagttttgagcaacaaggagagcttagttcaggaaaatatagagatttag

SEQ ID NO: 11692 - DNA, 648 bp, Glycine max
  Peptide Sequence Number=SeqID_128470
atggcggtatcactggtgtggcgacacgtggacgaagccgtcaggatgaatggcgagacagctgccagttggatgccaccagtcgaggtagcgagacacccatggaagtcaccagtcgtagcagcgagacccgtggaagaagacgaatatctcgctggttgcaatggcgagacagctgccagttggatgccgccagtcgaggtagcgagacacccatggaagccgccagtcgtagcagcgagacccgtggaagaagacgaatatctcgctggttgcaatggcgagacagctgccagttggatgccgccagtcgaggtagcgagacacccatggaagccgccagtcgtaacaacgagacccgtggaagaagacgaatgtgtcaaaccaagtacgttcatctcatctcgcaacacacattggcgagaccttcctgtgcatagcctgcgtccctcagctgtcccctcgaagcacgcgtgcaaggccaagtcgccactcagagtggcaagaacttgccacagcaaaatcgccatctccaattacgatatctacaccgatatcaccggctccactggcggtatcattccacgtgtcaacggcttgcggatttcgccattcatactggcgatacacttacatagctttgcatga

SEQ ID NO: 11693 - DNA, 459 bp, Glycine max
  Peptide Sequence Number=SeqID_128471
atggagaatcatttggaacctcaagattcctctcctaaggcagcggtgctattatgtgggataaactacccacgagaattaacctcctccatagaaatgtttcactgtcaacaacaacaacaaccggagtcaatcaaccatttgctgtttcagtgcccaaaaacccatggattgtggctacaattctatactcggcatttacagattgcttgcagccacacatgggcttttgatcaatcgaaggctggcaatgaaggatgggcaattgtgtggtgtacatggaagtcccgaggtgctctttgtgagttggtcatggttgagacaagagaggtcttttgccaaatttcacatattcgtttcaccaatgggctcttaatgttgatgcatgtctacgtgctgcagcttgacacattttatggacgcataggaacctacctgggggctgtgtatgtacggtga

SEQ ID NO: 11694 - DNA, 231 bp, Glycine max
  Peptide Sequence Number=SeqID_128472
atggtgggcttgggtgctgatctgatgatggcaagacataaatcagtctctagaaaaggtgaaaacagaacatcacgcactccaagagcagtggagaataaaaaggcagcgacaagtatggagtcaattgctaaacgtagacggagaaaaaagaaggcttcaagtgctcccaaatgtgagaagaagggtaagattactcggtatccatacgaatctatgctcagaaaataa

SEQ ID NO: 11695 - DNA, 222 bp, Glycine max
  Peptide Sequence Number=SeqID_128473
atgagccactgcgagagagaaaaacccaccacggagagagcaaaccgagtgagggagaacgaggttagaagggagaacgagagtcacgcgagagaaatggtcgctggagaggaagtgagatactccaaaaatacaacaagaattagagtccagacacatctaataccgatacacgtcgatacgtcccaatatgaatccaaaaagtatctatcaactttttaa

SEQ ID NO: 11696 - DNA, 489 bp, Glycine max
  Peptide Sequence Number=SeqID_128474
atggccatcaaggtccataaagagtgcgatgagctgagggacatcaacattgccacgaccgaagcattggaatgggaaacgaagagggcccgaaaagaagaatggggccaaaacaagtcaaagaggagcttgttggaacagttgagcaggacgaaagagaacatgtgggctatcattgaccaatacaaagagaagctaaatctagctgcgacccatgaacaaagactagaggacgagtatgcgaaagtatcggtcctgcaagtggaaagggaagcaagggagagggtgatatattcattgcacagagaagttatgatgtggatggacaggttcgctttcaccttgaatggaagccaagagcttccaagactgttagccaaagccaaggcaatggcggacgtgtactcggctcccgaggaagttcatgggctcctcgattattgtcagcatatgatcaatttgatggcccacataattaggaaccgctaa

SEQ ID NO: 11697 - DNA, 2862 bp, Glycine max
  Peptide Sequence Number=SeqID_128475
atggtgacggaagccgaatatactgatttttctgatatgcttgagcagactggtctggccgaaatggatagtcaaggagactattttacttggtcaaataagcatgtagaaggcaccatttactcgataattgatagagttctggcaaatgtttcgtggtttcaaaacaatctgaatgtgaaccttcacatcatgcccccaaatgtctcggaccacgctcttctatggctgcaacaccgcgatagggtaattctgaaaaaatcccacttcaaattcattaatggaagtgtcgatctggatggttacaatgatgcagtctcggccagctggagagagccaatcacaagcagacctatgttcatggtctgggaaaaattaaagcgtctaccgccagttctgaggaatttaagtaaaccactgatgcatctcaaacaaaatattctccaaaccagggggaacctgcaacaggctcaacttgatctctccatcgacctgatgaacagtaccaatattgctaaggaacttgaggaaaatgttcttaggcagaaggcgaagattgattggctaaaattaggtgatggcaacaattcatttttctacgcaaccgttaaattgagggctaatgctaaagggatgaacatgctaaggaagattgatggtacagtttgtgcaactcaggaagatattgagaatctggtcctggagttttatggtgagctgatggggaaaaaatctaccaatctgaagcatatagatgcagatgctatgcgaagaggtgggcaactttcaatggagcaacgacagcttcttgttaccccagtcagtgatcaggaaatcctaaaagcgttgaatggtataggcgatttgaagtctcccagtatcgacggatacggggcaaaattctttaaatccagttgggatactatcaaagatgatatcaataatgcattatatgactttttcaataatgatagattgcttaaggcatttaactgcactattgtaactcttattcccaagcatgagaaggttgtctctgtgaaagactatagaccgattgcaggatgcactatcttatataagattatctcaaaaatacttacagctaggcttggaaaagttttgaatagtattgtaagtccgtgtcaagcggcctttgttcctggacagcagatccataatcacattctgctggcctatgagcttataagagggtatgctaggaagaatggaaccccccgatgcatgattcaattagaccttcagaaagcgtatgacatggtggactggtttgctctggaaactattctgctggaaacaggtattcctaaacaatttgttaagtggattatgcttactgtcacttccgtcacctacaggtttaatatcaatggtaattacaccaaatgtatgaaagctaataggggcatacgacaaggggaccccttatccccggtgttgttcgttattatcatggaatatctcaatagactcctccataagatgcaaaggaatcctgatttcaatcatcattccaaatgcgaaaagctaaatattactaatttggcctttgctgacgatgtcttgctttttgctagaggagattgcagatcagtagagatgttgatgcagaccttgaataccttctctgaaacaactggtttagtggtaaacccgagtaaatgcaatatttactttgagggggttgatgctcctacgaagactgatattatgaagctgacaggttttaaagaggggcccctccctttcaaatacttaggtgtaccattgactagtaagaagttgtctatttctcattatctcagtctagttgatagaataactggaaagattaatcactggagtaataagttgttgagttatgcaggccggctacaactcattaagagtgttaccttttccatagcaaactactggatgcaatgttttccgttgcctaagtttgttatccataaaattaatactgtttgtaggactttcctttggacaggtggtgttgacaaaagtcgtaaaagtcctgtagcctggactaatgtttgcaggcctaggaaatacgggggtttgaatgttattcacctccaaacgtggaatcatgtcactatgatgaaactactttggagtcttagtgagaaagcagataatttgtgggtaaagtggatacatacctactatttaaaaaatcaaagtataatggagattccacagaagacaactcagtcttggattatgagatccattctcaatcaaagagttcatattaataatatgcagagtgatttgggccagagggataggggaaaattcagtatgaagacactatatctgaagatgcgatgtgaaggctcgaatgaggttgtgtggaatagacttttttgtggtaaccctgctagaccttgcactttgatgactctatggcaagcctgccacggtaggctacccacaaaagatcgtttgctaagatttggaatgctaggtgataagatttgttgcttctgtgagggaccagaatcccatgatcaccttttctttggatgtagtgtccttggtgatgtgtggaaacaagtccttgagtggattcaggtaaagcatcatcctcaagaatggaatgaagagctaaaatggattattaggcacggtaaaggaaagggacataaggcctctattctgaagctggaggtgactgaaactgtctatggcatctggaaataccgcaatgctaagatttttgaagaaactatagataatacgaacatagttgattatattatagataatatagtttatagagggtggtataacaataaactgaaatctcacatagctcatttcatgatgttttga

SEQ ID NO: 11698 - DNA, 276 bp, Glycine max
  Peptide Sequence Number=SeqID_128476
atggagcatctgataaacctcgatctagatgtttttgttttatccagaatgaaacaatttaggacaatgaacaagctaaagaaagctgctctgaaggaaatgtttaaatccatggacatagataatagtggaacaatcacttttgaagagttgaaagctggtctgccaaaactgggtactaaggtttctgagtctgaagtaaggcaattgatggaagcgaataccgtcagaattatggttcaaggtgcaaacctgaaaaacatgacttgtaattaa

SEQ ID NO: 11699 - DNA, 1093 bp, Glycine max
  Peptide Sequence Number=SeqID_128477
gaccgaccctctcaatggatcaatctcttgctttctcatcagggtggacccttgggtactagtaccctcaccttcagagggctacacgccctagccttcagagggctacatgtcctcgccttcagagggctgcacgccctcactttcagaaggctacatgccctcacctacagaggactacacgtcctcgccatcagagggctgcacgctctcgccttcagagggctacacgtactcgccttgagaggaccatacgtcctcgctttcagaggactacacgtcctcaatttcagagggctacacgccctctccttcagaggactacacgtccttgcctttagaggaccacatatccttgcctttagagggctgcacgccctcgccttcagaggactacatgtcctcaccttcagaggactacacgtcctcaccttcggaagactacacgtcctcgactttagacggctacatgccctcaccttcagaggactacacgtcctcgccttcagagggctacatgccctcaccttcagaggactacacgccctcaccttcagaggactacacgacctcgccttgaggactacacgtcctcaccttccgagggctacacaccctcaccttcagaggactacacgtcctcgccttgaggactacacatcctcaccttcagagggctacacgccctcgcctttagaggactacacgtcctcgccttcagagggctacatgccctcgccttcagaggactacatgtcctcgccttcagaggactacacgtcctcgccttttagaggactgaacatcctcaccttcagagggctacatgccctcgcctttagaggactacacgtcctcgcctttagagggttgcatgcacttgccttcagagtactacatgtcctcgccttcagaaggctgcacgccctcgcctttagaggacaacacgtcctcgccttgaaagggctgcacgccctcgccatgagagggctacacaccctcaccttcagagtactacacatcctcgccttcagagggctacacgccctcgcctttaaagaactgcacgtcctcgccttttacaggactgaac

SEQ ID NO: 11700 - DNA, 363 bp, Glycine max
  Peptide Sequence Number=SeqID_128478
atgcgtcctagaaccgaaccaaaacaacgtgtgacgacgtcgtcatggtactctgtagaggtaaaagcgaattcctgtcccaaaacctatgaagcacggacacccagtcccttgccgtgttcggtgtccgacatgactccgacactaacaccgacacgacaccgacgcccgtgtatttgtttgcatttagtttcacatgatgttcccaaagggtacttagttgggcttgagcttcggaggtttatcatttgttcaaggttttgctggaaaaggctgcagaggaatttgggtttgatcagagtggtggactcaccattccatgtgaaattgagaccttttgaattgcttagggaaccatcatga

SEQ ID NO: 11701 - DNA, 288 bp, Glycine max
  Peptide Sequence Number=SeqID_128479
atgaaggggaagggcaaagggttcagaaagtttagagaggaagaaaaacgaagggaaaggaaggaaaaaaaagaaaagcgaagccgaggcgttgccgaatcgcaaccgaggatcattccctacatcgcttttcttgctagtcttgtgccctgtgcaacaatcgatgaagcccctcagcgtcgaaggttgacaacatatgcgcgtggacaacggataactacacctattgctgagaatgttgagcatatggatcttgcaattgacgaggttcatgagcagcctcagtag

SEQ ID NO: 11702 - DNA, 234 bp, Glycine max
  Peptide Sequence Number=SeqID_128480
atgaagcttgtaacgccactggcaatgacgggattaacggatgtcgccattggcagcagtgggacggggctgagtaggagagaggagcatgtaacgccaatgggactggcgggacatgctgaagccatgccgccgttggtgctggcgggacatgcctacatggacagtcccgccattggcacctgcggttcccctttgaagcatgtgaccttgcccctaccgatgacagtctga

SEQ ID NO: 11703 - DNA, 780 bp, Glycine max
  Peptide Sequence Number=SeqID_128481
gttgcgagggttaggaatgcattggcatatgctacacataagttcttccaagaaaatgggtttgtatgggtctccagtcctatcatcacagcatcagattgcgagggagcgggtgaacagttttgcgttactaccttggctttgagcagaaggtttggttttatcctagattctggagtaggaggggacctctggcctctggggatgctgctctttttggcttatggaaaaacactgataccaagttctcatgaaactactgattctcctgttgatgctattccaaaaacaaatgacggattaattgactggtcacaagtgtatacatttggtcccacattccgagcagaaaattctaacacttctaggcacttggctgaattttggatgattgaaccggagcttgcatttgctgatctaaatgatgacatggcttgtgcaactgcttatctccagtttgtaataagacatgttctcgataattgcaaggaagacatggagtttttcgatacatggattaataaaggaatcattgatcgcttgagtgatgtagcagataaagatgttgtgcaaataacctacactgaagcgatagatctgctgtcaggagcaaataagaaatttgaattcccggtgaaatggggtagtgatcttcagagtgaacatgagcgttatataactgaagaggcattcagtggatgcccagtgataattagagactatccaaaggcatgctacttttcccctcatcttctggacatggcatatggaaaacattag

SEQ ID NO: 11704 - DNA, 453 bp, Glycine max
  Peptide Sequence Number=SeqID_128482
atggccgactcatctcaagaccttgaccaacttctcgatagtgctttggatgattttcagtccttcaacctcaatcctccccctccaagtggggaagcaactgcgaatagcaagaaggagagtccttctttgccgtcgggggttcaaggattgggcatgggtttacccgatttgagaacgaagaaaaaggggaaacagaaggcttccaaagacagccacgtgtcggaggcgctcaacaagctcagggagcagaccaaagaggctgtgaaggggctggagtctatatccccacccactgccgatgatttaggtaaggatgccttgatggaagattgggtcaaacaatttgagcagcttgctggctctcagggggagaagagggtgggggaaggcataatgaaaatggagaacttaaccattaatagctggtattctgaggtggtccgcctatga

SEQ ID NO: 11705 - DNA, 735 bp, Glycine max
  Peptide Sequence Number=SeqID_128483
atggactccagtgattcagactttgaagaaatgcttgagtgggaactcaatgaagatttcataaatgatgaccatccatatttaccctcttttcatccgaacacatcatcagctgctaatgttgagcaaaaggaaggaaaaagaaagagaaaatcaaaagtaaatgaagcatcttcttctgctaatgttgagcaaactgtaatgctagagatgcaaatgtcaaaagttcgcgttatgacagaattgatacggactagcaccaagaagcaaatggccgttagcattggcgttggcgccacaaaagcgatatcaatggcaatagcagcgaggcacctcggaacaaaaccttacgcagcagcagcaacaacaacggcacttgctcttctctcactccacaaacctcttttcctccctcattcctctcccttctcctctcgccgcgctttctgcgccgcgactcttcgcaccgccgataacagagtgcaacagttccgcaggaagcttagggtttccgaaatcaaagaaggcgacggcgccgacgtgttcggccgcaacctcgtcgtgcagggctggattaacgacggttcttgcctttctaacatgcaatgtgtgttgaattcggaggctgaaggttacgatcaggtagaatctggcttggttaccacgggtgcttcagtgtgggtgcaaggagttgtggtgaagagtcaaggatcgaaacagaaggttgaattgaag

SEQ ID NO: 11706 - DNA, 546 bp, Glycine max
  Peptide Sequence Number=SeqID_128484
atggaattaataggtttgaaaaagctcgagtatcttaatattggatgctgtaaatgtgttacggattcagacataaagtctatctcagagcttataaatttgaaggagttacaaatttccaacagcagtattactgatattgggattacctatttgagaggtttggagaagcttaccacattaaatgttgaaggatgcaatattactgctgcatgtttagagtttattcatgccttaacttccttggcatgcttaaatctcaacagatgtggtctctctgatgatggatttgagaaaatttctgcatgcacttcctttcctgcaggtcttaaaaacttgaagaggttaagcctggcttttaacaggatcacagatgcatgcttagttcatctgaaagatttaacaaatttggagtatttgaatctggattcttgcaggataggtgatggcgggctagctaatttgacaggcctcacactcttgaaaagtctggtgttgtctgacactgacattgggaacagtgggctgcgttatatatcaggttga

SEQ ID NO: 11707 - DNA, 351 bp, Glycine max
  Peptide Sequence Number=SeqID_128485
atgaacaatcgaaaaggtccagcaggtgctagcaccaatgacagaagtaaactttgtgcgttgtggaccaatttctcaatgtcagtggtccttgatggtgaggatgtgggtatagatgagtgtattggagatgatatgctaaatgaaattgataagtttcataatagtgacgaggacattgaaactcaaggaccgacacaaggattaggaggacctatgactagagctagagtcaaaaagccaaaggagaccctaaaacaagtggtagcaacaattcttgaagttgcacttgcggtgaaggacattgaaccaaaattatttcagtgcatgattgttattaaagacccatga

SEQ ID NO: 11708 - DNA, 273 bp, Glycine max
  Peptide Sequence Number=SeqID_128486
atgtgttttatatatggtggaaaatcaaaggatgtcccagaaaatatcattggtgagttaattgatatagagcaatggcaacttgagagtgacctaaagaaaactgtttcgactccgaggaatgaaaggggtaatacactcacatgcaatttgtggggagcctttgcaatccagttgaaaacctacatggatatgaatcaaaaggagtctgggccagtggtgatcttactgcaactagccaagattaaagtagctaaaggtttgttaccatga

SEQ ID NO: 11709 - DNA, 855 bp, Glycine max
  Peptide Sequence Number=SeqID_128487
atggctcatcgctacgatagtaaccccttcgacgaagaagaagtcaatcccttctctgaaccagctgtaaggggaaaaacatcaagccaatcaagttatagcgggggtgcattttacactacagtcatggccatagcccataagtgcattagtgaacaaccttgtttcttcaacttaagtgatctaacttgtactggtgatgttgttcgcaaaaatcctggaagtgttgcccctgccacaaattcaaggctatctcctcttaatcctgaacccgctgattataactacggctttggtgcgacagttgatatacgtcttgatccatcaatggatttgaaaaagaaggagaaagaactccaagccaaggagaatgaattgagaaaaagggaacaggaagtcagacggaaagaagaagctgctgcacgagctggaattgttcttgaggagaagaattggccgccatttttcccaattatccatcatgatatcgctaatgaaattccaattcatcttcaaagattgcagtatgttgcatttacttcattgttaggagtgaaaatatggtttcttgctattatctacttcatagcaggaattcctggagcatatgtcttgtggtatcgcccattatatcgtgcttttaggactgacagtgctttgaattttggatggtttttcttgttttacctgcttcacctaggattctgtatcttagctgcagttgctcctcccatagttttcaaaggaaaatccttgacgtatgttaacttcatatatgtacacttcattaacatgacaatattgcttaatcctttttgtttacatgcggctttacccgtgaaatatgaagattga

SEQ ID NO: 11710 - DNA, 225 bp, Glycine max
  Peptide Sequence Number=SeqID_128488
atggcgggtcacgccctttctcgtgatattctggttcaagcattgtgtggtgtggaccataaagatttgaagcagctttttcatgtctcaaaaatgattagagaagtgactatgatggctaaggaacattttgatatctgtacaccaaagacatttgcttttcttaatccattttgttcaggtgcaaatgggtttaaggaaattgaaactccaaaggttaactga

SEQ ID NO: 11711 - DNA, 1377 bp, Glycine max
  Peptide Sequence Number=SeqID_128489
atgaaagaaaattacttggtctgtaaagccaaatatgaagacttgcaaaagcggtactctgggaacaaggcttggtttgaggaacttaggaagactagagtagcagagctgaaaagagctctggaggtgtctgaagattctattgggtctcttgaatctaaacttgaaagccttaaggctggaaagaatgagaaaaaagatgatcgttatgttgacaaaggatcggctcgtccaaagttacatgtagcctcacagaaattggaaagagttgaatcttccaccaaagagacatcaaaagatgggctatctgctgggagtttcacacatgaaaccaggacaaactggtctcctgaatgtccggttccagcacggtctgtggaagatatggagactaagcctgaggtttcacactccactgagcaggccaaagttttgaatgtagataatcgggcacatactatatacgaaggacaaggaggaagtcttaaaaaacggagagggaagaggaagaggaaggattgtggcagaaatatgaaggaagcaagtgttggggaaagtgacttgttagattcggctgacattgtgtcatggtgtaaagaaagttcgaccagcaactgtggtgaagttgccaaatcatgtggtgtagatgatcaaaataggaacttaaaaaaggatagggtggaagacatgatggagattttggattttatatttgaaactaaaggtgctccggctttccgacgcagacttgatagtcagctagtttctgagttttttcaccataatgcctttgatgataggtccattagtttcttagatgcagatgcactggatttaaagagaggaaggtacaagaaaatgatccggcaacatatggactttgacactataaggtcaagaattagcagccagacaattaagtcgagtgtagaacttttcagggacttgctcctactcactaacaatgccttagtcttctactccaagagcactcgtgaatacaaaactgttctactgctaagaggcattgtgaccaaaaaaatgaaggaaactttgaagggtactacgagcaacaaagtcaccactcaagctaccaatgttcctattaaactacctgtgcataatcctcatgtgaaaccaagaagtgtaaggccaggcaacagaaaaatagttgcaaaggcagttggtggcaacaactctgcatctggggtgtcacatggaactaagaaacctagtaaagttgaatctccatcctcagtggaatccttaactgtgaagaaaaaaggttttggtcgaccaaaaaaggttggacgtggggctgcaggtcagaggcctgcaatgccaatgaagggaaagaaaagagttaggacaaagtga

SEQ ID NO: 11712 - DNA, 282 bp, Glycine max
  Peptide Sequence Number=SeqID_128490
atggatccagcaactgctgaaagactttcccaaatagatcaagaaattcaaaacatcgataccgagaaggcccaacggcagcaaaccctggctgccttttgggagcacctgcctcccatcgatccagcgcttgtggctgcagccatgcaacggatcctggaccgcattcgcggtctggaagaaaggaggagggccctcctccaagaacaacgagacctcattttgtgtggctggtttgtctatgtgtgcttgagatctactccggatgcttactggagatag

SEQ ID NO: 11713 - DNA, 870 bp, Glycine max
  Peptide Sequence Number=SeqID_128491
atgccattgtgggattcggcacttcgctcgcttttgttctcgccgtctttgctgcctcaaggaaaggtaggtgtagccgtgtatggtgtaggttttatttttcgattcccgaggccgatgtggagcgctgtggagacccgacacgatcaaaacgacgctcgggagtttgacgtttctggtgggagcaagtcaacgctgtccgaggctgacacggaggacaacaacgttgctgttacgcaaactgataaatctgtagttgtagaaaagcctaaacgtgttgtcatcccggtttgtgtggattctacccaagaagaagcgttgtcagtcttaaagtcattgaagataattgaagatgatgtggaagctaatgaattgtgtaccagaagagaatttgctagatggctagttaaattgaattcttcattggaaaggaatcctaaacacaggattgctcctatagtatcactttctggatctgtatttactgcatttgatgatatcagtatcgatgacccggactttagatccattcaagtcttagcagaagcgggagtgatccccagcaaattatcttggaataatagtttcgattatggtggatttgacactcaacaaaacatcaatttttttcctgatagattcatctcacgacaagatctaatagactggagagctcagttggagtatgacttcttctctggggtagttgaccagatatcaattaaaaaagcaggttatatggatgtgaaggagatcatttcttccgcagtttatgtggacatgttggcaggggataagagtatacttagaaaagtttttggtatcttctctcaggcttctcctcaatgcattgatgtttattttgtttag

SEQ ID NO: 11714 - DNA, 249 bp, Glycine max
  Peptide Sequence Number=SeqID_128492
atgccaaacacaagcacaagtgtggctactggggtacgctcaatagcttttcatcctgatggaaggaccctatttactggacatgaagatggtttgaaggtgtattcatgggaacctgttatatgtcatgatactgttgatatgggatggacaacacttggtgatctttgtattcacgatgagaaacttttggggtgctcattctaccgaaattctgtcggagtctgggtagcagatatatcgatttag

SEQ ID NO: 11715 - DNA, 2271 bp, Glycine max
  Peptide Sequence Number=SeqID_128493
atgatagtcaggttaggactcatagttgctgcttcacttgcagcttttacagttaagcagctgaatgtcaaaagctcaaaaccagaacataaagatgagggctcagaagaggagcatgtcacaagagttactgatcttctccaagagaatgaaggggaggaggaagaggagaaagaggaggttaagttaattagcagcataattaatcgagcgaatgactttgaagatgatattctaccagaatttgaagatcttctgtctggggagattgagtttccgataccacctgataaggatgagaaagacaaagtttatgaaattgagatggcacacaatgcaactgaactagaaagattgcgacagctagtgaaggaattggaggagagggaagtgaaacttgaaggagaattgcttgagtactatggtttgaaggagcaggaatcagacattgtggagttacaaaggcaactgaaaatcaagactgtggaaatagatatgcttaatattacaatcaattccttgcaggcagaaaggaagaagcttcaagaagagctcacacaaggagcttcagccaagagagaacttgaggtggctagaaacaagatcaaggagctacaaagacagatacagcttgaggctaaccaaacaaaaggccagttgttgttgcttaaacaacaagtttctactctactagtgaaagaagaagaggctgccagaaaagatgctgaagttcaaaagaaattgaaagctgtgaatgacttagaggttacagtagtggagcttaagagaaaaaacaaagaacttcaacatgagaaacgagagttaatggttaaactcaatgctgctgaatctagagcagccgagctctccaatatgacagagagtgaaatggttgccaaggcaaaagaggaggtcagtaacctgaggcatgcaaatgaagacctgttaaagcaagttgaaggactacagatgaataggttcagtgaagttgaagagcttgtataccttcgttgggttaatgcatgcttgaggtatgagctaaggaataaccaaacaccccaaggaaaagtatcggcccgggatctcagcaagagtcttagcccgaaatcgcaagagaaggctaagcaactgatgttagaatatgctggatcagaacgaggacaaggagacacggatcttgaaagcaacttctctcatccttcttcaccaggaagtgaagattttgacaatgcttcaattgatagctctactagcaaatatagtagtcttagcaagaaaactagcctaatccaaaagtttaagaaatggggtaaaagcaaagatgattctagtgctctttcatcaccagctagatccttttcaggaggttctccaaggaggatgagtgtgagtgttaaacaaaggggtccactagaatccttaatgctaaggaatgctggagatagtgtgtccatcaccagctttggtctgagggatcaggaacctattgattctcctgaaactccaactgacatgagaagagttccatccagtgattccttaaattctgttgcttcttcattccaattgatgtctaagtcagttgatggagctctggatgagaagtatcctgtgtacaaagatcgccacaagttggccctggcaagggaaaaacaacttaaagaaaaggctgagaaagcaagagtgctgaggtttggtgacaattcaggtttgaatatgaccaagcctgaaagaggaagtactatatctttgccaccgaagcttactcaaataaaggagaaaccagttgtttctggcactccgaatgagcaatctgatgatggaaagaatgttgataatcaaagtattagcaagatgaagcttgctcacattgagaaaaggcctactagggtgcctagacctcctcctaagccatctggtggtggtgctgctgctgctgttaccacaaatgcaaatccttccaacgaagtaccatctgctccaccaccacctcctcctcctccaggtgctccaccgccaccaccgccaccaggtggaccacctcccccacctcctccccctggaagcctatcaagaggcggaatggatggtgacaaagttcatcgagctccacagctagttgaattttatcaaacattgatgaaaagggaggctaagaaggatacttcatcatcactattagttacttcagcaagtaatgcatctgatgctaggagcaacatgattggtgaaattgagaatagatcatcattcctcctagctgtatgttga

SEQ ID NO: 11716 - DNA, 357 bp, Glycine max
  Peptide Sequence Number=SeqID_128494
atggtgagagagcataacattaacagtggatggccaccaataggggccccactactgaacgtgcagagagatgagtatgatcagcattggagcagcttcgatagctctgtgaatgctgtttcttttggctttgttgccactgccattcttgtttccatgttcttagtcatggctatctttgagaggtttctcaaacctacctcgccgcccattttgccgtccggcggcaggaaccgtcgccggagctctcagatggacttcaatgggaagcttggacacccttcaccgaaaattcatgacaatgtgaaagcctttttttttgcttttggcttggttcttcaagtttcctgttgttaa

SEQ ID NO: 11717 - DNA, 783 bp, Glycine max
  Peptide Sequence Number=SeqID_128495
atgggttgctgcgtcagtagtaccaacagatctcattcttcaccctcaagcaagcctattgaccgaccaagatctaccgcgaaaggttcagaaaacagagcaccgccaccggaggaagaaacggtgaaggaagtgttgtctgaaacacccaaatggaagccaaaattcgaagcggagaagccaacagagagcgatgctgagaacgagaaggagaagctgttcgtcaaacccgatgagatctctgaggtttctgaagtttgcagtgtaagtgagagcctgtccacactcgccgaagaagaagcacgtcaaagggtcaacagatctccggcaaaggtgcgcaaagcacgctccttttccggcgagttcggctgccggagggaaatgacggcggggaagtctccggcgaggaggccggagcagtctccgggaagaaggaatattgggtcggtgagagttgttcaaatggccaatggtggaaccgggagccagcctcgccggcgagactccggcgagaattccggccgccgatccaggtcgccgggcacccgcaccgacagcgtgtcaactagatccatcgtgggtcggagcccgtcgaagaggaggacgcctatgaatcaatcaccagctcgggtcagaagctgcgcggcggagagcggtggccggaaaatggagaattcgagcatggagggagtcagttattattggagggaaagggtggttggaccctacttctacttgcattgcaacatggccttttggatagttgaatacgtaaatggttaa

SEQ ID NO: 11718 - DNA, 393 bp, Glycine max
  misc_feature (4)..(4): n is a, c, g, or t
  Peptide Sequence Number=SeqID_128496
atgncggtgtcctctttgcccaatattttagacattaaccgtgtcgaagtgtccggtgtccatgttagagttcatgcttcatgggtagcagtacttatggaatcccttataaagttatgcaagcaagaagcaattcagaacttgggtctactgcaaagatggctccccctgctgctgctacttgttactaatccacaacgattcagaacacaaagaagaagaaaaagaagagattcttcggtgggtgaagatggaaatccgaagcggaaggtaggaattggattagatgtgtcagatcaaaaatggtctcaaaagaataataataaaaagaagaaaaagatgaagaagaagaagaatacagattcaacagtgagaaatgagaaaggggaatga

SEQ ID NO: 11719 - DNA, 273 bp, Glycine max
  Peptide Sequence Number=SeqID_128497
atgggtttgttggagcgcttggaatgggtgaatacttatggcaagaagcgttgtaggagcttgttttggagggtgcgtgctgcattgaagagggcattcaagaatgggggcaagcagagactcaaatttcaatacgatccttcgagttatgcactcaacttcgatgatggttgttgcgcggccaagaaattcattggtgatgcacgactcatggagcttaccgacattcacaacaacaccttggtttatgtgctttggatcaaaaccaactga

SEQ ID NO: 11720 - DNA, 1122 bp, Glycine max
  Peptide Sequence Number=SeqID_128498
atgggttcgctcccttctccaccaagaccaacagctccaccatccccagaaaatcttctttccaatcatgtagtggttgctgtgttttgtcctagagaaccaaccccaggtgtcagtctcccaaattcaattgagctatattacccatccatgaacacatggacctatgtaggcacaattcctggcctaattgatgaccaaatcttaaagggttttgccatagtctccctaggggactttatttacataattggtggccaaatttgtcacaaagaaatggttcatgtatctgatgaatgtgctgactacgttgatgagggtatcaaagttgtggcaacagttctccgttacaacattagaaccaaccaatggttcaattgtgcaccactaggtgtggcacggtatgattttgcttgcacagtttgtgacaacaaaatctacgtggcaggggggaagtccacgctgtcatgtgccgggccagcacgggggatctcatcggctgaggtgtacgaccccgaaaatgacaagtggatccctttgcctaatttgcatattttaaggtacaaatgtataggtgtgacgtggcaagggaaagtttacatagttggggggtttgctgagagagaagactcggataagacaatgccaagcatagtggaacgtagttcagcagaggtgtatgacacgcaagcagggaagtgggacatgatagcggggatgtggcaattggatgtgccacctaatcagatagtggcagtgaatggtacacttttgagttcaggggattgcctgaatgcatggaagggacacattgaggcctatgatggaaaactttggaatgaagttgatggatcgcacaagagaaacctgtccacattagaggacaactatgagaattggcctccgaatgatcaaagactgtacctaactatggcaccaattgggactcgtttgtttttcttggcaggttacaggataggtggggaactaccaagaactatgtctgttgtgcacatgtttgacacttcagccaccagggatgcttggaggagctttgaaccaatggaattggagggtgagaaagagctttgtggccattgctgtgttgtgcaactctcttaa

SEQ ID NO: 11721 - DNA, 2205 bp, Glycine max
  Peptide Sequence Number=SeqID_128499
atgaagttggagttgcatgttggaatttttgtcacctgcatggtgattctctctgggactttctgtgttggagatactgacatggttgatgttgcagcaataaatagtctttatgtttctctggggtcaccaccacttcaagggtggaaacccgtgggaggagatccatgtttggaactgtggcaaggtgtggcttgtgtcttctccaacataactgcaatacaccttggaggcatgaatttgggtggacagctgggcagcaatttgaatttcccatcagttatagaattggatcttagcaacaaccacattgaagggcctattccatttactttgccccctactctgaggaccttgtctctctcggcaaatcggttgaatggaagcattccagatgctttgtccttattaactcaattgtcaaacttggacttgtcaaataacaacttgagtggtcagctgccttcatcaacagggagtttatcatctcttaccacattgaatatagagaacaatttattctcagggccaattcctccaaaattgctgactatccccaatttcagtaaaaatgggaatccctttaatactactattattccatcacctcctgctgcggcccctgcacctgtagctataggttcatccccccaagaatcgccttggaaaatggcacatggtccttctgccctgacagcaccagtgcctgcaagtactaggaagtctgttatagctaagagtgtcatttggattgctggtgcaggccttttagtatttattgtattgggagtttgtcttgtaatgttgaggtgcattaagagaaggccggagaagaaaaatgctaagaaacttgatgatgtgggtgtgtttgcgggacctttgaataaacctacatgcagtgactctgatgttgaaacagctaatcaagaggagaaaggtaaatgtgaagtaccaaatagaagtacaaatttcattccaaaggttcaggaagaacaagacatatatgtgaaagtagtatctgcaacatcagaaggcaataatggtcatgaatcaatcaacactggaggggcttccaaactttcatccttacagccaccaccacaacactttctcccaaccagtcctggtgagaaggtcatcatcaatcctgctataactacacaagtaactgaaagacaagttatgtcaaattccatcagagtttatactgttgcattgcttcaacaatatacaaatagcttttcccaagaaaactgtattggggaaggtacacttgggcctgtttatcgggctgagctccctgatggaaagctaataatatgtcagcttatcagctgcaataggaatacttctgttttgcccttttgtcttgctgaggcctgggttttcttgagagaggaagaacttgtttgtgttgttcagtttttgcctctattggctgtgaggaaattggatgctactgcttccatgggtcagagtcatgaacaatttcttcaactggtgtccagcatttcaaaaattcagcatgcaaatattgcaaggcttgtgggctactgtgctgagcataaccaacgactacttgtatatgaatattgcagtaatggaaccctacatgatgcactgcatggggatggcaatcaccgtatcagacttccatggaatgcacgcattcaggtggcacttggagctgcaagagctttagagtatctgcatgagagctttcggccatctattgtgcatcgaaattttaggtctgctaatgttcttctgagcgacaatttggaagtgtgcatctctgattgtggattagggccattactatcttctggctctactggtcagttatcaggacgcctccttacagcttatggttacagtgctccagaatttgagtctggaagttatacgcagcaaagtgatgtcttcagttttggtgtcgtaatgctagaactcctcactggacgaaaatcctatgacaagtcactgcctcgtggagagcaatttttggtcagatgggcagtccctcaactccatgacattgatgcattgtcaaaaatggttgacccctgcttaaacggagcctatcctatgaagtccttgtcacgttttgcagatattgtttcttcatgtatacaggcaaagcgtgaacctgaattccggccggcaatgtcagaaattgttcaagatctcttgagaatgatgtaa

SEQ ID NO: 11722 - DNA, 177 bp, Glycine max
  Peptide Sequence Number=SeqID_128500
atgggtcaggaaaataaaacactcaaatcttttgcctttatatttctcattgatctgttggatatcaagcgtgtgggaagtcagttaagcttgtcaggtgcagtttcctcacgattcttgacattatggacaaatggccgcagtcacaatatgatcgcccgagtccaaaaacgttga

SEQ ID NO: 11723 - DNA, 429 bp, Glycine max
  Peptide Sequence Number=SeqID_128501
atgacctccactcacagcattgaaaaattgggagaattcgtcggcacactcattaaaggcacaaaaccatacctcggaaggattggtgtcctcgtcgagaacgctcataacagtgtccaaatcgatgcagagcttatcgtcgttggcgacgtctccgtcgtcgcccaagagatacggaaggcgtcgccacaaaagcaaaacctccggtggcaaatctcgaaatcgaagagcgatgaggttttcaatcccattccaaaaagggagagagggaggcgtgaagcgcgggttcgtgaagaatctgcggaggtttctgagaaggttcgtgaagcgacttttcttcgtaacgtcgtgttgtgttcggaagaagagagagaaagagggaaagttagagagagaaaggacaaagtcgttcgtgaatcgtggatgtag

SEQ ID NO: 11724 - DNA, 471 bp, Glycine max
  Peptide Sequence Number=SeqID_128502
atgctgcagagtagtcctgaggatttttcattgaaaaataattctcctggtgaagctggcctccatgataattttctacttcaaaatgggaattatgtccttgaatgtaaacatgaaaaccaggggccttcatcacagattttttcttccccaaatgctcttgctggtggtttcagggactcctccatggttgaaagtgatgaaaattgcttcacagaaatgacagaagtttctaattgtgagttgcctgcttacattgcagacagaaggttccctgttcctgaggcgatttcaagctgtgcagctgtctgtggagataatttgaacctgactccgtggaagcgtgaaaatgacagccaaatcaagcatataggatatgatgcacaatctgaatgtatgaaaaatctttactgggttatcattagacaaagacattggcaactcgttcattctttaaaaattttactttag

SEQ ID NO: 11725 - DNA, 762 bp, Glycine max
  Peptide Sequence Number=SeqID_128503
atgggaacgtcatacatcaacgtaattatgcagaaacccatgtgtctctacgtgaaaattgagaattgggtccagttgagacccggtagaaaacgaagcggatccgaactcaatgaggaaaaccgaagcaaatatctgtatatcacattgaaacagaactctagaagcaacttggaagaaagggatcgccggcggcaccctccgaagacggagatacacccactcacaaccactttcccggaaaataaccaccgaccacaatttcttggaatttattttgcggctgcatctaagaaactgataacaagagaagagtgggagaagaagcttagtgatgtgaagattagaaaagaagacatgaataaattggtaatgaatttccttgtcaccgaaggctatgttgaagctgctgagaaatttcgaatggagtctggaactgaacgcatcctttttattaatttatttatttatttatttatttttgggtctatgagtgcaagagattcagacatagatcttgcaacaataacagatcgcatggctgttaagaaagcagtacaaagtggtaatgttgaggatgcaattgaaaaagtgaatgacttaaatccggagatactggacacaaatccccaattatttttccatcttcaacagcaacgattgatagaactcatccggaatggaaaagtagaagaagctctagagtttgcccaagaggagcttgcaccaaggggagaggaaaatgtaaatctaatcaaatga

SEQ ID NO: 11726 - DNA, 171 bp, Glycine max
  Peptide Sequence Number=SeqID_128504
gagggtctgttcctctatggatgccgccagaggaactggcgacataggtgtcccgccattgcagatggcgagaagcatgctgagctggagggtgccgccagtggcacaagcgagatacaccatgctggaatgccgccaatgcaaatgacgttatgcagtgaattattataa

SEQ ID NO: 11727 - DNA, 458 bp, Glycine max
  Peptide Sequence Number=SeqID_128505
agctccttgatgctggggagcttcttggcaaccccaaagtagcggtatcaagggccacgctcgcccaggttcgggacatcaacgatgattccattgagatttgttatcttcgcggagtgcttcaagtaatttggcctgtcaagctccacgatgcggcattcccagtgagactttttgctaatgaccttgttgatcttgtcattgagattgcggaggcagtgctcgtcgagacctctgttctggatctcagctacttttcggtcgatctctcgcatgactgtcgacctccaagagcatcaactaggccttctcctcattatgagccatctttcaagaaagaaaccctaatgacaaggtgttcaaggaaagcaacgtcgtgcgcgattgtggggtcggcggtggtaacggttttcgttgaagaagagaaagaaagagatgatgtgacaatgatgtgctag

SEQ ID NO: 11728 - DNA, 834 bp, Glycine max
  Peptide Sequence Number=SeqID_128506
atggggaagacccatgtaatcataagtttgtatgacagctctaagatgcctaaactgatgtttgagatgccttttaatatatggtgtggaggatgcaattcaatgattgcaaagggtgtccggttcaatgcagagaaaaaacaagtcgggaattattactcaacaaagatatggagcttcactatgaaatctgcctgctgtaaacaagagattgtcattcagactgatcctaagaattgcgagtatgtcattattagtggtgcccagaaaaaaacagaagattttgatattgaggatgccgaaacttttgaattgcctgctgatgaagagaagggtaagcttgcagatccattttaccgccttgaacaccaggaagaagacttgaagaaaaagaaggaagctgaaccagtgatcgtacgtctccagaggcagtctgatgcaaggcattcagatgactattctcttaataagactctccgtgcccaacttagaggtcaaaagaaaagagttgctcaagaagaaaatgcttccaagaaaagaggccttggcataagacttcttccagctactgaacaagattctgccacggcaaaatcagtgaaatttccagctaagtttgagagaaataggaaggacaagagggcattgatcaattctgaatctatcttctctggagtctctagctattcgatatctgacaagagaaaacaagagctagagtcaaaacgaagaaaaatttgtgccacttcagcatccaaccttctagctggtagggtaaagccatcatcatggtcacagtcttcaaccaagcaaaagggaactatgagacgttag

SEQ ID NO: 11729 - DNA, 1586 bp, Glycine max
  Peptide Sequence Number=SeqID_128507
tggcttggtttagagttgtcctggatgaggcccagagtataaagaatcacagaactcaagttgcaagggcctgttggggtcttcgagccaagcgtagatggtgcttgtcggggactcctatccagaatgcaattgacgatctctatagttactttagatttttaagatatgatccttatgctgtgtacacttcattctgttccacaattaagatccctatcagcagaagtccatcaaaaggatacagaaagctacaagctgtcttaaaaacaataatgttacgtcggacaaaaggctcacttcttgatggggagcctatcatttccttgccacctaaatctgtagagttgaaaaaagtggaattttcacaggaggaacgagatttttattccaaactagaggctgattcccgagcacagtttcaggaatatgctgatgctggaactgtgaagcaaaactatgttaacattttgttgatgcttttgcgccttagacaagcgtgcgatcatcctctgcttgtcaaacgttacaattctaactctctctggaaatcctcagttgagatggcaaagaatcttcctcaggaaaaacgattatctcttttaaaatgtttggaggcatccttggccctctgtggtatctgtaatgaccctcctgaatatgctgttgtttcagtttgtggacatgttttttgtaaccagtgcatttgtgaacatcttactggtgatgacaatcagtgccctgctacaaactgcacaacccgactaagcatgtcttcagtgttttccaaagtcacactgaatagttctttttctgaacaggctggtgataatttgcctgattactctggttgtgaagtggaggaatctgagtttttttctcaggctcagccatgcaattcttcaaaaataaaggctgcacttgaggtgttgcagttgttgtctaaaccacaatgctgtgcttcccaaaacaattctgtgcagagcacttctggggaaagtactgatggccttggtagttcatctagtgctgacagaatgaaatccttaaatgaaattcccgagagtcaaaatgtgtttgaggagagaagctctaataattcagtcggtgtaggagagaaagctatagtgttttctcagtggacaaggatgctagatttacttgaagcatgtcttaagaattcttcaatccagtatagaagactggatggaacaatgtcagtcactgcaagagataaagctgtcaaagattttaacactctccctgaggtttcagttatgattatgtctttaaaggctgctagtcttggtctgaatatggttgctgcctgccatgttcttatgctagatctatggtggaatcctacaactgaagatcaggcaatagaccgagcccatcgaattggacaaactcgtcctgtcacagttttacggttaaccgttagagatacagttgaagaccgtattttagctctgcagggacaatttaatgaacaaaactttttggaaggagatcggaatactgctgaactctcaatggacaattgcacatataaatgcatagattacaatgagttcactaagtga

SEQ ID NO: 11730 - DNA, 174 bp, Glycine max
  Peptide Sequence Number=SeqID_128508
atgagcaagacccagtcgagctatggtctgctccactttaaccctagaacaaatgagtgggtaccctggacatggcaaagcatcacagcaaactgggtttacgagaaggtggacacgacggtgagcgtgagcgtcatagcagactgggttcgcgttttggtggacacagggtag

SEQ ID NO: 11731 - DNA, 180 bp, Glycine max
  Peptide Sequence Number=SeqID_128509
atgttgatgtgtttttcccatcaagaatgtgtacccctcgaatctcctcaacaattgatatcagagccgatggttcaagttggtgaccgactcagacgagtatgcaagtaccgcaggtggccagaatggctagcggtacagcgtgccccgcaggtggagcggggtagccagaatggctag

SEQ ID NO: 11732 - DNA, 1089 bp, Glycine max
  Peptide Sequence Number=SeqID_128510
atgtacaaccaggtagctggtcgtcagctacttaacaaattatgcactcaagttaagcaattggaacacaatacgataatggacttgataactcgtccttcaccagtgctgtttgatgcaataaaatcaggaaatgttgaggctgtagagattcttattgacaagaatcgtgaatttgtgagaataaaggacccacaaaatggacggaacctactgcacttggttgtgctatttcgacaagaaagcatatttgagagtataccaaacacattaaaagagaatttaggacgagcagcggacaatgaaggtaacaacattctacacttggctgcgcatcttccagttgacttcaaagaatcttccagtttaagagcaagcattcaaatgcaaagagacctcgaatggttcaagttcgtggagttgcaagttcctcttgaactaagtagaatgagaaacaacatgggcaagagaccaattgatgtattttatgaagaacacaagaagttatccgaagaaattaaagatgcaggcaaaggaatatccgaatctggcatgctcgtagcagcacttgttgctaccgtagcatttgcggctgctctgactgttccaggtgataagaccaatccgtggtttactgttccaggtgataagagcaatgcgtggtttactgtcttcatattggcaaatgcagtagcattattcacttcttctgcgtctatactctcattcttgtcaaatttcacttcatcaagattcgcacaaagcgaatttgtgaaatcacaacatcccagcttgacttttgggcgtgccttacttttcatctccgtttttgctatggttgtggctttcactgcagcctcctttttgatatttgatcacaaatccaagtgggttgcttatttagtggcttcaatggccgttttcccaatccttgtgttttttctctttcaaattagatttttggacgaccacttgtggtctagatggtatcgtttgtgcgacgacgatttcatgtggtatttcaggacgctccacaggcagctcaggtcgtttagagatgcgatatctgaggttgctcaggtcgcttag

SEQ ID NO: 11733 - DNA, 852 bp, Glycine max
  Peptide Sequence Number=SeqID_128511
atggattgcaacaggaagttagaaactcttgaagcactgaagaaaacatttaagaagttagatcatgatgtaaatgtacaagaatttatgggtacaagtagtcaaactattgaggatttgagtaatcaagccaggctattacaaactcaaatttctgaaactcataagagattaagtcattggactgagtttgataaaataagcaatgtggatcaactaggacaaatggaaaattcacttagagagtcacttaatcaaattcgaacccgtaaggaaaatataaaaaaacagcaacaacttatgtcgctacaatgcaataatcagttcaacgaaatgaatattccttttagaatgagtgtagagcaacaactgcaacctttgtcatggattgccaatgatgataaccacaatatagttttacccgaggactcaaacatgtttctccacaaagatgtagagggatctacaagttcatcttttgggagtcatgtcagttatcttggctcaagtatcaagaatgacatgtcaaactcagcacaagaaaatggagtccttagtgatatgagcaatactgccccaatgaggctacaattaaatgggcattttccatacctaccttacaattttaatttaccgaacaatttgaagtttcaaccaactgcagagatcaacccttatgaaaatcctgtagattatcatgttaatggaggctttgaagcacctagatctggttatgactctaacaatcaccatgattgggcttccacatcagggccttgtggtgttactatgtttgatgagcaattatatgcccaggcaagctccactaaaatgaactttggttttatatag

SEQ ID NO: 11734 - DNA, 300 bp, Glycine max
  Peptide Sequence Number=SeqID_128512
atggacggaacctactgcacttggctgaagatagagcatatagcacgagcagtggacaatgaaggtaacaacgttctgcacttagctgttcatctgccacttgaattcaaagcattgtccagttttagagcaaccattcaaatgcaaagagagctcgcatggttcaagaaagtagagatggatgatcctcgtgaattaaggacaatgagaaaccacatgggcaagacactaattgatgcattttatgatgaacacaagaagttatccgaagaaattaaagagatgcagccaaaggaatag

SEQ ID NO: 11735 - DNA, 571 bp, Glycine max
  Peptide Sequence Number=SeqID_128513
atggtggtagaggttctaggtcaaggattgttcaattacttggtggtgaatttagttttgaacgagaatttgttaatggtgtttgggagtggcgagaatatgcaaaacaatatggggattgggttttggggtggggggatgggtgttgtagggagccaagaaagggagaagaggttggataagttacaattgttgctgatgggaaggattgcaggttctttaaaagaagatctgacgagacatatatggtgggataagtggctcgaatcaaaatcgataattgataaatgtcctgatatggtacgcattccgttaaatgataggggagacacggctcttcatgtagcagtaagtcaatggagccttgaaactgtgaaagagttggttcaacgtatgagcccagaagacatgctaataccaaacttagatgggatgcttccagttcacttggctgctttatatggccgcaacataatggtgcaaattttgtcctctcagaaagtgcttgacaaaatggattccaagcatattgaactactgtttttaatgaccattaggttcaacatgtttg

SEQ ID NO: 11736 - DNA, 879 bp, Glycine max
  Peptide Sequence Number=SeqID_128514
atgccgcagcagcggcaggttaacggccactggcatctgcgcccgttgcttaacctcagccgtcagcagctggaagcttacgctgtcgggcaccagctggactggattgacgatgagagtaacgctgaccgtcgctacgatcgtaatttcctgcgccaggaggtgctgccgctgctgcaggcgcgctggccgcacttcagcgcggccagtgcccgcagcgcagcgctatgcggtgagcaggagcaactgctggatgagctgctcagcgagcagcttgcgcaactgaccgatgcccagggcgcgctgcattttccgccgctgctggcctgtagcgaggcgcgacggcacgcgctgctgcggcgctggattggcgaacgcggtggtgcaatgcccgcgcgcgacgcgctgcagcgcattaccgacgaggtgatgcacagccgtgaagatgcgcagccatgtttgcgctttggcgcgcacgaactgcggcgctaccgggaacggctttactggctgccgcgacagcactcactgagtcagcactcgctaacctggcagccgctgacgcagccattaattttgcctgatgggctgggtgaactgcgcgccagtccggcgcaggcggaactgcgccagccggcggcggatgagcaggttattgtgcgctttcaggcccacggctatcaccatgttgtcggccgggctggtggtcgcgaaatgaaaaaactgtggcaggagctgggcgtcccgccgtggcagcgcgaacgcattccgttgatttactacaaccagacgctgattgctgcgccggggctgtttgtcacccgcgcaggcgcggcgggcgagacgcaaggctggcaggcgatctggtcaacaccctaa

SEQ ID NO: 11737 - DNA, 996 bp, Glycine max
  Peptide Sequence Number=SeqID_128515
atggctgaagctggcgatgtggtcgagacgcagctcgcgcgtttcaccggagagcgacagcgtccagtgtttggtacaggcgagctcgaggttgtcgtagtcatcacagttgatggcggcaatatcattgagtgctttcagtgcgcatccgatcgcgtctggcacataccccaggggttcgctggaaatcagccagggggcgcagggaaggtggcaaagaaagggcaaaaagtgacagccagcactggtctcagccagcctggcggcgcacaaaaggttatttccggatacaaccgcgctgataacggcaggtggcagatgattgtgctgtcacgtagtgtttcaattgcggacaatgaagtggagctcagtgccattcgcgctcagggcgcgggcggccagcacgtcaataagacgtcgaccgctatccatctgcgtttcgatattcacgcctcgtcgctaccgccgttttataaacagcggctgctggaggcgaaccaccatttgatcagcgccgatggcgtggtgattatcaaagcgcaggagtatcgcagccaggagatgaaccgtgaagcggcgctgcagcggctaatcaacctgatacgcgagctgacgacggtggagaaacaatgtgaaggcgctgcgcggcaagctacgctaaaaaaaacgcctccggcaggaggcgtcaggggattacttgttgagggcgcggctgaggaagtcgacgatgtcgtgctgcttgatcatctgcttctcgctggcggcgcgggctttgtactcgatctcctggttatccaggttgcgatcgccaatcacgatagtgtgcggtacgccgatcagttccatatcggcgaacatcacgcccggacgctctttacgatcgtcaagaatgacatcgatgcctttggcgcgcagctcgttgtacagctgttccgccagctctttcacgcggaaggatttgtgcatgttcatcggcagaatcgccacttcgaacgg

SEQ ID NO: 11738 - DNA, 243 bp, Glycine max
  Peptide Sequence Number=SeqID_128516
atgttaaaatcattcagcacaagacatgtgaggagatacatggagaaaaatgaagaaatgataatggaggagaagatgtcgtacaggatgtcacgacatcacgcttcagaacatgcagattatatgtgtccgtatgaacagattaaacaagtaaataacacaagagaattgtttacccagttcggtgctacctcacctacatctgggggctaccaagccagggaggaaatccactctcaatag

SEQ ID NO: 11739 - DNA, 495 bp, Glycine max
  Peptide Sequence Number=SeqID_128517
atgcggaaggcgtggagccatagggaatcggagacggagcggaagcggcggaaccaggagtcgctgtgcggcggagagagaggcggcgagggagagtgggagatgatggatgagattagggattcgagacggagggattgggaaggtaggagaacgaggtcgttttgggagaggaaggactgtactgcatgtttacattgtgattgtggggtttcttcttgggcttgcgctttttggccatgccggaggagccaaggaggtgtgttgtcttccatcatatacttcactctcgtctatggaggtataagaaaacttaacattgttaaacttacacctcgaatcacccttcatggtcctcactcgcttcatactccttccacctcttcaagaacgcaaattcatttgtcaacgatagaaggcagaggaaggcgacgaaggccaagtcgtggttgccgcaaagaaacacaacttctattgcgagtactaggtaagtaa

SEQ ID NO: 11740 - DNA, 2113 bp, Glycine max
  Peptide Sequence Number=SeqID_128518
atgggaaagaaaaagaagcaagtaggagaaataggggaggatggtaaagtgggagatagcagccccagagcatatgataatgatactatggtgtttatatccatgtctcaagaattgaagaatgaggggaacaagctgttccaaaagagggatcttgaaggatctatactaaagtatgagaaagccctcaagttgcttccgagaaatcatattgatgtgtcctatctacggagcaacatggctgcatgttatatgcagatgggactcagtgagttcccaagggcaatccatgaatgtgatttggctcttcaagtgacaccaaaatatagtaaagctctgttgaagagggcaaggtgctatgaggctttaaataggctggatttagctctgagggatgccagcactgttgtgaagatggagccaaataatgtcatggcattggagatctcagaaaaggtgaaaaatgcgcttgaggagaaaggattgagagtaagcaattcagtaattgagttgcctccagattatgttgaacctcctaatgctctgcctccagaaaaggcattgaaagagaagacacgcaagaagaagagcagtaaagaggaagagaaggcacctgatggcaaaattccagaaaagcaaactgaggagaaatttgaggacaagaaggctgagggcagtattgtagtcgtagagaagaagatcaacacgcccaagaagaagaaggccaaggtaaaagttgatgagaagaaggctgatattaaggaagttatagaggaaagaagtaatggtagaagggaacctgttcctaagaaaacagctaaacttattttcggtgatgatataagatacgctgaactgcctattaattgtagtctcttccagttaagagaagttattcatgaccgtttcccaagattaggagctgttcttgtcaaatacagggaccaagaaggtgatttggtcacagtcacttctgatgatgaattaagatgggctgaaacaggatccaatggttctatccgactgtacatagtagaagctactcctgagcaggatccactttttgagaaatttaaagtgaaggaggcggaagtggttggcattaacattgcacacaagagtggttgtgtgggaaaggcaaaggaaattgttagctcttcttgcattgaggattggataattcagtttgccaaactgttcaagaaccatgttgggtttgaatctgacagatatttggattttcatgaactcgggatgaacctctgttctgaggctttggaggagacggttacaagtgaagaagcacaaggtctgtttgacattgcaggagatatgttccaagagatgactgctcttgcattgttcaactggggaaatgtgcatatgtctagggcaaggaagaaagtgtatgtcaaggaagattcttctaaagaacatctatgtgaacaaatcaaaagttcatacgagtgggcactggaagaatatgcaaaagcgggagaaaaatatgaagcagccattaaaattaagtcagattttcatgaaggcttcctggcactagggctgcagcagtttgagcaagcaaaactttcttggtatcatgcacttggttgtaatgtagatttgctgacatggccttccactgaggttcttcatctttacaacaatgctgaagaaaatatggagaaaggaatgcagatatgggaagaatcagaaaagcagaacttgagtaaaacatctagttcaaatgatgttagattgcatttgcagaacatggggttggatgggctttttaaaaatatatccctagatgaatttgcagcacaggaggcacatatgaggtctcaaataaatctcctatggggtaccatgctatatgaacgctcatttgtggagttcaaattagggctaccaatatggcatgaatctctagaagttgcagttgagaagtttgaacttgctggagcttctccaacagatatagctgtagttttgaagaaccactgttcaaataatactgcagtagatggtcttgcctttaaaattgatgaaatagtacaggcatggaatgagatgtacaaagctaaaatgtggcagagtggagttccatcatttc

SEQ ID NO: 11741 - DNA, 936 bp, Glycine max
  Peptide Sequence Number=SeqID_128519
atggccgccgagtgcgtcctcgccgccgccgtcttccgcctcgcccacgccgccccctacccggccgtctcccgccgcttcgccatctccccgccggacgcctgccgcgccttcttcgccgtctgcaaggccctcgccgacaacctcggccacctcttcgagctccgcaccgactctgagagggttgtggtggggttcggcttcagctccctccccaactgtttcggggttttagggttcactaggttcaaaatcgacgattcattattgggtgaaaatggagctttaatagttcaagcattggtggattccgaaggaaggttcctggatgtctcagcagggtggccaagtacaatgaaacccgaaatttttttacgtgagagtaagctttatcgtgaggtggagcaatccaaggaattgttgaatgggcctagttataatctcagcgaaggttgtttgattcctcagtatattctgggcgattcttgttttccccttttgccttggcttttgacgccttataacagagtgaatgaggaagatagttttggttccgctgagagagcgttcaattgcgtccatgggaatgcgatggagttggttggggatgcgttcgggaggcttcgtgccaggtggcggcttcttgcggcttcgaggaagtggaagcaagagtgtgttgagcatttgccgtttgtggttgttgcttgttgcttgttgcataattttgttgtcaagttcaatgaggcaatgccggatgaaggggtgagtaagtggtgcgtggaaaaggagaaggaaaaggaagaggagcttcctgcttttgatggagtgggggatgagagtgctgtgagggttgagcttgagaaaatgaatggtgtgaatgttggaagaactagtggatgtttgattggtgaacttgttgtttgggaattgctgtaa

SEQ ID NO: 11742 - DNA, 162 bp, Glycine max
  Peptide Sequence Number=SeqID_128520
atggttgctgggggaggatgggagccttcgaaagaggtctcacatctgaggccagaccgcttactaaccatgggtgaaaaagagatacaagccacaaggaagacaagaggggggacctgcaaaataaaggactttgacgctcaaataataaccaatagataa

SEQ ID NO: 11743 - DNA, 258 bp, Glycine max
  Peptide Sequence Number=SeqID_128521
atggatgagttgcgtgaacgagccaaaggctacatccaaatggaccgcgacaagcaggaaggaaacaccaaggccaactcacataagttaaacaagaggcacaagccagacaagcgtcagcctctcccgaaagggcccaggtacgagcgttacacacccttgacgaccaatcatactacaatccttaagaaggatttcaacttggagctacttgatggaagcttgcttgagaagcttctatggaggctggatctttga

SEQ ID NO: 11744 - DNA, 393 bp, Glycine max
  Peptide Sequence Number=SeqID_128522
atggatgagtttggtgccgctgctccgaacactgaagatcacaaacaattcggacacgctttcaaagaaggtgtatttgatgcatcacaatatgcattctttggtaaagatgttgctgaggaagttgagttgagggggttagaagatgaagatgactataaggctatgcctgctgctgagttcaaggaggaagatttcttactcaataaagaagaggcagtggatgtaagatctctttccgatattgatgatctcactaccacttttttaaagccttacccttgcatatgcgaagaggctgtttccggattcgaacccatgaccaacaagtcaccaaggcacaactttaccgctgcaccagggctcgccctcagcaactctatagttaaatag

SEQ ID NO: 11745 - DNA, 2316 bp, Glycine max
  Peptide Sequence Number=SeqID_128523
atggctgtattattccccttttctctccatgcattgtttccattgactgaattatttctaattctagattttacagattcctctgcttctgaatggtcacaaagggatgacattccctactggtttgatcagcatgcttacgaccctgaagggcaaggctttcaggatggaaaaagatggtcatcacatccccattcttctctaactcagctacatgactcaaggcccttgtacagaacatcttcatatcctgagcagcaacgacagctgcaacaccaacttcaacattgctctagtgaacctgtttcaaactggtttgatcagcattttaatgatagtgaaactactgaggatggaaagagatggtcatcacagccacattcctccattgcccacttacaagaatcaaagcccttgtatagaacatcatcatatcctgacaagcgacaggagcttactcgtttttctagtgaacctattttggtaccaaaatcttcatttacttcctatcctccccctggtggtaggtcccaacagtcttctccaaatcacagtacaggtcgtttgaacattccctttcatgctggaggagatcacatggctttgccgtctcaaaatcattctcatttgttcaattctgctctacagttgagtggatcgaaacatgagtcactttttagtggaaaggtgggtcaatttactgccggctcccatctaaattatcaaatgcagaatccctgggtcaaccaatcagggttgtattctggagatcatccaaacctcctcagtaatatgttgcagcaacaattacaccatcgtagtggatcattatcacctcatttgttgacccaattgcagcaacagcagcatagattgcatcatcccattctgcaatcaggaagctacatgtcaggtttccaatcccatttaattaaccctcaactttcttctggatcatccatggttagcaaatatgaacatatgcttggtcttgctgatgttagagaacccagaccaaaatcaactcataagggtaaacagagtcatcgtgtctttcaacagggttccgatgcaagtagccagaagaatgaaagtggttcattacactttaggtccaagtatatgactagtgatgaaattgagagtattcttaaaatgcagctagctgtgactcattgtaatgatccctatgttgatgactattatcacctagcttgtctttctaaaaaaactggtgctaagttgaaaaaatcattttgcccaacccaaataaaggaacttccttctcgagcccgctccaatacagactctcatggttttcttcaggtggatgctttagggagggtttcattcctggctattcgccggcctcatgctctgcttgaagttgatccgtcaaacagtggtatctctgagcgaaatatttctgagaaggcccttgagcaggagcctctgtttgcagccagagtgacaattgaggatggtctatgtcttgttcttgatgtagaggatattgatcgttttctacagtgtaatcaactgcaagatggtggaactcaattaagacgaagacggaaggtccttttggaaggactagcaacatcactccaacttgttgacccactgggaaagaatggacacaaagttgggtttggtgctaaggatgatgttgttttcttacgattagtatctatagccaaagggcgtaaactcctagcaaagtatcttcagttacttgttcctggtagtgagcttatgcggatagtctgcatggccattttccgtcatttgagactcttatttggtggtctgccctctgatccagcagctgcagagactacaagtgaccttgctaaggttgtttgtcagtgtgtcctaggaatggatcttggtgccctaggtgcttgtcttgcagcagtggtttgttcgtctgagcagcctcctctacgtccccttggaagcaccgctggggacggtgcctcccgtattttagtatctgtccttgagagggccactgaacttcttaccgatccccatggtgctgggagctatgtagggatggaaaatgtgtctgtaattggatcagatgctgctaaagcaatcagtagggaaatgcctgttgaactcttgcgagcaagtcttcctcacaccaatgatcaccagaggaaattactactagattttggtcagcgctctgtgcctgtggttggatttaacagttatactgggagcagtagtggtcatgtgaactcagagactgtgctaatatatctggagcaaactgaagtggaagtgcaagttgcttctatggtagag

SEQ ID NO: 11746 - DNA, 582 bp, Glycine max
  Peptide Sequence Number=SeqID_128524
atggggcatagacatggccagtgcatcttggacaaagaaaagagccagtgcatcatcgagcgagacaggaaccaaaaatgcaacctaaacaaccccttaaaatgtgcaaaaaataaggctcgagaaacaaaacagtctttgaatggcccaaaaccaactaggctttgtgcgcttcagtcctgtgagcctagaaacaacgaccaaaaaggtgaacagacgcgtcggcaaagcaccaacaggaggagctgtttagcgtggcaaaaaataacctattggcgaggggtgatccggatccagttcatgatcactgaaaaagtcatcaaagttgtgttagtgatcgaagataacagaaaaagatgtcgaaaaatttgctggagcgcggcaacaggtcaccagaagaacagtcaaccgagaataggggccttggacaagggcaaaaatgaggggcaaaaaggtcagggcttggacacaaagatgacggcgagtgggaaagaggtgaaacccaggaacaaccgcaaatgctcgagattagcagcgctacaaccaagacaatattttcatgccacgacgcaatcttggtga

SEQ ID NO: 11747 - DNA, 735 bp, Glycine max
  Peptide Sequence Number=SeqID_128525
cacaggctagagattctcaagcttgtgaagaaacaagaaggaggagcaacagcacggcccaataagaagctctctggggtcatcaagaagtgcctaaggaagtgcatgaacaagtttgtttctcgtgaagatcatcatcatcatcatgcagtgaaacacgtgccatgctccatggtgcctgtgtcagtgccaccaccaccaccaccccctgagattagttggtatcaccaagggaaattgaaagggtcacttgtgaggaagcaacaagggagtgaggaacttaaggaagaagaaaaagaaaagcctttacctgtgccacccatgtacagaagcaggaccatagcactatcaggacctttggaatatggtagtagaatgcatcatgagaaaatggcccagaacagggccttgaagctatctgggccacttgatggaagaatgcatgagagaatgatgatgaacagtactaatagtagaagccctttgatgcctaggcctttggatgcaagatttgtggccacaacaaggagtccaagagtgtctgggcctctggatccaagagtgatggttgagaatagaagcccgagactgacacggccttcgaatgcaactagggctgaaactcagagcccaatgggttatagtccttataacaagcccaaagctgattttgattttgatgatgatgatcacacactctggccttcactgtttcaagatctcaaaccaacttga

SEQ ID NO: 11748 - DNA, 369 bp, Glycine max
  Peptide Sequence Number=SeqID_128526
atggagtctcagagtcagagagatcgcaggacagatgctgttggagaccttcgagtccttcccgacgaaatcctctgctctattttagaaggtctcactccccgagatgctgctcgcgtcgcttgcgttatcggtgtgatgtacattctgtacaacgaagacccactgtggatgagtctatgccgaaaaggagcatctggttcttggaagaaaactgccctgcataagagattataccgctgccataccacattggatgcattttttgccgatattggaaatgtggaaagaataaaagacatctcactcttctataatgactatgatgcaaagaaaccggttgacaaaaaggaaatcaaacttacgtaa

SEQ ID NO: 11749 - DNA, 336 bp, Glycine max
  Peptide Sequence Number=SeqID_128527
atggtgatgttggtggtgttagaagcgacaatgacaatgctagaaataccagttatgattgcgatgaccgtgatagcagagatggtgataatagtaatagtgatggtggcaatgtttgtggtggtggtggtgataggtgctattagtgatggtaacagtgatgacaatgataatggtagtggtaataatgtcaatggcgatagtgataatgacatgataatgatgataacactgttggtgtcagtagccaggggtgatagtagcagcattgacaacaatgatagtgttggtggtggtcacagcggtgacaatgaaatatggaattgtcaaatgtag

SEQ ID NO: 11750 - DNA, 486 bp, Glycine max
  Peptide Sequence Number=SeqID_128528
atggagcttaccaacgagacaaatgacgaagctacagacttaaaacaaaagaaaaaagaagagaagaatgtacaagaagaaaaagaagaagggaggaagggggagaagagggaagaacttgagagagttatgctcgctggattggctgatacatggcctgccaggcgtaaatggacaactgataaactgttgctaaactatggagatgtagcatttaaaatttctcaaaagagttcgcggaagatctccataaagttcaaggattatgtctctgacatgaaatttggcgaaactgcacctagcttattgaaggattattgtgtgcctcatctttttcaagaagacttctttgatatcttagatacagataaacgaccatcctataggtggctcataattggaccagagagatctggtgcctcttggtatgttgatccagctcttaccagtgcatggaattctcttctttgtggccgtaaaaggtaa

SEQ ID NO: 11751 - DNA, 1135 bp, Glycine max
  Peptide Sequence Number=SeqID_128529
atgttgcgagtgaagggagggaagagaccaccttgggtgggacttggagctgcagtgtgggttcagattgcttcaggaaatggctactgtttccctctttattctcattccttgaaatccgttttgggtttcaaccagagccagattaccctgcttggtgttgccaatgatattggtgaaaatgttggcattcttcccggtctcgcctgcaacaagttccctccttggctcattctcttcatcggtgctcttttttctttccttggttttggggttctctggcttgctatcactaaaacacttgattctcttcccttcatcttgctatggtttgcactagctgttggtactaacagttgtgcatggttatctactgctattcttgtcaccaacatgagaaatttccctgtcagtagaggcacagttgcgggaatcctgaaaggttattcgggactcagtgctgcagtttttactcaaatttacagcgtggtttttcacaattcttcatccaagttccttttatttcttgccattggtattcctgctttatgcttcagtaccatgtttcttgttcggccttgtactcctgcttctggtgaagattctgctgaaaaagggcattttttgtttatccaaggtgctagtgtggcaatgggtttatatattcttgctacaacaatacttgacaactttatccacataagtgacagtgtttcatatgctttgttggccgtgatgattctccttctcttggctccacttgttatccctacaaagatgacactatgtcccagaaaagcctctaacacagaaacccctgaggaacatgttggatcttcagactttctggttcaagatggcaaagacaacatagagccattgctatcatcttcatcagctagtggtcttggaagttttaatgatgtggtggatggttcagctgaggtggctatgcttcttgctgagggtgagggagcagtgaggaagaagagaaggcccaaaagaggggaagattttaagtttactgaggctctagttaaggcagattactggttactgttttttgtttactttgttggtgttggaactggggttactgttcttaataatctggctcaaataggcattgcacaag

SEQ ID NO: 11752 - DNA, 363 bp, Glycine max
  Peptide Sequence Number=SeqID_128530
atgaatgagggtgagccacttggaaagttggcaaatctaggtaagtgggaacaggaatccaacgatggatgggtagtcaagggcgttggatttgaattaggtggcacagatgaaagaggagttaatggagagaaaggatccaagttagatttggtacttattttgttggaaaatcacgcaattgcagacaaaaagcttagtgtcagagtatatgccaagctagtaaaaagaggcagtcaacctagccagagtgggttaaaggctcaaatgccctgtcgtgagagtggaatggaactccttaaggaaggaagcacaaagctcgaaaatctaaggaacaaaaagacgattatgaaaataaagtaa

SEQ ID NO: 11753 - DNA, 225 bp, Glycine max
  Peptide Sequence Number=SeqID_128531
atgggtaataaggatgaaacctggaggaatgggggtagattggggtgttgttgtgatgcccatggtggtggagacaaatccctgcatggtctggttgggtttggaagaggaggtcctttgggaagttggagctatgatagaaagcatggccatgatggcatccatggtttaaataacaaacttatcagacaaaagattgagggcatcatccacaacctcggctaa

SEQ ID NO: 11754 - DNA, 240 bp, Glycine max
  Peptide Sequence Number=SeqID_128532
atgaagcttcatatatatcaagacgtgtgtcaagttcatgatctccatgtaatattgcatgttgatgtggataattccgatgatagtcttgtagatgttggtagtgggggtgatgaggttgacatacatttacttaatcaacttgacagcaataatgaaaatgatttaaatgacattaagagtgagattgaatactttagtcaacctaagaccgataatgagaatgataaattttcataa

SEQ ID NO: 11755 - DNA, 252 bp, Glycine max
  Peptide Sequence Number=SeqID_128533
atggaggcgatgacgtgcagcaagggaggcgtttggttcgcttgcgggaaacgacaaggagaagatgaagaagaagttgaggtgtccgcgtccacttgttgggtcacgtccaatcgcgcatgtccggctgtccaaccgtgtccagtgacggtggaagcacctgacaccgcgtcacatcggagtcggatccgcattcgtgtccagtgcgagtccgacgtgggacacgacagaatacttggctacccaacatag

SEQ ID NO: 11756 - DNA, 207 bp, Glycine max
  Peptide Sequence Number=SeqID_128534
atggcaattgattttaagatgaaatctaacatggtatcaaagcaggttctaatcttgggacctcgccttcgcttccgctgcgacgagcatctaccatctgtggttcacgcaccaagtccaataagtgctgggcgtgaaggggagggaaagattcacataggaagctatgtggcattaggaattgaggctcctgtccgtgacagttag

SEQ ID NO: 11757 - DNA, 543 bp, Glycine max
  Peptide Sequence Number=SeqID_128535
atggacaatataatctacactttagttttgatactttttctatctctgaaggccagtagtgtttcttctagagatagacaatggggcggtgtgaggagaaaattgagctttggggatcataataatggtgatcttgtgactaacttgcctggccagcctcctgtagattttcagcactatgctggatatgtcacagtcaacgaaaccaatggccgagcactcttttattggttctatgaggccatgaccaagcctcaagacaaaccattagtgctgtggcttaatggaggtcctgggtgctcttctgtgggatatggagcaacacaggagattggcccatttttagtggacaccgatggcaagggccttaaattcaataacttttcatggaacaaagaggccaacattttattcctggaatctcctgttggagttggcttttcctattcaaatacaaccagcgaatatgcacgactgggagatgacttcacaggtcttaattttgatatccttgttgtgtacatcaatatcaactgttactaa

SEQ ID NO: 11758 - DNA, 771 bp, Glycine max
  Peptide Sequence Number=SeqID_128536
atgctgggcaaccctgaaacatctgatgctgaggactggtcaggtatggttgattatgcttggagccatgcagtgatatctgatgaaacttacaaaactatcaaagcaagctgtgagttcaatagcagtgatccgtggagtaacaaagattgtactcaaggagtggatgaaacactcaaacagtacaatgaaattgatatctacagcctctacacctctgtctgcttcgctagtacagcgcggtcaaacgatcaatccaagaaaatggtgatgaatcgctcatctaaaatgatgccacggatcatgggaggttatgatccatgtttggataattatgctaaaactttttataatagaccagatgttcagaaggcactccatgccagtgatggttacaatctgaggaattggagtatttgcaatgaaaacatattcaagggctgggcacaatcgaagccttctgttatcccaatctacaagaagcttatttcagcaggacttaggatttgggtttacagtggagacactgatggtagggtgccagtgctatcaacaagatacagcttaagtattctaggtttgcctatcactaagagatggaggccttggtaccatgaaaaggaggttagtgggtggtatcaagaatacgaggggcttacgtttgcgacatttcggggagctggccatgcagtgccttgtttcaaaccaagcaactcattggcattcttctattcctttcttcttggagaatcaccaccgtccacaaaataa

SEQ ID NO: 11759 - DNA, 612 bp, Glycine max
  Peptide Sequence Number=SeqID_128537
atgggtgcaagtgttggtgttgcacaatatgggaaagacttgataaagcttattctaagcacgttatacgagagctccaagttcaagccttcacttgtcgcacctggaggattttatgaaaaatattggtatgacaggcttcttcaggtttcgggtttaggcataatcaatgttctgactcatcatttatataatttgggcccaggtagtgatgagcatcttgaaaggaagattctagatcatgagcgcttgagtagggtggaatcaattttcggaaatctttcagaaatcattaaaatatatggtccttggtcttctgcatgggtaggagaagctggaggggcatacaacagtggtgtcaatcatgtttctaacagatttctaaacagcttttggtacttagatcaacttggaatagcatcttgctacaacactaaagtctattgcagacagactttaattggagggaactatgaccttctcaataccactacctttgctcccaatcctaactactacagtgcacttttgtggcatcggttaatgggaaagaaggttcttgcggtctcaagtgatgttcatattaaagacttttacctacagttaggaaat

SEQ ID NO: 11760 - DNA, 391 bp, Glycine max
  Peptide Sequence Number=SeqID_128538
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagg

SEQ ID NO: 11761 - DNA, 1275 bp, Glycine max
  Peptide Sequence Number=SeqID_128539
atgtctactgctgttccttttctttccgtggctgtagcctggttcgtgatttttggaatttttttacttatcatcttagcgtgttgctgctgttgtaacggaggagagtcaaatgatgatgatgactattctaaagcactgcatcatttgtccttgaccttgcttatcctctgtaccattgcagcaataggtggatgcgctgttctgtactctggtcaggggaagtttcgtgaaagcacttccaacacacttgattacgttgtgaatcaggctcaaatcatagctgaaaacctcaggaacgtgacaagctattttgattcagctaagcagcttgtgaatgggattcccctgccactagatcttggatccaacattgatgatgtaaaagtgaaagtcaccacagctgctgattctctctccaagaaggctaaagaaaattcaaggatgatacacaaagtcatagatggagtgagactggctcttgttactgttgctgctgttatgatctttgttgcatttctcggattgttattttctttacttgctttgccgggtcctgtatactccttggtggttattggatggattcttgttacaggcaccttgttactttgtgctgcatttctgtttgtccataatgttacagcggatacatgcgttgcgatggatgagtgggttgtgaaccccactgcccacactgccttggacgacattcttccatgcgtggaaaatgcaactgccgtggaaacccttctacgaagcaagaccctcacatataccattgttgatgcatttgaccaaatcatttccaatttcacaaatgtaaatgcagctgctaatttcaatcaatcaggtcccctcgtccctcttctctgcaatccatatattgccaacttcacatctcgccagtgtgagccaggggaagtcacattcaaaaacgccatcgaggtgtggaagaattatacgtgccaggtttcgtcatccgagcaatgtatgagtgaaggtcgtttgacaccgaagatatacaacaaactggcagctgcagtgaatgtgacaaatggtttatttcattatgggccatttttcgttgatttggtagattgcacttttgcacgtaaagcattctcagagattagcagcaactattgtccttctctgcggagatatactgaaagggtttatttgggaacggttgtggtatctgcggctgtaatgctctccttgatattttttatcgtctttgtcagagagcagtggcggcgtcttcacaactaa

SEQ ID NO: 11762 - DNA, 312 bp, Glycine max
  Peptide Sequence Number=SeqID_128540
atggacagaataagagagccaagaaagaaagaaagaagaaaagaacctgatggtgtgcgtagagagtttaaaagagagaatgttgcagaagcggaaaagagaaagagaaagaggaagaagaataggagaaggaagaaagaggagtttgactttgacgtgaaacgtagcatgatgatggttaagaagagtttaatgttattatgggttatggcatggagaaagtgggaacaagaaacggtagctagttgctcagactgtgttacctatggagttacttcacactacttaaaggcattggttaatgctctttaa

SEQ ID NO: 11763 - DNA, 324 bp, Glycine max
  Peptide Sequence Number=SeqID_128541
atgaagtcccaatcatcacgcacgtgcatgtgctcacccacgaatcaccctggctcgttccggtgcagcatgcacaagaagccaccccgagcggtggtggctcgacccttgtctcggacaccctccagctggaactcatcatctatggctgccaaagccaattcattgaaggccattctcttgcaaatgattaagccctctagccatgagcatcacaggagaaagagtttccaaccaaagcctagtcgcttttctttgatgaacaacgataacgctgctgttgttgctgttttgctaatgtctgatatggccggtgtagaatga

SEQ ID NO: 11764 - DNA, 822 bp, Glycine max
  Peptide Sequence Number=SeqID_128542
atgcagctagttcaaggagagagtcagagtggtgtttgtttagcaatattaatagagctcataagccaaggagatgagcagagaataggacaccaaaagcctgcatggttggaagctctttacacacaaaagttcttcgtggggtgctcttaccatgagaacgctaaaaagaatgagaagaatgtcttctgcttagattgttgcaccagtatttgccctcactgcttgccatctcatcgcttccacaggcttcttcaggttcgccgctacgtttatcatgatgttgttaggttggaagatcttcagaaactcattgattgctccaacgttcaggcctataccatcaatagtgccaaagtggtgttcattaagaagagaccccaaaaccggcaattcaaaggatcaggaaactactgcacctcctgtgatagaagtctccaagagccttttatccattgctcccttggatgcaaggtggattttgtgctgaaacactataaggacctctctccctacttgaggacatgcaactcactacagctaagccctgattttctgatcccacaagatatgggggatgaggaaatgactcgttcaaccgttgtggattgtgatgagccaatgagctcatcttctggctcatcagagtcagagaacaacatgagcatgatggcttgcacagagattgttcggaagaggaggagtggatggagcactgtgtgtgcaaaattcatggccaatagcaataaggtttctgatgaagacatggccaccagcatgagtagaagaaaaggcatccctcatagatcccctctgtgttag

SEQ ID NO: 11765 - DNA, 366 bp, Glycine max
  Peptide Sequence Number=SeqID_128543
atgtggatgtcgagggagcggtttccgacagatttcaggcgggaggagaaagagaagagcgatttcaggcgggaggagaaagagaagagcgatttcaggcaggaggatgacaaagagaagagggagggcaaggatgacattcagcaaaagaggcagaagaaactggccaagactattgctaatgaagacaaggctttggaaacttttggccttgctacaaaggttaaaaggatccttagggagaaaaagggaaaggtccaaaccaaaaagcctgcccaacaacaaaagaaggagcaaaaaattgttatagaggagcaatggatgaagaagagacatgaagtgcccagaccctctcttccagtgtag

SEQ ID NO: 11766 - DNA, 747 bp, Glycine max
  Peptide Sequence Number=SeqID_128544
atggctactacccccatcaaatgcaaaccattgcttccactttcttctttgccaaaaccaaccacttcatggctttttggcaaaccaatttcccatccctttccaaattctcgtcctgtgtatcagcgaggaaatgtcgcaatctcagtttcctacaacccccaaggcaacttcgacctctctttatttgacgatgatgatgaaactaaagctgcacctcctctgcccccaactgaaggccgatttgaagttgctattgacaatgatgttattagtcgtcttgacttgtccccttttcaagctgcaacaggcatgaaatcccctttatctgtaaaaccaaaagaatttcttgagcgcacaatcggcttcaccatcaactatactagagaagatccccgcgatcctcgagaactatcagagtatcctgatattagggtgtggtttgtgagacttgatgctacttatccatggttgccagttttgttggattggagagctggagaactggctcggtatgctgcaatgctggttccacatcagatgaatattaaaatgggagtggtcttcaatcctgaggcattggaactgtttgttatgaagaaagtttttattgtgtattcttggttgaagcatcacaacattcccaagcctaaattgaaggcaaatgatatggccagaatgcttggatttacaattggagatgaactatatgactttattgataagcatccgcttgatctgtcgtaa

SEQ ID NO: 11767 - DNA, 351 bp, Glycine max
  Peptide Sequence Number=SeqID_128545
aagaagttgggttggagattagatttggtcttggttatcatctataacttaactggtcatggttttaatcttgcttctcctatagatcttatcctggatgttggcaaattagttgttcgcccgcaagctaaagatgttgttctttctggctttttctttgtgttatcttacttcaagctgtataacatcaatattcatgaacccaaggctggtaaaaccatttcatggttcccttcgctatgctttttggctatttctatagctcattccaaaggttggggcaagctttggctggaggtgaattctcttttagtcctcaaggcttttaatgttatcactgtggctccttag

SEQ ID NO: 11768 - DNA, 720 bp, Glycine max
  Peptide Sequence Number=SeqID_128546
atgtttgaatttctcgaattgcatgattttctagggggttcaagggaattggtgtatttggcattttcacctaccagtgtgaattccactgtttcttctagacccaaggttgtgaagtttggtgccctctttactatgggttctgtcattggaagattagctttacctgcgattatggctgctgttaaggatgttaattccagcactagcagtctccttggcattgatttgcaattgatggagaatgatgtggttgttgttgttggtccactgccatctggaatagctcatgtcatatctcatgttgttaatgaacttcatgttcctcttttatcatttggggcaactgatcccactctatctgctctacaatatccgtatttcgttcgcaccactcagaacaactatttgcagatgtatgcaattgtagactttgttgattattacagatcgacgaaggtaattgccatttacgtagatgatgacaatggaaggaatggagtttctgttttgggggatgcaatgtcaaggaaacgtgccaagatctcttacaaggctgttttccctcctggtgccacagaaagtgatatcagtgacttgttaaatgaggtgaacttagtggaatcgcgtgtctatgttctacatgtaaatcctgatcatggtttagcaattttctctattgccaagagactaagaatgatggacagtggatatgtttga

SEQ ID NO: 11769 - DNA, 212 bp, Glycine max
  Peptide Sequence Number=SeqID_128547
tctgggactttcggccgccgaaaggtgccgccgaacctgcctgggtttcagctctggagggactttcggccgtcgaaggtgccgccgaacctgccctgttcagccttcctttgcatgttttgcatgattgttttaaggttcggacccgaggaaccgaggacctcagcagtgagtcagttgcctcagtcagtgtcagagctagccagaggtga

SEQ ID NO: 11770 - DNA, 3141 bp, Glycine max
  Peptide Sequence Number=SeqID_128548
atggcccagtcctctggaaatcccatctccactatcgtccatcgttaccctaaaacccgaaaaaccccatctccgtctgttcgaaacgacggtgacaccaattccctcccactccctctctattttcctctccacactccacattccgccatggacgacagcttgtacgacgagttcggcaactacatcggccccgagatcgagtccgaccgcgactccgaccgcgactccgacgccgatgacaaccccgacgaccaatccgacgccgtaggagccgcccactccgatggagaggacccgagcaacgggtggatgacgacaatctccgacgagctggagaaccaggtggtgttagcagaggacaagaagtactaccccaccgcagaagaggtgtacggcgaggacgtcgaaaccctagtcatggacgaggacgaacagcccctggagcaacccatcataaagcccgttagaaacataaaattcgaagtgggcgtgaaggactcctccacctacgtgtcctctcagttcctcctgggtctcatgtcaaaccctactttggttcgtaacgtggcactggtggggcacttgcagcacgggaagacggtcttcatggacatgctcgtggagcagacgcaccacatgtccacgtttgattcgcagagtgagaagcacatgcggtataccgataccaggattgatgaacaggagaggaggatttcgatcaaggcggttcccatgtcgctcgtgctggaggatagcaattccaagtcctatttgtgtaacatcatggacacgcctggccatgttaacttctccgacgagatgaccgcggcgttgcggctcgctgatggcgctgtcttgattgtagatgctgctgaaggagtcatggtaaacacagagagagcgatacgtcacgcaattcaggagcggttgccgattgttgttgtaattaataaggttgacaggcttataactgagcttaagttgccaccgaaggatgcttatcataaactaaggcatactttggaagttattaatactcacatatctgctgcctcctcgattgctggtggtgttcaagttgtggatccagttgctggaaatgtttgttttgctagtgctactgctggatggtcctttacgttgcattcctttgctaagttgtatgggaagctgcatggaattcctttggaggctaataaatttgcttctcggctttggggagattattattttcatccggataccagagccttcaaaaagaaaccccctgccagtggaggggaacgatcttttgtggagtttgtgctggagccactttacaagatatatagccaggtgatcggggaacataaaaagagtgtagagacaacacttgctgaacttggagtttctctaagtaatgcagcctacagattaaatgttaggcctttgctaaggttggcatgtagctcagtttttggtccagcttcaggtttcaccgatatgcttgttcagcatataccttctccgagggatgctgcaattaagaaagttgatcatatatatgctggtcctaaagactcatccatttacaaagccatggcacagtgtgattcttatgggcccgtaatggttaatgtgaccaaattgtatccaaaatctgattgcagtgtgtttgatgcctttggtagagtttatagtggtaagatacagacaggacagactgtacgggtactaggagaaggatactcgccggatgatgaggaggacatgactgtaaaagaagtaacaaagttgtgggtttatcaagctcgtgataggatgccagtagctgaggctcctcccggttcttgggttctaattgaaggcgtggatgcttcaatcatgaaaaccgccactctttgtaatgtggattatgatgaagatgtatatatattccggcctcttcagttcaatacactgtcagtggtaaaaacagctaccgagccattgaatccaagtgagttgccaaaaatggtggagggcctgaggaaaataagcaagagttatcctcttgcagttactaaggttgaggaatctggggagcacactattttagggactggtgagctgtacttggattcaattatgaaggacctgagagagctctattccgaagtagaagtcaaggtagcagatcctgttgtctcattttgtgaaactgttgttgaatcttcctcaatgaaatgttttgctgaaacaccaaacaagaagaataaaataactatggttgctgagccattagaaagaggtcttgcagaggacatagagaatggtgttgttagcactgactggagtaaaaagaaactaggtgactttttccagactaaatatgactgggatcttcttgctgcacggtcaatctgggcatttggccctgataagcagggtcccaatattctgttagatgacacccttccaactgaagttaacaaggatctaatgaatgccgtgaaggattccattgttcagggatttcagtggggtgcacgagaagggcctctctgtgatgagcccatcagaaatgttaaattcaagattgttgatgcaaagattgctacagagtcacttcatcgggggtctggccagatcattccaacagctagacgagtggcctattcagctttcctcatggctactcctcgtcttatggaaccagtatattatgtggaggtatatgcattactaaccataatgatggctattcaaacaccaatagattgtgtatctgcaatttacactgtattatctcgaaggcgtggacatgttactgctgatgttcctcagcctggcaccccagcttatattgttaaggcatttttgcccgtgatagaatcttttggatttgaaacagacttgagatatcatacacaaggtcaagcattttgcatgtcagtttttgatcattgggctattgttcctggagatcctctggataaaagcattgttttgcgcccacttgaacccgcacctattcagcatcttgcccgtgagtttatggtgaagacaagacgtagaaagggaatgagtgaggatgtgagcataaataagttcttcgatgaggctatgatggtggaactggcacagcaggcagcagaccttcatcaacaaatgatgtga

SEQ ID NO: 11771 - DNA, 498 bp, Glycine max
  Peptide Sequence Number=SeqID_128549
atgtggagtgtggagaggaaaatagagagggagtgggagggaattggtgtcaccgtcgtttcgaacagacggagatggggtttttcgggttttagggtaacgatggacgatagtggagatgggatttccagaggactgggcctggcccgcgctagcgttgggggcctagatggcagtgcgactacccttctgcatgggaatattggtagcaacatgagtgtgaagtttggtgtgattgttgtaatgttggtgaggatttgggtgacctgggtagggggcgagttgacacgacgagtcgtagcactgatgggaggagaaggcctaggagggggatcgtgtggccgaagaggtggaggtcttagtggcctaggagggtggtggtgtggagccctagaggtggaggagatggatgagcatgtggtggcagagcaagtccatgatgcaatgggtcggatgggtcgtgggggtgatgaaggcttggtccaatgggccgggatg

SEQ ID NO: 11772 - DNA, 264 bp, Glycine max
  Peptide Sequence Number=SeqID_128550
atgacgaaattaaagacgagcttgtctcttgaaagtaaggcagctgcacctaagtggattgaagttaagagtcacgttcaaaccggatgttatgaatgtggatattacgtaatgcactggatgtggaacatcataaccagcgagataaagagtgactggtccatgtggtttgctgatgtgacaccgttggacatcgacaacatcacaacaattcgaaacaaatgggcaagatattttttaaagactgcgtgtaaaaagggctaa

SEQ ID NO: 11773 - DNA, 799 bp, Glycine max
  Peptide Sequence Number=SeqID_128551
atgggtagggtgatggatagtatcgttggaaagaaccaagctgcttttgtccccggccaaaaaatttataatcacattctacttgcttacgagctgattaagggttactctcggaaaggtgggactccccgctgtatgatgcaaatagacctccagaaagcttatgatatggttaactgggatgcactggaatgtattcttaaagagattggtgtgcctcaacaatttatcagatggatcatgatagctgtgaccactgtttcttaccgtttcaatatcaatggttgtcactctaaccttttgcaggctaagcgtggactccgtcagggagaccccatgtcccccctcctttttgttattgttatggaatatctgaatagaattatgtatgacatgcagaagaatcctaattttaaccatcatgctaaatgtgaaaagcttagtattactaatctggcttttgcagatgatttacttcttttttcgagaggtgatccaatatctgtggatcttatggtgaaggctttcaagaatttttctgagtccactggtcttattgctaatcctagtaaatgtaagatttactttggtggtgtgggggacgatagcaagaggaatattctcaatcttactggttttactgaaggccctcttcctttccgttacttgggggtcccgctcactagtaaaaaactttctattcaccactatatgcctttagtggataagatagtggggagaatcaatcactggagcactaatcttttgacttatgcaggccgtgttcagcttataagga

SEQ ID NO: 11774 - DNA, 632 bp, Glycine max
  Peptide Sequence Number=SeqID_128552
atggaattttatcaggccgatccgacgcttgagaactactggcgtggtgtgatcctctttggaaggaacgtcgcatcttacaaatttgcgctggcgtcagcgttgtatgaagtggataagacgggcagcgatttgattacgctcgaccagctcgccgtgccgttcagccgctatctttgtgagcacctgaagcatgcgccaaagcagatcacctcccgcagcagtcaatttctggaaacctgtctgaaattcaaccgaggtgaaatcacccacgcccaacttattgaagcgacggtgcgccttggctttaacaacgtgatcgatgcctttcattacgtgaaccagggcgagatcgataaacgttttttccttgatgagcgcaaaacccacaacgggatccgcctgacggataacttctatttactgggcgaacgcctgcagtataaaaacctcgcttttgaaaccaatgctcgctggaacctggtggaacaggcctggtcaatggggatttcacgtaaccttgtgggcgtggagttcgacgaagataatcagctgttgttcacgagggtgaacgcgcgtcgcgtagacatcaccagctgccgcgacagcctgaatggttaccagaaagggag

SEQ ID NO: 11775 - DNA, 282 bp, Glycine max
  Peptide Sequence Number=SeqID_128553
atggcttactgtggccctggttgctcatggttttctcgcattgtccttgaaattggtccagttgcatttaatcatgagcaatataatgggagccttcccactttgatcttgaggccacaatcatggacaaagatttctatgacgtgcctttatatggctgttgttgaaatactcacgaacaacaacgggtgtaacgtccaccccgacattgaaattttaaaaaacaacgacgggtgtaacgtccaccccgacgttgaaatcttcaaaaacaacgacgggtga

SEQ ID NO: 11776 - DNA, 201 bp, Glycine max
  Peptide Sequence Number=SeqID_128554
atggagcatgaaacattccttgcaacttggttggcagagattgatttctctcccaatggcttgagattctcaaatttgcaaccacaacctaggttgatcaaccatgaaaaacctattctatgtaggtggcacaagcttaatcccttgaaaattgagggtaggagatttgccctggattcagttagggactactttccttag

SEQ ID NO: 11777 - DNA, 1241 bp, Glycine max
  Peptide Sequence Number=SeqID_128555
atggtgctatccattgagtttcttggccgctactggattcttttggtggtgtttctaacacactcttcaccccaacttgctgcagccgagaacaatgaagcaaacgcacttttgaggtggaaagacaactttgacaagcccagccaaaatctcttgtcaacatggacaggctctgatccatgtaaatggcaaggaattcagtgtgataattccaactccgtctccaccataaatcttccaaattatgggttgtcaggtacactccacactctcaacttctcctcattccccaacctcctcagcctaaatatctacaacaactccttttatggtaccatacccccacaaattggtaacatgtccaaactaaatgttttgaatttttctttaaatcttttccgtggttccatccctcaagaaatgtggacactaaggagtttacgcggccttgatctttcccaatgtagtcaactaagtggagagattcctaactccatatcaaacttgtccaacctgtcatatcttgatttaagtatctgcaatttttctggccacattcctccagagattggaaagttgaacatgttggagattctacgtattgcagagaataaccttttcggttccattcctcaagaaattggaatgttgacaaatcttaaggatattgatttgtcattgaacttactctctggtactctccctgaaacaattggtaatatgagtaccttgaatctgcttcgtctttccaataactcctttttatctgggccaattccatcctccatatggaacatgactaacttgacattgctctaccttgataacaacaacctttctggatcaatccctgcttccataaaaaaattggccaatttacagcaacttgcacttgattacaaccacctttcgggatcaattccttccaccattggaaatttgacaaagctcatcgagttgtatttacgctttaacaatctttctggatcaattcctccctccataggaaatttgatccatttggatgcccttagtctccaaggaaacaatctctccggaacaattcctgccacaattggaaatttaaaaaggctcaccattttagaattgtccaccaacaaacttaatggcagcataccacaagtcttgaataacattcgcaactggtctgccttgttactagctgagaatgatttcacaggccatttaccacctcgagtttgctctgctgggacactagt

SEQ ID NO: 11778 - DNA, 423 bp, Glycine max
  Peptide Sequence Number=SeqID_128556
atgacaaggaatcatttgaaattccacgtgaccaaggccaatgaggtggttcaagagcttgataaacaatatgccaagctggataagcttttgaaaaagctccaggatgcccatgaggaatccaaagccgtgaccaaggctccttccatgaaggctataaagcagagaatggagaaagatgttgatgaagttaagaaaactgcacattacttaaagaccaaaattgaagaactggacaaagaaaatttggcaaacgggtgtggaaaaggatcaggtgctgaccggtcaagaacagcaacaaccatttctttaaaaaagaaactgaaagatactgaatttcagatcctgagagaggccatccatcaagagtatcgtgaggtggttgagagacgtgtttttacagcatgcctactcgacaattga

SEQ ID NO: 11779 - DNA, 624 bp, Glycine max
  Peptide Sequence Number=SeqID_128557
atgtcctcgccttcagaggactacacgtcctcaccttcagagggctacacgccctcacctttagaggactacacgtcctcgccttcagagggctacacgtcctcgccttcagaggactacacgtcctcaccttcagagggctacatgcccttgccttcagagggctgcacgccctcgccttcagagggctgcacgccctcgccttcagagggctgcacgccctcaccttcagagggctacacatcctcgccttcagagggctacacgccctcaccttcaaaggaccgcacgtcctcccctttagagggctacacgtcctcaccttcaaagggctacacgccctccccttcagagggctacatgccctcgccttcagaaggctacatgtcctcgccttcagatggattcacgtcctcgccttccgaggactacacatcctcaccttcaaagggctacaccccctcaccttcagagtgttgcacgccctcgccttcagaggactacatgtccccgcctttagaggactacatgttctcgccttcagagggctacacgtcctcgctttctgagggctctacatctgcatcttcagagaactcaaggtcctccatccttaatgcttaa

SEQ ID NO: 11780 - DNA, 880 bp, Glycine max
  Peptide Sequence Number=SeqID_128558
atggaaattcaattccagcatccaaagaagcacttgagagcaagcacatcaaaaggaggcaaagggagaaacaacaacaacaaaaccaaaagcaagtatgttggggtgaggcaaagagcatcagggaaatgggttgctgagatcaaagacacaacacaaaagataagaatgtggcttggcacatatgagacagcagaggaagcagcaagggcttatgatgaagctgcatgcctccttcgtggatccaacactcgcaccaacttcatcacacgtgtgtcccttgattcccctctcgcttcgcggattcagaatcttgtcaacaacagaaaaggtaccaaaaccaaacaagaacaatatgtcgtggaaacatgtgacacaaggatcaagagcaaccgacatgagtcgatcgctctaccagaaggagctagtcctccacaacgtggtgaactaaggtctgaatcttcgttggaagacgtgtccaaatttagtatccaacaactgtatattgatcaggattgtctccgaaagaaaatacgtgtgggaaatgagaagaaaagaagggtcaatagcaccacttgtagtactagtaatagtactaattcaagcaataatagtgactcatgtgagaactcactttctagtgagacaacaacacaaaacacacaacaatttgatgatgatgcttatagacctgatttgagcaatttcatggtgtccgagtcaggttctcatcagaacaatccttcatggggttttgaaccttcttttagccaagtaatggatgtagcaaacctgcctgatatagctggcttggagcttccagattttgaaaggataaaagttgaaaggcaaatatcagcttcactttatgcaattaatg

SEQ ID NO: 11781 - DNA, 207 bp, Glycine max
  Peptide Sequence Number=SeqID_128559
atgcagagggaaaaactgctgcaagagagagacacaaaagtgagaaactttgcaagaatgaaggaggtttctgatgccgtcaaactttccgttgcagtcaagaatgaaggaggttttcgatgcagtcaagatcaccggaaaccaccgccggcagctgagtgcagaggttttcgggagaagccaagagagagaatagtgagaggatga

SEQ ID NO: 11782 - DNA, 294 bp, Glycine max
  Peptide Sequence Number=SeqID_128560
atgtttagatgctatgctggcacaaatatgcatataatacacacacctgcaagatatgtgaagatatttctggatatttcagtgttagtggatgcgcaaggagacatgcttgacaacatagaaacacaggtttcaagtgcagtggatcacgtgcatcaaggaaacaatgccctccagaaggcaaagaaactacaaaggaactctagaaaatggatgtgcattgcaatcatgatcgttgttataataattgttgttgctatcatcaaaccacgggttaccaaaaacggtgtatag

SEQ ID NO: 11783 - DNA, 804 bp, Glycine max
  Peptide Sequence Number=SeqID_128561
atggccttagatcacttcgaggagagtgtgcaccaaaaaggaaattggaaatcttccagtgaaatcattgcagattctggtagaaatgcctctggtagctttgactgcaacatctgcctggagtgtgttcaagatccagtggtgacactttgtggtcatctttattgctggccctgcatatataaatggcttcattttcaaagcacctctttggataatgaagagcaacagaagccacaatgtcctgtatgcaaatcagaagtttctcaatcctcccttgttccattatacggccgcggccaaaccacaataccttctaaagggaagccacatcaagtagggactgtcataccacaaagacctcatggtcccagaacacacaacattagaagtgtttcccaaccgatttctcaaagttaccatccctatagtaatccttatcatcctcaacaattcaactcgattccaagcggttacacctcacctatgattagaacaagtggttcaatagacaacacatttggaatctttggagagatgatatatgcaaggagttatacatatgagagaatagatggtagtataacttggtattccagacgttgcaagtactctaaccctttagcaccgacctctgccatgcctaaagagaggaccaccgcgagagtacttccgaaggttaaaatcaaagtcggacatctcagaccagttcatttgataattctaattagccaactgatgcttctacctgagcgtagggcaaataagaggattcaggataggaatgactttgcttatttgtaa

SEQ ID NO: 11784 - DNA, 291 bp, Glycine max
  Peptide Sequence Number=SeqID_128562
atggaatatggtggcgtgtatgaacataagaggctaagcataaataaagaaggcgagttaaggaaaacaaaaacgaaactgcatgccccatgtcttgacatcacatcctatgaagagagagagagagagagaaagggtgcaactactatagcaagccgtgagaatatttggaagctcaatagaaaagaaggaaagttgcgtagaagggtagagacagatgaagagaaggaagaagaacaagaaatgatggagtacgagggaaagaagagttgggagaatgagattttataa

SEQ ID NO: 11785 - DNA, 214 bp, Glycine max
  Peptide Sequence Number=SeqID_128563
acatgatatcaaaattcccaacggtgagaatgctcagaattgggttgcaaacctggtactaaaatgtcacgacgatccaacggttaatgagttcgagatcgttgtttttctgagacagatttggtgggctgcgggaaaaagaaagggttttgagaggagaaggagaaaaaacgagaatgagggaaagaagagacaccgtcagtgtgaaaactga

SEQ ID NO: 11786 - DNA, 429 bp, Glycine max
  Peptide Sequence Number=SeqID_128564
atggaaaacatctacaactcctacatgcaaaggaacaaaaatgttccaatctctccaccacaacattctctgccagataccatagctgcagcgacaaaagtaatcactgcagaccccaattttcaatcagctttggcagcagcacttacaacaattattggttctggaagcactactcaaggaaaccatggtggtgcaggggaaaatctgagtcagaaaatgaaatggggtgaactgtttccttcatcttcttctgcattaccttcatcttcaacaaaagtcaatggttgtgcatcaagcttcttgaacaaatcagccgctaatacacaaccaggaacagctttgatgtttcttcagccacctttgcctctttctagccccaaaagcgcttctgggtctccaggagatcatatagacaagagaaattga

SEQ ID NO: 11787 - DNA, 264 bp, Glycine max
  Peptide Sequence Number=SeqID_128565
atggcatataacttgcagtgcttcttttcaaaatatggaattcacagcttgcctgcaatattactagtgaaccagacatcaaagttgagatatcacggtccaaacaatcttctctccctttttgaattttacgaaagaaagacaggtgatcgatgtcaggaggatttggaacaagctaagactgtgcaagaccaggacttttcacgaaaaggcaaggagtgcccgcgtttgggcttcatctataacttctgtttcccttggtga

SEQ ID NO: 11788 - DNA, 747 bp, Glycine max
  Peptide Sequence Number=SeqID_128566
atggatttcacagtggagaagaaggaatcagagaacaacgccgaaaatgctcacccaacaacgttagattcttcttctcaattggcatcggcacttgattccaacaacaaagaaatcgaagaacgacaagctcgtgaactcaaagccggacttcaccccctaaagggtaattttgactttgatcctggtctatggttgtgtatttgggacgaaatgcacaagtttgtcttctggtacactcgtcgaacacctggagttcgaaatcaaacatcatatgaggacaacataaagaaaattgttgaatttagtacggttgaaggattttgggtctgctactgccatcttgctcgtcctgcttctttacctagtccaacagatttgcaccttttcaaggaaggaatccgtcctctatgggaggactctgctaactgcaatggtggtaaatggattatacgattcaaaaaggttgtctctggccgtttttgggaggacctggttcttgccttggtgggtgaccaattggattatggggataacatatgtggtgcagtactaagcattcgtttcaacgaggatatattgagtgtctggaatcgcaatgcttcagaccatcaggctgtaatggctctgagagattcaatcaaacgtcacttaaagcttcctcacagctatgttatggagtacaagccccatgatgcctctctgcgagacaattcatcttacaggaacacttggttgagaggctag

SEQ ID NO: 11789 - DNA, 2169 bp, Glycine max
  Peptide Sequence Number=SeqID_128567
atgatttatcctcacaagggtattttcggaatatggttaaaaaacacccatgtgggcggtgccaatagcagctcccccttctccaaaactaaaaaactaaaaccccaaagcaaaacggtggcagcggcgaccccttctccaagcttctcttctcttttcttctctccatcttcttctctgctcagtctcgcaatcttcaccttcatttggatcatggcaacccttgctccatcctctgacactgcaaatttactgcagaatttgtccttggattccgagtccaagacagttcctgagcctgcaaagaagaatggacatggtccagccaagggggtgaccaagccatttaacccgaatgcaagcttcactccaaatggacacctgtctgcttctgcatactattatggaggtaaggatggatgcttcctacttgctaaaatcacgcttgatttgtttctgggggttctaaattgttacaccaatggtgttttgggagatagctgctcttatttgtaccatcaaggttatggttatacaccatatggagcacccatgcaacatgatgacaatctctatgggctgcaacagtaccagtacccttcttcttactaccagtctccagcttctgctgatgggtcatttgctgctaacaaaatcaatgctcaagaagggagaatatcagctgcagccagtgctgaacatatcccttcatctgctgttattaataaaggaagctccattggtgtggtgaatgaaggttccacaaacaacaatggggtaaaggaatttttatcaagtacccagcgcccgttgttgaattcaaatgattcttatcaaagggctggctttcctgtgtatgctcctttgtcaggatatcaagatccaagagtaggtcctcatgggactcaaccagcattacctttggatcccttattattttctaataagaagtccaatgatggagcaaaaattggattatcttcaccagctgtgcctggcaaaaaaatttcctctcaaaggaatacaaccattcctcagccacttccacagtccatgaacttacatggttccatacattcatctggactagaaccgttctctggattcattaatgggacgtacccaagcaacacaatgtatagccaatatggaaatgcatatagagctagttctcatttcggacaagctccgtatggatatgggtatagaatagggtctgttaataacaagcctaaagcctcaaatgatggttgtgctattgatcatgtcaaaagaaatatggatggctttggtgagctgaataagggacccagatctggcaatagttctgatgataaaagtgttgatggtcctggacctgtcacattattaatcaagggacagaatcttccaattaagagtgataataaagaagtgcctctagttcccaataacgaacagtacaatgggaaagactttcctgagaattattctgatgcaaaattttttgtcatcaaatcttatagcgaggatgatattcataaaagcattaaatataaagtctgggcaagcacctttaatggcaacaaaaaactggatgcagcgtatcatgaatccaaggagaaacctggtgactgtcctgtatttttgctattttcggttaacactagtggccaatttgttggtttggcagagatggtgagtccacttgattttggtagaactgtggagtattggcagcaggacaggtggagtggttgcttttctgtgaagtggcatatcataaaagatatcccaaacagtgtgttgaggcccataacactagaaaacaatgaaaacaaacctgttactaacagcagggacacccaggaggttaagtttgagaagggtattcaaattctcaaaattttcaagcagcattcaagcaaaacatgcattttggatgattttgggttctatgagactcgtgaaaagatgattcaggaaagaaaatctatggaacaacagcttccgaaacaggctagcaagtccaatgatttaacaacaaatgggacagttatgttgcccaagtctcatgatggagccttgaagaatgaatcagctactacagatgaagcaggacaaaaggagaagctggtagaagtgaatggatcaactcaagcatctgaagactgttcaaagaactgctaa

SEQ ID NO: 11790 - DNA, 279 bp, Glycine max
  Peptide Sequence Number=SeqID_128568
atgaaaatagggaggctggagagaacgaagctgcacgtattggatggattcatggctggcgagctgtggaattctctcggtataagcgaggaaaacgctcccaatttctcaaggagacaaatcggagagggtgcgggagagagcggggtagaggttctggatgacccggattttccaatccgggtcaccgggagggacccggaatatctcgggcgcgcactcgtgctcgtggccgatacagaaggggcattgctggttcgggttcgggtcggcgggtga

SEQ ID NO: 11791 - DNA, 780 bp, Glycine max
  Peptide Sequence Number=SeqID_128569
atgggtttcaacattcaaccctatgggattcagtccatgctcaaggaaggccataagcacctttctggcctcgatgaagcggttctcaagaacatcgacgcctgcaaacaactttccactatcactcgaacttccctcggtcccaatgggatgaataagatggttataaatcacttggacaagctttttgtcacgaacgatgctgggacgattgtgaatgaacttgaagttcagcatcctgctgccaaggttttggttttggctgggaaggctcaacaagaggagattggggatggagctaatttaactatttcatttgctggggagctcctgcagggtgccgaggaacttatcaggatgggtttgcatccgagcgagatcatcagtggatacactaaagcaatcaacaagactgttcaaatattggatgaactagttgaggatggttctgacaatatggatgttcgtgataaggaacaagttatttcaagaatgaaagcagccgttgccagcaagcaatttggtcaagaagatatcatatgttcgcttgttgctgatgcatgcatccaagtgtgccccaaaaaccctgcaaactttaatgtggacaacgttcgtgttgcaaagctcttgggagggggcttgcataacagtactgtagttcgaggattggttctgaaaagtgatgctgtcgggactataaagcaagcagaaaaggcgaagagtgagatccttcacaactgtctcaaccttttcatttttccagtcctatatgctagatga

SEQ ID NO: 11792 - DNA, 888 bp, Glycine max
  Peptide Sequence Number=SeqID_128570
atgaaaaccctgcagtattcatttgcacagattgaagccttcgcgacgattgctgagaccggtagtctgtcgcgggcggcgatccgtttagggaaagaccgtacgacgcttcgcgatctgctggattacctggaagatgcgttgggctaccggctattcagccgtgcagggcgtagcctgaccttaaccgccgagggcgagcagctttttcgccaggcgcacctgttgttgcgtcaggcgcaggctttcgagtcttttgcgcaaacgctgccgcaaacggcctggcaggaattacgcctggtgtacgattctttcgtgccgcgtgaatttctctgtttgctggccgatacgcttgcccggcggcagatccgtttaagctgctggagcgcttcgcgtcgcgaagccgagcaggcgttgagcgatggcgtcgcggatatggccatttgccaggcgaacaatcgtacgctgggtagcgaaatggagtggcgggcgctgggtaccgttgatttacgcttttacgccgcgcagcggttgttcgctggtaccgcaaggccgctgacgttgctgaatttatcgctcaccccgcagttagtcatgcaccggcgcagcgacgatcaaatcgcccgccggttgcagatatccgggcatacgctgtatatgaatgaaatcaccatgttgcgccacgcaatggagcaggggcaggggtggggttttttacccgaccatttacagcccggcgagtggcagggggtagctgaaattgctaccgaggtcggtaatcaggggcttaacgttaccatggtgatgctgtggttgccgggaatgaataaacaccgcgcgctgggagagattgttgacgacgcgccagggttatggcggcgcagataa

SEQ ID NO: 11793 - DNA, 1029 bp, Glycine max
  Peptide Sequence Number=SeqID_128571
gttgctgtgtttgctagtggtgttgatacatctgcaactgagactaaaggaactgtcctcatacatacagctgagcagttatattttttttattgtttgagtggtgaagcctattttgtgtttgctggtataagttggagatcaatccccatctcccagataagaaagttgaaagtggattgtgataggctagaaaattattcaaaaactgaagaggctaaagtagaggagctcatcaaggcagtagcagattcaggtgccaaagtgattgtcagtggaggagcagtaggagaaatggctttgcatttctgtgagcgttacaagcttatggttctgaaaatcagctcaaagtttgaactacgtcgattttgccggacaaccggctctgttgccatgctaaaactttgccaaccaaacccagatgatcttggatatgtagattccgtttcagttcaggaaattggtggtgtcagggtgaccattgtgaaaaatgaagagggtggaaattctgtagccactgttgttttacgaggaagtactgatagtatactagatgatcttgaaagagcagtggatgatggagtgaacacttacaaggcaatgtgcagggatagccgctttgtacctggagctgcagctactgaaattgagttagctaaaagggtgaaagacttttccttcaaggagacagggttggatcagtatgctattgcaaaatttgctgaaagttttgaaatgattcctagaactttggctgagaatgctggcctaaatgcaatggagatcatatcttctctgtatgcagaacatgcatctggaaatgccaaagttggcattgatttggaagaaggcatatgtaaggatgtctcaaccttgagcatttgggatctccatgtgactaagttatttgctcttaaatatgctgcagatgctgcatgcactgtactacgtgtggaccagattattatggcaaaaccagctggtggtccaaggagagaacagcctgctggtggtatggatgaagactaa

SEQ ID NO: 11794 - DNA, 1085 bp, Glycine max
  Peptide Sequence Number=SeqID_128572
cctgggctgccaagcgtcttcgtcactacatgattaaccacaccacctggctaatatccaaaatggacccgatcaagtatatctttgagaaacccgctctgacaggaagaattgctcgttggcagatgttgttatccgagtatgatatcgaataccgcacccagaaggcaattaaggggagtgttcttgcggatcatttggctcaccaaccgattgaggactatcaacccatcaagtttgactttcctgatgaagagattatgtacttgaagatggaggattgtgatgacccattgcttggagaaggtccggatcccgagtctagatggggtttgatttttgatggagcagtgaatgtctttggcaatggaattggggcagttattatcactcctgaaggtaatcatctccctttcgctgcaaggttacagttcgattgcaccaacaatatggcagagtatgaagcatattatgcaaggcatttgctaaccttcttcaacaaagtggagcttcaccacatccctcgtgatgagaaccagatggcagatgcgttagcaactttatcctccatgtacgaagtgagtcaccagaacaatttgccaacaatcagaattcagcgcctcgagaggcccgctcacgtgtttgcagtcgaagaggttgttgatgataagccctggttccatgatatcaagtgtttcctccaaagtcaggaatatccacctggagcatccaacaaagataggagaactttgagaagattgtctggctcctttggaactcactccaatggacatgcaatggctaggaagttgttgagagcaggttactactggatgtcgatggaaacagattgttgcaagcatgctaggaagtgccacaaatgccagatttatgctgacagaattcatgtaccaccaactacacttaatgttctttcttctccgtggcctttctctatgtggggcatcgatatgattggtagaatcgaaccgaaagcttcaaacgggcatcgtttcattctagcggctattgattacttcaccaagtgggttgaagcagcatcttatgcaaatgtgactaagcaa

SEQ ID NO: 11795 - DNA, 612 bp, Glycine max
  Peptide Sequence Number=SeqID_128573
atgggtcatgagttttctaatggagggggagatttaacaggggagtttgctggtttcatgcacaaaagtcattggcatggagcatctagaagtgccagcacaagtccattaagatcgcgcacgcaggacaacattaagatctttatgactcctaggaaactcattcactctcttcaagaagacctaaatgatgagatttcagattgctcggagaaaccaaatagaaggatcaagagtctatcatcaggcaatattaagttgagcccggcatcttattctaaatatgatcaaaatggtattgcagatcatgtcaactatgattctaaagagagtggaagcttgtgtggcgatggtgaaggcgatgttcagttccaaggtgggctggagtcagtctcttcaacagatgacattccttgtaataccgatatgcagaagccttctgaggttggtcctgaaagtagaaatggtactgaaactgttctcatgggaaagccttttcaaaagactaagcataaattagtttatggcatttcttttgctcttttagcaatagctactcctttcctctggatcaacagtcaggaccaaggccattttcttgtaccgacttaa

SEQ ID NO: 11796 - DNA, 846 bp, Glycine max
  Peptide Sequence Number=SeqID_128574
atggctttaagttcactttttggctccactcgtttcattcccacacccttcgttacttccactagaaacataccttcttcagcacacacttgtgccagtaacaacaagagagagtttccactccctccagtggcttcagtcccttaccaacccatcaacaactttgcctaccttcaagaagaattcagtggacatgctggagtcacctttgaaggagttgaagacagttgtgttgccaagatggagctgaaaaatggaagcattgtggagttgcttcatactaatgtgtcagagggagagtatggtgatgccatcattcaaggaggggtgtctctgaacttcaattttcaaactcatgatgatggtgaattttcttggtctccaactaattggcttctgcataagattcaaggcaatgctaatgaatatattcaggatggggaggggcaagccccccttggatccgtcactgaggtagaattaacaaatagaacatcagatgacaagattggattaaaatacatagtgactttggaacaagatgccttaaactcagagcttgaaatctcgaacaaaaagtctttaccagttcagatgaccggttccatcctgaatcatctgacagtaagctcaccagaagcaacttatgcactaggattagaaagatcaaattactgtagcaagcccttgtttgaatctgaatttatgttgagtcctccagattcatgccaggaagaaggctttggaaaaatattacagcaattttttcctcattggggtacaaaaggtcagaataatggatcagaaggtggccaacatgaagaaatggatgaagcaagcagttaa

SEQ ID NO: 11797 - DNA, 931 bp, Glycine max
  Peptide Sequence Number=SeqID_128575
atgggaaggagtctgagtccaatgctacggagagagatccaaaatcttgacaaagatacggatagccgcaaatccgcaatgagagcattgaagtcatatgtgaaagatttggacatgaagacaattcccatctttcttgcacaagtttctgagaccaaggaaactggttctttgtctggagagttcacaatttcactgtatgaggttcttgcccgtgttcatggagtcaagattgttcctatgatagacagcattatgcaatccatagttcagaccttagcttcaagtgcagggtctttccctcttcagcaggcttgctcaaaagtggttccagccatagcaaggtatggaattgaccccgcaacccctgaagagaagaagaggcaaataattcactctctttgtaagcccctttcggactctctcttgagttctcaagagagtttgacatgtggcacggccctttgcttgaaggctcttgtggattcggacaactggcgttttgcgtcggttgagatggttaatagggtgtgccagaatgttgctgcagcattagagggaaagtccacacaaaccaattcacacatgggtctgattatgtccctggcaaagcgcaatgctttgattgttgaagcctatgctagattgctcatacaatctgcactgagaatactaaatgctggcagtgagcctgtggaggggaattctcagaagcagtttgtagccattcaaatggtgaacttcttgatgaaatgtttggatccaaggagcatattttcagaggttgaacagataattgaggtgatgaagctgtgccaatcagacaaaatggcatatgtcaaaggagctgcatttgaggctttgcaaactgctaatataattgccgctgataaaaaatcaagaggtgtgaagagtcctgcttctgtgccgg

SEQ ID NO: 11798 - DNA, 2765 bp, Glycine max
  Peptide Sequence Number=SeqID_128576
atgaacgaaactgaaacaaacattcgtgacaactaccaacgactaccctctatgcttatttcttccctttctcttcgtcccttcttcttcctatgtcccaaggcctattcttttccacgccaatgcaaattcccacttcaaaattttcccaaacccattttcaatgatcacaagttactgtctggaaatttgagttttgcggctttcagtaacactgcattgagctatgcctacagcaacgacgaaggagaagcaaatggaatcaatttcttgcacctcatggaagaacgtggggttcgtgcgaattcccagacctatttgtggcttttagatgggtgtttgagttctgggtggttttctgatggttggaagcttcatgggaagattctgaagatgggtttttgtgcagaagtggttttgtgtgagcgtcttatggacttgtacattgcctttggtgacttggatggtgcagttacggtgtttgatgaaatgcctgttagaccgttgtcttgttggaacaaggttttgcacaggtttgttgctgggaagatggcgggtcgtgttctgggtttgtttaggcgaatgttgcaggaaaaggtgaagcctgatgagagaacttatgctggggttttgaggggttgtggtggtggtgatgttcctttccactgtgtggagaagatacatgcaaggactataactcatggttatgagaatagtttgtttgtatgtaatcctctgattgatttatattttaaaaatgggtttttgaattcagctaagaaggtttttgacggtttacagaagagggatagtgtttcttgggtagctatgctatccggtttatcacaaagtgggtgtgaagaagaggcggttcttctgttttgtcagatgcacacatcgggagtctatcctaccccttacattttttcgagtgttctaagtgcctgtacaaaagtagagttttataaggtcggagagcagctccatggccttgttctgaagcaggggttctctttggaaacctatgtttgcaatgcccttgtgacattatattcacgtttggggaactttatacctgctgagcaggtttttaatgcaatgttgcagagggatgaagtttcatataattcgctcatctctggtttatctcaacaaggatatagtgacaaagctttagagttgtttaagaaaatgtgtcttgattgcctaaagcctgactgtgttacagttgcaagtcttttgagtgcctgttcatcagttggggctcttctggtaggaaagcaattccactcgtatgctataaaggctgggatgtcttcagatattatcttggaaggtgcactgcttgatctttatgtgaaatgctcggatataaaaactgcccatgaatttttcctttcaactgaaactgaaaatgtggtgttgtggaatgtgatgcttgtagcttatggcctgctagacaatctaaatgaatcatttaaaatatttactcagatgcagatggaaggcattgaaccaaatcaattcacctatccaagtattttgagaacttgctcttctttgagggctgttgatttaggagaacaaattcacactcaagtcctaaaaactggctttcagttcaatgtgtatgtctctagtgtgcttattgacatgtatgctaaattaggaaaattggatcatgcccttaaaatctttagaagactaaaagaaaaagatgttgtttcttggacagccatgattgctgggtacgcacagcatgaaaagtttgctgaagctcttaacctctttaaagaaatgcaagatcaagggatacactctgataatataggatttgcaagtgcaattagtgcatgtgcgggtatccaagcacttaatcaaggacagcaaattcatgctcaggcatgtgtctctggttattcagatgatctttcagttggtaatgcacttgttagtctttatgctaggtgtgggaaagtacgagatgcatactttgcttttgataaaatattttctaaagataatatatcatggaactcattgatatctggttttgcacaaagtggacattgtgaggaagcactaagtctattttctcaaatgagtaaagctggacaagaaatcaattcattcacatttggtcctgcagttagtgctgctgccaatgttgctaatgttaaactagggaagcagattcatgccatgattataaaaactggccatgattcagaaactgaagtttctaatgttttgatcacactatatgcaaaatgtggtaacattgatgatgctgagagacagttttttgaaatgcctgagaaaaatgagatttcttggaatgccatgcttactggttattctcaacatggtcatggatttaaagcattaagcctttttgaggatatgaagcagcttggtgtattgccaaatcatgtcaccttcgtgggagttttatcagcatgtagccatgtgggtttggttgatgagggaattaagtattttcaatcaatgagggaagttcatggtttggtgccaaaacctgaacattatgcatgtgttgtggatcttcttgggcggtctggtcttttaagccgtgcaaggagatttgttgaggagatgccaattcaaccagatgcaatggtctgtaggacccttttaagtgcttgtattgttcataagaatattgatattggagagtttgctgctagtcatcttctggaactggaacccaaagattcagcaacctatgttctgctttcaaatat

SEQ ID NO: 11799 - DNA, 268 bp, Glycine max
  Peptide Sequence Number=SeqID_128577
atgacgtacttacttgttgggaatgaaataaagcgtgaaaagggaagcaaaaaactcaacaatggaagcttgggggctactgttttcgtagttcccgtgagctttgtgtttttgaaaatgagggtgaaggtgtttggggaagacataagtatggctctttacgggatactaggctgcctcccagcggcgctttccatttgtccagagctgggcatgggacgacgatctatcggtcgtgaccctagcctctacttgcgtccgtccctaa

SEQ ID NO: 11800 - DNA, 243 bp, Glycine max
  Peptide Sequence Number=SeqID_128578
atgaacacaatgcacaatcgaaacaaaaaagaacatagaaacataggagaaggacaaaaaagagaaagaacacacacaagatggtgcaggcggcgcgacggcatcggggttgggtgtagacagcatgcggcggagctggtagggatcgtgtcagcgtcattgaaggcgcaagggtgcaggtgtttggaggcagaagggtcattcgcaatcaaatctggaggaggaggcagcatgcaacgttaa

SEQ ID NO: 11801 - DNA, 898 bp, Glycine max
  Peptide Sequence Number=SeqID_128579
atgggcgtcaagtacctcgaagtgatcaagcgagggtcgcatcccaacaaacagatggtccccggacgaaatttgggtatgacaccaggcaagccaaaggttagcctggaacaccatggactatgccaaagtcttcctctagagaagtttggcaattctggaggagaatgggcaacaacaccaagaggctttgcactaagtgtcatccttggagatgaagtgaagctccctaacgtagctagtgccactgtcgccttaattgaggcaatgaagtcaaaccaccaactatcttcgaaagttggtagtgtgttggccaagttgttgcgcaccaggttggacggcgatgaactgttcaaatgttgcaaggacttgcaggaagagaaaaataacttggttggtaaggtggaggatgttgcgatggagaaggacgagcttaccaagaaggtggcgaacctcaaggctcggttgaaagagtcggagtccatgctggacgagttcgagctgtgggctgctagggagaggaaggccagcaaggagcttgagggggagttattcatatacaagaaagaggtcgagttcttcgccaaggaccttgacttgtgtctttttgacccattgaattatgtgaatgacaattttctgcttgataaagaagaaattgttgcggaggagaagggttctagggaggagaagcaaaaccttgtcgatgtagaggttttgtcactcatctggtggtgcttccttgtgctttgcaaagcttctcctctgatgcttgtgaggaaccaaggagatgccttgggttttgtagaagtatgcaccaaggggatgccttgtggtgtaacaacccttcgtgactatggcatgagggaggccatacttgcatatgaggtgtttctag

SEQ ID NO: 11802 - DNA, 279 bp, Glycine max
  Peptide Sequence Number=SeqID_128580
atgcccatcaaaaatcacgaccaaggaggtggagaagtttacctagaaacacctcatatgcaagtatggcctccctcatgccatagtcacgaagggttgttacaccacaaggcatccccttggtgcatacttctacaaaacccaaggcatctccttggtctgctcactcgcaacaactacgacgaacaccatcaaagatccaagttcaacaaaacgaactaccaccagactatttggcaagaccttcaatcaggtggaagtcatacttactcctcataa

SEQ ID NO: 11803 - DNA, 324 bp, Glycine max
  Peptide Sequence Number=SeqID_128581
atggcagacttggaagaggtcttcagagaactccataaatatgacatgcacctcaatccaattaaatccaaccccaacaaatgcactgctatcctggagatgcgttgtctgaccaacgtccaagaagtccaaaagctcaatggtagactagcatccctgtccaggttcctccaaaagattacaaaaaaggtgaagccattctacaaactactcaagaagactaagccattctcatgggacgagacttgcgaacaagccttcttggctttcaagaagaccattgccacaccgctagtcttgagcctaccttctcttagtggctga

SEQ ID NO: 11804 - DNA, 600 bp, Glycine max
  Peptide Sequence Number=SeqID_128582
atggctgccaagcgaataggtccacattctgatgtagggtatcagcgatgcatctgtgctcatggcttgagctatgtacattgcccgggtttgagtcccaactgcagcttgacgagctcttcaatgggctttgggcctttgttagaagtgttgttgcatggatctatatcgaattcatcatctaagatggcttggtatatggttagggctcagattagaggtctttccttcatgctcatgacttggagtaccttcaaccattgtggggtgaggcttagcaagctccctgcctcttgtctctactcttttgcatatgaagccaaggagtggaccggcatgagggaccttgaacaccatgaagcttgcgatgatgatggagataaccatggggtcgtcctggttcatggggttgatacccttgaagttgtcacttgtgcctttgttgttggtatcgctatctacctcaacctttcactctatcttttcttttgtccgcatcatgattcctatgctaattctcttggtgtcctccagggcccgacagtcttttgtattgtgattgataccatgatggtatctacagtatttggtcgcatctaa

SEQ ID NO: 11805 - DNA, 264 bp, Glycine max
  Peptide Sequence Number=SeqID_128583
atgatgagcattatgaatcttaaggtggctcagttgttggatgatttgaaaatgaatgatgttgaaagaaagaagcagtttcatacaacgaagagaaaaaaggagacagaaacagaaggaactactgcttatgaattaacaggccctttgtcctcactccagttgcacactgccaaatggcctttggtctcttatcaaccgaaacacccccgtgttatgctgcctaattttcaaaagctcaataagttcaattgtgaagattaa

SEQ ID NO: 11806 - DNA, 327 bp, Glycine max
  Peptide Sequence Number=SeqID_128584
atggacagatttggacgcattgtcgtcaagatccaaaatctcaacccaaaggtagcactgcacgccatggtccttgccttaaggcctggcatgtttgtggacagtttgtgcaaaaacacctctgatgacatggacgagttatgtgaacgagccaaaggatacattcaaatggaagaaatgtctaggttccagaacaaagttaaacaagccagacagaagcacgacaagcgagaagaaaatgccaagatcgactcacacaagttggacaagaggcataagccagataagcggcaacctctcctaaaaggacctaggtatgaacactag

SEQ ID NO: 11807 - DNA, 277 bp, Glycine max
  Peptide Sequence Number=SeqID_128585
ggagattcgccacttgagtgaatcccccaccgagggtcaggaggccagacaagaaagattcgcgcgcctcaagacggttcttgactcagtcgacagccggttggatcaagcccgagaaatagatcgggttcgtgacaacgaacgtgctcggctacgggcagaaatggatcacgactgtgatcggtggagggctctcgagagaaagaacgcccaaatgcgattgaaagttaatgaactaaatttaaaaaagaggggacctcttattaagtttaagtga

SEQ ID NO: 11808 - DNA, 303 bp, Glycine max
  Peptide Sequence Number=SeqID_128586
atgaccacttccggaagaacgtcttccggaagtggtgaaggccaattccggaagaagttcttccggaaactacttctggaagaccttcttccggaatgtgtagtaaatttttggatgtggttatatgataatttgaatgtacttgtgtatgatgcatatgtccttaagatggacgaagatcaatggaggtatgactttgcgatgtcacaagaagttcatatggattatgattatgataatcaagaagaatgtggagtgaatgaacgacatgtcgattgttcaaatgcttttaatacatctcag

SEQ ID NO: 11809 - DNA, 1195 bp, Glycine max
  Peptide Sequence Number=SeqID_128587
atggtgataatgggaaaagggcttggggtgaattgggggactcaagccacacaccagttgagggcagacacagtggttgagatgttgaaggacaatgggattcagaaggtgaagctgtttgatgcagatgagtctagcatgagtgctctatctggctctgggattgaagtcatggttgccattcccaataaccaacttgctgagatgaatgactatgatcgtgctttgcagtgggtcaagaagaatgtcactcggtacaacttcaggggtggagttaacatcaaggtgtcaatttgtgaatgtgggatgtttttaaacttgagggagagtaaaatgtatgtagcagttgggaacgagccatttttaaaatcctacaatggttcattcttgaacatcaccctccctgcattacagaacattcaaaatgcactcaatgatgcaggcctaggggactccataaaggccacagtacccttaaatgctgatgtgtacgagtctccaccgaacagtcctgtgccctcagcaggaatatttaggcctgatataagtgaccttatgacccaaatagtgcaatttttggcaaagaacaaagcaccattcacagtcaacatttaccccttcttgagcctctatgggaatgacaatttcccctttgactatgccttctttgatggtgtggccaatcccataattgataatggggtttcatacaccaatgtctttgatgcaaattttgacaccttggtctctgccctaaaaaaagtagggtatgggaacatgccagttttggtaggagaggtagggtggcccacagatggtgacaaaaatgctaatgtaggaaatgcttttaggttctacaatgggcttctaccaaggcttgcaatgaataaagggaccccgcttaggccaggatttattgaagtttacctatttgggctcattgatgaggatgccaagaacattgccccagggaactttgagagacattggggtatttttgggtatgatgggaagcccaagtttccaatggacctttctggaaaaggccaaaagaaggtactagttggtgctcaaaatgtgcactatcttgagccaaattggtgcatgtttaaccctgatgcacaggacctaagcaaacttgctgataatataaactatgcttgcacccttgctgattgcactgcacttggatatg

SEQ ID NO: 11810 - DNA, 1329 bp, Glycine max
  Peptide Sequence Number=SeqID_128588
atgtattcaactgagcaagctgatgatacagcttcccaggatagcaattctgatattgttgcaggaactccacctcctaaaagtagtatagttagtcctactactacaacaccagcagggaatttttctactcctgtttctatgaatgttcccatgcctaacttgtcgagtccaccagccattgcgtcagccatgcctggttcaaattctgttcggagttccttggagattagtagtcctgtcaatgcttcatcttttgtaaatcagtctagcactatgaaggaggaagagattaatagtttccctggccaaagaccatctccatcactttctgatgttgcacttgtaaggaacatcagcagaaacagcttatcaaatcaagcaacaaataacatacctcttgtttctggcaatatggtttccagcaatgggccccttggttcagtcccttcagcatctgaaataaccaagagaaacatattggtagttgatgatagactcggaagcaatgggatggtgcagcctcttgtatcccctttaagtaatagaatgatcatgcctcaggttgcaaggcctaatgatggaacttcctcagttgactctagtagtgtcaacgaagctgcaactgtatctgggagagttttctccccttctgctgttcctggcatgcaatggagacctggaagccccttccagaatcagaatgatgtgataagacaagctaaaaccatctatatattgatgtatataaattataaaatattccgtgttttaaggcctatttacatggaaaataattacatgggtgcacatatatatatttgcagaactgaaatagctttgatgattcgtggaagaactgaaatagctccagatcaaagggaaaggtatttgcagaagttgcagcaagtgcagcaacaagggcaaagtgcccttcttaatatgccatcttttgtaggagggaattctaagcagttttctgctcagcaacaaaatcctctcttacagcagttcaattctcaaggctcatctgttgcttctcaatctagcgtgggacttggagtccagtcaccaggtcttagtggtattgcttccacctcattaccgcagccacccaattctgtccattccccatctagccaacaatcattgctattagttgtttccaaagatgcagatgttggaaattctaaggttgacgagccacaactacatatttttcctgatgattcggggactgaatctactgctagtactgggattggcaaaaatttcgtgaatgaagatgaattgaaatccacatatgccgtagattctcctgtatgctaa

SEQ ID NO: 11811 - DNA, 960 bp, Glycine max
  Peptide Sequence Number=SeqID_128589
atggagaatgatatagagggtgtgcattggtgcaacatatgctctaaaatggtgaatccaatgagtgatgatgagaacatatgcccgttttgtgagacagaattttctgaggtaatggacaacctaagggaccagaatgatgtttttgacttaaggtcagcttgggtgttctcgctttacgccccaatttttctcggtttgatgggtgctttcagcccttccctagcaagaattgctccacatggaggcagcagcagctcaaggggtgtggaagaagaggttgagcaagagagggaaaatgaacttgtgcttgggagaaggagaagaacttcaacttacatgatgcacctctttcgcggtcttcacattaggatggtgtctgaacttgaaaaccctgaagacaataataggaacatggatggcagcagcatacttgtgattgatccattcagtgaaggtgcattgattgtgaggggacctaacttgagccacacaactagttcgaatgagaataatgctgtcggaagctccttgaatgaccttgtggtaggatctggctttgatttgttgctacagcatttggcacagattggtcctggtggctattcaagtgttaaccctccggcacagaaggcggcaattgaggcattgcctagtgtgactagtgaggagaagtttcagtgcccagtgtgcttggaggatgttgaggttgggagtgaagcaaaggagatgccatgtatgcacaagttccatggtgactgcattgtctcatggctcaagcttcatggctcttgtccagtttgcaggtttcagatgccatctgaggattcaactcttgaagccaatgtggacaatcggaacagtgagctggtcagagctggagaagagagacccagaaatggaaggaggaactggtttccagtgctgcaatcgtttaacaattttcttccttatccttga

SEQ ID NO: 11812 - DNA, 342 bp, Glycine max
  Peptide Sequence Number=SeqID_128590
atgtcctccttgtccttttctgtaaggttggaagatcaacatccactccagggtccagagatcagaacagggtttttgaaacaagggaagcccatagaaatccaaagaggacaagaaatcacaatcacaactgactatagcataaagggtgatgaaaacatgatcagcatgagctacaacaagttggcacaccatttgagtccagagagtaatattctgtgtgctgatgggacaatcagtttcactgtcctggaatgtgacatggagaatggcttggttcgatgtcgttgcgaaaattctgcagttcttggggagaggaagaatgttaacctacctggagtg

SEQ ID NO: 11813 - DNA, 288 bp, Glycine max
  Peptide Sequence Number=SeqID_128591
atgctgggtctatactttgccacaagttttgaagtggttcctcctctagttagcacaaagattagagcagcattgctgcaatatgcagtcctaactgcggccgaagccatgctctccaaaggactcattggagttggagctggccatggtttgaacagcaatgtctggataggctcctgcagaagtttccccgctaagcataacacagtctgtgccatcaaggactgcattagcaacatcggtggcctcggctcgcgtaggccggggagatttgatcatggactctaa

SEQ ID NO: 11814 - DNA, 417 bp, Glycine max
  Peptide Sequence Number=SeqID_128592
atgactaaccttgtgtctggagtccaagagcatactaacattgtcttatcaggtaatgccgatagaataaaactgttccacgataacaggaagtcatgccaattgccgccgttacagaatatcttgcattttgagcatccaccgtcgaacattatcttgcggcgcacggtagccagaaatcgcctcacgacgattgagactaaaatcaaaggggttttgttgcgaacatggagaggaggtgattgttggtggtggtttcttggttcaggattggagttggccagaaaaaggaaggttgaacgtcattgttgttgttgcgagcattttggtgctgtagcggagagtgagagggatggagtaggggagtgcaagaggaagagtgggaaacaagaaaggagatggagtgtgagaaactag

SEQ ID NO: 11815 - DNA, 897 bp, Glycine max
  Peptide Sequence Number=SeqID_128593
atggaagcagcagccagaatttcagaagcaagtggagttcaaatgaaacatttaagcataggcctccagacaaacaaaaattcagaaataaatgatgcactacagatgcaaattgaagtacaaagaagactgcatgagcaacttgaggtacagagacacttacagctaaggatagaggcacaagggaagtaccttcaagcagtgttggaaaaagcacaagagacactaggaagacaaaatataggtgctgagggagttgaagcaaccaaagttcaactatctgaactagcatccagagtatcccctcaaagccttgactctagattttcagaactgaaagaattgcaagttttgtggcctcagcaaacacaagaaggccaagccactgattgttcaatgggaagtttcttaacctacagtgaggaatctcaaagagacagagaaacacataacatgaacttgaatttgagagcctataatggccctccattttcagtttcaaaagggtctgtggaagagtctatgcatttaaagcctgatcacacattgtgtgatgaagtgaaggagaatttgatgtttctttcctcatcaagtgatagtaaagtagtgaagggagattttttatcagaaagaccatcaagcctcttgtccatgaatgaaggagttcaagaagaagaaaattttggtagaacaacggttccaaaggaagaaggttggaagggaagaaagagcactgaaactgggagagcgccggtgaaattgaaccatgagaagatttctcaagattatagacttgcaaactttgaagtgaaactggacctgaattcccatgatgataatgatgcttcttcccactgccaacagtttgatttgaatggtttcagctggaattgctag

SEQ ID NO: 11816 - DNA, 651 bp, Glycine max
  Peptide Sequence Number=SeqID_128594
gttgaaaatcaagagggtgttgccaattttgatgaaatactggcaaattcagatgcattcatggtggcaagaggtgacctgggaatggaaattccaattgagaagatctttcttgctcagaaagttatgaaacacaagtcaagcatacaaggcaagcctgtggtgacagccacccagatgttagagtctgcgatcaaatctccccggcctacgcgagctgaggccactaatgttgccaatacagtccttgatggcacagactgtgttatgcttagtggggaaactgctgcaggagcctatccagacattgctgttcaaaccatggccagaatatgttcagaggcggagagtttcatagactccactgacctattcaggagagtgatagaaacagctccaactccaatgagtcctttggagagcatggtttcggccgcagaaacccctctaaggcatagccttatctaccggggactaatacctgttttgggcacaggttcttatggagattccatgactaaatcaacagaagaaaccatagagcttgctctttcatatgctaagaaaaatgacttgtgcaagactggagactctgttgtagcactgcaccgtcttgagtctagtactgtcatcaagatattggatgtttga

SEQ ID NO: 11817 - DNA, 903 bp, Glycine max
  Peptide Sequence Number=SeqID_128595
accattgatgttgcgaaccgacttttgtgcttccttatgcttttctctataactggacttgttgccattggaatatctgtggcaagagccaacataataagctcatttgctttagcctcatggaaaatttcttcaatacttcctatcatacctgtggctgtactcacattaggatttcatgtcataactccttttatatgcaaagttgctgggaacactattgatgaggctagaaaagcaatactaattggtggaacggttcctttagtcatggttttgtcatggaatttgattgtgttggggcttgtggggaccaataacataccagctacctttggtgaccctatgtcccttttgctttctgtgaatccatctgctttatcagcagttcaaggctttgccttctctgctatggcaactagcttgataggatacgctgtaagtttgcctaaacagcttcttgacactttggagttagtatctgaaaaagccaaagcttgtgatgagcataattatagtggaaaagttggattagcttcttactcaggagggtcttgcattggtaattctgggaaggtttgcttcaaaggttcaagaaatgtgactatggttgcatctacaatgagatcaaatgagcaagcatgtgatccgattaaagtgcttgtaacattgtccctccttggtttctcagtgctgatagcttcattttttcgctcaatgttttcaagagctcttgatcttgctggggtatatgccaattgttttctctttggcattattcctcctgtgatggcttacatgcaacaatccaagaagaaaataaggaaatcaatcattccaggcggaaatggaacacttctactgcttttcattgtctctgtggttttgggaatttggcattag

SEQ ID NO: 11818 - DNA, 486 bp, Glycine max
  Peptide Sequence Number=SeqID_128596
atgggatcaagaaagcctcgcggtcccaaggatttattgaacatgaagatagtgaaaaagtccaggagcaagcaacctatacgagttgttagacgacgcattcaatctgaagaatatgccgcttcagagattcaaagacagacacatcatagaggaagtaacaaaaaaagtaatgagtcgtataaatcaactgagagcatggaggaaattgtgattcccggagatattccagagcttgattcgttggtggtttatgagaaagaactatgttcagatttttttagcaatggtacgggctgtttggaaccatctggtgaaaggagaaaaaaaaatggtcacaaaagttgtaacaaagacgaatcacatgatctaaataagagtataactgattttgtgattcctggagatgttcctgccattgattcattgatggtctttgataataattttttttcagatttttttaccaatataccggtattctag

SEQ ID NO: 11819 - DNA, 471 bp, Glycine max
  Peptide Sequence Number=SeqID_128597
atggagactcaggaagcaataattggaggtgcaagaagcaacagccgaacccatcttcaaacaagttataagaaaactgtagctcctattttcataaccaatggctccaatgctcctctcaccacaaagttagcaccctgcaatgcaatcacattgcctaccctctcagctgaggatgatgcaaacaatgctaacaaccgcaccaagaatgaggtttctaatggaacttccaagggaaagagcttctggggtgctgttagtttgatcattggcactgctgtgggtcctggaatgctggctttgcctgctttgactgttaaatctggtccatttccttcatcaatcataatacttgcttcatggctctatgtcatttcctcaatcattattgttgctgaactttgctttgaatccatggaacaagatggggttgaagaaatgagcttcacaagccttcaacaaagacattag

SEQ ID NO: 11820 - DNA, 372 bp, Glycine max
  Peptide Sequence Number=SeqID_128598
atgggtagtatcactacacttttgctgttatgtttggctttgattagcatagcaattgaagccattgatgtttcctacgatggaagggccataacaattgatggcaagagaaaaatcttattctctggctctattcattatccacgtagtactgctgaaatgtggccatctttgattgagaaatcaaaagaaggtggacttgatgtcattgagacatatgttttttggaatgttcatgagcctcaccctggccagtatgatttttctggaaatttagatcttgtgaggttcattaaaaccattcagaatcaaggactttatgccgtgcttcgaattggtccatatgtatgtgcagaatggaactatgggtaa

SEQ ID NO: 11821 - DNA, 393 bp, Glycine max
  Peptide Sequence Number=SeqID_128599
atggttttctatatggctgttgagcattttctgatccacaaaaggaaggctcgtagtttgtccgtggtgatgaaagacatcaaggttttctatatggcttctgagcattttctgatccacgtacaaaaggaaggctcaaagtcacccagtggcatacgaagcgggcggcaggaaattaagcaagttgtacatcttgccaaggttgttctagagagggacgcttgtcaacagtataaaatgtttaaagcagaatgtatttaccaaactgaaaagcttacctcgatggccttcatcaaccaagagaaattcccaaggaactccggcaaagaagaagaatcagcaagaatcattcttgatttttgttgttgtgattataaaccatgggacctttag

SEQ ID NO: 11822 - DNA, 868 bp, Glycine max
  Peptide Sequence Number=SeqID_128600
gggatttccggtgtggttacataatatacctaacatcgaatttaggacaaacaatgctatttttgaggatgagatgaaaaaattcactacactcatagtggacatgatgcgacatgagaagctctttgcatcacaaggaggacccattattcttgctcagattgaaaatgagtatggaaatattatgggctcatatggtcaaaatggaaaagagtatgttcaatggtgtgctcaactagctcaatcttatcaaattggtgtgccttggatcatgtgtcaacaaagtgatgctccagatcctttgattaacacatgtaatggtttctactgcgaccaatggcatcctaatagcaacaacaaacctaagatgtggaccgaggattggactggctggttcatgcattggggaggaccaactccacatagaactgctgaggacgttgcttttgctgttgggagattttttcaatatggtggcacatttcaaaattactatatgtaccatggaggtaccaattttggacgaacctcaggaggaccatatatcactacctcatatgactatgatgctcctttgaatgaatacggtgatttaaatcaacctaaatggggacatctgaaacgacttcacgaggttttgaaatcagttgaaacaaccttaactatgggttcctccagaaatattgactacggaaatcagatgacggccacaatttttagttatgctggacaatcagtttgtttccttggaaatgcacatccatcaatggatgccaatattaactttcaaaacactcaatacactattcctgcatggtctgtgtccatccttccagattgttatactgaagtctacaacactgcaaag

SEQ ID NO: 11823 - DNA, 201 bp, Glycine max
  Peptide Sequence Number=SeqID_128601
atggagaaacttagtgaggaagccatggacgccaaatcagagctttccaatcatcacacaatacctaagaaagagtcacacaacaatgatttgaatcccccttcagaaggtcaaaatttcttttgttgtagccttattagcacaatatcagaagtccctaacaatgtgaacatcgagggcgggtgcattatgacgttttga

SEQ ID NO: 11824 - DNA, 1203 bp, Glycine max
  Peptide Sequence Number=SeqID_128602
atgaccattaataatgaaaattcatatgcattggattggcaatggatgcctgagacgcatttggagcaaatgaaagatggcaaagttcttggatctgttgctataactgctcctcggcttttggatcaaaaggtggcaaatgatacaagtgattacttatggtacatcaccagtgttgacgtcaaacaaggcgaccccattttgtcccatgatcttaagataagagtaaacaccaaaggacatgtacttcatgtgtttgttaatggagcacatattggttcccaatatgctacctatggaaagtacacgttcacttttgaggcagacatcaaattgaaacttgggaaaaatgagatatctttagttagtggcaccgttggtttaccaaactatggtgcctactttgacaatatacacgttggtgttactggcgttcaattggtgtcacaaaatgatggcagtgaggtgaccaaagatatctccacaaacgtgtggcattataaggttggaatgcacggtgagaacgtgaagctatattcccctagcagaagcactgaagaatggtttacaaatggtcttcaagcacataaaatattcatgtggtacaagactacattcagaactcccgtaggaactgattcagttgtgctagatttgaaaggtttgggaaagggtcaagcttgggtaaatggtgaagatggttgtagttcaacatgtgattaccgtggaacatataggtcaaacaaatgcacaacgaattgtggaaatcccactcaaagatggtaccatgtcccagactcatttcttcgtgatggtctggataacacattggtggtgtttgaagagcaaggaggtaacccctttcaagttaaaattgccacggtaactattgcaaaagcatgtgcaaaggcctatgaaggacatgaattggaattagcatgcaaggagaaccaagtcatatctgaaattaaatttgctagctttggtgtgcctgagggtgaatgtggatcctttaagaagggtcattgcgaatctagtgatactttatctattgtgaaacggctatgtcttggcaagcagcaatgttctattcaagttaatgagaaaatgcttggacctactggatgcagagtcccagagaacaggcttgcgatcgatgcactttgtcaaacaacagtctccaatgagaggaggaagtactag

SEQ ID NO: 11825 - DNA, 180 bp, Glycine max
  Peptide Sequence Number=SeqID_128603
atgaagtcaggtgacacgcgggattaccttatggtttttactcttgtcgtccggaaacattcaagcccaacgacgcgtgagattcttctctactgggcagggacgatcgagtgcaatggcgtaggttctgctggtggggatattgaccggccgaatgatgttccgctcgaacgaaattag

SEQ ID NO: 11826 - DNA, 417 bp, Glycine max
  Peptide Sequence Number=SeqID_128604
tgggcggtaaagttgctttgttacctattccgttaggaactgcggattttttggtccatcatattcatgcatttacaattcatgtaacagtattgatactcctaaagggtgttctatttgctcgtagttcacgattaataccggataaagcaaatctaggttttcgttttccttgtgatggacctggaagaggggggacatgccaatcagatgtttggggtagtataagtgatcaagggatagtaaatcatatcacaggaggaaattttgcgcagagttccattaccattaatgggtggctccgtgatttcttatgggcacaggcatcccaggatcctttacatgtaagacctatagctcatgcaatttgggatcctcattttggtcaaccggctgtagaagcttttactcgaggag

SEQ ID NO: 11827 - DNA, 1240 bp, Glycine max
  Peptide Sequence Number=SeqID_128605
attatttgatgatggagagccggttgtggttaacaaaggagatgatcatgatcatgatcacgagcctttggatttgcctccaggtttcaggttccaccccacagatgaagagatcatcacttgttacctcacagagaaagtcctcaatagaaccttcagtgcaactgctattggagaagctgatttcaacaagtgtgagccttgggacttgcccaagaaagcaaagatgggggagaaagattggtacttcttttgccaaagggataggaagtatccaacaggcatgagaaccaatagagcaacccaatctgggtattggaaggccactggcaaagacaaagagattttcaaagggaagaacaaccttgttgggatgaagaagacccttgttttctatagaggaagagctcctaagggtgagaagtcaaattgggttatgcatgaattcagattggatggcaaattcgcatgttacaaccttcccaaggcttcaaaggatgaatgggttgtgtgcaaggttttccacaagggcaacaccactactacagatgttgttaacaaaagggcactcccaataattaacccttgccttttgagaatgaactcatcaattggagaagatctatttgatttctcttctctcccacctctcgtggatcctctctttgaccaaacctcaaacaagcacattgacaatgatttcaagggtactaataacacgccttcatcttcatcagctaaaccaccatcaagtggctactatcttcccaacttcatcaacaacaacaacaatcagcacatgctaatgatgatgaagccagaagaacacaaaatgtatgagattcccaccaacaactatgcctccaccagccaagtgaatttcactactactaataacccaataatgggaattagcacaggcaataacaatacccttctttctcagcctcaaattcgaacccaaaattcaacctcagtacccttcaacatgttccaagattattataattatatgaaccaaggaaaacaatgcaagatggagcaattctcaaacactaagaaccagcctgtggtcagtgcctctcaagacacgtgcctcagcaatgacacttcctcggtggtttctaagcaagacaacaacataggaaggaacaaggcattgtacgaggataattttgaagctccttcatcagttgctactaccctctcagatttggaatgcctgtgggatgattactga

SEQ ID NO: 11828 - DNA, 138 bp, Glycine max
  Peptide Sequence Number=SeqID_128606
atggggcaagtcacattgcccctattcccttgttattggcacccaaaaggacatcatgtagaggttaaaatgagtgcccaaattaaggacttagacctaggaatccaagcctttggttttgagtgcaagaaagcataa

SEQ ID NO: 11829 - DNA, 402 bp, Glycine max
  Peptide Sequence Number=SeqID_128607
atggctacgcaaaccgttgaggataattctagatctggtccaagacgaactgttgtaggcgagttgaacgaagggcctagggaagtcggggctgagcaacctttctctagctttttcaaatatcgatgcaccggctattccccatcatgtgcagctcctaggatcacagcttttattgcatcaacagctgattcaattgctagtcctccaacaccgcttacggatgaagttccgcttgcattctcttctttttctttaactatgtcatatgctttcacaaaaggaaagaaagctgggcagaaaatggtcgcttggaactccactctcactatgggacagattcccattggcactgacccagaagaaccacatctgtctcaagctcaagccgacccaacctga

SEQ ID NO: 11830 - DNA, 351 bp, Glycine max
  Peptide Sequence Number=SeqID_128608
atgcaatggcttgttggagattgctggttcggagaaattgaggttggggaggagagtggtggcgatggtgttgttgtggcgatcttcggagatgattttgaggaggtagaagagggcccattttttgttgacactttgggctttggaggagaatttggagaagaggtcagcgaaggagagggcttaggaggagtggctgtgggaggcgaggcggcgcttgatggagtcggcgatggtgacggcgtcgtgggcaacggagggggtgaggcgacgggagaggatgtggagggcgtagcagaagccccattgcccctgcaatgcgagttcctcctccatctcccaaagttttga

SEQ ID NO: 11831 - DNA, 2487 bp, Glycine max
  Peptide Sequence Number=SeqID_128609
atgggtagtatcactacacttttgctgttatgttcggctttgattagcatagcaattgaagccattgatgtttcctacgatggaagggccataacaattgatggcaagagaaaaatcttattctctggctctattcattatccacgtagtactgctgaaatgtggccatctttgattgagaaatcaaaagaaggtggacttgatgtcattgagacatatgttttttggaatgttcatgagcctcaccctggccagtatgatttttctggaaatttagatcttgtgaggttcattaaaaccattcagaatcaaggacttcatgccgtgcttcgaattggtccatatgtatgtgcagaatggaactatgggggatttccggtgtggttacataatatacctaacatcgaatttaggacaaacaatgctatttttgaggatgagatgaaaaaattcactacactcatagtggacatgatgcgacatgagaagctctttgcatcacaaggaggacccattattcttgctcagattgaaaatgagtatggaaatattatgggctcatatggtcaaaatggaaaagagtatgttcaatggtgtgctcaactagctcaatcttatcaaattggtgtgccttggatcatgtgtcaacaaagtgatactccagatcctttgattaacacatgtaatggtttctactgcgaccaatggcatcctaatagcaacaacaaacctaagatgtggaccgaggattggactggctggttcatgcattggggaggaccaactccacatagaactgctgaggacgttgcttttgctgttgggagattttttcaatatggtggcacattccaaaattactatatgtaccatggaggtaccaattttggacgaacctcaggaggaccatatatcactacctcatatgactatgatgctcctttgaatgaatacggtgatttaaatcaacctaaatggggacatctgaaacgacttcatgaggttttgaaatcagttgaaacaaccttaactatgggttcctccagaaatattgactacggaaatcagatgacggccacaatttttagttatgctggacaatcagtttgtttccttggaaatgcacatccatcaatggatgccaatattaactttcaaaacactcaatacactattcctgcatggtctgtgtccatccttccagattgttatactgaagtctacaacactgcaaaggctacccgtccaatgctacatgttaaggtcaatgctcaaacatccataatgaccattaataatgaaaattcatatgcattggattggcaatggatgcctgagacgcatttggagcaaatgaaagatggcaaagtccttggatctgttgctataactgctcctcgacttttggatcaaaaggtggcaaatgatacaagtgattacttatggtacatcaccagtgttgacgtcaaacaaggcgaccccattttgtcccatgatcttaagataagagtaaacaccaaagggcatgtacttcatgtgtttgttaatggagcacatattggttcccaatatgctacctatggaaagtacccgttcacttttgaggcagacatcaaattgaaacttgggaaaaatgagatatctttagttagtggcaccgttggtttaccaaactatggtgcctactttgacaatatacatgttggtgttactggcgttcaattggtgtcacaaaatgatggcagtgaggtgaccaaagatatctccacaaacgtgtggcattataaggttggaatgcacggtgagaacgtgaagctatattcccctagtagaagcagtgaagaatggtttacaaatggtcttcaagcacataaaatattcatgtggtacaagactacattcagaactcccgtaggaactgattcagttgtgctagatttgaaaggtttgggaaagggtcaagcttgggtaaatggtgaagatggttgtagttcaacatgtgattaccgtggaacatataggtcaaacaaatgcacgacaaattgtggaaatcccactcaaagatggtaccatgtcccagactcatttcttcgtgatggtctggataacacattggtggtgtttgaagagcaaggaggtaacccctttcaagttaaaattgccactgtaactattgcaaaagcatgtgcaaaggcctatgaaggacatgaattggaattagcatgcaaggagaaccaagtcatatctgaaattagatttgctagctttggtgtgcctgagggtgaatgtggatcctttaagaagggtcattgcgaatctagtgatactttatctattgtgaaacggctttgtcttggcaagcagcaatgttctattcatgttaatgagaaaatgcttggacctactggatgcagagtcccagagaacaggcttgcgatcgatgcactttgtcaaacaacggtctccaatgagaggaggaagtactag

SEQ ID NO: 11832 - DNA, 1641 bp, Glycine max
  Peptide Sequence Number=SeqID_128610
atgtcatggactaaaatacccttactcaggaatgatagccgtggtatattctcacttgtggagctgaacaccgtagctaaatggtttaggtttagccccaccccaaaatgctgccagtatgagcatagtactctccaaatctatggagatggtggaagtcttgcgtgcatgagcttgggcccctcctgcgggtgcgaaaatgggtcatatgctttcatcggtgtcaacattggtacagatgccaccaacatgccaagtccaacagaggttgttgcccttcttaaggctcaaggtatccaacatgttagactctacgatgccgacagagccatgcttcgcactcttgccaacacaggaatccgtgtaattgtttctgttcccaatgatcagatactcggcattggtcagtccaatgccacggctgcaaattgggttgcacgcaatgtcatagctcatgttcctgctaccaacatcactgccatagctgttggttccgaagtcctaacttccctcccaaatgcagctcctgtcctagtctcagcactaaaattcattcaagctgcactagtcgcagccaatctcgaccagcaaatcaaagtctctactccacactcttcttctgtcatccttgactctttcccaccttctcaggcatttttcaataaaacatgggaccctgttatggttcccttgctcaattttttgcaatcaacaggttcatatcttatgctcaatgtgtacccttattatgattacatgcaaaccaatggtgtagtccctctagactatgctttgttccggcccttgcctccgaataaggaagctattgattccaacaccctcctgcattatactaatgtctttgatgcaattgttgatgctgcttattttgcaatgtcatatttgaagtttaccaacattcctattttagtcaccgagtcaggatggccctccaaaggcgactcgtctgagccggatgcaaccgttgataatgctaacacttacaatagtaacttgatcagacatgtccttaacaatagtgggactcctaagcaacctggaattgcagttagcacttatatttatgagctttataatgaagacttgagatcaggaccagtgtctgaaaataattgggggctgttttatgctaatggagctccagtttataccttacacttgaccaattctggtactgtatttgcaaatgacacaacaaaccaaaccttttgtgttgccaagagtaacgccgatacaaagatgcttcaggcagcgctcgactgggcttgtggaccggggaaggtggattgttcgcctttgctgcagggtcaaccttgttatgaaccaaatagtgtagcttcacatgctacatatgctatcaatgcatattatcagcagatggctaaatctgctgggacctgtgatttcaaaggagttgcctctgtcaccactacaaacccgagtcatggttcctgtatatttccaggaagtggtggtaaaaatgttaccagcgtaaatggcacagcattggctccatctaccaattccacaaattcagggtgcttgacacaatattacaatggtggattttttacaagctctgtgattcttactttaatattgagtgtagttgtcttgtaa

SEQ ID NO: 11833 - DNA, 237 bp, Glycine max
  Peptide Sequence Number=SeqID_128611
atgcaacgtttatattcaatctctctctcaaattgttgcagcaagaagatgatcaaaagagcgcagtgccgactccgacatcttaagagcaagagggaggtgatggcaatgcaaattggcaaagacttgtctgagttaatacagaatggtcatcaagaaacagctattatgagagtacgaagatatatatgctttgttatttttgttggaaccaactatgaaatgtctaaaccctaa

SEQ ID NO: 11834 - DNA, 297 bp, Glycine max
  Peptide Sequence Number=SeqID_128612
atggtccaatggttcaacagctgtcttgaagagaaggatataaaccttatcaatggaaaagtacaaaaagccaccaacagaatgtgtaacataggaaccaaagctagtacccacaatgcagtgccaagctggaccataagaagaatcaaattcctattttatccatacttgaatgttgaatccatggagagtcacaaaagaaaagtcatgcaaagagagtggggggagccttatgcattggtgcaccctttaaacatgtatagtgggcagcggcttagcgaggagagcggtttctga

SEQ ID NO: 11835 - DNA, 813 bp, Glycine max
  Peptide Sequence Number=SeqID_128613
atgcaaaaatgtgataattcactctctgtagctgtagctgtggagctatttcctagtaatcttgtatacaaaaagaaatacaaagtggttgatgaaattgctagcgacaattgcctccaacaagaggtgaaagaacatatagggaatcaattagtggaaagtgatggcgaaacgaatcacacaattgcagaatatacctcaactgaaaattctgcattggtgtatagtgtccagcaatatcccccgtgtggtgaagaaatggagaaagaagactttcctgatttgcaaaacaagggagaaacaatggctttgggaccttcatcagaaggagttagtttgcttccatatgctgaagcaatggtagagtactatgttgaagagattgaagaatctgagaattttgaatcaaaagatggtcaggaagaatcagcaagtgagaggtcaagcataagggttggcttaagaaagagcaaaggggcacctaagaaaagattgaaaaggagatcaagtttacttgaaagacaaggcacaacagaaaatggatgtataatatattatcaacagccatgcaagagtccctctactcagaactatgctgatctgccttgttattgttgctttagctacgataaaaaatgttattcaagagccttgactatgaccacggagcagcccaaaaactacaaagacgagttgttaaggacatattcacgttcttctccacatcctaagcatgttcatcctaagttaccacagtgtgaggacatagttgctatctttacggctctcaagagagagagaggtagaggctag

SEQ ID NO: 11836 - DNA, 885 bp, Glycine max
  Peptide Sequence Number=SeqID_128614
atgtatggcataactaaggatgaagaggggaactatgtcactgacccgaatgagattgaagggatgataacaaatttttacaagaacagtaagattcttagggaggcaccagatatagtttccaagcagttttcttctagaagtattgagttgtggttggtgatgacctctgcaagaaagatgaggaaccagacctttatcactctcattcccaagaaagatgaggttttatggaatgggaaagccttggaagattttgctccctctagagagttgagtcacgaaacatggaatcctatttctttgagtaaacatgactctcccacttcttatttggcgtttgcagatggtcttattctttttgcggaagctttgttggaacagtgtcagtttatgaggatattgacaaagcttgcaggagatttacatggggagattcaactaaagcaaggagaatccatcttgttgcttggaatactgtgtccactcccaactaaagctaggagaatccatcttcttaaggttcgttctagctcgggtcttgaggaaacctattggataatgccaaaggagggaccagtcgcactaaattgtgatgcatcaatggtccagtttggtgaagttatggactgcggaggagttattcacaatcatgcaggaagctctgtttgtgattttcaagctcagttgagaggagattctatcctatatgggaaacttaaggctattcttcatggcatcaagcttgctaaggctattaaagcactagagggtaattgtgatcatcttcatcctcattaccagtcaattcaagagattcatttggtgcatgggagatcagagggtggaccgatagttcctgtgactgctcttaggggcttttaa

SEQ ID NO: 11837 - DNA, 336 bp, Glycine max
  Peptide Sequence Number=SeqID_128615
atggaagaagcagagaaggagttagagagaaggagcaagtttctgaacagtttgatacaacagaagaagaaagccgccatagagtcagagcatgaacatgagagtagtctcaaggttgatgtcagagcttgtgacatgcccctccctttgcagaaccgtgccttccaatgcgcacgtctctacttggagtctatgccacctgccaacaagcttgacagtaaacgccttgcacttgcccttaagaaggacaaattagatgtttttcctttggtgcttttagtacgtactgttgtcgaatcagaattggagtttcacccagataacttatgctattga

SEQ ID NO: 11838 - DNA, 186 bp, Glycine max
  Peptide Sequence Number=SeqID_128616
atggataaccacttgggtatctctgcctgccacctaacttcacgggttaggattaagcagaaatcgtttgtgccgataaccacttggcctgacttcacgggtcaggatgacaaaggtgcagatgacgacgatgcagaagacgacgttagtctctacatgctaccagactctgagtctgacgaatag

SEQ ID NO: 11839 - DNA, 592 bp, Glycine max
  Peptide Sequence Number=SeqID_128617
atgaacgaatctcaaaacgccattccccatttatttagatgccccatcagtttagacttgtttgaagatcctgtaactttatgcactggccaaacctacgacagatcaaacatagaaaaatggcttgctcagggtaacctcacatgtcctgtcacaatgcaaaagcttcatgatccatccattgttcccaaccacactctccgccacttgatcgatcagtggcttcaacttgatccccaattcgaccctgctaaccctgaagcttcaactattgaatccttagcttctctgaaactcaaccttgaatcctatgaaagcagcttagaaaacaagctccaagcacttaggaaaatcagtgtcttatctgatgagtattgctccttcaacaaatcatgcttcctccaattggatttcctaccactgcttttggaactagtttttggaactcaagtgtcaccagaaaatgacatgaacttcatagagcttgcactttgttgcattaaaaaattgctaccacttggtagtttggagcctctaaatatgatcaaagatgggtctaaattagcgacgtttgtgctactatttgaaaagg

SEQ ID NO: 11840 - DNA, 549 bp, Glycine max
  Peptide Sequence Number=SeqID_128618
atggtaccaagcatcagattttgggttcatgcagagggctcatacttttgcacaacaagacgagagtattattttctatatggttttgggtatgacccatccacagatgactacttaatagttcttgttggatttttggatgaattcgatgaagagccttatggtgtgcctaatgtccacattttctccttcaaaaccaattcgtgggaagaagatagtgtccgtgttccaaatgagattttccacggtaaattcagatcagggtctctcttgaatgagactcttcattgtgtttgctgctcagtcatcatagactgtgcgaagactgaaatatgggtgatgaaagaatataaagtgcagtcgtcctggactaggatcattgatatccctgcttatggcatttccctgatatgcaccaccaaagatggtggaatgtatgtatcacaaaaccgtccattacggaaaattaatcgcaacggagagccgcctgagtgcctcgcattcgatggagatagaggattgttctgtgccaatctaccatctgggtag

SEQ ID NO: 11841 - DNA, 402 bp, Glycine max
  Peptide Sequence Number=SeqID_128619
atggataaccatgagcatgcaaatcatcgtgatacggcacaagccaggataaagaataaaggtatcaggcaacacaaagttaatgatcaggctcagaatattgatttcaatattcgtgattcatcagaggatgacagttctaaatcaacacaagtttcttcacctgagaaccaaaattatatgtcctcagctaatgagcccgcaattaatagagaaggatattttgatcttggtgatcaactcatgcagtgtagtcactgtaatgcaaatatgtggtatgatgaaagagtctcaaaagataaaagaactacaaatccaagattcagtttatgttgtggaaatggcaaggttgaacttccattgttacagaatccacctaaatatctctaccaacttttgtaa

SEQ ID NO: 11842 - DNA, 138 bp, Glycine max
  Peptide Sequence Number=SeqID_128620
atgtctcaaagttataaaaaaacaaaagtaacaagctttggcactgatgcatccattttgctcatgcttaacgaggtagccaacaacctatcaaaaatgtatgtcgggaagggaatcaggaacgggcagctagattag

SEQ ID NO: 11843 - DNA, 339 bp, Glycine max
  Peptide Sequence Number=SeqID_128621
atgaagaaagagtcattttgggtgatggtcaacaccacaccgacttggcatagggcaggtgctaggcctatgatcagatcaatcaccacccagcatccaactaaagatgttaaagaagcactcctaggaggcagcctaatctggataacacttctccacagcaacatccttgccagcaatcataattctgatctcccgctgccaaaatgccagctggtctatgttatcctgacccaggcacaacagttggggcaagaccagcagcagcagcagctggccacagacgcaccactgtcacctctacagcaaccaccatctcggctcacatgtaaaggatga

SEQ ID NO: 11844 - DNA, 258 bp, Glycine max
  Peptide Sequence Number=SeqID_128622
atgtggaagcttgagaagaatggcgagagtgtctatgcagggacttgggtgcatgggcatgtcgatcattcttctatgttcctcctaagcctgaaccctgatatgattgatcttatccaccaagcagtcgaatgcggtgtcacatttcttgacacctctgacatctatggccctcataccaacgaagtccttctaggaaagtctggaatcctgcctaggttagctttgctattcttagccggtcccaagcctggataa

SEQ ID NO: 11845 - DNA, 371 bp, Glycine max
  Peptide Sequence Number=SeqID_128623
gcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttaattag

SEQ ID NO: 11846 - DNA, 627 bp, Glycine max
  Peptide Sequence Number=SeqID_128624
atgatacactcgtgcctcacgtacaaccctggtcctgaatttctcaaaaacagcattcgtgtgaagccagatttagatggtcttggtgccctgggtgacactggttggtattgcataagagccattttatgggctgtgaactatgaacttccaaaatcagtgcttgcattcccaggagcaattctcaatgaagaaggtgtaataatctcttgtggctcttctatgcattgggaagatggaagatctgccacgttccactgttctttcttatcctatgtaacttttgatgtaacggttttgggaacaaaagggtgtcttcgtctcaatgattttgctcttccatttgaggaaagtttagggtttgggaaatttttggaggcctcagagttggattatgggaagattgaacagggaatgtggtgtccaaagccaaatgagcatgttgttgagactgggttttctcaagatattttgatggttaaggagtttgctgatttggttcgaaaggttcaggggtgtgaaatgaagcctgagaagacttggccagttttgagtaggaagactcaggtagttttggatgcagtgaaagaatccattgagaaaggttaccagcctgttgaattgtga

SEQ ID NO: 11847 - DNA, 294 bp, Glycine max
  Peptide Sequence Number=SeqID_128625
atgaggaacagtatggatactaataggaaggaagtcacctcacagtttgcggagtttcgatcctatgaaggccaggttatgtatgttggggagaagattgttccgatcaaggacttggacaactttgagagtgatcatgaagagtttgccaaaatctctacaaggacacgagcattgaatatcccgaggttggagaaaattttcgtgttctacatgtctttcttttcatcttgcgccattgattctctgaatttttcttgcaattcttcattcgcgatctctgcgactctttga

SEQ ID NO: 11848 - DNA, 126 bp, Glycine max
  Peptide Sequence Number=SeqID_128626
atggtgacagtcaataacgacagtggtaaggatggtaatcataatgataactataacgatgttcatgacaacaacaaaagtgatgacaatgggaagtacataaaaaagataagggggctaggataa

SEQ ID NO: 11849 - DNA, 171 bp, Glycine max
  Peptide Sequence Number=SeqID_128627
atgaggaccagatttttctttctttcttttgggggggggttggtcttgtgggttttgtggtactgtgggagtctgattgcgttgcgtaaggttatgacttatgaggttgctatgaagattggaagaggagtaggagtggttgttgctaacaatattgatggaactaaatag

SEQ ID NO: 11850 - DNA, 1080 bp, Glycine max
  Peptide Sequence Number=SeqID_128628
atggtggagaaccaaattccaacctacatgttgttgaggatcttggtgcttcaaagctccaaacctattgattcagttcaagagtatttgggttcaatgctcttgtcattctgtgaaaaacactctccactcaagttaactcacacccccacatgttctgaagctgtcaccaagcattatcatatcttggatctcatgtatcatttggttgtctctgaacatgaaaaactagaaacaccaacacctgagagcgaaggtatgtgcaaacccaatagcaattgctctaacactcctacaagaagctcaaaatctgaaggcatagtcacattcttaaataaagttaaaggtctattaacatggacacttgccacgctcaaaaggctaaaggtcacgaacattcctcttccacaacccgttaaacgacccttagatgcaatactcaacatgccaacaacttttcaaaagttttcatcatcagaaacacctccttctgaaacagaagctcctgctgtggttgttaccttcccttctgtgcgtgagcttcactcagttggtatccattttcaaccctcgaaaggtggcatcacgaccattgaattcgacgagaaaaaaggcatattttaccttcctgtgctgaaattggatgtcaactctgaagtgataatgagaaaccttgtggctcacgaggccttgagcaaaccagattttcttatcttcacaaggtacacagaattgatgaggggaatcatagacactgtggaggatgtgaagctgctcaagaatgaagggatcctagagtcaagtagctctctcagtgtggaagagactgaggagcttttcaatggaatgagcaaatctattggacctaccaagactgagaagttggatgagaccgttaaaaaggttaacaagtacttccgtgataagcagaaggccaaaccctacaggatcttaaacaattatgtgtactcttcgtggaggttcttgacacttcttgccacctttgtgctcttggccatgacaattcttcagtcattttgctctgtttatgattgtccaagtcattttagaaacagataa

SEQ ID NO: 11851 - DNA, 1182 bp, Glycine max
  Peptide Sequence Number=SeqID_128629
atgcctgtttgcatataccaagtccctaaatcattatgttgtgccaagccagaagccttttccccacaacttatagccattggtccatatactcactttcaccctgagctctatcccatggaaaggttcaaagtttttgcagccaaaggggtcctagatcacttcgaaaaacatgacttcaagcaacttgttgagctactccgcaacacagggcaattcatccgtgctagttaccacaaatacttggatttcaaggaagataccttgttatacgtcatagcaattgatggtttgttcttattggatttcttccacaattatctcaacgaggaagtgtcttgttctttcatgacaggactacaagaccaagttcagctaagtggtgtgaagctaaccagggatgccatcataagggacatcatcatggtggagaaccaaattccaacctacatgttgttgaggatcttggtgcttgaaagctccaaacctgctgactcagttctagagtatttgggttcgatgctcttgtcattctgcaagaaacactctccactcaagctaactcacatccccacatgttctgaggctgtctctaagcattaccatatcttggatctcatgtaccatttggtggtgtctcacactgaaaagtctgaaacaccaacacctgatcaaagcgaaggctctgtaaaaaagcttaaggacgtgaatattccactattgaagcccattaaacgacacatagatacaatactcaaaatgtcctctcacctagaaagtctttcatcaaatccaaagctttcagaagaagaagaagaggctcttgaggttgtcaacatcccttgtgtgcgtgagcttcactcagttggagtctattttcaacccgtggaaggtggcaacatggccatcgaattcgacgaaaagaagggaatattttacctccctgtgctcaaattggatctgaactcagaagtgataatgagaaaccttgtggctcacgaggccttgacaaaaccagattttctaatcttcacaaggtacactgagttgatgaggggaatcatagacactgttgaggatgtgaagcttctcaagaatgcagggatcatagagtcaaatagctctctcggtgtggaagaaactgaggaacttttcaatggaatgacaaatgttactgggtag

SEQ ID NO: 11852 - DNA, 249 bp, Glycine max
  Peptide Sequence Number=SeqID_128630
atggctataagttgtggagaaaaggcttctggcttgacacaactcaatgatttagggacttggtatatgcaaacaggcattttgttcaagattgagaggttggtttcactcaccaattggttgatttggatgacccaagagtcttcatcagattctgaattgaagattgttagagaggccatatatgaaggtggttatatagatgaagaactgtatatgaatgattgctacagtcacggccttcagtaa

SEQ ID NO: 11853 - DNA, 581 bp, Glycine max
  Peptide Sequence Number=SeqID_128631
atgatggacttttctcgtgtcttttatttccttttggtggttctttggccagaatgtggttggcagccagtgtctctgacagatatgattacctcttctgcagttaaaaaagtgtatagaaaagcaaatttatgtattcacccagataaagttcaacagaaaggtgctactcttgaacagaaatacacagcggagaaggtttttgacattcttaaggtcaatgtacaaattttaaatgttcatgattccctaaggtcgaacaaggataatgatgagcatcttgaaaggaagattctagatcctgagcacttgagcaaggtggaatcaattttcggcaatctttcagaaaccattaaaatatatggtccttggtcttctgcatgggtaggagaagctggaggggcatacaacagtggtggcaatcatgtttctaacagatttctaaacagcttttggtacttagatcaacttggaatagcatcctgctacagcactaaagtctattgcaggcagactttaattggagggaactatggccttctcaataccaccacctttgctcccaatcctgactactacag

SEQ ID NO: 11854 - DNA, 183 bp, Glycine max
  Peptide Sequence Number=SeqID_128632
atgggcaagggaaaggagaagaagagcaaaataaaggaactaagcataatcctcgaggtaggccggcctcttggtgctacgcttgggtctactctcttgttggttgcagtcatgattaacataaacagttcatttgaaagaccaagtgtggaaattctaactgtccaagtggcaatcgtttga

SEQ ID NO: 11855 - DNA, 219 bp, Glycine max
  Peptide Sequence Number=SeqID_128633
atggagttccacaaaaaaacatttgaaggacaactcagggatgttgacgaagttgggaaatattgcttgaaaaggagagagctggaaaacacatcaacctcagaagagttgaaagcttcagaaccaatggtggagactcaacagggggatagagaaaaaagaatagcaaaaatggaatcggaggaagacaagcatcatggtggtagtgggtgcacctag

SEQ ID NO: 11856 - DNA, 186 bp, Glycine max
  Peptide Sequence Number=SeqID_128634
atggttgtgattgcagcacttgacataatagttggcttctcttcaagtgcaaccacaacaccatatcattgttgggaagcaggatttgaggttgatatgccttgttttgacgttggcagtgaacctatttacgagactgatgatgagtttgatgattttaatgaaaaccttgatgatcattgctag

SEQ ID NO: 11857 - DNA, 384 bp, Glycine max
  Peptide Sequence Number=SeqID_128635
atggccaaaggaaagcattcgtatacccgagcacaggggaagaagtggtcaacattctcgctggttctatgggcacttttcttcctcacacttatcctcgtcctgctccttgctctcggcattgtttatcttccaactactgacgatgattttccaaccccggatctcagcgtcttcaggcgcaagacctctcaaagtggcgagagtttggtggaaaactcggagcaacggaccaagattctctcttgggagccaagagcgttcatctatcacaattttctgcgagcgtccgctaagcgcaacactcatgggctaagcgcgaggaagactctggaagaagatgagctttacaggctcgctaagagcaccgcttcatctcactaa

SEQ ID NO: 11858 - DNA, 231 bp, Glycine max
  Peptide Sequence Number=SeqID_128636
atggatcaagatcacatggttgcgattgcagcacttgacacaatagttggcttctcttcaagtgcaaccaaaacaccatctctcattctccaaaagatggtttgcatcatactggtatttttaaccttcccgtgcatgattgtcgattctaggacagacctttatgaggaagtagggaatgatgtagaaagagggtgcaaccatgggctaaaaaggatgtcagggctctag

SEQ ID NO: 11859 - DNA, 164 bp, Glycine max
  Peptide Sequence Number=SeqID_128637
gagatgatagtgcacttggagggaaagtacggtgcgggggagcatatcgaaatgatgtcagattgagagtcacaagtgaggttcatggagtcgaagttgttgatggtgcggacgatggtttgaaggagcgtggtgatgagtttgccagaggggggagggcatga

SEQ ID NO: 11860 - DNA, 129 bp, Glycine max
  Peptide Sequence Number=SeqID_128638
atgaagcatatcaaccttggatcccacttcctagcaatgatcatcaaggttcactgccgatgtcaaaacaaggcatatcgacctcaaatcctgcttcccgacaatgttgtagttgagggaatacattaa

SEQ ID NO: 11861 - DNA, 261 bp, Glycine max
  Peptide Sequence Number=SeqID_128639
atgagattttggattgtttctaaacgaccatttagaggaaacactgggtctaacaaagataggagaaaatcactcaaagtgtatcaatctcacacagggcaaggattgacattctcaccctgggtcaaggtttatgataagttgggattttggctcaaggcttgtagaacggctggtcatgatatatgtcagggtttggccagcggttcggggataaaggggatgtcctacattatttccatgatacacatgcaacaatga

SEQ ID NO: 11862 - DNA, 987 bp, Glycine max
  Peptide Sequence Number=SeqID_128640
atgaccatcacgctgagcaaagatcagaccagcctgacggacattaaagatgcgattaacaaacagcagggcagcgttaccgccagtatcatcaaatccgatgacaatacctattatctggcgctgacctcgcgtgataccggcaccaccaacgagatgacggtttctaccgatgacagcgccctggcgcagtacattggttttactaaaggtggcagcagcaatggcatgacagagcaggtaaccgctgccgacgccaaactgagcatcaacggcgtcgccatcacccgcagcagcaacaccattactgatgcgccggaaggcgtcacgctgaacctgaccaaaaccaataccggcagcccggagaccttatcagtcaccaaggataatgcgccgatgatcgctgcggtgcaggcctatgttgatgcgtataactcgctgcaaaccaccattagtaaccagacgaagtacactgccgtagatcagggcagtacgtcccaggataccagtaatggcgatctgctgggcgacggcacgctgcgtaacattcagaccagcctgcgctccaagctgtccaccagtgcccaaagcggcggcagtatttcactgctttctcagattggtatcactcaggatattaacggcaagctgaccgtcgacagcaccaaactgaataaagcgctggatgaaaaatccgcagatgtcgtgacgttcctgtcaggtgacggtaaaacgactggcttcgcaacgcagaccagtaactatctcgatcagatcctgggcactgatggttcagtccaaaacgccacagacggtatcaacaagacactgaagaaattgtctgatgattacgaccgggtgaatgctcagattaccgccaccatggcacgctacaaaacccagttcacgaatctgaatacgctggtctcatccatgacgcaaacccagaactatctgacgcagcagtttgcggcgatgagcagttaa

SEQ ID NO: 11863 - DNA, 158 bp, Glycine max
  Peptide Sequence Number=SeqID_128641
atggtgatagtgcgcgaggcgaggctggaatcgcctaaatcgccatctttactggttgcacttttggacagcagcgactgcgctttagccagttgggtaacttcaaccgaaaagttaccggctgccgcgtcattggccagcgtggcggtgaacgcagt

SEQ ID NO: 11864 - DNA, 150 bp, Glycine max
  Peptide Sequence Number=SeqID_128642
ggaataacctactactccatcttgttggggtgtcctaggtgccgaaaagttgtgttctatgtgtcataccctaatttcgtccggggacctttgcttgatgacatacgacttttctttggtccttgtgaggttcttggcacccatcattag

SEQ ID NO: 11865 - DNA, 324 bp, Glycine max
  Peptide Sequence Number=SeqID_128643
atggcttctagaaagagaaagagtattggtacaaggcccacatctcagtatgatacaaggagctccgaaggaccttcaccaaaacaagtcagggtcagaggccacgtggtgaagattgatgtagacagcctcaacacctttctggagacacctgtggtactagctgagggtgaaaccttacccgcatattctagatactgcaggttgcccgctgatattagagaaattgaggttgccttatgtatcccaggtcgggggtttgttttgaatgctgaaggccacgctgggaatattctcaggaaagattcaacaactcttgcttag

SEQ ID NO: 11866 - DNA, 780 bp, Glycine max
  Peptide Sequence Number=SeqID_128644
ggatcttcctccaccaccaccgctgctggccaccgctgccatggaacctctgaagacccaccaacaccagttcttccctctctttcatctcctcggtcatccacattattttcctctgatgaccagcgtcagaggtacttctctcaattctgtaatagagtcattctagaccctaagtaccttgaccttgaattttttgatggggaaacatttgattgttaccaagtgcataatattcccattgttattgatcagtccttgttttattcattgactaaactactcagtcaaggtgttccttttgagggcactcttgtggatggctggaaatttgactattcaagtcatgatgctcgcagaatggcattacaggccaatgcacctctcctgtatccccaccttgttactctttttcttcatcatttcaatgttcctttggatgatgaaccatatgtcaaggttaaaaggtctttctccattggtgtcggtgctgttacctcctttggttaccggaaggatgttgatggtcaatgggttcacaaacaagacttgccatcgcctattcctgatgaacgtaccccatctcctccaccacaaagggatacttcttcttctctgctgattgaagtcctcacagagctccacgatcttcgagcatttgtgggtgaacattttgatgtgatggatactcgctttgatgggatggatactcatatcattaggcttggagatgatatgagcttcatcaggcgtttcttcgatcccccgactgactcttag

SEQ ID NO: 11867 - DNA, 516 bp, Glycine max
  Peptide Sequence Number=SeqID_128645
atgggtagtagaattcacagattgaatgaacgaagaatgcggcactcgagatctgagatctgggaaaggcttcgtggtggctttgatgagattggtcggtggaattcatgtccactaggaattcatgcagatggcatgtgcttctgtgagtcttcgccaatggctgaggaatctagcactcgagcaagtatttcaagaatagtcatgctggctgaggctttgtttgaggttttagatgaaatccatcggcaacctggctctctgtctctatccatggtctcactccctgcacctgaatcaattgttgattccctccctctgaaatctcacaaaaaggttgatggggctgatgtaggcaatgatgctgaacattttcattttataaataacaacttactcagcttccctctttttacagtgtatgtcctctgtgtcgcggcaatgtctgtggagggtccacagagtcttctgccaactcggaagtgcagtctcattgacattgtacatagaatgtaa

SEQ ID NO: 11868 - DNA, 1518 bp, Glycine max
  Peptide Sequence Number=SeqID_128646
atggtgtactcctactacacccccacgtactactcaaccctccatgactcactcacctctctgtgcaaaaccattcttcctttcagcttcaagaaacgaccgttacctgctgcggaacacaaattgtcgaagctgcaatcaggcaacctcaaatggcagcaagactctttccaccaggtgctgaacttaatgggtctccacaaagaaggcatcgtcgctgaatctgaggtttcggccttcagaactcacttgctagacaccctcattgcttctcctccagaacaagaacaccccgttatattaagagacaagcttctgtttctccaggaacttctttatgccaagtgcatttctgaagaagagtaccattcttctaagaggccattgctccggagactggcagctcaaggggctcagattgaagctagggatgtgatcgtggcagggcctaaggactcaaaagagaattcggaagaagagtggtcggtgattgacttgaaggatgagaaatgctcggtgaacaaagagaattcgggttgtaagagcaagtccaatccgggatcagctatgaagcagattaaaggagcagcctcggtttttggctttggcaaaggtgggaaaaatggggcagaaaagagcatatttgattcaccttctttgtctgccaaaaatgaatcgagggaaaaccccttctgggatcttcagactaaggaaaaacaaagtgaaggagggtcaattctcatggaggaaagtgggcctccagagccagtgaaggagagtaatggtttggacaagttgaagaggaaaccatttaggactttgtttcataaggagcaaagtggttgtcctgaacaagatcaaagatcagggaaatcaggtaaaaagcaatgggggtttgaagggttcaagaaatggaggagaaatgaatcagaggatgagacagctcctttgcctcgtaatgaaaaatctgacagtgaggcctattcaggttccttggcaaaggcacttggggagggaccacatacaaagttaataaagaagaagttgcattctgatggttccccgtctgatttttttattgataaggttttgggagacaagataaagaaggagttgtcaagaatccagacagaactgagcagcacaaacccaaatcttaagttctccaatgatcagattgaagcaatttctaccagaattccagtggacaaggctgagttaaaaaattactttcccaaatcatggtgtgaccgatacggtgatgttgtgctggatgtggtgaagaaggaattcaaggaccatgttgcggaaatggagaacatgcgcagcattgctagagaaaaacacagcaactctaggcggtggacaacaacaacaacatttgacgatgacgaaaaccttcatccaaatctatttgatcatcgtgataataattcagttcgcagcagaaacatcaatccattttctcatgtgtttggatcacgattcacgaataatgaggaaaaagaaatggaatag

SEQ ID NO: 11869 - DNA, 174 bp, Glycine max
  Peptide Sequence Number=SeqID_128647
atggcttttgtcttcgggtgccttgcctttaagttaaggcttcgttccactcctcttctgtcgctctcatctctgcctttcatttacatagatacccccttcttttcccactcgttagggcagcggttggagaggggagctaggcagggaagagcctttcaggctgaagaataa

SEQ ID NO: 11870 - DNA, 1197 bp, Glycine max
  Peptide Sequence Number=SeqID_128648
atggaagctgttaagttggtgtctagtgatccaagtgagagaccagacacataccgagtcgcttacataattcatttcttgcttggtgctggcaacttgctcccttggaatgccttgatcactgcagtggattactttgcctacctctatcccaccaaacacatagaaaaggtgttctctgtggcctatatgatttcatctgtgatggtgcttcttgggatgatcagttggggaggttggagcaaaacaacattgaggctgagaatgaacttggggttctccatgtttgttatgtctcttatggtagccccagtcatagactggacctcgagcagcaccaagctcaatgagagaccgagcggcgcctacggcttgacggttgcagcagtggtgatatgtggtttagctgatggcttggtgggtggaagcttgataggatcagctggaaagctcccaaaacagtatatgcaagcagtttttgctggaactgcttcttcaggtattataatttcgatcttgaggataataaccaaggcatcactcccacaaaccccaaagggcctcaaaataagcgctcacttgtacttcatggttgccaccattttcctcctatgttgtgttatctttagcaacttgcagcacaagttaccggtgatgcagcagtatcatcagaggcttcatcaggagagcaccttgtgcacagggacaaaattttgggcagtggcaggaaaaatcaagggggcagcttttggaattttcataatctacatagtgactctgtctattttcccaggatttattgctgaagatcttgaatccaagcttctaagggattggtatcctattttactgataacagtttataacttggctgatctcattggaaagtctttaactgccttctatgttatgcaatctatgacaagggcaatatgggtagccacagctaggctactattctatccactctttgtagtgtgtcttcatggaccgaagtggctgaaaactgaagtacctatggtggttctgacttttctgctaggatttagcaatggttaccttactagtgtccttatgattctagcacccaagtcagtgcctttgtcagaatctgagttatctgctattgtcatgacagggttccttgggtttggcttagttggtggttcagttcttggctggttctggatcttatga

SEQ ID NO: 11871 - DNA, 504 bp, Glycine max
  Peptide Sequence Number=SeqID_128649
atgcagccaagcatctatgttggaagaggaatgcatgatagtcaatttgctctcatgaacttttttgtccagataaaacctctagttaggccaacaaaggacataatgagcattccacgtgttaattatggctggcatgcatttttcccaatggtttatttcatggacactcaaatttggtatgcactcttcacaactttgtgcggcggtcttgttggagcctttgatcgtctaggagagatacgcactctgagcatgctaagatcacggtttcagtcattgcctggtgcattcaacacatgcttggttccttctgataagaagcaaaaaggaagattctctttctcaaagaaattttctgagttcatcttcactttagtttccattcttgtatggattactgcaagcaaaagaaatgaagctgccaaatttgcccaattatggaatgagattatttgcagtttccgtgaggaagatctcataagtgatatgaaaggaccttag

SEQ ID NO: 11872 - DNA, 801 bp, Glycine max
  Peptide Sequence Number=SeqID_128650
atgaagaatcaacggttgagatcaatcgttgcctccctctataaaactccgtcgccgttctccaccaccctcagcgacaaacaagatcttcagatccatgacaacaacgacaatgcttctgcgaagctcgtccacgccgattctcaattctcgcatccctcacccgaaggattcgcctcacgaacccgaaatccttcaccggagcccgcgcacgcgctcgctcacgctctccgcgtcgtcgagttcgctctcgccggtcgaagcttcgccgagcagaatgacgcgggcgcttcggacgaaggagacggagttggcggcggcggcggcggtgatggatgggacaacggtgacggcggagggtcggggttttgggattcgaataatgggaatgatagcacggacttgtattaccggacgatgattgaagcgaatccagggaaccctctgtttcttggcaactacgcgaggtacttgaaagaggttcgaggggactatgtgaaagcggaggagtattgtgggagagcgattttggcgaatccgaatgatgggaaggtgctatcgatgtatgcagatttgatatgggagagccagaaggatgcttcgcgtgctgagacttattttgatcaagcggttaaagcagctcccgatgactgttatgttctggcatcctacgctcattttctttgggacgcggagggagaggaagatgttgaagtgcaagaagattcatctgaaatatctcctagtttcttacatggagctgctccactaccaccgcctttagctgctgcttcttcttaa

SEQ ID NO: 11873 - DNA, 4131 bp, Glycine max
  Peptide Sequence Number=SeqID_128651
atgccgaaacaccatactcgccaggttacgacggacaatttggaggaggccattagccgcctcagccttggtcacaccaacctcaacacgaaggttgagtccatccacacttccctcaccgcaaagattgattcccttctcgaatgcttcgccgccatttctgctccgccgcattccccatcttcctcgccaattcagcctctggcaccggtccaccgccaccacatgaagctggatgtcccacgcttcgacggctcggatcctctcggctggatattcaaaatatcccaatttttcgattatcaggggattcctgatcagaagcgtctcacggtcgcggcgttttacatggacggcccggcgttgtcctggcattggaatcatgattcgcgccttccttttacgaagatccgcaaggagcattgtttaagctccagcagaccggcaccctgctttatatcagggttgagtccggagctccgccgtgaggtccaagctctccgtcctctttccctcctgcaagctacagaacttgcgaggcaccaggaagataagatgcttgaccgccgccgcggcactcgagcaccttcgcacccaaaccctaccttcaatcctcgatcctccccaaatccatccacggcgcatcctaaagttcctctgaaacgcctcatgacggaggagatggcaactcgcagagatcaaggcctctgctaccactgtgatgacaagtggtcacagggtcacaggtgcaagcctcgtctgcatctcctaatcgcagacgaagacctagaaccttcttcaggattcccccttccagattcccttacctacaccacacccaaacctgggttgactccacaaattagccttaatgccatggaaggcactccggcaccccaaaccttcagactcctcgactccctgtgccatcatcaggtcgtgatcctcgtagacggaggaagcacacataatttcattcaatcacgtgtggccaagttcctcacgttacccacaaccccgacggcggccctgaaggtgggcaacggccacaccttggactgtgatacgatatcgtttcaagtccctctctctatccaaggtcacgacttcagacttgacctgtaccacttacccctctgcggagcagacattgtgttaggggtccaatggttaaaattcttgggcccaattacaacagactaccacaaccttaccatgacttttgtgcacatgggccaacccattacacttaacgctgatgcaccccccattccatctgcagcctccatccataagctcaaacgcctagcccaaacccagagcatctctgctctgtttcatatctccaccacgccaaacctacacacctccctccttccccaaaccactccggtcaacgtccgtccctacagatatccgcatttccagaaggccgaaattgagaagcagaacgccgccatgctcgccgccaacctcattcaacccagctactctcctttctcttcacctatactcttggtcaagaagaaagatggatcgtggagatgttgtgtggattaccaggcgcttaacgcagtcaccattaaagatagatttcccatgccgacaattgatgaattgttggatgatctaggacaagctgtgtggttttcgaagctggatttgcgtcaaggatttcaccaaatccgcatggcggaggaggatatacacaagacagtttttcgaacgcatcagggaaactacgagttcaaggtcatcccgtttggcctctgcaacgcgccgtcgacgtttcaggcggccatgaacgacacccttaagcccttcttgaggaaacatgtggcggtgttcttcgatgacattttggtctatagtgctgacttggccacgcatgtctctcacctcgactccgttctggatacactatcagctcaacaattccttctccggcgtactaagtgcctctttgcccaaactcagcttaactatttgggccataaaagatctctgcgatgctggcctagcctgtacccacatctccgacagctcttcgtggattcttgggtctcaccggtttctaccggaaattcattaagaactacgcagcaatcgcctctcccctcacgtcattattgcggaaggagcaattctcatggtccgcggaagccttgcaagcttttcaagcacttcagcaagctatggtacaagcccccgtcctcgccaacccgaatttttctcgaccattcaccattgaaacggacgcctccgcttcagccatgggtgcggttttactccaagaccatcaccctattgcttatcacaacaaggtactatgtccacgattacagcgagcctcggcgtatatccgcgagctccacgccatcacctccaccgttaggaaatggcgtcactatctgctgggaacgtccttcacgatcctcacagaccatagaaacccctgagcagcagacgtacctcttaaagcttctaggattcgattacgtcattaaatataagtctggcgccaccaatgtcgtggcagatgctctctcgcgcatcattccagcagaggccacgtgttttaccctggtcatgccacatttcaccttcttggagcagctacgtaagtctttaatggcggatccacaatatctcaacctgctaaaggatatccagtctaagccggaagcccactcggacctgtccctctaccaggaccttatcatccgcaatagacatatctggatcccattcccttgcccgttcactgacaggctattagaggagtttcactcatctccgatcgggggccacaccggcgctgcaaagactcttcatcggctgcgtcagaacttcgattggcccaccatccagaaggatgtgcgtcactttgtcggccagtgctcggtttgtcagcagaccaaatacgagaccaagaagcctgcgggtctattacaaccccttccgattccggccaccgcatgggaagatttgaccgttgacttcatcacgggcctcccttgctctcatggcttcaccgtcatcatggttgtggtcgaccgttattcaaagggggcccatttcggtgcacttctaacgcactattccgccttcaaggttgtcgttttgttcctggactgcgtctgcaaacttcacgggtttccccgtaatattgtttccgaccgcgaccccgtttttgtaagccatttctggtgcgagttattcaaactcagtggcacgaagctccgcatgagcaccgcgtaccacccgcagacggacggccaaacggaggtcctcaatcggactctcgaacaatacttgcgtgcctacgttcataatcatccttcccactggtttcgtttcctgtctctcgcggaatggtcctataataccgcaacgcacgtgggtacggggatgtcaccctttgagggatctacggtggctgctgttgaccatctactcagttctcgggagaccatccacgccaccctccagcgtcgtcttcgcaaaatgcaagaggcaatgaaggctaccgcggacaggcaccgccgggacctctccttccgcgtcggtgattgggtttatgtacgtttacagccttaccggcaaacctcggtagctccggcatatagcaaactgaccaagcgtttctacggccccttcaaagtggtcgagtgcattggggcagtagcctacaggttgcagttgccgccatcatcaaggatccacccagtgttccacgtttctcttcttaagctccataagggccccttaccttcctctctagtgacccttccgacggcgtctaccgataatcacccattagttgcgcctctcgccattctcgactggcgaatggaccactcgcaggacccaccagtcacgcaggtcttggttcagtgggaagggcaagctcctgaagactcctcgtgggaacgctgggacgagttgcgtcgcatccacaaccttgaggacaaggctgttttcagggacgggagtgttgatagcaacactggccagggggatacaggtgttatcacagggaatcacaataacacaggggatatcacagataaccacagcaggccaaagagagttagtgtgagaccgacttacctgcgggattatgtgtaa

SEQ ID NO: 11874 - DNA, 480 bp, Glycine max
  Peptide Sequence Number=SeqID_128652
atgattgaactgttattacccggctggctgggcggcgtattgctggccctggcggccggtccgctcggctcttttgtcgtctggcgccggatgtcctatttcggcgataccctcgcccacgcgtcattgctcggcgtggcgtttggtctgctgctgaatgtgaacccctattatgcggtgattctggtcaccgtctgtctggcgctcgggctggtctggctggagcgacgcccgcatctggcgatcgacacgctgttagggatcatggcgcacagcgcgctttcgctgggtctggtggtggtcagtctgatgcagggcgtgcgcgttgatttgatggcctatctgtttggcgatttgctggcgatcaccccggacgatttgtcgctgatggcgggcggcgtggcaatcgtgctggtggtgatggcgtggcagtggcgttcgctgctgtcgatgaccatcagtccggagctggcgcagtag

SEQ ID NO: 11875 - DNA, 330 bp, Glycine max
  Peptide Sequence Number=SeqID_128653
atggccggcctgcacccgcttcagcgccggcagaatagcgtcacggcgactgccgcgcgtcagacgcataaagcgctcaacgctgattggcagcgtcggatcgatgtgcagcttttgcggcacatagccaatacgcagccccggcgcgcggcggacgctgccgctgtctggcgtgagcaggccgagtaccgtgcgcaccagcgtggacttgccggctccgttgggacccagcagggtgagaattttgcccggctgcagcgacaggctgatgcctgccagcaccgcacgctggccaaacttcaccgaaatgttttcgagtgtaacaagtga

SEQ ID NO: 11876 - DNA, 645 bp, Glycine max
  Peptide Sequence Number=SeqID_128654
atggacaagcttgatgacattagactgaacaaactccctgatgaaatggtggtctatgtcaatgtgcttggatcattcgtggtgcgtagggtggtaagggaacacgtgtccaagtggaatttgcctcaagagcttggattttctcattcattgcttgacaccattcaggatagggagcagcttgatgataaaattgaggttcatacacaattggaatctgacaagtataagggaggcttagtgtggtgtgtactccttcttaaagtgatagagggcaaagggttagggttaggtaatgtattagtgagaggaatggggataaccaaatcaagtaaggaatcaagaatgacttggttctatgaaatgaccacaagaactgtagatcctagcgatgaagagaaggaagtcgatgttggcaaggaggacagtgaaggaaacgacaacgcgcagatggggcagttcagcggtgaagtagacgacgtcgggatcgaggccgacaagagtgcagcaatggaaacgacagtgtgcgaggaggaggacggtggagatccggacacagggaaagagatttgggagtctcatggttctttgttttgtttgaatatgagtgttattgttctgaactttataattcttttaaactag

SEQ ID NO: 11877 - DNA, 2068 bp, Glycine max
  Peptide Sequence Number=SeqID_128655
ggattcagctgctgcaactcagattctcttgcttgtgcttgtggacttattatcatctgtgctcatgcctgcccttgtcaattacagtggtgatgatgaactgtaccctgggggttctttttgcccaaatccaatggagttgggtcgcttgtacactactattggctccaatttggatatgtactaccctcctactaagagaccacgctccatctttgaagctattgagcgtgagcagtattatcaagaccctggtattgaggttcttccagatgaatgcctctttgagatattcagacgcctccctagtggcaaagagagaagctcatgtgcctgtgtatctaaacggtggcttatgcttatgagcactatctgtaaagatgagattgaggggactacttctgttgctgaaactgtttcttctgatgagaatcaagatattgatgatgatggctaccttacaaggtgtctagatgggaagaaagccactgatgtgaggcttgctgcaattgcagttgggactagtagccgtggcggtctagggaagctttcaatcagaggaagcaactctgagcgtggtgtcacaaaccttggcctctctgcagttgctcatggttgcccttctctcagatcactttctttatggaatgtatctaccattggggatgagggtctgtctcaggtagcaaaaggatgtcatatgttggagaagcttgacttgtgtcattgttcctcaatcagcaacaagggtttgattgcaatagctgaaggttgccccaacttgaccaccttaactattgaatcatgcccaaatattggaaatgaaggtttgcaagctactgcaaggctatgccccaagctgcagtccatctcaatcaaggattgccctcttgttggggatcatggagtgtctagtcttttggcatcggcttcaaatttatcaagggttaagcttcagactttgaacatcacagatttctctttggctgttatttgccattatggaaaagcgataacaaatctggtcctctctggtctaaaaaatgtaactgaaagggggttctgggtcatgggggctgctcaaggtctgcagaaactactgtcacttactgttactgcctgcaggggggtaactgatacaagcattgaagccattggtaaaggttgcatcaacctgaagcacttgtgccttcgccggtgttgttttgtgtctgacaatggattggtagcatttgccaaagctgcaatatctcttgaaagtttgcagctggaggagtgcaacaggttcactcagtctgggattattgttgcccttgcagacatcaaaacgaagttgaaatctcttgcccttgtgaagtgcatgggagtcaaagatatcgatatggaagtgtctatgctttctccttgcgagtctcttcaatctttagccattcaaaagtgccctggttttggtagtgctagcctggccacgattggaaaattgtgtccccaacttcagcatcttaatctgactggactctatggcataactgatgctggccttctcccccttttggagaattgtgaggctggacttgtcaatgtaaacctcactggttgctggaacttgacagataatatagtttcagccttggccaggctacatggtggaaccctcgaagtactaaatcttgatggatgctggaaaattactgatgcaagcttggttgcaattgcaaacaacttcctagtgcttaatgatctagatgtgtcaaagtgtgcaatcaccgatgccggtgtagctgttctctcaagggccagtctgcctagcttgcaagtgctttcgttgtctgaccttgctgggattgaatcttcaaaactgcaattcaattggcagcagcacaatggagttgctagtggagaagttgtggagatggtggattggtggcagtttggtgacttggttgttttccagggaactttggcttgttactttatgacccatttttttcgcaagcatgaaatgcttgttccaacttacaacccttttggccccttggcttactggggctacttctttcatggctag

SEQ ID NO: 11878 - DNA, 1503 bp, Glycine max
  Peptide Sequence Number=SeqID_128656
atgaagaaggtgaggagaaagatcggcaagtatgaggtgggtcgaacaattggcgaaggcaccttcgccaaggttaagttcgcaagaaactcggagacaggggatagcgtggctattaaaatcatggctaagaccaccattctccagcacagaatggttgaacagattaaaagagagatatccattatgaagattgtcaggaatcctaatatagttagattacacgaggttttggctagccagaccaggatctacataatccttgaatttgtaatgggaggggaactatatgataaaattgttcagcagggaaagctttctgaaaatgaatctaggcgctactttcaacaacttatagacacagttgatcattgtcatagaaagggtgtgtaccatagagacttgaagcctgaaaatcttcttcttgatgcttacggaaatttgaaggtttctgactttggattgagtgcattgactaaacagggtgttgaccttcttcacaccacttgtgggaccccaaactatgttgcccctgaggtactcagcaatagaggatatgatggtgcagcagctgatgtttggtcatgtggagtcatcctatatgttctaatggctggatatcttccttttgaggaggcagaccttccaacactgtatagaaggggtgagattcattgttcttatgttcatgcttattatccagtagatcttcttaatgaaaacttgtttggaaccttattattgggaaggactatagctgagtattggggctggaaaatagggtttccctcttcccttgaaggggcaacagtcctggactctgggataaatgctgcagaatttgtttgcccattctggttttctgcagacacaaagtcattcatacaaaaaattctggatcctaatcctaaaacacgggtgaaaattgaagaaataaggaaagagccatggttcaagaaaaactattttcctgtcaaactcggggaagacgagcaagtgaatttggatgatgttcgagctgtttttgatgatattgaggaccaatatgttgctgaaaggtcagaaattactgagggaggtcctctgataatgaatgcatttgagatgattgccttatcacaagggttgaatctttcaccactatttgataggcttcaggataatgtaaagcggcaaactcgttttgtctcccgtaaaccagcaaaagttataatttcttcaattgaagctgttgcagagtcaatgggtcttaaggtccattctcgcaattacaaggtgaggcttgaaggcgtttctgcaaacagggttggaccatttgctgtggtcttggaggtgtttgaagttgcaccatcccttttcatggttgatgttcggagggccaccggggatacttttgactaccacaagttttacatgaatttttgtgccaaactaggaaacattatttggagaccggcagggactatgccaaattctaatctgctcaagcaaatgactttataa

SEQ ID NO: 11879 - DNA, 261 bp, Glycine max
  Peptide Sequence Number=SeqID_128657
atgaagctctccaagactgagatcactttcagcagaaatgtggccactctcagagctgatgagctagcaaggctgttcaacataaaggcagtgagtgatcatagcccttgtggggaggtccaagttgcaagtctagagatagggtctggaagccaaaatgcttttcaaatcagtgaaagatattggatagaggatgtctctctccaacttttgattggtgtttcttgtgatgtaaggcctcaagccgcttctctaagttaa

SEQ ID NO: 11880 - DNA, 291 bp, Glycine max
  Peptide Sequence Number=SeqID_128658
atgtggagtgtcaaagttaagcatactcacagagaagatatagatgacaatacgttgcaaaaaattctcgtctttggctcaagtgataaggaggagagcgctatcaattgtgctccgctgattcccttaacagtgaacaccaaatatactacgaggttacaatctgttgaccatattcttaacggagaaacaaaatcccccagtgagaacaaaattaagtttgagacaacttcatccaccaatacaaagaaaggagagagcatgatggagactttaatccagaaccgttga

SEQ ID NO: 11881 - DNA, 240 bp, Glycine max
  Peptide Sequence Number=SeqID_128659
atgaaggttcggtcatctgtgaagaagatgtgtgaattttgtcagatagttaagcgccggggacgaatctatgtgatttgctctgggaaccctaagcacaagcaacgacagggcatggcaacatttgcaagtgaaggcccatctcaaccagtgatttgcactctatttactggtgcgcactgcgcacatgctattaactcaacagtagagaagtttaatttctatccattgtgggtctaa

SEQ ID NO: 11882 - DNA, 1059 bp, Glycine max
  Peptide Sequence Number=SeqID_128660
gatggacccttgggtactagtaccctcacctttagaggactatacgtcctcgtcatcagagggctacatgtcctcgccatcagaagattacgagtcctcgccatcagaggactacacgtcctcgccttcagaggactacacgtcctcgccttcagaggactacacgtcctcaccatcagagggctgcacgccctcaccttcagaggaccacacatcctcgccttcagagggtcatgtaccttaaccttaagaggactacacgtcctcgccttcaaagggctgcatgccctcaccttcagaggactacctgtcctcgccttcaaagggctacacgccctcatcttcaaagggctacacaccctcaccttcaaagggctacacgccctcatcttcaaagggctacacgccctcatcttcaaaggggtacacgccctcaccttcagaggactaaatgttctcgccttgagaggactacacgtcctcgccttcggagggctgcacgccctcgtcttcagaggactatatgtcctcccctttagaggactacacgtcctcgccttcggagggctatacgtcctcaccttcaaaggactacacgtcctcaccttcagaggactacacgtcctcaccttcagagggctacgcgtcctcatttttagagggccaactatgcgagcacaaccagaggaaggctatcgcgcagctactgtgcatactggggcaaggggtcgcgcccacaagacatccagtggccccggagaagtccaacagggccctggggtctccagctttggttacgggcctctgtcattcctacagggtgctcattccccccagcaagggatcgtgcccgcaggacacccagtggacccaaagaagtccaacagggtcctggggtttccagctctgattacgggcctttgtcagttctacagagtgcccgtcacccccaacaaggcaggtagagggcgagacaccacaacagcctggggatggctagcaacaggcaataaatgcaccgccgccacctctagagcccctcagctcatccacgaaaag

SEQ ID NO: 11883 - DNA, 558 bp, Glycine max
  Peptide Sequence Number=SeqID_128661
atgtttctgttcgtgggagggccgccctcggcagcggaaggaaaggaaaaacttgatctcatcgaagagagattgagggtcgttgaaggattcggcgattatccgttcgtagacatgaccgacctgtgcctggtgtcagacgtcgtcatcccttcgaagttcaagtcggcagacaaggaaggtcctaaaaagcctaaacccttggtaatacacttcaccagggatacgactccccaaaggcccccacacccctcgacaatgtcaggcgttagatcgattccgtttccttacaagaacagtcgcgcagttccatggaggtacgcccctctgggcggtaggaaggaagaagctacccatatcggctcattatcggccaaagtaaccaacatcaccgggctgaacgacataacccgcagtggtcgcatgtttgcaccccctggcctgccaacgcagcccgcaaactttaaagggaaagcaaaggtgatcgaaggacaaaatgtcaaggtgatccccacaccgggcgaggatgttccgacaaagaaatttgctgagggatga

SEQ ID NO: 11884 - DNA, 395 bp, Glycine max
  Peptide Sequence Number=SeqID_128662
atgtcgcgtgttcttgtgagcctcacggtggggatgggggagaggatctccgagaggcgtgagacggagtacgtgacagcggggattttgcggcggaggacggaggagaggacgacggggtccattagggtgcggtgggtgcagacaaagaggacgccggagttttcgccggagggaggaaggggtggtttgccctttacgatgaccttgccgccgaatagccttgagatgtggggaatggcccaaaagggtaaaatagagcctatggctatgcggattatggcaagtataatgcccaccggaatccataggaggattaagagggaggtggatggcgttggccgcttcacgaggcggccatcgtggaagatcaccggaagtggccgtagtagctg

SEQ ID NO: 11885 - DNA, 210 bp, Glycine max
  Peptide Sequence Number=SeqID_128663
atgaatggcacttcgaagtgcctcacgttgggggatcggcgtggggaacttccaccggttctggactggagccagcgggttctgaatgacctccctctcacggttaaaaaagtggttaaccatctcgaaaaaatccatatccgaaaaacgtgtctcaactacagccaactaactcccctgtttccctatcgaaaaaccaaccctacttaa

SEQ ID NO: 11886 - DNA, 463 bp, Glycine max
  Peptide Sequence Number=SeqID_128664
cgcctcgggtcggtagccgggctccgggacattactaccacggctactatcgacccgagcccaaagaaggaaaagaacggactaaagcgaggagttcattggccatacatagtgaagggggatgggggtcaacctctttcatgacccatggccccattgagacacgtttttcggatatggattttttcgagatggttaaccacttttttaaccgtgagagggaggtcattcagaacccgctggctccagtccagaaccggtggaagttccccacgccgatcccccaacggcggctttccgttcactttccggaaattgaagaaatctattccagtgtcgcagagaacattatgtctcgcgatctggaaatatctgcggagatttctattgaaaccctccgcggatgggtggaggagataaaggagaaccctaatcccctaaaatccctcattagggaacacct

SEQ ID NO: 11887 - DNA, 1038 bp, Glycine max
  Peptide Sequence Number=SeqID_128665
atgtcttcccattggtgtcaccggtgcaacaaatttgtcagagcatggcgacaagaaatgcccgtttgtcccgattgcgacagcggattcgtcgaagagatcgaaccttcgaaccggcccgtccaccacgtggaaactcgccgccgtaggttcccgacagcggcggcgatgtacatgatgggccaccgttcgggtaactcggatcacaacccccgttactctagccgtcagcattgccggaacgttatcggagaccggtcactgctcaaccgggtcatcatgctccagagcgaggggacaagccgcgaccgtggctccggtttcgagcttttcttcgacgacggagccggttccggtttccgacctctccctccgaggatgtcggagtttctcctcggaacagggatcgaccgtgtcatggaccagctttcccacgtggagtcaaactccgacggcgggaggcacgaccagcagagccacgcgccggcgtcgaaatccgccgtggagtccctgccggcgattgagataaacgcgacccacacggcgattgaatcgcactgcgcggtttgcaaggagcctttcgagctttgcaccatggcaaaggaaatgccatgcaaacacatataccacgcggaatgcatactaccgtggctcgcgattaaaaactcgtgccccgtgtgccggcacgagttgccatgcgagaacgcacgtgcgagattggagcgcgtggaggaggaggaagagaacaacaacttggggttaacgatctggaggttaccgggtggcggttttgcggtggggagattcggaagaagagagggtgagagagaggttaacgttcctcttgtgtacacggaagtggatggtgggtttaacttcaacaacgttcttgtgggggaaccgaggagggtttcgtggtcggtgttggagtctagcgggagcagaagaggtggcgcgtttaggagaatgtttaaccatttgtttagttgcctgagaggtggtggggttgggcctaatcgttcttcttcttcaagcact

SEQ ID NO: 11888 - DNA, 312 bp, Glycine max
  Peptide Sequence Number=SeqID_128666
atgtctgcatcccctctcgtcactccaacatgctttggttatcattggacaacccatgtgaagttctcgtggtactggttgcaacttgaaccaatcatatttcaccccaagggagaaacaaaagaaagggccttcttgattagacaatggttaatgcaggagaaatccctgcaattatggaattctctcaactgctttgtagttttctttgattttggaaaacagacaacagaaaaacatattacccattatccattacatatacttgtaaaagaaaaagttgttgataaatggccaaccgtgaaatcttaa

SEQ ID NO: 11889 - DNA, 447 bp, Glycine max
  Peptide Sequence Number=SeqID_128667
atgtgttccatgataagcgcgcaaggggtggcggttgcaaccgccatggccgtctctggcacggtgatcctcctcgccctccgtctgcagaagtcttttccaccaccccaattctccgttcaccaccaaatccctccttctccttctccggttctgcgatcttgcatatccaacgctgggaagaagagcaagaagaagaagaagaagaaaagagtgcactttgcggaggacgtggtggagtcgtgcagagacggagaagagttcaggaagcgaagttcgcgatcgaaggttcagaagagttataacaacaacaacaacggagaagaagacgaagaagaagaagaagaagaagcgaagatcggaggagtaatgcctgctaacagggtagctttgtataacggaattcttaggggccgtgtggcccaacgtttggcctactcttgttga

SEQ ID NO: 11890 - DNA, 918 bp, Glycine max
  Peptide Sequence Number=SeqID_128668
atggcctcttctatttcctctctttctctccttctcccttctctcacaaccctcattctcctccaaattcaaacatgtgtctcttcatcacaaacacaaaaacccctcctactacctctcaaaacacaaacacaaacacctccacgcaagcttgcatttcagcacaacgtcacactaaccatctcactaaccataggctcgcccccacagaacgttaccatggtcctcgacacaggcagcgaactctcctggctccactgcaaaaaactcccaaacctaaactcaaccttcaacccactcctctcttcttcctacaccccaaccccatgcaactcttccgtctgcatgactcgaacccgagacctcactatccccgcttcatgcgaccccaacaacaaactctgccacgtcatcgtctcctacgccgacgcctcctccgccgagggcaccctcgccgccgaaaccttctccctcgccggcgccgcgcaaccaggaacgttattcgggtgcatggactccgctggctacacctccgacatcaacgaggatgctaaaacgacaggtttaatgggcatgaaccgaggctccctctcgctggtaacacaaatggtgcttccgaaattctcgtactgcatctcgggggaggacgctttcggcgtcctcctccttggcgacgggccttccgcgccgtcgccactgcagtacacccctctagtgacggcgacaacctcgtcgccgtacttcgaccgtgtcgcgtacacggtccagctcgaggggattaaggtttcggagaaactcctgcagctttccgaagtcggtgttcgtgcccgaccacaccggagcgggtcagacaatggtggattcgggtacccagtttacttttctcctcgggccggtttacaattccctaaaggatga

SEQ ID NO: 11891 - DNA, 198 bp, Glycine max
  Peptide Sequence Number=SeqID_128669
atgtggcatctccaatcatctttcttccttctcgattccgctgctattgatcttcaagaagcaaaggactccattgatgaagaagatccaaggcctacaagctccacatggagctatgtcatgtgctatccagagcatctgtatctaggtgatgttcttttgcttcctatatctttttgttcggtcaattcattttaa

SEQ ID NO: 11892 - DNA, 393 bp, Glycine max
  Peptide Sequence Number=SeqID_128670
atgaaattcactaccggaagccattcaccgatacagaacaaatttgttggttgcgcgttcacaggaaaaaatcctaagaaatttcaaattccttcaacatgtaccatcgatgaactgaagaatttaatcaagcaagttgcacctaaagggattccccttcttggaattcacgaatcacaaacggtaccacgattgtttttccgccaaccagctcggtttgagtattcagatacggttataaaatatgaaataaatgagctgatcaccaacgaagaactgctgaaagtgttagtacaatctaactactggaaaaaatatggaccaatagaaattttagctgtctttactaaatatgttgaagacgaggtcagtgggacgtcgctaaacaactga

SEQ ID NO: 11893 - DNA, 180 bp, Glycine max
  Peptide Sequence Number=SeqID_128671
atgactctattttgcacacgactccctatcgaatcaaagatcaaacgtggggtgggatatcgccagtcgagaacgaccttgaatggaaatctgaaaggaagaatgacctttgccggcagtcacttaccttgccgaaaatttatctggtctgaagatcttccgttctctttctttcattga

SEQ ID NO: 11894 - DNA, 363 bp, Glycine max
  Peptide Sequence Number=SeqID_128672
atgaggtgggtcgttacacatattgataagaatgtgaaagcaaagtgtaaacatgtaactcccaaagaagcatggggtcaagtgatggaggcatggggtacttttatggattgttctgcagagtttgactatgaagattgtttgacaaagtttgaagttatctgtcaaccatggcatgagtttgttgcatatgtgaaagatacttggttgatccctcacaatgaaagatttgtaaaggaatggacagataaagtcatgcacttggggaacacaacaaccaacagggctgagttttcacattgggccttgaaaaggttgctccagtctagcatgagagacttgtgtgaatgttggatacagtga

SEQ ID NO: 11895 - DNA, 489 bp, Glycine max
  Peptide Sequence Number=SeqID_128673
atggaatgtgggtgtgagcggctccccatggttgagttcctcatggaatctgctcaaatacacgattctcgaccgctttccgttacatgtttcaagtccttggctgatgcatccatcaaggaacagcactttacttctcgaaatttcctcgaagcagaggtggtattcatgcaggttttgaattttgagattggcacaacgaatattgcctttttgttccttgaagatctttggattcagttcaatggagtggccaaagttggcgcattgattagcattgaaacttgcatggaaattatggatcttctgtacgaaaaagaggaaatgtcgattctgtttaggtctcctcactccattgctgcatcaatcttggttgcctcatatgtaatgacagtccctaaacagaaatgggaatttccagttcttgcatgggatttaatcttgtatcaaccttctaacatcaatcatattcacgtactgaggaactaa

SEQ ID NO: 11896 - DNA, 2664 bp, Glycine max
  Peptide Sequence Number=SeqID_128674
atgatcaaggatcgtgtgcgtacggaaacttacagggatgcaatcatgcagcatcagagttccattgcaggcaaacagttgcaccaccgttaccgttgtagcattagcatgcttctacgctgctttccaataaagtcgaagctgttgcagtctcaattcaccaatacacgcctcttgtcgtgtgctacaatcccaatcacagctctgaaagaatgcaactccttagcccatgcgaaactgttgcatcagcaaagcatcatgcaaggtcttcttttccatttggcgacaaacctcatcggcacatacatagcttccaattctactgcgtatgcgattctgcttctggagcgcctcccgccgtccccttcatcggttttctggtggaaccaactcataaggcgcgcccttcatctcggaagccctcgtgacgttttcactctctaccgtcagatgaaatcacttggctggacccctgaccactacaccttcccttttgtcttcaaagcttgtgccaacctttcctctctctccctcggtgcttccctccatgctactgtttcacgatctggctttgcctctaacgtatttgtctgtaatgccgtggtctccatgtatggaaagtgtggcgctctccgtcacgcacacaacatgttcgatgatttgtgtcaccgaggcattcaggacttggtttcttggaattctgttgtgtctgcttatatgtgggcttccgatgcaaatactgctctcgcattgtttcataaaatgactacacgtcatttgatgtccccggacgttatcagcctcgttaacatacttcctgcttgtgcttccctggctgcctcactgcgcggaagacaggttcatgggttttctattagaagcggattggtggatgatgttttcgtgggaaatgcagtggttgatatgtatgccaagtgtggcaagatggaggaagcaaataaggttttccagaggatgaagtttaaagatgttgtttcttggaatgccatggtcaccggctattctcaagctggcagattggaacacgctctttctttgtttgagaggatgacggaggaaaatattgagttagatgttgtgacatggacagctgttatcactgggtatgcacagagagggcaaggttgtgaggctctggatgtgtttaggcagatgtgcgactgtggttctcgtccgaatgtggtcactctcgtctccttactttcggcttgtgtgtctgttggagcactgcttcatgggaaagaaactcattgttacgccatcaaatttattctcaacttagatggacctgatcctggggccgatgatttgaaggtgattaatggtctcattgacatgtatgctaaatgccaaagcacagaagtggctcgaaaaatgtttgattcagtatcgccaaaagacagggacgtggttacctggactgtgatgattggtgggtatgcccaacatggtgatgctaataatgctcttcaacttttctccggaatgttcaaaatggacaagtctataaagcctaatgattttactttatcatgtgcccttgtggcctgtgctcgtttggcagcactgaggtttggtaggcaagttcatgcttatgtgttacgcaatttctatggttctgttatgctatttgtggctaattgtcttatagacatgtattccaaatctggagatgtagataccgctcaaattgtttttgacaacatgccacagagaaatgccgtctcttggacatctttaatgaccgggtatggcatgcatggacgtggtgaagatgctctccgtgtttttgatgagatgaggaaagtgcctctggtgcctgatggcataacctttctggttgtgctttatgcttgtagtcactcaggaatggtggatcatggaatcaatttctttaatagaatgagcaaggattttggggtagatcctggaccagagcattatgcttgcatggttgatctctggggtcgcgctggtcgtttaggtgaagctatgaagctcataaatgaaatgcctatggaaccaaccccagtagtttgggtggccttacttagtgcttgtcggttacattcaaacgtggaacttggggaatttgctgcaaaccgtttgttagaattggaatctggaaatgacgggtcatacacattgctttcaaacatatatgctaatgccagacgctggaaagatgtggctaggattagatatacgatgaaacggactggaatcaagaagagacctggttgcagctggatacaaggaaggaaaggtgttgcaaccttttatgtgggagacagatctcacccacagtctcagcagatatatgaaacacttgcagacttgattcaacgcattaaagccattgggtatgttcctcagacaagctttgctcttcatgatgtagatgatgaagaaaagggtgacctgctttttgaacatagtgagaagttggctcttgcctatggcatcctaacattacatccacgtgcacctattcgaataaccaagaatttacgcatctgtggtgattgccacagtgctattacctacatatccaagattattgaacatgaaatcatactgagagattcaagtcgcttccatcatttcaaaaatggatcctgctcatgcaaaggatactggtga

SEQ ID NO: 11897 - DNA, 387 bp, Glycine max
  Peptide Sequence Number=SeqID_128675
atggaggagaagaaaaagaaacaattggaggaagctgctcaattcggaagcattgacaccgtgattgatcctccatctcccatcagacgacataattcattggaggagcaggcctcacaaggttcctttgtcgcccatggacgtcaggatgtaccgactgctgccattaggcaactagaacaccctagtcgtgtgcgtgttgctggagccgatgtcatgatcaagcaatactttggaccgacttcaaggacctcctgcacgtcttcgtccatggctcccgaagacctggagcagctgacgcaaaaaatcagggaccaactggaggagtcgatcatagaaaaagtgactcgacaactaatgttatccttcagccagatgcagtcctag

SEQ ID NO: 11898 - DNA, 277 bp, Glycine max
  Peptide Sequence Number=SeqID_128676
cgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttagttag

SEQ ID NO: 11899 - DNA, 343 bp, Glycine max
  Peptide Sequence Number=SeqID_128677
atgactagaggcaatccatctgacttacaaccctttgatcttgagatagataggacatttcataaattagttagccatcatcttgtaccttttgagcatcctaagcattctgttattgatgattttgagcatccagatttagagcattataattttgaacattctgattttgaacattctgagaacatggcacaacctccaccccgtgagaggactctaagggaaatggctgcacctaatttcacctacgaaagcttgtgcatccaatacccagatgaggatgtcccatatgttcttaaaactggactaattcatttgcttccaacgtttcatggccttgcag

SEQ ID NO: 11900 - DNA, 450 bp, Glycine max
  Peptide Sequence Number=SeqID_128678
atgtcaggacatcgtatccgacatcttggatcctgcagcttcaatgcttcacttgacttttatcttgcattgtacagcacttccagtattctcgagcaggatgtcaggacattaggttcaacattcaatttcgagcgtctcgatatattacgggactcaatcagacatccgagtaaaaagttattgtcgtttgcatttgctcagaggttcaacattcaatttcgagcgtgtcgttatattacgggactcaataagacatcccgagtaaaatattatggtcgtttgcatgggctcagaggttcaacattcaattccgagcgtctcgatatattacgggactcaatcagacttccgagtaaaaagtcatggtcgtttgaattggctcagaggttcaacattcaattccgagggtctcgatatattacgggactcaatcagacatccgagtaa

SEQ ID NO: 11901 - DNA, 265 bp, Glycine max
  Peptide Sequence Number=SeqID_128679
ggtacctatcacctccaacaagggcatcaggccccctactaatcgagctttcatcaagaagtactgcggctccaggcaggcgcagggtgaaacaccacagcagcctggggatggccagcagcgggcaacagacgcaccgccatcacctctagagtttacctcagctcatccacaaaaaggtaatggtaggacacacctagttgctcatgatcctaggaacttaaataaaatgagcacaagctcggaaggtagaaagataccttga

SEQ ID NO: 11902 - DNA, 303 bp, Glycine max
  Peptide Sequence Number=SeqID_128680
atggcagagttgaaactctctgagagacgtgatctaacctgcatagagcactcgcacattcatggccttggcctgtactcctccctggagctgcatggtcgggcaaaccgtgtagttgtcctagtcggccagcctggcaccgacaagaccgccattgccatgggcatggccaaggatggcggattcatgaacggaggtctcccattcggtgacaccgtcatggaaggagtggtggtggtgggaaggggaagtagaggacggcgggggagatcccaagaagaagagtgcaatgaagctgagtaa

SEQ ID NO: 11903 - DNA, 699 bp, Glycine max
  Peptide Sequence Number=SeqID_128681
atggtggttgcaaaggtttgtcacaggacagagggtggggttggcggcgaagggagaatccggttccagacaaacacacactcccacatccaaatccaaatagaaaacacaaacacactctcactttttctcattcacaccgacacacgcattccccccatacgccgtcgttttccaaagcttcgcgccttcaaatccaatccacattcccatcaatcagcactggagtcgctccaagtgctgaagcctccctccccctccgccgccggccagattcgcttccgctccccttcctccgccgaactcctcgccaccgccgagctggatctcgaaaccaccaaaatgctgaaacgctccggccggcccccgccgccgacgccggagtcgctcaccgacaagatctaccacctccggggtgcgtttctgatggtggcggtgccgctcctcctcgtcacgctcgtgctctacgccatgccttccgcctcctccagcgagtccgtggaggactacgccctcacgcaccgcaaggtcggcaacgaacgatccacctccttcgccgtcatcttcgacgccggcagctccggtagccgcgtccacgtcttccgcttcgatcggaacttggatctcgtccacatcgggaaggacctcgagcttttcgttcagatttggggtggaagaagagagatagggaagaagtga

SEQ ID NO: 11904 - DNA, 279 bp, Glycine max
  Peptide Sequence Number=SeqID_128682
atggcccaggcgagtcagaggctagcctgcgtgagccaggggcctgaaaaaccccaaaactacccttttgcccttccttttgggtattttccacattcttttccgaaacatcgaaaaaccttacaaatagtgcgacaactggtgttaagcagctcaattcggctggcaagaatcaaaatgttagcaaatgaagaagtatttttctctaagaacgataagtattccgaaggtgctaagaatatggaattgaagtactttgtcgtgaaggaagaagtttag

SEQ ID NO: 11905 - DNA, 315 bp, Glycine max
  Peptide Sequence Number=SeqID_128683
atgtgtgctttatctcaagaagagtactccaaagctcacaacttcaaaagcaccaaacagatatgggacaccttagccattacgcacgaagggtcctctcaagaaaaatgcaacaagttgagccttcttgtcacaaacaagaacccctccaagtttaacgaatcatccaaaagatccttctacaagaaagagaaaagtccaatgatctgctataagtgcaagaaaccagggcacttcaagttggaatgtcctggccttgaaaagccaaaggataaaaagaagaaattcttcaagtccaaaaaaagatcctcatga

SEQ ID NO: 11906 - DNA, 261 bp, Glycine max
  Peptide Sequence Number=SeqID_128684
atgccttcatttacatttcaaaagatgacaatgtcttcagtcatttatgctttcaaaaggtttttcgacgtttcggaaaagaatgcggaaaatacccagaagggagggcaaaagggtcattttgagaggaagcacccagctcgcctaggcgagctgctgttcaacctccacccctcatttgctatatataggcgtgagggggctgaaggaaatagattccaaggtccagaattgaggaaaaagaagagaaaaagaagctaa

SEQ ID NO: 11907 - DNA, 357 bp, Glycine max
  Peptide Sequence Number=SeqID_128685
atgtcttttgatttgaactgtaagcttaagaaacatgaggtcttgagggaagtacctcctatgtttgcaacactctatgaggagatagaaaccttgagaaataaactaggaaaatttgttgctggtcaggaagccattaacaagattattaaggtgcaaagaaaccttaaggacaaatctggccatggtttcaaaggcaaaaagatttgggtcatgaaattcacaagtgcaaggacctccctgaaaagggaaacccatcatagggctagttcagcacttagcaacacccacatgctaaccagagaaaaggacccaaaaagatttgggtaccttagaggaaaaatagtcatgttgtag

SEQ ID NO: 11908 - DNA, 243 bp, Glycine max
  Peptide Sequence Number=SeqID_128686
atggacaaggcaatggctgtgatcctgaaatatttcctatcagtcaggataaatgtcagtaatagaaaaggaagcagcagaaagactttggttaggcaagtgatggatgtatggagcagacatgatggtttaaaacgtcatggcagtagaaggattaaagcagttcctgctcaaaataaggccactagtaatccacgaagctttgagaaacttaaaatggaatatgcatcacaaaccacttaa

SEQ ID NO: 11909 - DNA, 960 bp, Glycine max
  Peptide Sequence Number=SeqID_128687
atgcgcgcccccactgtaagaaacctatgcaccctcagcaacctcttactctcggaggtgttaacctgcaaacgcaacaccatcgttgtcccctccacaaaaccttctcctgaatcagaactcgaccttgctcgtgacacttcgcaaggggattcgattgaagaaagtgaggatactaaagagctttctgatatatggtgctctaaagaagacaagaggtctgcttcagaggaaattgatgatgatgacgagaaaaggcaaagagctgtagatataccgtggataccgggcctgtctcatggtaaattgtgggtgaaacggaaggaggtagcgcataaactaggagcgggaaagaccgtttatgtgtttggtcacttgggtcgagaaacgggtgtgaaagagtacaatgcattgataaaaatgtgcataaagaaggcaagggcaactgacgatgaattcattggtttgatacaacttttcactgatattatcaaagctgagaaccctagttcagcttcacaattgggttactacgaaatgttgctgtggttaagagttggcgatgaagaaatgatccaggatatttgtgaatatattacagtcgaaactagtgaagacacatctgctttacgagaaagttacttgatggctctttgggaaagtgataggaaaatgcagattttggatgtggtgaagaatatagacatcacagagctttcatctgaaaaatctattgctgatatattccaatcattaggcaggttccagctggaatctgttgcggacgatttacttttggatttgagagcacgtgggggttggacacattggtgcattcttgtagggaggatagtgtatagagggagtgaacaaaggggaaacaagatggagagatgtgggaatgggttggtgttcaaagggcaaggcgggggcagtgggctaaaccaatattctcaataa

SEQ ID NO: 11910 - DNA, 201 bp, Glycine max
  Peptide Sequence Number=SeqID_128688
atggaaaaatccgacaagaaatatttcaaagataagaaagaaaagaaagcatacattacttgggaagataatgacatggattcatcaattgattcaaaaaatgaaatcataaatttgggcctcatggccaaagactatgaaagcaaagaagagatgcattcaatgactagcaaaaagaatctatcaaacttgccaaattaa

SEQ ID NO: 11911 - DNA, 258 bp, Glycine max
  Peptide Sequence Number=SeqID_128689
atggaggagtttgatgctttggtggcctggccaagagaccagccctattcctctggagagggtggggcctctgcagcccaggagcctgtgactgaggagccaccagcaccagcaccatcactgggagcaggagagaaggagaccactccagatcagaccccaaagccatctccatcctctgcacctgctcctaaggagactcagccatcagcactggatcttaatgaagaccagccacaggaggagcaggacgtttaa

SEQ ID NO: 11912 - DNA, 206 bp, Glycine max
  Peptide Sequence Number=SeqID_128690
atggctaagtttgacccagatatagtcctggagttttatgttaatgcttggccaacaaaagaggaagtgcgggacatgcggtcatgggtgaggggtcagtggattccctttgacgcagatgccctcagccagttcctgggtgacccgctagtgttagaggaaggccaggagtgcgagtttagtcaaaggaggaacagggccgatgg

SEQ ID NO: 11913 - DNA, 135 bp, Glycine max
  Peptide Sequence Number=SeqID_128691
atggttgggcacatcacattgcccccatccccttttttcgtcatacctaagcttgtagaggttaggataagttccaaaaataaggacttagacctaggaatccaagcctttggttttgagtgcgagaaaacatga

SEQ ID NO: 11914 - DNA, 429 bp, Glycine max
  Peptide Sequence Number=SeqID_128692
atgaacgatagtcaccagattaaattagggtatgacagggacaagactgagacagattaccactgcatccacaacgagcttgcggcagacttcgaaggtcatgatggagctttgtggcagattgcaaaggtcatggcaggggagagggagagaagagcacgaaatttagttggagatgatggagagctaattaaggttgacaaagaggcattgcttccaagagaaacctcctcaagcttttggaatggttttattattggtttggtgatagggattgagtttgagtttgcttgggggcttaagagattcttaaggccgaaggcactgctagaagccattgcaaggagtttcaaggagaaaagttcaactaggagaattaaggtcatggcatggactgatgtgatcacggtcgcggttgcgttgtggtga

SEQ ID NO: 11915 - DNA, 606 bp, Glycine max
  Peptide Sequence Number=SeqID_128693
atgtggccgggactgcggacaatgatcgtcatgggagacgcaccgccagcggacgtcgtcacctggtgggccgagcgcacccgattgtgcaacggttacgggccgaccgaggcttctattgccacttcgctgtgcgagtatcgtccaggtgttccctggaactgtattggcaaaccgctgaaaaactaccgttgtcacatccttgatccccaccacaatccactgccggtcggttttgagggcgaactgtgcatcgccggcagcggcctggcgcacggttacctgcatcaagaggcgctgagcgcagagaagttcattacctgtcggctaccgtatatggcggccgaagagcgcctttatcaaaccggtgacatcgccaaatgggacgaacagggcaacattattttcgtcggccgccgtgatcaccaggtgaagatacgcggtgtacgcatcgaaatgggcgaagtggaaagcgccgtccgcagtcaccccctggttgacagcgcctgcgtggtggctcgcagccagccctcgggcaaaattctcgccgccttcgtacaacccgcttcgcctgagctgacgatcgacgcgctgcgtcacgcgttg

SEQ ID NO: 11916 - DNA, 342 bp, Glycine max
  Peptide Sequence Number=SeqID_128694
atggccgatatcgtgtcgagtcagataatcgtgcagcgcgccgacatcggtatgcagctccgagggcgccagataaagcgtcgcaccgctgaccaacgcgccatagacgtcccagccgaaggcgtcgaaacccaacgaggcgatggccagcacgcgactgccttgcgccaggccaatgaaatcgcggtggttttgcgccacgttgctcaggccctcacgccctatcatgacgcctttgggtttgccggtcgtcccggaggtatagcagacgtaggccagtgcgtctcgcgattgagggagttgctccgcatggatgttcagcgaacggtagtcaatgcttga

SEQ ID NO: 11917 - DNA, 291 bp, Glycine max
  Peptide Sequence Number=SeqID_128695
atggcgtgttattccctatggaagtcagaagatgacatgttgaaaaccgcaggctggctgctgcccgccatcctggcgctggcggggtgttcgtcatccggccaacgtcatgagcaaacgcttagccaggcgctgacggccctcggccaggacaaggcgctgattggggcgtcgagcggcgtgatggtgcgcgacgccgagagcggcaccgtgctgtatcaggcgcaggcggagcagcgtttggcgccggcttccaacatgaagatgttcacgtctctggcggcgttcggc

SEQ ID NO: 11918 - DNA, 576 bp, Glycine max
  Peptide Sequence Number=SeqID_128696
atgagcctcattgaaaccacgttgaaaaaatgggatcgcgccgcgattgtccgctcccgtcctcgtcgccttctcaacgaacaggacagccaatcaacccttttcttccccttggaacgtctgccgctgtgcctccatccgcgcgttgccgcgctcggtgaacaagcattgcgctatattcaggtgcaaaccctctaccactacctgaatggcatcgccaacatcgagttggatatcatcaatgattccagttacaagctctacaaaaacgcggtcggcgtagactttccgcttgaaatgcgcttagacgcgctgaccgtggtcgtggatgagtcctatcacgccctggtggcgctggatctgatcaatcaggtagagcagatgacgtccattgcgccgctgccgatgccaaaagacaccgaggcttcctatgccctggcgcaatcgttggcaatgggggacgaacggctgcgcgaactgctgcgactggtgtgcgtgtctctgtcggagcaggcgctgacgaccgatcttatcgatgtgatcaacaacgaagatattttcccgaccttctatctg

SEQ ID NO: 11919 - DNA, 180 bp, Glycine max
  Peptide Sequence Number=SeqID_128697
atgtcgaaatgccctaggtgtggggtatcacggtacaaactcaaggatgataaggagtgtagtagtgatgaaaacttaaacaagggcccccccagcgaagatgacgcaaaagaccttacatggcatgcaaatgggagaaactgcgacagaatgcttcatcatctagctgattcctcgtag

SEQ ID NO: 11920 - DNA, 165 bp, Glycine max
  Peptide Sequence Number=SeqID_128698
atggatggcaagcccaagccctgcaggctttgcatgatgatggactgccccctgtatataggagctggaagtggtatctgtgtagatgtaggaggaataactggagctgaggaaggtactggagctgtggaagaagaaggagctggtgtctcaggtggtgcctaa

SEQ ID NO: 11921 - DNA, 288 bp, Glycine max
  Peptide Sequence Number=SeqID_128699
atggcatgtccggaggggcaaaaagttgcttttggaacatacactctggtggaagaagctgagtattggtgggagaatactcaccaatgcctagatgataaaggtcaagatgtgacctgggatgtctttgtgaatattgcttcaacaaacaaagccttgtttcaagattcactaaagatcaagccttgcctcaaaacaaagggtttcaatgtcatgcaaggctctggtaatcgattaccaggaagtgtaatcgattaccaggagggaagaatgaaaaagagctgttga

SEQ ID NO: 11922 - DNA, 258 bp, Glycine max
  Peptide Sequence Number=SeqID_128700
atgagtgacaaagaaaatgcttgtgcattgctggttatgggaaagcttggaggggttgatggggacccggtgctgagaggaacgtggataagggctacgtgggagtgtgtgaactcagttaagaggtgggcaactggggatgagtggtacctgaagatatgtcgcgggggtcaggagaccttggggacgtcaggtggggtgctattgcccaaaaccaagcttgaccaatcccgacccaacccgggcatagtcagttag

SEQ ID NO: 11923 - DNA, 468 bp, Glycine max
  Peptide Sequence Number=SeqID_128701
atggtatggaattacctatgtgcaaaggatagagctattggactcggagcagaaaatgcattagatgaagatgatatcatgagtaaagaagcaaatgaagaagaaacaattcacagtgtgagtattgacttagagggatcaagttctgccacaaggaaaaaaattcgcccaagtaagagtggagagaaagaaaggatgatttcctcaatgaaagaagtagccgagtcattgaaagaatttgttaaagtgactaagaagaagatgaagaacaaaaaaaagatggagataaaagaagctcaagaagtggtacatgaagtggtgaatgagctagataatatacctaattttaatggtgcacttcaacatagagcaatcaattggttgacagaaaatcccattaggtttgtgattataaaagctctcccattggatgagaaggaggattacatctcatcttttatgccttga

SEQ ID NO: 11924 - DNA, 312 bp, Glycine max
  Peptide Sequence Number=SeqID_128702
atgaatttattgcctagcgttgttcatgtgtcctccaccttcgagtctagagccccgcgaattcattgcctagcgatgttcgccaattctccattctccacttttattcggagaccgatgaattcattgcctagcgctgttcatgtgtcctccaccatcgagtctggagcccggcgaattgattgcttagcgctgttcgccaattctccattctccaatcttatttggagacccatgaattcattgcctagcgctgttcatgtgtcctccgttatcaagcgcggagcctctgaaaaaaaaaagaaggagtag

SEQ ID NO: 11925 - DNA, 730 bp, Glycine max
  Peptide Sequence Number=SeqID_128703
ccatcctaggaagatcctcatgaaagatctgacaactcttgctcaggtttggagtgttctctcatactccaacctggctccgacttcccacacctctgatttgactttagatagagctaggttaatctttggtctagtctctcagttggacatgaatgtaggagctctcatctctggccagatcacatctatggctcagtctaactcctctacacttgggttccctgctcttatcacaactctatgtaggtccagaggggttgcttctaacagcctagtcttcgaacgcttgagcccggttattaacttggcctatatcaggaagaactgttggatccctactgatctggcagttactattagaggggctaggagagcaaggacaaggccagctaaggctctttccacatctgcaactcctcctctagcacgtacctcagcagctccttctaccccatctttctacagactttcaacgggggtacgaatagcaatctgcccacttgggccttccagatccttcctccagaagactgttgcttctggaggaagcaaccttgctcgcttgggtgagctgggtggcaagctcctcccctattttgctataaatagggggaggagtgaagaagaaaatggttcagccttcttggcacttctccctctcttgaaattgctgaggaaaattgtttccgtgaagaaaatccaagccgaggagcttcctcttcaacgg

SEQ ID NO: 11926 - DNA, 375 bp, Glycine max
  Peptide Sequence Number=SeqID_128704
atgtcgatctccccctgcgaaagtatcagttgggatcacgcccaacaaacaccaagtggacccagagaagtccaacagggccctggggtttccagctctggttacgggcctctgtcaatcctacagggtgcccgtcccccccagcgagggatcgcgtccgcaagacacccagtggacccaaagaagtccaacagggtcctagggtttccagcttggattacgggcctctgtcagttctacggagtgcccgtggcccccagcaaggtcatcaggccctctattaaccggactttcatcgagaagaacagtgccccaagcaggcgcagggtgaggcatcatagtagtgggcaacaagcacaccgccaccacctctag

SEQ ID NO: 11927 - DNA, 178 bp, Glycine max
  Peptide Sequence Number=SeqID_128705
acccattccatcccaggcctctttgttggggacgctggaggatttcaaagtccccacacgtgaaccactgaacgtgggtggtctagtgcccccacattgttccttaaaatcggttgtctcggatgacgcttgccctggcgcttgctttgttcaacgcgatgctactactcttagttag

SEQ ID NO: 11928 - DNA, 276 bp, Glycine max
  Peptide Sequence Number=SeqID_128706
atgtggaatcggcatagacttaaaggagcactcaaactgggtgtatttacccccgaggtctacactctgaagagtccgtcagagtctctccctcctgattcaggtcaaaacacgaaaacatcaagaatactcaagtttatcaaccaattctcatcagaacatcaattgttttacccagacaagttttgggtgtctagggaaaaagaaaagctcaatgcgagggacatttcttccaccgaagactttatcttcaaaatcccaatggtggttctgtga

SEQ ID NO: 11929 - DNA, 219 bp, Glycine max
  Peptide Sequence Number=SeqID_128707
atgggtaggttacaaagattatatgcatcaactgaatgtgcaactccaaagagatggcatgttcaaaatagaacaaatacaagagtgatatgtcatccatctaacgagatagcatggaaacattttgatagtgtttatccagactttgctactgatccaggaaatagcattatctcccgatgttcttcagcacaaggtcccttaaagcaattcacctag

SEQ ID NO: 11930 - DNA, 216 bp, Glycine max
  Peptide Sequence Number=SeqID_128708
atggaggccatgaaagaccaaatgaccgccatgatggaggccatgttgagcatgaagaaaataatggaaagcaatgcggctgcagttgccactaccagcgtcgccgctgaggtggacccgactcacccatcaggcctcaatcaagtaaatcctccaatcccgaatatggtacgtgttcgaacccgacaaatgcaccgaatcgcgcaagtagtataa

SEQ ID NO: 11931 - DNA, 177 bp, Glycine max
  Peptide Sequence Number=SeqID_128709
atgtcaacctctactcctttagagtctgttgcacaatttggtgcctttgtaatgatccctacactaggttttgtccagaaacttgttgcttggaaacctgaagatgaatatcaagttaaggcaaatttcaaatctaaaggattaaagcatctatctcaaatgcttttagaggtgtaa

SEQ ID NO: 11932 - DNA, 405 bp, Glycine max
  Peptide Sequence Number=SeqID_128710
atggtaatcgattaccagaggctaatttccagataccagccaagatacatagctggccagccaccacacaagcctccttgcttcgtggactttgttcttttattggttgactgccaggagctcgcctgcttaggaagactgactcttccacgctttctcacatcaagcttattggattatggggcacccgtcatatgtggtactaggtggcgatcgggcgatgacgcaaatcaactctctcacttccacaagtcaaacataaacacaccatccccagttgcccaccttcaaattgagctcacgcactcctacgtagcccttatcctcgttcctctcagcaccaggtccccatcaacccctccaagcttccacaatatcccaacaattcaattccaattatcatga

SEQ ID NO: 11933 - DNA, 723 bp, Glycine max
  Peptide Sequence Number=SeqID_128711
atgcgcaccagcatgaccaccttgacccagatgtggatgacattgctgctcagcaatgtactgcccaatgatcataactccgaccttcctctgccgaagtgtcagttggtgtatgccatcctgacacggatgagcgtccatgtggctcagttgattgctgacgccatctatttatttgcaggcatgccacccaccagacaccctctagacccggataagtctaacagggccctggggtttccagcattgatcacgggcctctaccagtcattcggggttcctgtcacacctagtaaggtgatccgatcgccgatcacccgagccttcattgaaaagtattgcacgcctaggcaggcgcaggatgatgcaccacaggccgcagacgcatcgccaccacctcatcaggctgatcttgctgggtcattaggcatggcgcggcatctacagcacttggtttgccaacaggcggccaaccaccgggggcaggtacagatacatgagtgtctctaccagctcagcctcaatcaacagggtcagagtttctctccttttgcatgccctactccagatcagtttagggctgaggtcgcatggcccagagattggcccgaggcccaggcaggggaggcgcctgcaagagctcccggtgatgcagaggaggcccgcatggatgaggagatgacaaacttgctcgacttcttgggaggaaacggagccacgtga

SEQ ID NO: 11934 - DNA, 426 bp, Glycine max
  Peptide Sequence Number=SeqID_128712
atgcggagataccttacggttatccgcacccttttgtcatccagaggcggcgggcccgatgacaagcagcggccaatgtggtcattctgcacccttgtttcatccagaggcggcgagcccgatgacaagcagcgcccaatgtggtcatctacacccatgtgtcatccagaggcggcgggcccgatgacacgcagagacaaaatttggtcattctgcacccttgtgtcatccagaggtggcgggcccgatgacacgcggagataccttacgattatccgcacccttttgtcatccagaggcggcgggcccgatgacaagcaggggccgatgtggtcattctgcacccttcgtcaatcgcggccgacaagcccgttgacatgcggagatttacatcatcttccgcacttgcaagatctgtcacactga

SEQ ID NO: 11935 - DNA, 960 bp, Glycine max
  Peptide Sequence Number=SeqID_128713
atgggatcgagtcaggcgccttcgcttaaaaagaggttctatcaagtcaagatcaagggcctaggagtcgccagtctgaaagagttaggacagttgatgggtcagctccagcgacaagcctttcgcaaagcttatggtaagatctgggacctaaccatggcagaggtctccacggaggccattgcctccctcgcccaatattatgaccagcctttgaggtgcttcacctttggggacttccagttaacacccacggtggaagagtttgaagagatcctgggatgccctctgggaggaaggaaaccatatcttttttcgggattctatccttccttaggtagaatttctaagatagtcaaaatctcgacacaggaattggaccgcgggaagcaagtcgaaaatggggtggttgggggtaccaaggaaatgtttggaagcaaaggcgagagtcttggcaagtcaagaggaatgggccccgttcatggacatcctgagactcttgatctttggggtggtcctctttccaaatgtggatggaacaacgcaaggatcgtttgctgtacaccggctctctatgtatggttggtttcgcacttcttttgccaagagatgagacatgtttgcccgctagaaggccaccgctcatgcaccgagaaaaaagaggcaaactgggaccgactcttagcaagcaaagaaggagtgtctgtcaattggttcccccgatggaaggaaggaagaaccgggattcttattttgtgcgggaaatttccaaatgttcccttgatggggacgagggttttcaatagcaccaacacgggggtgcttcagagggtccacaaggcatgggaaatgttgcaaaggaaggacaaggaacttagggggagtagcaacgggctcatcggcggttaccataggtggttgaaagcctacgcacaagatctggattggctcccgagttaa

SEQ ID NO: 11936 - DNA, 207 bp, Glycine max
  Peptide Sequence Number=SeqID_128714
atgttgtgtcgtgacgactcccgcgggacaccgtctccgggcccccgggagtcgcacttaacagatttgagttccttggcgcacgaagcgccggggtttgtgtttgtcgcgaggacgaggaggccgggcgcacggggcgccgtggtcatcccctccctcccgacggttcacctacggaaaccttgttacgacttctccttcctctaa

SEQ ID NO: 11937 - DNA, 879 bp, Glycine max
  Peptide Sequence Number=SeqID_128715
cgcgcccgtcagttcatcatggcgcttctggccgccagccacatgacgacgcgtggctgcagcagcacgggctggacgacacgcagcggcagcagtttctcgccctctgtccacgccagctggaaaaaacgcagcgctggctgcaacaggcgcaacatcatctgatcgcctgcagcgatgcacattatcccgcccggctgcgggaaatcagccgctatccggctgccctttatatagcggtcgtcactgttcaccgtatggcagagaatggggcagctgggcaaaaccctggccgtgctgggcagcgggctgaatcatctctatccgaaaagccatcagccgctggcacaggagattatcgccaacggcggcgcgctggtttcagaactgccgctgtcaatggcgccccatgcgcgtcactgaagagtggctcgctggtaacggcgcggtatgcgctggaacaaaaccgtaacgtgtatgcgctgcctggcgcgctgggtaatcccggctgtgaaggcacgcactggctgattcagcagggtgcgctgctggtggcgcatcccaacaatatccttgaggatttgcattctgccctgcaatggttgccggccagcatctcagaaacaatatattcacaactcagtgatgatgtgccattgccatttcccagcgtgttggctaacgtaggtgatgaggttacacctgttgacgtcgtcgctgaacgtgccggccaacctgtgccagttatcgcagcgcaattgctggagctggagttagcaggatggatcgcagctgtacccggcggctatacgtatatccacaacgaggctgaaatgcgcgttgaccaggataaattgaccgatgacttaaccgatgccg

SEQ ID NO: 11938 - DNA, 570 bp, Glycine max
  Peptide Sequence Number=SeqID_128716
ggctgcacgccctcaccttgggtactagttaccctcaccgtcagaggactacacgtcctcgccttgagaggactacacgtcctcaccatcagagggctgcacgcccttacctccagaggactacatgtcctcgccttgagagggctacacgccctcaccttgggtactacttaccctcaccgtcagaggactacacgtcctcgccttgagaggactacacgtcctcaccaccagagggctgcacgccctcacctccagaggactataagtcctcgccttgagagggctacacgccctcaccttggaggactacacgtcctcgccgtcaaagggtcatgtgccttcacctttgtagggctacatgccctcaccttcagaggactacacgtcctcacctttagaggactacacgtcctcgccatcagaggactacatgttccccattttcaaaggggggcatgccctcaccttcagaggattgcacgtccttgccatcataggactacactccctcgccttcgaaaggcgacacgtcctgaacttcagagggctacacgccctcgcctttag

SEQ ID NO: 11939 - DNA, 713 bp, Glycine max
  Peptide Sequence Number=SeqID_128717
atgggtgagacagaggaggtgcaagagcgaatgaaggctgacacggaggccatgaaagagcaaatggccacaatgatggaggccatgatgagcataaaaaagataatggaagtcaatgtggctgcagtcaccgctaccatcgctgttgctggggtggacccgactcccccatctggcctcaaacaaataaatcatccaacctcagatgtgggcggcccccattttgtgcaaattcacaacaagcacgccttcccgccatatgatttgccttccaactatacaccacccaatttggcgcatactcccattgagaatgtcaataactccactcctatacccattgagagccaacaacctcaatctgatcatgcacatgtctctcaacccatgggggagacacatgaagtaccccaccacaatctagttgacattgagccttgcctcggatataccattgaggggcaagcagttggtggcgtacccctgccaaacactctggagggccctcaaattagcccacaaccacaacccttgcattttgcggtgggaagagtgcctcctgccatggtgaaaacggagaaattggatcacctagaggaaaggctcagggccgttgaaggaggtggagattatgcctctgctaacctagaagagttgttcctagtacccaactttgtcatccctcccaagttcaaggtgccatactttgacaa

SEQ ID NO: 11940 - DNA, 237 bp, Glycine max
  Peptide Sequence Number=SeqID_128718
atggataaaacatttagaatttacaacaaaataattatgatcattgaagaatctatccatgttgcctttgatgaaactaatcctataaggccaagaaaggaaacttttgatgatattccatattctttagaaggtatgcatattcatggtgatggtcacaaaggcaaaggaaaaggaaatgatgaagactttcaaattgacgaaacaaaaacaagtacagatctcccaagagagtga

SEQ ID NO: 11941 - DNA, 159 bp, Glycine max
  Peptide Sequence Number=SeqID_128719
atggttgtcggtggtggtggagggtctagggagaggcctcaggctcatatcttgtttttcaaccatcacagagtacctatgattgaagaatcccacgaagatgaaccaaagacaatcctaatgaggaaagttgtcaaggagttagtcctcagagattag

SEQ ID NO: 11942 - DNA, 522 bp, Glycine max
  Peptide Sequence Number=SeqID_128720
atggcctccatcgcccagtattatgatcagccgttgaggtgcttcatctttggggacttccagctatcaccaatggtggaagaatttgaagagatcctaggatgtcctctagggggaaggaaaccatacctcttctcaggggagtcctctttccaaatgtggatgggttggtggacctggcagcgatcgacgtttttctcgcctatcataaaggaaagtccggttgtcgctatgctagccgacctatatgacaccttcgaccgaagatgtgaagaaagcaatgcaaggattgtttgctgtactccagctctctatgtggggctggtttcacacctttttctccaagaaggtaggcccgtctatccgctacaaggttaccgctcgtgcgtcgaaaaaggaaaggcgaattgggaccaactcttagctagcatggggaggcgtctgttaattggttccctcgctagaaggaaggaagaatcaggattctatcttcatgcgaaggatgtccaaatgttcccttga

SEQ ID NO: 11943 - DNA, 591 bp, Glycine max
  Peptide Sequence Number=SeqID_128721
atggcttcgaggaagctttccgcaaagagatctaggagggacgccacggccgaaggaaccagtgccgctcccgagtttgacaaccatcatttcaggagcgccgagcacctgcagcgtttcgaggccatcaaaggatggtcgttccaccgagagagacgcgtcccgctaaggataggcgtgcgggacatgcggtcatgggtaaggggccagtggattccttttgatgcagacgccctcagccagttcctgggccattgcccaactgttatgcataccgggtcaggattttgcccggaccgctgccgggaggcgggtgcggatcatgcgcaccagcatgaccaccttgacccagatgtggatgacgttgctgctcagcaatgcacccctctagacccagataagtctaacagggccctggggtttccagcattaatcacgggtctctgccagtcattcggggttcccatcacacctagtaaggttattcgaccgccgatcacccgggccttcattgagaagtattgcacgcctagacaggcgcaggcggtatttacagcacttggtttgccaacaggcggccaaccacagggg

SEQ ID NO: 11944 - DNA, 159 bp, Glycine max
  Peptide Sequence Number=SeqID_128722
atgactcctatgcagaagcaagatgtcttgatgatgccaaaggatcaaaggattcctgaacacaagggaagggttgtccctgtgtggttcagactttctaaaaggagttttacaaagagagtggaaatctcaagtgggttgcttgaggactggacgtag

SEQ ID NO: 11945 - DNA, 1053 bp, Glycine max
  Peptide Sequence Number=SeqID_128723
aattgcaactgtggtcaaggattcagcaagaggtttggaccgcataaaacagactcggaacggcatagcgggcctaccacagaagtacctagaagacaaggcgaggggtatggccaatcaaggagactgggtcccgtttatggatgtgttagctttgctaatttttggggtcgtcctctttccaaacgtggatggtttggtagacctagcagcaatcgacgctttccttgcctaccaccatagcaaggaaagtccggtggtagctgtcttggcagatctatttgacacatttgaccgaaggtgcgagaagagtagcgcacggatcatctgttgcttacccgccctctgtgaggtagaacaatcagttggttctccccgatggaaggaaggaaaagaaagagtccttttctctatgtgggaaggataccccaaacattccgctggggatttcggcgcacaaaattccaagactatacaaagaatccataaggcatgggaaaccccattaaggaaagatcaagaacttagaggcattcgtaatggcatcattggtgggtaccacgaatggctgaaagttcatatacgaggtttagattggctccccaagttaaaagtcgtcagcaaagagagttttgaagcaccggaagaggacgaagaagtccaagctctcaaaagcgagttaggaaaggcaaaactcgccaaggagaagttcaagttggctgctacacacgttcggaaggagtgtgccgggttacgggaagagaatgcaattaccgcaagagcccttgaacaagagaccaagagggctcgcaaggaagagtatggccggaacaaatttcgcggagctctatggggtagcaataatgaactcaagttgcgaagggaagaaagggaccagtcgcgagcacatagcgtggttctgaaagaggagttgattgcttgttcaaggtccaaaagaagcttgtctcagcgtctatgcgagacagagaccaacatgttagctatcatcgccaagtaccaagaagagttaggtctagccacggcccacgagca

SEQ ID NO: 11946 - DNA, 414 bp, Glycine max
  Peptide Sequence Number=SeqID_128724
atggacaagactaggaaggcatgccatcttctgttaaggttcttggtcttcttggcaacgcttgcagcggtgattttgatggctactagccatgagacagctaccatcttcacagtgacctttgaagcaaaatacaccaattcccctgccttcaagtactttgtgactgcatattctgttatcactgtctatggatttttggtgctctttcttcctgcaaaaagcttgctatggaaattagtggtggccttggatttggaaagaaactccaatccattttatttttttttagttaaaaatttagaacaacatggtgcccctcttccaagacagggtaagccttcgggagttcggattaaaaaatacttacaaatattcttccacttacctcacccaaggaaacgagatgagtga

SEQ ID NO: 11947 - DNA, 396 bp, Glycine max
  Peptide Sequence Number=SeqID_128725
atgtgggttttaatttcttggtctcattttcaaacttgtggagttgaatttgagaacaagaactacactgtcctcacaagccaatgcaagggaccccagtacccacccaaagtgtgctgtgaggctttcaagcaatttgcttgccctttttcaaatgaggtcaatgacatgacaactgattgcgccacagttatgtttagctacatcaacatctatggcaaataccctcctggcctatttgccaatcagtgcaaagaagggaaccaaggtcttgattgcagccaagttacaccaaccaacacttcttccaacaccattcatgtggctgctcctcctcactttttctcacttgctaccatttctgctttcctgggattcttgttccacttgttctga

SEQ ID NO: 11948 - DNA, 285 bp, Glycine max
  Peptide Sequence Number=SeqID_128726
atggaaggttcccaacaaaacactcactatcctaaggaaaaattgcctaaaattattacacacaaatggaagtttggtaacctattggaggctcctaacacacttccaatgaaaggcctttttgttacaaaacttgaaagcaatgaagtgcttcttagtccaatagctcttaaggtggttggccccttgcttcaggactcaaattcttcaagggatggccccaatcctccttccaattccctatatggcaacccacaaacaaggaaacaaagagacaagcaataa

SEQ ID NO: 11949 - DNA, 461 bp, Glycine max
  Peptide Sequence Number=SeqID_128727
atgaattcatcctccatttatattcttgtctttgtccagctttggttgttgagcttaccatgcagagagagtgtgtgcatcccaagtgagcgtgagacacttttgaagtttaagaataatctgaatgatccttccaataggctttggtcttggaatcctaataataccaactgttgccactggtatggagtcctctgccacaacgtcacttcccatcttcttcagcttcacctcaactctgctttctatgagaaatcccagtttggtggagagataagtccttgtttggctgatttaaagcatttgaattacttggacttgagcggcaatggatttcttggagaaggtatgtcaattccttctttccttgggacaatgacttcccttgactcacctcaacctctctcttactggattcagggggaagatttcctcctcagattgggaatctctcaaatttg

SEQ ID NO: 11950 - DNA, 453 bp, Glycine max
  Peptide Sequence Number=SeqID_128728
atgggtccgcaatctaccctaaggctcatgagaaccctagggccttctcttgtatctctggctcaatctacttggagtcttctatccaatgcccttttatgtacgaatcctgaccttggttgttgtcccctttcgattaccctccccaccctcgttggcaccctcaacatatcccacaaccacttcatcgacaacatcccgttctccctcaaaaccttcttagttaccattagcctcaacctccactacaacaatttaaccagagaaatccctcaggtcgaatttccctggaacccaatggctccaaaatcaagtgcttcgattaattaccagatgcaatcctaccccccaagggcattggatagaagactccaagaagatttggccaaagatgcaagagaaggccctagggttctcatgagccttagggtagatttcgggcccatgggctaa

SEQ ID NO: 11951 - DNA, 264 bp, Glycine max
  Peptide Sequence Number=SeqID_128729
atggcagttgccaaggcaatcgacgaggctggcattggggacgaactcaaagacgaggaagatgacgacaaagacaaagatgcaaaggagtttaatgtcgcgaacgacaacatgagaagtgggtttggtaatgatgtaagctccattggagcttgtaggtctaggatcttcttcatcaatggattcatttgcttcttggaagatgaatgtcagcggaatggagaaggaagagagagaggagacgccacttcaaggagaatatga

SEQ ID NO: 11952 - DNA, 1030 bp, Glycine max
  Peptide Sequence Number=SeqID_128730
atgggtaaatgggatcatcgtccgtcgcgaaggttcttccgccgtcgaagatctccggtgcgtcccccgaccttctacgacatcaatgcccctcttcctgagtattggcaggacggaatacccttatgggagaagaaatactgcactatagttggattggtaccgtggcagaaaattgttgattcaaagatgtttgtatactgccacagtaatgtgtttgattggaatgattcagccgctgaagaagctttacaaaatgccaaaaatcattactgggcaaagatcaacagccttccctgtgatatttctctgcctgatccagatacttataatgatcaaatagattggaatccttatattgatccggatatgattaaggaaatagataaagcattctttactgtgccagatgaggaacaagaaactgccattaaaaacaaaagaacaaaaacttcagttaatgatgaaaatcctttggaatgttctgatacacctcttagcagagctttagaaaataatgaagtgcaaagatggaatcagggaaactctggagatgtggataatactgacaatccatgggagtgtagtgttactcatggaaatggaagattaactgacaatgcttgggaaggtggtcctgttaagtcttggggttggaatgaaggaagggatcacaaccagtgtaaggattggaattctgaaaacttacaggataaaggatggggtaaagccagggacagttcttggtgccagcagcagtcaaataatttggctaactttggcaactcttcttggcaatgcaaatccagtcaacagaatgtaactccattgaagacaggatggcgaaacagtggagcaaatgggtcaggatggaagcaacaggaaaaggctgatgtttctagaaggaattatggaggttggactgctcagaataagggtaaccagtggagggaaggctctcattggcatacattaggctccaatggctctcagttccaaagggatggttgtcaaacgggtcattactggg

SEQ ID NO: 11953 - DNA, 276 bp, Glycine max
  Peptide Sequence Number=SeqID_128731
atgtggttgagcttaacttgggaaggcataaatgagttggagtatgacgttgaccttgggggatgtctagtttggaatctctatgtagctcatgttgatcacatgggttggagtctccttgcaagactaagttcattactacatgtcctcccgagcttctttcacaaattttttccggtaccacgtgcatatgagaaaagactctttaagggcatgatgagagatatatctagaatgacactattgagtacaggctataacaaatatttcctttaa

SEQ ID NO: 11954 - DNA, 315 bp, Glycine max
  Peptide Sequence Number=SeqID_128732
atgaagtgccaaaagtgtcagttgagcttacctcatcagtgggctaagtgcgcatccaccgctaagcgcagcttcatcgcacttagagcgacagaagaatctggcagggcatcagcatcaaggtcgcgcgctaagcgtgagatcagtgcgctaagtgcagcagggtacaatgcccagggcacaaaattccatagacaccatagtgcctatttcaggaaaatagctctagaggcagcaagaggagcagcttttgcagagatacctaggttttgtaagctttttattgttagggtttcttctgtaatggctggctaa

SEQ ID NO: 11955 - DNA, 237 bp, Glycine max
  Peptide Sequence Number=SeqID_128733
atggaccaattaaagcacttaagcatcccctcaggaatgcttagattctctaaccacgctagttacccacgtctgggccattcgacaaggtcagtgcactctacccccccaggacatacacttcatacgacgtatgatcgtggccaaaagctagtgccaaagaccctggaaggtcagtgcatagtgccccccacgatcatacacaacatccaacgtatgaacgtggccaaaagctag

SEQ ID NO: 11956 - DNA, 153 bp, Glycine max
  Peptide Sequence Number=SeqID_128734
atgactcaattagtatcacgaggacatcttagagttggaccgttacgatttcttgaagcaagacttatgagtcaagtatacgaaagtaagaaagatcatgttgaaggaagaggcttagactcaaggatgttcgaaaaagagtcgaccatgtga

SEQ ID NO: 11957 - DNA, 259 bp, Glycine max
  Peptide Sequence Number=SeqID_128735
atgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtggtagtagcaatattcaaatgagaactttgaaggccgaagagggaaaggttccatgtgaacggcacttgcacatgg

SEQ ID NO: 11958 - DNA, 336 bp, Glycine max
  Peptide Sequence Number=SeqID_128736
catttcgtttctaaacgaccatttagaggaaacactgggtccaacaaaaataggagaaaatcactcaaagtgtatcaatctcacacagtgtgtggcgagaaagttgctagcgcacaggattttgtcggcaatcaaagggagaggaccactttaggtcgtggtttcctttttcttgttcacttgggcgaggattgccattctcaggtttatgataagttgggattttggctcaaggcttgtagaacggctggtcatgatatatgtcagggtttggccagcggttcggggataaaggggatgtcctacattatttccatgatacacatgcaacaatga

SEQ ID NO: 11959 - DNA, 675 bp, Glycine max
  Peptide Sequence Number=SeqID_128737
atggttcaaaaagcaattgacaaaggaagattgaaatccgaagagaaaccaatgaaggtggatactgatccattccacatccaggctaattatatcaaacccatgcaaaccatgatgatgggagctttgataggaatgccaagggtgagtactcttttatctgaagaggaggtcaatcaagccttggaagaatttgaaaaagaagaggaatcagttttcttgcctacaagggaaacattggttggatttctgttaaagaaacagaaggctgaaaaagaggtaatgttgtgtcatcgttgtagcgtcgtgttcgacaagtctactaaggctttcgaagctttagagattcgaaagagttttcagaaaatttatgaaattgatgttaaaggaaaggagaaacaaaatataaatatgactgagtcaagtctaaaggttcagttctcatttcaaagcattcgaagtgatttggcccttcgaagaggaggaactactgaaggttctaagaaaggatactatgagtaccaaaatcctccatggattgtaggcctaggatcttcttcatcaatagatttctttgcttcttggaagatgaatggcagcggaatggagaaggaagagaaagaggaaacgccgcttcaaggagaagatgagtctagaagaagctcaccaccatag

SEQ ID NO: 11960 - DNA, 379 bp, Glycine max
  Peptide Sequence Number=SeqID_128738
atggagaatatgtttatgcaattcatggaaacatcccaagctagatttaaagccaatcaaaactcaattcaaaatctggagattgaggatggcaagagttactccatggaaaattgttggtgggagaaagagttacaaccttacaatcaatatgaagaagaaagaatttctaaccttgataatttgttgatgcaactcatggaaacatcagaagctactcaacacacaattcaaaatctagaaattcaagttggtaagctagcaaaacaagtggctaaattacccttggtcacaagggaagaaaactttgtagaggttgaagcttatgaggaaagtcttgtagaagagcatgattcaagagaaaaagacgaaggaaaag

SEQ ID NO: 11961 - DNA, 192 bp, Glycine max
  Peptide Sequence Number=SeqID_128739
atgcggaaattgattaaggaaaggatggaaaataaggtggttaatttcgtgggtcttaataaggttaagtggtggctggacagaaatatagaaatggcaataactgaagctacagggctccaaatgaggggattccaaaatgaggtgaaaggtctcgtttttaaagtcaatttaggctcaagaatcacttaa

SEQ ID NO: 11962 - DNA, 213 bp, Glycine max
  Peptide Sequence Number=SeqID_128740
atgaccaccgtgtgctatttcagatacatgctttatatacaaggggaagttgtcattaaacaccctaaacacggtagcatcccacataacctgcaacagcttcaaaaaaagttgtgggatggaataaatgaagcattgggcttgaatccagaattgggcttggacttgaagagagcagactattttattctacaaaattttatcttatcttga

SEQ ID NO: 11963 - DNA, 285 bp, Glycine max
  Peptide Sequence Number=SeqID_128741
atgcaggatggtggaagcagtcaatattgtatcatcatcatgattttgcaaagaatattactcggtgaaagagcagtctatgcaatgatgctggtgtttccacctgaattttctcctttgaaaactattttatttgggaatccttcccaagacaccattgaaccactgatggaggctttggaggaagattataaagatggaaatgagataaatgaatcaaggcagtttattggaggagtattggatcttgaaaagagaatcaatagactagatacattgacttag

SEQ ID NO: 11964 - DNA, 372 bp, Glycine max
  Peptide Sequence Number=SeqID_128742
atgaaagaatcacacattagtaatgagtatgagaatggggtcgaacaattcctgcaattcactgaacgtaatgcacctagtatggatggaaaatttttctgtccatgtgttaaatgtgtggatgggagatgccagtcgaaaattctccttgaagataacacgttgctgaaagatcagtacaaggcaaagaagattttatgtcctgtgggaatggagtaccagaaaatacattcatgccctaatgattgcatattgtacgaaaatcaatttgtcgaaatgtgcaagtgcccaacatgtggggtatcacagtacaaagtgaaggatgaagaatgttgtgatgataaagcaacaaacaatgatcatccaacaaag

SEQ ID NO: 11965 - DNA, 225 bp, Glycine max
  Peptide Sequence Number=SeqID_128743
atgcagaaggggtcccaatctgaaccgtttgatgtagaaatgggagatcggttagaggataagattcgtgatcttggacaagagtcttttcagcaagcacatgtccctatgtatgatacattacaaagtgatttgaagaaacctttgtatctggtgagcaagaagtcattgacgcttttgtcaatagtgttaagtctggttaatgtcaaggctagatatgggtag

SEQ ID NO: 11966 - DNA, 315 bp, Glycine max
  Peptide Sequence Number=SeqID_128744
atgactatgcaaaacatgcagtttcaacaagagaccagagcctccattcagagcttaactaatcagatgggacaattggctacacagttaaatcaacagcagtcccagaattctgacagattaccttctcaatctgtccaaaatcccaaaaatgtgagtgccattactttgaggtcgggaaagcagtgtgaatcttccactggtaattctgatttacagaagcagcatatccctcttccattccatccaagagcaatttccaacaaaaaatggaagaggcagagaagaagatattggaaacatttagaaaagtag

SEQ ID NO: 11967 - DNA, 528 bp, Glycine max
  Peptide Sequence Number=SeqID_128745
atcatttacaatttcctaactaatgagattaccctcactcatcttggcactaaatttgtgttgcatcctcaaacaccttcaccggtggccaaagatcaactaactaagaaagataagagggataaggaagaaaaactagaaaaacaaaagaaaaagaaggatagtaaggccttgtctttaaaggccaatgggaaggaaaaagaggaaaaggattcctccaagaatattgttaagaaggaaaatcatttcgtaacaaaaggtgatatcaaaagagcactccttcttaaacaatctttctaccttctcctatcaagggaaacatcccttagcactgccatacctcttgagcttaaggttattcctcaagtaaaggagttgttggatgagggtttggttcataagagcttaactccttgtgctttgttggtgctcaaaataggggttcccacgaaccctaagagaataaaggtcattcttgagtggcccactccaccaagtataaggaaaattggggcttccatgacttaa

SEQ ID NO: 11968 - DNA, 315 bp, Glycine max
  Peptide Sequence Number=SeqID_128746
atggtggtcaaatataacaacttgaccacccacttagtggatttagaagaagttttcgaccaactcagaaagtacaacatgaggctgaaccccaaaatgtgtgtctttgggggaatacatgctaacctagacaaatgccaagccatcctggagatgaaaagtccccggaatgtgaaagagactcaaagactagttgacagaataacctccttgtcaaggtttttgccaagaattgctgagaaggccagacccattatgaacctcctcaagaccaaaaactttgtttgggatgaatggtgcgaagaatccttttga

SEQ ID NO: 11969 - DNA, 624 bp, Glycine max
  Peptide Sequence Number=SeqID_128747
atgatacgacgtagggcatgctcacacgccttacaatatactcctcagtcatcccttactcaatgccctaggcgtagttgtttcaaccccttacctcgcaatgaagttcctgtcagaagccgggacaatcataattgtgcacatcaaccaaaggacaaccagagaatactacattggcagcctttggctatgtcctcatacaaggggggagccccagaagtcgtccattgcgtggagactaggacgaaaatcaaagaggtggaagaactagagcttgatccaggaactaatgatgacaaccgagtgaagccagtagaggagacacccactttccaactcggacctaaggaaggacaggttatccaggagcacatggacttatttgcatggtctgtgacaaacatgttcgagatcgatccaagctttcactgtcataagttagccatatgtaaagatgcaaagccagttacccagaggaagagaaagatggggaaagagagactacacaaatctaaatcgagcatgctcgaaggatgcatacttactcccaaacatcgactgactggtcgatggagtagtcagacacaagatgttgagttttttggatgcttattccgactataa

SEQ ID NO: 11970 - DNA, 2034 bp, Glycine max
  Peptide Sequence Number=SeqID_128748
atgtcaccacttcaaacatccttcttcgtcttcttcctatgttttctcaatgcctcttcttctattttcgccaccacccaatttgactttgggactttaactatgagcactttgaagcttctcggcgatgcccatttgaacaacaacaccgtcagcctcaccggcgaccccgccgtccccaactccgccgccggaagagccctttactccgcccctgtcagattccggcaaccgggaaccccttctccggcgagcttctccaccttcttctccttctccgtcaccaacctcaacccctcctccgtcggcggcggcctcgccttcgttatctcgccggactcctccgccgtcggcgaccccggcggcttcctcggcctccaaaccgccggcggcggaaacttcctcgccgtggaattcgacaccctgatggacgtggagttcagcgacatcaatggaaaccacgtcggattagacctaaatagcgtcgtttcgacgcaagttagcgacttgggaggcatcggagtggatctcaaaagcggtgactcggtgaacgcgtggatcgagtacgacggaaacgccaaagggttgcgcgtttgggtctcgtactcgaacgttcggccaaaagatccgattttgaaggtggatctcgatgtgggtatgtacgttaacgatttcatgtatgtggggttttctgggtctacccaaggtagcaccgaggttcacagtgttgagtggtggagttttaactcctcctttgattccgcggcggctcctgccgcctcgtcagcaccctccgccacgtcagagcaaaaggagagtaggtcgtctaggaagagtactgtgggggcagttgctggggttgtcactgctggtgcttttgttcttgctctctttgctggtgcattgatttgggtgtattctaagaaggttaagtatgtgaagaagctcgatcattctattgagtcggagattattagaatgcctaaggagtttagctacaaggagcttaaattggccactaaggggttcagtgctaatagggtcattggtcatggtgcttttgggactgtgtacaagggtgtgttgcctgagagtggtgacattgttgcggtgaagaggtgtaaccatagtggccaggggaagaatgagtttctgtctgagttgtctataattggaagtcttaggcataggaatttggttcaccttcaaggttggtgccatgagaaaggtgagattttgttggtgtatgacttgatgccaaatgggagtctggataaggctttgcatgagtctagaatgccgttgtcttggcctcacaggctcaaaattttgttaggtgtgtcgtctgttttggcctacttgcatcatgagtgcgaaaaccaggtaattcatagggacattaagactagtaacattatgttagatgaagggttcattgctaggttaggcgattttggtttagcgaggcaaacggagcatgacaagtctcctgatgccactgtggctgccgggacaatggggtaccttgcacctgagtacgtgcttactggtagagccacggagaaaactgatgtgtttagctatggtgctgtggttcttgaggtggccagtgggaggaggcctattgagaaagatgctcctgctgctgggaatggtaaagttggaattagcagcaatttggtggaatgggtttggagtttgcatcaagaaggtaagttgctaacagcggctgatccgagacttgaaggtgagtttgaggaaggggagatgaggaaggtactcttggttggattagcttgctcacaccctgattcaatggcaagacctactatgaggggtgtggttcagatgctgctgggtgaggctgaagtgcctattgtccctagagccaagccatctactagttacagtacttctcaactcttaatgaacttgcaagatagtgaatctgagtgtaataatggtatgatcaccatctctacctcttcatcagagagcagcttcaatggcagagatagtctgatggaagtctag

SEQ ID NO: 11971 - DNA, 351 bp, Glycine max
  Peptide Sequence Number=SeqID_128749
atggatgccttgaatgaaggttctagtaaggcatgtctgaagacacatttttatatgtggactaataggagacctaacatgaggcacttgttcactgaaaatgaagaaatcaatgggagtatagttccatggaatgtagaaattaaagaagttagagtgcgagatcctttgacttatgcctctagcaataaaaattgccagaaggttgcaagagagttggatgtaaatgggtctttaaggctacaagactctcatggcaacctcgaacgttacaaggccaaactttttgctaagggttttactcagaaagatggtgttgattacaaagacagtttttcaccattctcatga

SEQ ID NO: 11972 - DNA, 264 bp, Glycine max
  Peptide Sequence Number=SeqID_128750
atggttctctccaaaaccgcctccgaatccgacgtctctgtccactcaaccttcgcttctcgctatgtcagaacttcgcttcccaggcattgttggaaaattaagagatttacattaacgcctcaatgtaaagttcaagatggcggaggagtcgataccgaaggaggcagcataccagatcataaacgacgagttgatgttggatgggaacccaaggttgaatttggcatcatttgtgacgacttggatggagccagagtgtga

SEQ ID NO: 11973 - DNA, 348 bp, Glycine max
  Peptide Sequence Number=SeqID_128751
atgactaatgcaaactgtccgcaagaatcattgcatttagtctcaaacgggaatctaagaggtacgacagaggtggatggaatatgtgacaaccaagaaggattaggttgtgagtacaccagtcaacctactgcttccgcaaccagtagacctgacctcttgagtggacctcatgtgccagcaaagggtgtgtctgtctatgatgaaggagtgtttgatgtaagctccattggagcttgtaggcctaggatcttcttcatcaatggattcctttgcttcttggaagatgaatggcaacggaatggagaaggaagagagagaggagacgccacttcaaggagaatatga

SEQ ID NO: 11974 - DNA, 1025 bp, Glycine max
  Peptide Sequence Number=SeqID_128752
atggctctcctcacatcccaacctaaaaaccccattctccatcgcttcaccacccttcactgccctcttccacgcttacatagaaccgttcttggtcttggctccttctctcacaacatgacagccaaagccaatgccaatgctgcatttggagaaggtttcaaggaggaaggggcatcgagacacagaaagattttgttgtcagaggttgaggtgaagagagagaggagagttttctttggcagaaaatggaactctttggattttggcactgctggaattgtgttggcaatgcatctcctttgcgtctttgctccattccatttcaattggccagctttttgggtggctgtggctctctatattgtcactggcctttttggtatcactctttctttccataggaacctttctcacaggagtttcaagcttcccaaatggcttgaatacttctttgcctattgtggggtcctggctcttcaggggaatccgattgattgggtgagcacacataggtaccatcaccagttttgtgattctgagagagaccctcatagcccaactgaaggattctggttcagtcatatgagttggctatttgataccaattctgtcctagaaaggtgtggagaggcaaacaatgttggtgatttggagaaacaatccttctatagatttctccgaagcacttaccttgcccacccttttgctttgggagcccttttatatgccgcaggaggatttcctttccttgtttggggaatgggagtgaggattgtttgggtttatcacataacctggtttgtaaactcagcttgccatgtctgggggaatcaagcatggaacaccagggacttgtccagaaataattggtgggtggcgttgcttgcatttggtgagggttggcacaataaccaccatgcttttgagtactcagctagacatggacttgagtggtggcaaatagacatgacttggtacgttgtgagatttctccaagctattgggttggccactgacgtcaa

SEQ ID NO: 11975 - DNA, 330 bp, Glycine max
  Peptide Sequence Number=SeqID_128753
atggcttcttcaccgctcttgagaggcaaagaattcgtaaccagtggcatgcctgatgatgcaatgaggcgaagtaggtaccatgtgaagaggtgctttgctaagtacattgagaaggggagaaggaccataaaacttcataacttgatggaagaaatggagcatgtcatagatgacaacaatgagaggaatcaattgttggaggggaaccttggcttcttattgagttgtacacaggaagttgctgttgatccgccttatgttgcctttgcagtaaggccaaatcctggagtttgggaatttgtaagagtgagctcagaggatctttaa

SEQ ID NO: 11976 - DNA, 786 bp, Glycine max
  Peptide Sequence Number=SeqID_128754
atgggaactcggtcggaaatactccaagctccagatgcagtgaacctggagaagttttttagcagagttcctacaattttcaatgttgtgatattctctattcatggttattttggacaggcagatgttcttggcttgccagacactggtggacaggtagtttacatattggatcaagttagagctcttgaagccgagttgctgctcagaattaagcaacaaggcctaaatgtaaagccccagattcttgtgaattatgcaagtatattattggccatgacaggaatcttgcgtcaatgggtttctcgctttgacatttatccatatcttgagaggtttactaaggatgcgacagccaagattctcaacctcatggaaggaaaaccagatcttattattggaaattacactgatgggaatttggtagcatctcttatggctaacaaacttaggataactcagggaactatcgcacatgctttagagaagactaagtatgaagattcagatgtcaagtggaaagagttagatcccaagtatcacttctcatgtcaattcatggctgataaaattgcaatgaatgaatcagatttcatcataaccagcacctatcaggaaattgctggaagcaaagatagaccaggacaatatgaaagtcatgctgcatttacactcccagggctgtgtagggttgtttcagggataaatgtatttgatcccaagttcaacatagctgcacctggagctgaccagtctgtctatttcccttacacagacaaagactga

SEQ ID NO: 11977 - DNA, 144 bp, Glycine max
  Peptide Sequence Number=SeqID_128755
atggaaactgaaataaaaacagtacaaaagagattgcagaaagggattgctatagcgtcagctcatacacagtacccattagattcagagcaccgggttgtcaataacttgattataaacatcctgggttatttatatgactga

SEQ ID NO: 11978 - DNA, 642 bp, Glycine max
  Peptide Sequence Number=SeqID_128756
atggcaaggtttgatgttgtgaagaacttaaccgggttagttgagtggtatgggaagaaccaaagactaagaaagatggtgaaccttgtcatagttggaggcttctttgaccctttgaaatccaaagacagagaggaaatggcagagataagaaagatgcatgatttggtagagaagtaccaactcaagggtcaattcagatggattgctgcacaaactgatcggtattgcaatggagagctctaccgcttcattgctgacacaacgggagcttttgtgcagcctgctttgtatgaagcatttggtctcactgtcattgaagctatgagctgtggttttcctacttttgctaccaaccaaggaggtccagcagaaatcattgttgacgggatctctggcttccacattgatcctcacaatggagaagaatctagcaacaaaattgctgatttctttgaaaaatgcttacaagattcaacacattggaacaaaatttctgcagccggattgcagcggataaatgaatggtgggttaacaatgaacaaaaagaggcaaagcaaagatacatcaagatgttctacaaccttatgtacaagaatttggtgaagacaatacctgttccaaatcatgaacctcaataa

SEQ ID NO: 11979 - DNA, 377 bp, Glycine max
  Peptide Sequence Number=SeqID_128757
atgtacatgcatgtacagtttttggctacacataaaggtactttgatggttggattttactatgctacaaaaaaacttgcgtgggaaatatttgatatagatggtcggattaagtacaagattgaagtaccatggcaaaacattatgggcatgcaagccattgtagaagaaagcaagtctgaaattcttcaaattgagctggctaaggcaccaccattctttcgccacattgatccaaatccacgaagtcatcctcaatgggagccatcaaaagacttcactggaggtcatgctttgaaataccggagacattaccttgggtttgctttgggagatcttagcaaaaattaccagaagctcatacaatctgataatcg

SEQ ID NO: 11980 - DNA, 234 bp, Glycine max
  Peptide Sequence Number=SeqID_128758
atgtatcatatattgtgtgaatattctgcatgtgaagactggtataatggagcagtgtcccaacctcaattggcactagcagatcttattgaagttttatttcccactgaaaattacacaacgacctattttaggaacattgcaaaggcagaagtacctataaatattggtcttgaaatgtgtgacagggacacatccacagcaatggagcctaccatagtagcatgtggatga

SEQ ID NO: 11981 - DNA, 2031 bp, Glycine max
  Peptide Sequence Number=SeqID_128759
atggctcctgtttcattgcctcctgggtttaggttccaccccaccgacgaggaactcgtttcttattacctcaaaagaaagataaatggtcgtaagattgagttagagatcatccatgaagttgatctttataagtgtgaaccatgggacttgccagggaagtcattgttaccgggtaaagatttggagtggtatttcttcagccctagagataggaagtacccaaatggatcaaggaccaatcgtgcaaccaaatctgggtattggaaggccacagggaaggaccgtaaggtgaactctgagagccgtgcaatagggatgaagaaaaccctagtttactatagaggtagggcaccacatggatgtcgcacaggttgggttatgcatgagtatcgtcttgatgagactcagtgcgaaactaattcaggcttgcaggatgcatatgctctttgccgtgtgtgcaagaagactgcagtgattcccccaaaggttggagatcagcactatgttaatgttcctagccatgtaaatcagattacaagtgatcaatcatcaagcattgacattgagatatactcagaaggaagaggtgaagttttagagagctcaaattatttgatgccgtgggatacatgcccatccccaaacataaatattgggtctgctctcaatatcaatatcaatggtgggacaagggataataacattgggacatggtcacacttcttagcagaagacttacccaatcttccaacatctgcttcttcatttcccaattatggatctatgagttaccctccatcaaaggtggatatagcactagagtgtgcaaggatgcaacataggtttaccatgcctcctttggaggtgcaggacttccctcaagttggcatttccgagctgaagatggcacaagcctcgggttccaatatgtgtggaggaagcagaaataatgaaacagatatcttgcaggaaattctttcagttgctcatgcttcccatgagttaataaatcagtccaactactcatcacattcacaggcattgggtgccaatgaaaataactatgctgcacctcatgaaagtgattttacttttatggttggcaacaattacaatcgtgtgaatgatatgaacaccatgggatttgttgacaaagcatgggaagaccctaacgcaagatcaatagagatcggggatcttgatgatggattcaagacagagaggatggtggagaacttaagatgggttggaatgtccagcaaaaatatggaaaagggctttatggaggagcaaaagattgtgccgattgagcatatctcaaacttccaaactaacagggaagaaaacgaggtgcaagtaggatctcagcaacacaataacaacaaagaactcaatgacactgacattgacgatttctcaatggggttcatcaatggtgacgaccacaatgagaacttcatagatgagggtaacattaattattcaaattctacaaactttgaggttgttgaggaaacaaaagtcagtcatggaatgtttgtctccactcgccaagtagctgacacattctttcatcaaatagctccttcacaaaccgtgaaagttcaactcaatccattaatggctgaagatcaatctatagagaatgcagtaatggttaaccaagggccccctttctttagaaagttcaaggcctatgtgatggggaagctgacaaagtcatcaaacacaatagcaagtgcccttgtgttcctctttgcacttttgttgatgcattgtgtgtttttgaaggaacaagtggaagatttgaaatcggaccccaaatgctttgatggtgctaactccatgaagaaaattatgagacaaccagctgagaacatcatatggaatgaacaagaaaatttttggtctgttggtattaaatgcgggaaaggatttagtgtggtcttgaagaagataggcattttcctcaccatatcattggctctttgtaccatgtgggctaaccatgttatagttgactcttag

SEQ ID NO: 11982 - DNA, 967 bp, Glycine max
  Peptide Sequence Number=SeqID_128760
atgattttgaacgtggaaatgagatgggtagtggctgaacaaagcaacaagaggtccctctttcagctcatggattcagctccttcttgttcttggctacaagccttctccttcttagcattggtttggttatttaactgtggatgtgtccatggagccaccccagcagtgaaagtaggtaacttttcaaaggtggaagatgctggaaacttccatatttactatggccagaccttcaaagtcattaagaattctgctgagggccagagctaccttcttctccagcttttaggtttagtggagagcttgaaaggcataacctcagactatgtggcttctccatgtgtgttgaaactgtacgaaggaggacagatagaattgttcaataatagtgattaccaaaagcttgcagagttctcttcatactttcttagtgacactgatcagcagccagcttgcaattttgcaacttttgttccatttatagaggatatccctttgcagagagcagaatggatcaaattcatgggagcttttgcaaatgttgaagctagagccaatcaagtctatacagcagttaaggcaaactatttgtgcttggctaaaattgctacaagtaggacaacattcaagccaacggtagcttggatgaggtataaaaatggtctttggtcttttacacaggaaaagtatcaattgaagtacgtgcaagatgcaggcggagagattttgggtgccaacaagaacacttacaatgtctctgatcctgatgacttggaggaatttcatgccatcctatgtaccgtggaagtagtcattgatgaaacactaacatctgatccagtcaactacaccttttcaacatttatccaaaatctaaacgttgaagatcgttcttgtttttcttttatttcaaacacaagtctatggagatatgacaaaagggtttataattctgtagctcttg

SEQ ID NO: 11983 - DNA, 2553 bp, Glycine max
  Peptide Sequence Number=SeqID_128761
atggcattcctccttggcacaatcctgatcccttcagtcaaagaacctctttactcagcttgggagagatgcaacactctcatcatgtcctggcttttgaattcactttccccctccattgctcaaagcgtcatcttccttgaatatgctaccgacatttggaacgaccttcgtgaatgtttttcacagggagatcttctccgcattgcagagctccaggaagaaatatatggtctttctcaaggtaaccgtcttctctctgacttttacactgccttgaaaaccctctgggaggaactggataattatcgtccttttgttacctgttcttgtgaggccaagaaatgccatcagcaggattttgtcattagattcttgaaaggattggatgaatgtttttttgttgtacgttcccaaatcttgtttatggatccccttccgacggtcaatcgagttttctccatggtggttcaacatgaatgtcagcttagtgtcgttcctccttcctctgttgaacccaatagctttgtcaatgcttccaatggttttggtaaaggtcgcagtgtgtctagttcgttgtccaccaacaaaaatgcttccaataaaaagtgttcttactgccaccgcaccggacacactattaacgtctgttgggggaagcacgactatccatcgggtcatcctcactaccttggccgcccacggttcaacaaccgtgactcctcttcttctgccaatagcactgcttcaatcgacccagtggagagaccgactgcctcttcatgccctattactttgacccaagcccaatatcaatctctaatggccttgattcaacaacccaactctgcttctaatgctacagggaacaaccttgtccagcctaatagcgccaatctcattcaagttcccaaggaggcccaacgtgatcctctacctatgccaactaatgcccaaaaccttcatgaagaaaacccaatacaaatgcccaatctggatttaactcctacttacaccacccaacaacccaactttatcccatctccaaaccgacatttaccatcatttttttcaccttcgctgcaatcacaacttccttcaacatctccacaattaagttctcatcaatttaggacacctggttccccttctttcaccattgacactcatttgcaccatagccccactcctacatctactccctttgtcccaagacgctcttctcgacctatcaaacccaatgtttgccttgcagactatatctgtagcatcgagacgcaaccaaatcaatcatcatcaacatgcttgtatcccctccaatctgttttgtcttattccaacatctctgagtctgagcgtcactatataatgaatctatcttctgggattgaacctcaaagttatcaggaagcgattttgagtccctattgggttgaagccatgaaagatgaaattgaggctttaaaactcaacaacacctgggaaatttttgatactctagctgtggaaggaattgatttctttgaaacattctctcccgtggtaaaaatgaccactattcgtgtcatcctcactcttgcttctgcaaataaatggcagcttcaacaactcgatgtgagtaatgctttactccacggtgacttgtctgaagaggtttatatgacaattcctcaaggattgcaaggacatggctcttctcaatgttgtaaactcaaaaaatctctatatggtctcaagcaagctagccgcaaatggtatgaaaagctttctgatcttcttatttcatccggttaccaacaatcacatgcagatcatagtttatttatcaaacacaatggatataaatttacaactttgttgatctatgtggatgacattgttttaagtgggaattttgctgctgaaatggcccaaatcaaaaatattcttcattcaaattttcgagttaaggatttaggagcattgaaatactttatgggtttagaaataaatcactctgctgatggcatatatgtatcacaatgtaaatactatcttgagttgcttgttgattttggaatgatgggttgcaaaccttgttcaacacctatggacagttcattgcggctgcatcaagatgattctagtgatcttcttgatgatcctttatcctataggcatcttgttggtcatctaatttatctctccacaacccgtcctgacattgtttttgcaacccaacaactcagccaattcatggctcatcccacaaagtctcatcttggtgctgcaaggagagtcttgagatacctgaagggttctccaagcaaaggtcttcaattcaagagggacactcttatacatttaattggctttagcgattcagattgggcgacttgtgttgacacccgcaaatcaatcacagaaaaggctcaagcaggtctaatgcggttgctgccagttccatcctctcatcagcttgctgacatgttcactaaggcattaccacctcatctcttcaagtcaaatgtatccaagctgaagttaattgatctttatacacctccagcttga

SEQ ID NO: 11984 - DNA, 2532 bp, Glycine max
  Peptide Sequence Number=SeqID_128762
atgaaggtacatagcgtatgtgcaagtcccactttgtcactttctgaaaggtgcttttctgatggcttgtcatgtacctctgataacttttattcatcgtcatctttcctttccaacactcatggcgtaacagataattcagtgccaagttctccatacattgatcctgataatcatagcaacattgagtcaacccgcattgataaggagcacaagaagaatttgtcctataggtatctgatgcattccacttccccacatgtaggaaaaaataatgtgttgaaagatgtaatgatatggggtggagggattggatgtcttgtagggattgtgaatgaaaggtttgttcagcctagaatttattctttagtgccaaagttactagaatccactgcaatgttagatgttcataacatagctttaggaggaaaacatgctgccttagctacaaaacaaggggaagtgttttgctggggtcacgatttattgattgaagggagaactagaagtcagtggataccacaaaaacttggtggatccttagatggtattagtatctcaagtgttgcctgtggggaatggcatactgcaattgtctctagttgtgggaggttatttacttatggagatggtacatttggggttcttggccatggcgatcttcggagctattcaagtccaaaagaagttgaatctcttagtggtctacgggtgaggtctgctgcttgtggatcatggcatacggctgctattgttgaagtcatgtttgaccgtttcaggtacaatagtgctagtggtaagttgtttacatggggtgatggagatgaagggaggcttggtcatgttgataatggaagcaagcttgtaccaacacgtgttacacaacttgttgactatgattttgttcaagtgtcatgtggaagaatgttgactgtagcactcactaacatgggcaaggtttttgcaatgggaagtgccaaatatggacaactaggaaatccacatgccagggataaagcagtcatggttgaaggacaactcaaacaagagtttgttaaggtgatatcaaccggttcataccatgttgctgttttgacttctggggggagtgtctacacatggggcagaggtgaaaatggccaactggggctaggtgatactgaagacagatacacaccttgttttgttgaggctctaagagacagacaggtaaatactatcacttgtggtccaagcttcacagctgcaatcagtttacacaaacctatttctattagtgaccagtcaacttgtactggttgtaggttgccatttgggttcacaaggaagaagcacaactgctatagctgtggtcttttgttctgtcgtgcttgtagtagtaaaaagattacaaatgctcctctagcccctagtaagagcaaggcttttcgagtttgtgatcagtgtttcgataaacggcaagggggtacacatcctgtaatggcatcaaagtccagaaatcacaactctcagcaattgttgaagcatcaacacaaaattgctgatgtgactgaagataggggagagacaactgtgacacaaggtcctttgttatcacttggtcaatcatgctacaggaaaagcatgccaagtggacgtaaggattggaaaagcaatcaagaaagtcagcaggatgtagaagatagttctcctatgctaggtggaatgccacagtgggggcaagttccttgccctgccatatttaaaataaattctacagaaaatccagttgctcatgtttcttcatccaaaaataaattagccacagtttctccctttaatgtggaatctacaacatataacttctccaatgtagagacagatgcaacaaagtctgacaaggtgctccttgaagaagttcataggctgagagccgaggctaagagacttgaagagcagtgtgagctcaaaaaccataaaatacaagagtgtcaacaaaaaattgaggagagttggtttgtagcaagagaggaagctgctaagtgcaaggcagcaaaagaggtcataaaagctttagcactaaggcttcatacaatatcaggaaaagataacgttggacaagaaggaaaagctgggccgaatgaatttgtgcccaatgtggcacccatacatacagaaatgaagagtccacgtgatgttaatgtggatagtctatccaattcccctatagtattctctgacacattaaaatccaaatttgggagaagtttgttccccaaaattgataattctaatagagcagaatctcaacaggacaatattgatggcttgaaggctgaatgggtagaacaatatgagcccggtgtttacatcacatttacaactttgcaatgtgggaaaaaaggccttaagcgagtgagatttagtcgaaagcgattctcagaaaaggaagctgaaaaatggtgggaagagaatcaaggcacggtgtatcacaagtatgggattgaaggatatataaataataacactagccaaagtcaggtgaaaggctaa

SEQ ID NO: 11985 - DNA, 1321 bp, Glycine max
  Peptide Sequence Number=SeqID_128763
cgtgcccatgccgtggagatattcaccaccaactacgacctcctttttgaacaggcattcgaagcggccaatgctccttatttcgacggttttaccggaggtcacgcaccatttttcgatcccgtgaccgttgctggcaacgacttgcccccaaggtggtcaagaatctggaaattgcatggatctctgggctggaaaatctcgaatcaggtagtaatcagaactggaaatcgagaaagcgcagacctagtctatcccgaccacctgaagtacgacctaacccagaagcagccctattcagcactgttcgagcgattgaagcaattcctgctgacacctgatacagttctgctttcaatcggtttctcttttagagatgctcatatttccgcagttgtaggagaggcattggccatgaactccaacgcagcggtattggcgttccagtatcaagctttggcgaatgaagagcccgcgcggaagctcgcttttgagcatcccaacctgtctgtgtacgcaagtgatgctgcagtgatcggtggagtcgagggcgcttggcgtcccggggatcttcccaaaaactggggcgaaatccgagcgagcttttggggaagccgccaaaaggatgaagcccaatcgttccttctcggcgattttgggagattctgtcggttctgcgcgttgtcgtcatcagcggacatctcactgcctgtgcctgttgcgccgattcggcttgctgaatcgctgtcgtcgggtttggctatgatcgatggccatacgtatcgtgtcgggcaggtggggagcttcgtccgcatcccgcttgggtatcagagcctatacggtgtggtttctgagattggcgccgaactatctcttggagatgcgcgcagcaacatggcttccggatcgggccgctggatgaaagtcgaactcgcaggtgaagctattggtgggcggttcgaacgcgggctcagccagcaccctaacgttaatgatgcggttcacctagtgacacagcgtgatctgttgaatatctacggagacgaaagtgaagatcaagtgcctatcggcacattgtctagcgcagagaatattgctgtgcgactttcgctcgatgcactcgtgacaagacactctgctgtacttggttccacggggtcaggcaaatcgaccacggtcgcaagtctgctccgatcgatcgtgcaaagcagcgaaagtcttgagcaaagtggagctcgtgtccttctcttggaccttcatggcgaatactcatcagctctcaatgatatcgccaagattttcagtgcgacaccgcagcccg

SEQ ID NO: 11986 - DNA, 294 bp, Glycine max
  Peptide Sequence Number=SeqID_128764
atggaaatagcaaaaatcatgtatggtctaataaatagctcaccatttacagataagatatgcaaggacaaagcccaagctgcttcttggtttgttggattgaaagctgtgatttctaggtgtcagcatcctagagcttttagtagtttaagaagttgcaaaggggtgcagagttgtgctagtagtccagctggaatcttaagaagaaagaaaaatcttggccttctggacgatacctctcagtttactcaggtttcatacatcttctttgttaggttttctgtatataattaa

SEQ ID NO: 11987 - DNA, 186 bp, Glycine max
  Peptide Sequence Number=SeqID_128765
atggaacctacaaggggccctttctgtgatgaatcagatggtcaaaaattccctgccaaattggttgttggtttaggaatgaaggctatgagagtaggctcaaaggtaatgttgtcttttgttagaggagcagtcatactttgtgaatgttcagtctgtccattacatcttcttgtggctagctaa

SEQ ID NO: 11988 - DNA, 519 bp, Glycine max
  Peptide Sequence Number=SeqID_128766
atgcaaatagggggatgccacatttgcggtggagcacacgagctagggcaatgcatagcccaagaagattcttccaaggaggtgaactacatgggagctcagagtcgccacggattccaaggctacaaccaaggaggaccgtcgggattcaaccaagggatgaatttaacacagggctcaagctggaggaatcatccggggaaccagttcaacaaggagcagaaaagtcaaccagcccaaaattctaaccaagggatagatctttataagaagaccaacaagcttcaggagacgctgaatcaattcatgcagatattcatgtccaactataggagcatggagtcctccatcaagaacctggagatacaagtaagacaattagccaaacaaatggctgaaagacccaccagcagctttggagccaacatagagaagaacctaaaggaggaacgcaggggggtgttgactagaagccagatgagagcgcaaggagaaaaagagaaagctaaaggagaatag

SEQ ID NO: 11989 - DNA, 198 bp, Glycine max
  Peptide Sequence Number=SeqID_128767
atgatgagagagaagaaagcattccctaaggtagagttctcaaactttgggtgtgtattagagtgctctgagattcggtgcctgcctgtatttgtgcttagcgcgtgttgctcacttagtgtggtgcctgtattcacgctttgcgcgcctcttcctcgcttagcatcaatgcttgttttcacgctgagtgtgccctga

SEQ ID NO: 11990 - DNA, 161 bp, Glycine max
  Peptide Sequence Number=SeqID_128768
atggagggagataatggaatcgcaccaagacagtacaaatggaggcttcaatcccttctcgttctctctaacgtttgggaaccttataagagcaatcagaggagaaacttgagaaatctcaagaaattgctagagatgccgatatcactgtcggaagacac

SEQ ID NO: 11991 - DNA, 241 bp, Glycine max
  Peptide Sequence Number=SeqID_128769
tttcggtattttccttctagaacttgccagtggcagaagaccggttgtaaagcttagttccacggtgaagcaatcaatagttgattgggcgttgccattggtttgtaagaagaaattcagtgaacttgctgatccaagactaaatggtaactatgtggaggaagagcttagaagagttgcgttaattagttgcacttgtatgtgctcaggttctatctgggaagagacaaaccatgcttga

SEQ ID NO: 11992 - DNA, 771 bp, Glycine max
  Peptide Sequence Number=SeqID_128770
atgttgccaaaaagttattatcaggcgaagaagatattgtatccgatgggtatggagtatcagaaaagacatgcatgccctaatgattgtatactgtacaaatatgagtatgaagaaatgcataaatttcccaggtgcgaggtatcacgatacaaagtgaaggatgacgacgagtgtagaagtgatgaaagcacaacgaaagggcccccaacgaagcgtttgtttgctaatgtagatgacgcaaaaaaccttacatggcatgcaaatgggagaaattgtgatgcaatgctttgccatccgattgattcctcccaatggaagaagattaatcatctatatctgaattttgagaaagaggcaagaaatttgagtcttggacttgccactaatggaatgaatccctatggcaatttaagcattcaacacagtccgtggcctgttttgctagtaatttgcaacttgcctccttggttgtgcacgaagcaaaaatacatgatgttgtctatgatgatattgggctcaagacaaccaggaaatgacatcaatgtttatcttagtccattgattgaagatttgacaaagttttgggacgagggggttgtcatgtttgatgggtatcaaaatgagacattcaagttgcatgcaatgcaattttgtaccattaatgactttctagcatatgggaatttaagtggatacagtgttaacgactatcatgcatgctctatctgtgaagaagacacaacctacgtgcaacttaaacatggttga

SEQ ID NO: 11993 - DNA, 360 bp, Glycine max
  Peptide Sequence Number=SeqID_128771
atgaccctgaaatcgaaaaagtctatcacaggaataacgttgaaacaaggagaaggaaaatggtcgtcaatggagaataggagcccaccctgtaggattacctcaccccttgtgtgggaatcactacagtcatacaactccctaatctgggagaccaacactgaagttcataagactcatagacacgtgaagagccctgacaatgctcctgactacatcagattggctgccttcccattctcattaggggggaaggctaaaaattggctcggtggctggtcgagtaggagcattatcacttgggataggtgctcactagcatccttgaagaaattctcccctacaacaaagtctgcgtag

SEQ ID NO: 11994 - DNA, 567 bp, Glycine max
  Peptide Sequence Number=SeqID_128772
atgtatctttcattttattttatttttttcataaaatatttaaaaagtattaaaataggagaccatattatccctcaagtcacacggtttaaatatcttgggtctgtaatacaggatgatgaagaaattgaaggggatgtgaatcatcgcattcaagcaggatggatgaaatggagaaaagcatcgggggtgttatgtgatgcaaaggtaccgatcaagctaaagggaaagttttatcggactgcggtaagaccggcgattttgtacggaacagaatgttgggcggtcaagagccaacatgagaataaagtaggtgtagcggagatgaggatgttgcggtggatgtgtagtaagactcgacaggataaaattagaaacgaagctattagagagagggttggagtagcgcctattgtagagaagatggtggaaaatagacttagttgggttggacacgtagagagaagaccgggagaattttcggtagatgaagaatcgttggtagccaacgcaggggaagcacgtggagcagttttgattcgtttcctttgtggcacaagactataa

SEQ ID NO: 11995 - DNA, 678 bp, Glycine max
  Peptide Sequence Number=SeqID_128773
atgtctgctgctgtgtgcggaagcaagagatctttcttcgaagagcttcctccttctccgccactctccaagaggctccgttgttcctcttcgccgattcgattccctcctccctctcccgtcgaccaacttcgccctctctttccccacatggacgacttgtttcttctcattttgtctaacttacttcctttttttcctttctttgtgagtttcgggagtatccccaattgtatgtcttctaatggttccctcttaacggtttccccttttatggagagtggtgtgaatggtgccttaggcacgtgcgaggggcaggttcttgagagagctctccaagaatgtggcaatgatatagatgctgccatcaagaggcttaatgagctttgcttgggaactgccgatagaaatgggattgctgaagaattggaggttgtcattaatctggatgcaggtaatttggaaggtgatggaaatgcttctgtttctgaggagcagcctgctttgaacaaccaccttccggcagatggagcagaatggattgatttttttgtcagggaaatgatggttgctactagtgttgaagatgctagagcacgtgctgccagaatgctggaggttctagagaaatcaatcagtgaaagagcaaaggctgaggcaactgatgtgcttcagaag

SEQ ID NO: 11996 - DNA, 1218 bp, Glycine max
  Peptide Sequence Number=SeqID_128774
atggagtcagccacatattgttgcccttctgatgttccattctttatgttttctagggttactcgtgctatcatggagtttgttgcttgtgctaaccctgataataatgatgagatatctgattctgaaacacaacccaataagtggatgagaaagaagtctatggtgtgggactacttcacagtggaaacggttggagctggatgtaccagggcctactgtaaacagtgcaaaaaatcattttcttatataactgactcaaaattaactggcacaagccatctgaaaagacacatttctttgggaatctgtcgtgtgcttcgggagaaaaaccaacaaagatcatatcctaaaactggtggttctctagatactgccaatccactcaagaaagggccaagagcaacacctgggtttgctggtaatggtatctcattttatcaggagcattgcaaccatgatgtcgctaaaatgataatcttacatgattatccacttcatattgtgaaacaacagggtttcattgattttgtgtggatgcttcaaccccagttcaatccattttgtctaaattctgttgaagcggattgtgttgctatgcacctcagaaaaaatgaggctgtgatgggaaatctgagaggccttctctttgttaagaaccctgccatcctcaatagtcagttgttaaaccagaatggttatgctcgtgctcttagtcattttgcagcagatgcactattggcaacaagagaaactattagcaaagttcgcaaaactgtaatgcatgttaaatcttccgaatcccataaaaggaagtttatagagctgaaacaacatctacaagtaccaagtatggtggacctttcaattgatgaccagtataaatggaacacaacatatcatatacttgtagctgcctgtgaattaaaggaagtcttcacttgccttgataccatttatcctgattacagaatgactctaacaatgggtgatttgtcaaaagttcaggtggagttgacatatgcggccttcagccaggatcctttccttagcactatggatccaaggcataaaatgaagcttgtcaaattcccctttgctaagatatttggtgagaatgctgaggcatggataaaaatagatgaggatgtcttcggaagacatggtgtaggagaagagatggaaggttccgaggttgggatctatggcattagatga

SEQ ID NO: 11997 - DNA, 1134 bp, Glycine max
  Peptide Sequence Number=SeqID_128775
atggcgattctttcgctccaattccatgctcttccttttccactcccaacttcttcttcttcttcctactttgacgcgatccaccttcgctctaacaacaagaacctcgttttcatcgcttatcctctcttttccatcagcagcagcagcagccgccggcgctttgcgacactggttgcttcagcttccggcgattactacggcactctcggagtctccaaatctgcctccgccagggaaatcaaagcttcttatcgacgactagctcgccagtatcatcctgatgtgaacaaggaacctggagccactgagaagttcaaacagattagcactgcttatgaggtgctatcagatgataaaaagagggcaatgtatgatcaatatggcgaggctggagttaagagtactgtagggggagcatcagctgcctatacgacaaatccattagacttatttgagacattttttgggtcgagaatgggtgggttctctggcatggatccaactgaatttggaacatgggaacaatgtactactgttactaaaggtcaagacatccgaggtttgtacaacttaattggaacctctgttgacaaactgacatttatagtttcagtgtgtcctaactgtggaggggatgatgaagtcatatctgaatattgcactaattgcagaggtgaagaacaaatacagattaagaaaaacattaaagttaaagttccacctggggttagctcaggcagtatactgcgagttgctggagagggtgatgctggaccaagatggggtccttctggagatctttatgtttatcttgatgtggaggagatatccggaattcaaagagatggcattaatctccgctctacaatatcaatcagttatctagatgccatactaggggcagttgtcaaggtgaagacagttaaaggcatttctgaacttcaaatacctcctggtacccaaccctggagatgtcctaatcctagcaaggaaagtacaatggaacaaagaagtactgaaggtcctgcaactcaaaatgttgaaagtacagtagcaacagtggcagaacctactgcacaaccagaagatcaaaatgacgcgtggaagaaattgaaggacattgctgggtaa

SEQ ID NO: 11998 - DNA, 1452 bp, Glycine max
  Peptide Sequence Number=SeqID_128776
atggttctcgcggagttaggtggtagcatttcgcgtgctcttcagcagatgagcaatgcgacgatcatcgacgagaaagtcctcaacgattgcctcaacgacatcactcgcgcgcttctccaatccgatgttcaattcaagctcgttcgcgacatgcagaccaacatcaagagcatcgtcaacctcgacgaccttgccgcaggtcacaacaagcgcaggatcatccagcaggccgtcttcaacgagctctgcaagatcctcgatcccggaaaaccctcttttaccctcaaaaagggcaaacccagcgtcgtcatgttcgttggcttgcaaggatctggtaaaacgacgacgtgtacaaaatacgcgttttatcatcagaagaaaggttggaagcctgctctggtgtgtgcggatacgttcagagctggtgcttttgatcagttgaagcaaaatgctactaaagcgaagatccctttctatggaagctatatggaatcagatcctgtgaaaattgctgtggaaggggttgaacgattcaagcaagaaaactgtgatcttataattgttgacactagtgggcggcacaaacaggaagctgctctttttgaagaaatgcgccaagtttcagaagcaacgaaaccagatcttgtcatatttgttatggatagcagtatcggtcaggctgcttttgatcaggctcaagcatttaaacagagtgttgcagttggagctgtcattgtcactaaaatggatggccacgcaaagggtggtggtgctcttagtgctgtagcagcaacaaagagtcctgtcatattcattggaactggagaacacatggacgaatttgaagtttttgacgttaaaccatttgtcagtcgtctattaggcatgggagactggtctgggttcatggataaaattcatgaagttgttcctatggatcaacagcctgaactgcttcaaaagctgtcagaaggaaacttcaccttgaggattatgtatgagcagtttcagaacatacttaaaatgggccccatcagccaggtcttttctatgctacctggatttagtgctgaattaatgccaaaaggtcgtgaaaaggaaagccaggcaaaaattaaacagttggatagttcaaacccaaagctcattaatgagtcccgtatgatgcgaatagctcgaggttctggtcgtccagttagggaagtaatggaaatgttagaagagtacaaacgtcttgcaaagatttggagcaaaatgaaagggcttaaaataccaaagaagggtgaaatgagcgccttatcccgaaatatgaatgctcagcacatgagcaaagtcctccctccacagatgctaaagcaaatcggaggcatgggtgggttacaaagcttgatgaagcagatgggatctgctaaagatatgatgggaatgtttggtggtggtgataattag

SEQ ID NO: 11999 - DNA, 2217 bp, Glycine max
  Peptide Sequence Number=SeqID_128777
atgaagttatgtttgccaattcctttgtctttttcgcttgcaaccttgacactttcactttcttggttccctaagagaatgatttcacactgctttggagaatctccaatctctttgcttgaaaagtgcaagtccatgtaccagctaaagcaaattcactcccacaccatcaaaatgggtctctcttcagaccctttatttcaaaaaagagttatagccttctgttgtgcccatgaatcagggaaaatgatctatgcccgtcaggtgtttgacgcaatcccgcagccaaccttgttcatttggaataccatgatcaaggggtattctaggattaaccatcctcagaatggagtttccatgtatctattaatgctggctagtaacatcaagcctgaccgttttacatttccgttcttgttgaagggatttaccagaaacatggctttgcagtatgggaaagtgttacttaatcatgcagtgaagcatggatttgattccaatttgtttgtgcaaaaggctttcatacatatgttttccttgtgcaggcttgtggatttggctcgcaaggtttttgatatgggtgatgcatgggaagtagttacctggaatataatgctatctggctataacagagttaagcaatttaagaaatcaaagatgctttttattgaaatggagaagagaggggtgtcacccaattcagttactctagttttgatgctttctgcatgctccaaattgaaggacttagaagggggcaagcacatttataagtatataaatggaggtattgttgaacgtaatctcatattggaaaatgttttaattgatatgtttgcagcctgtggagaaatggatgaagcacaaagtgtttttgacaatatgaagaatcgagatgtgatttcttggacttccattgttactgggtttgccaatattggtcaaattgatttagctcggaagtattttgatcaaatccctgagagagattatgtttcctggactgctatgattgacggctaccttagaatgaaccgtttcatagaggctttggcacttttccgtgagatgcaaatgtcaaatgtgaaacctgatgagttcaccatggttagcattcttacagcatgtgcacatctgggagcacttgaactaggggagtgggtaaagacttacattgacaaaaatagtattaaaaatgatacttttgttgggaatgctctaatagacatgtactttaaatgtgggaatgtcgggaaagcaaaaaaagtattcaaggaaatgcatcacaaagacaaatttacctggacagcaatgatagttggccttgccatcaatggccacggtgaagaagctctagccatgttttcaaatatgatagaagcttcaattacaccagatgagattacctatattggtgtcctgtgtgcatgcacacatgcaggcatggtagagaaaggacaaagttttttcattagcatgaccatgcagcatggaattaagcctaatgtgacacattatggatgcatggttgatctacttggtcgtgctgggcgtttagaagaagcccatgaagtcattgtgaatatgcctgtaaaaccaaattcaattgtttggggatcacttcttggtgcttgtagagttcacaaaaatgtgcaactagcagaaatggcagctaaacaaattcttgagttagagcctgaaaatggggctgtttatgtcttgttatgtaatatatatgctgcctgcaagagatgggaaaacttgcgtcaggtcaggaaactgatgatggagaggggaattaagaaaacaccaggttgcagtttgatggaactgaatggcaatgtttatgaatttgttgctggggaccagtcacatcctcaatctaaagagatatatgcgaagttagaaaacatgatgcaagacttgataaaagcagggtactcacctgatacatcagaggttttccttgatctaggggaagaggataaggagactgcactttaccggcacagcgagaagttggctattgcttatgctcttattagttcagggcctggaattaccataagaatagtgaagaaccttagaatgtgtgtggattgtcaccatatggcaaagcttgtgtcagaagcttacaatagggaactaatagttagggataaaaccagattccatcatttcaggcatggttcatgttcatgtaataatttctggtaa

SEQ ID NO: 12000 - DNA, 297 bp, Glycine max
  Peptide Sequence Number=SeqID_128778
atggaggtagtgaagaaaaattactttgttccaactctacttgaagctgcaagaaaagctaacttcaaaggtactttcagtgaaatagcagcaggatttgcaactgacagatgggataaaccaatactacttgcttggggattatcagacaagtacttgccccagtctgtagcagagcagtttcagaaaggaaatccagcacaaatccagcttaaattgattgaaggagctggtcatatgccacaagaggactggcctgagaaagttgttgatactttcagagtgttcttcttctga

SEQ ID NO: 12001 - DNA, 246 bp, Glycine max
  Peptide Sequence Number=SeqID_128779
atggttgtgaaaatattgcatgattccattgtgcaagtggggggagggctttgtgaggcaaggagggaagcgaggaggaaaggagaaatgaagaaagggaaaaaggaaaggaatgaaggaaggaagaaagaaaagaagaaagggtggtggggaacggtgggcgccaataagaaggagaaagggtattttgatctttttcatgtgaccaataggaaatttggagggccaacatcaactctccaatag

SEQ ID NO: 12002 - DNA, 771 bp, Glycine max
  Peptide Sequence Number=SeqID_128780
atggcgattcaagatcaaaatggatttaacagatcacagggtggtcctccaataggaggaggagtatctttgagttctggagtgcattctgtcacacatattcaacttagtgaccagttttcttgtggcaatgactatgctctgaaggtaagaaagccttatactatcaccaaacagagagagcgatggacagatgaagaacataagaagttccttgaagctttaaagctgtacggacgggcttggcgacgtattgaagaacatgttggcacaaagactgctgttcagattcgaagtcatgctcagaagtttttttctaagcttcttcgcgatcctactgggaacaatacaaacacagtggagtcaattgaaattcctcctccaaggccgaaacgaaagccagtgcatccttaccctcgtaaactagttgagacccctaataaagaaattttgatcccagaacaacttatgaagtctaattctctgaagtcatcagactttgatcaagaaaaccaatctccaaaatcagtattatcaggagttggttcagacagccttggctcctctgattcagacacaccatatggaagtttgtcgcccatgtcatccattagtggcatccatacaagcagttttacacgtgctgagcacaaaacaacatctgatgaagctgggatggacactgattcagctcatgatgagaaacctcttatggtacttcccaatccattccattttattgattacaatatcatcactagagtatcttga

SEQ ID NO: 12003 - DNA, 1023 bp, Glycine max
  Peptide Sequence Number=SeqID_128781
atgggttcttgggctacatcatctgttctggctaatcaatttattccatggtctacaaccaattctgaatctgccatcgattccaaattgggtgtcgttttttacaaaatgtacagaaatacaaacaaaagacaactcagtctcgcttttgcttgggataattgtaaagttagaagtattggtgcaattaaatcatacaaagatgtatcttattttcaaaacgaactagtaggaacttgggaagaacccgatactggaagtgacagtgagggtgatgatgaagaatatgaggaagttgaaaatgagaattttggatttgaaagtggttcaggagaggaagggatgaagacttcagttgttactgatgttaatataacttcaggggacaactatgaagaacttattaagaaagagattgaacagcttttggaacctggagaaagagcaatattgaaacagaatgttactcctaacttggaaaaaatatcaaccgcaaaatggagcccactgcacactcttgtgctatcaatgcagatgagttgtgtggataagcttcttgaaaatggtgttgatattgatttacctgataaggtgggtttgtttatatctggcatacaagaaggtcttactgcacttcataaggcaattataggtaaaaaagaagcagtgattagccatcttttacgaagaggtgcaagtcctcatgttatggataaggatggagccactccacttcattatgcagttcaagttggtgccaagatgactgtgaaattattgatcaagtacaaggttgatgtcaatgttgaagataatgaaggttggacccccttgcacgttgccattcaaagcagaaatagagatatagcaaaaatattgttagtcaatggtgctgataagactaggaaaaataaggacggaaaaacagccctggatctaagcttatgttatgggaaagatttcaagtcttatgaccttgccaaattactgaagacggttccagctgacagtgatctattctga

SEQ ID NO: 12004 - DNA, 183 bp, Glycine max
  Peptide Sequence Number=SeqID_128782
atgtccaaacccttaaagataaacactaaccggatgaagaatgaagaacgaatgaagaacggtgtagaagtcgattacggacgcaatttggctgaaccccttccttcagaccccttacccctatttataggaaatgacgagacttggttgatctggagctcacccaggcgagctgttacttaa

SEQ ID NO: 12005 - DNA, 669 bp, Glycine max
  Peptide Sequence Number=SeqID_128783
cttgatccttttgaacagcatgttgagtggagtaagatccagacgcctacggatcaagtagtggtgccttatgacactttggcaccaattcctgatgaggtgaagaacctcttggacaagcttgtggtgttgaagctcaatggaggcttggggacaactatgggttgtactggcccaaagtgggtaaacttaaaagcagttaaaaggcttgttgaagctgatgctctgaagatggaaattattcccaatccaaaggaagttgatggagtaaaagttcttcaactggaaactgcagctggtgcagcaataaggttctttgacaaagctattggaattaatgtgcctcgatcccgcttccttcccgtgaaggcaacttcagacttgcttcttgtccagtgggacctttacactttacaagatggattggttattaggaaccaagctagggcaaatcctgaaaatccttccattgaattggggccagaatttaagaaggttagctacttcttgagccggttcaagtcaatccccagtattgttgagcttgatagtctgaaagtggcaggggatgtatggtttggagttggtgcaatccttaagtcagagttgcgtgatagtactttaggagctcagaaatctctgcaaagagttctttttttcaagatttga

SEQ ID NO: 12006 - DNA, 277 bp, Glycine max
  Peptide Sequence Number=SeqID_128784
atggcacgttctctagacaagataaagagcatcaatggctcaaaagaaactcttaaacttagtgtgaggatcagtaatctatggtttattggcacgcctaacaaatctgagcaagctgagatggtgtttgtggactcctatggtgatgagatccacgttgtttgtaaacaagaccaactgaaggagtgtgttctagaaaacatcccttttagaaaatacaggtttgctggatttgcagatattgtggctggccagtttgaacctgggctattggttg

SEQ ID NO: 12007 - DNA, 188 bp, Glycine max
  Peptide Sequence Number=SeqID_128785
atggaagagagatctttactttcagaaatagcaagagatgtaccctctcttgttctcagtcaaacccaagtagatgtaccctctacttgtaccacaaaggatgtaccctccaatgtgttaagacaaagatctcaagctgtcaaacctttgatactttgtgaatggggatacagaagaattctcaggcg

SEQ ID NO: 12008 - DNA, 255 bp, Glycine max
  Peptide Sequence Number=SeqID_128786
atggtcgtccgcgccttttgtcaaccaggggcaaacgagctcgttgacgcgcagagactaacgtcgtcttctgcatcttttgtcatccagggaaagcaagtcgggtggcaggcagagatacattatggtcgttcgtacctttcgtcaaccaaggcgaacgagttcgacggtttttgctctcgtcgtccagagacattcaagcctgacgacgcacgagattcttctttgctgagcggggacgatcaagttcgatag

SEQ ID NO: 12009 - DNA, 318 bp, Glycine max
  Peptide Sequence Number=SeqID_128787
atgcatgtatgtgtacattatggaaaaatactgccaacaccttatgttgggggaaatgtcttgaaaattatgaccaggccttgcttaaagggaatagaagagaagactgccaacttgaaaggaagtgagaaggctctagttgcacggcatgaagctagcaatgctgtagtaggtactgcagtagcaaaccttcttgctggacagccacatgttgaggtgtggactttggaatatcttattttagaattcattgatcttgttttatggtgggaaattaaagaaaagtataaatctgttatgtgtgatattcaacgataa

SEQ ID NO: 12010 - DNA, 457 bp, Glycine max
  Peptide Sequence Number=SeqID_128788
cagcagcagcaccttctcttgttgacatcattgtggtcaccccatatgacacacagattgtgttgaagggcatctctactgataagatacttgatgtaagaaaactattggctgtgaaggtggagacatgccattttacaaattattctttatctcatgaggccaaagggcagagattaaatgacagagtggaagttgttaccctaaagccatgtcttctaagaatggttgaagaggattacacagatgaagcccaagcaattgcgcacgtgcggagggtcttggacattgtggcctgcacaacaaggttcggtaggcctaagcggagcgtatcaagcccagagtcaaggcccaagaaaaacggtaaggcccaacatcagaacaagatgagtttgagcccaccggggacaccgaatggggaatcccgggtcgggtcaccgtcgtcggaggcgccacc

SEQ ID NO: 12011 - DNA, 4281 bp, Glycine max
  Peptide Sequence Number=SeqID_128789
atgaaagcctttttggaacgtaataagtttggaaatcttccgtatggattccgagcaaatacatggcttgtccctccatctgtcgccgagtctccttcaaactttcctgcattacctgctgaagatgaaaactggggtggtaatggtggtggccatcaaagaaatggcgcattggatcatagatcatgggctacagattttgcaatactggcctcccttccttgcaaaactgaggaggagagggtggttagagatagaaaagcatttctgcttcacagtcagtttgttgatacctcaatatttaaggctgttgcggctatacagcatgtcatggaatccaagtcaaatatcaagagtgaattgaattcttctccgggttctgttctgcatgaagatctcacgggagacttatccattatagtcaaacgtgatatccaggatggaaatacaaagtatgattctatactggatgaatctagcatgcatgaaggggatgctcagaagaatttaatcaaagggttgactgcagatgaaagtgtaattgttcatgatacttcttccttggctgttgttgttgtacaccactgtggatatactgcaacagtaaaggttgtgggtaatgtgaacgtgaggaagcctgaagtccgggatattgagatagatgatctgccagatggaggggcaaatgccctcaacataaacagtttgagggtactgcttcacaagtctggagctgagacattagaagggactttatcatccctatcaaattcggatgacttagatgcttctaaagtccttgttaagaaggtggttcaagaatgcatggaaaagataaagggggagccaagtgcttcaaaaaggtctattcgatgggaacttggttcctgttggattcagcatttgcaaaaacatgaaacttcaacagatagcagttccaaaaacaaagaagatggcaaagatgttgatcaagctgttaaaggtcttggaaagcaatttaaattgttgaagaggagagagaagaaatcaaataatctagatggtgcagattttaaggagcaaaatgactctagacttgcaaacatggatgatgttgctgataaagttgagccaaacaatgatgacttaagtaactctaatgagctagagaaactactttctgaagaatcatttttgcgtctcaaagaatctggaactggtcttcacacaaagtcagtagacgagcttatcagcatggcgcacaagttttatgatgaagttgccttgccaaagctggctatggactttggatcacttgaactttctccagtcgatggtcgtacactgactgactttatgcatttaagaggattacagatgcgatctttgggtaaagtggttaaacttgcagagaatctgccacacatacaatccctttgtattcatgagatgatcactcgagctttcaagcatctacttaaagcagttattgcctctgttgaaaatgtagctgatctatcttcagccattgcatcaacactgaatttcttacttggtgggtctcgaacagaagataccagtgaccaaagtttgagtgatgatcataacctcagaattcaatggttacatctgtttttgtccaaaagatttgggtggacactaaatgatgaatttcaacatttaaggaagttgtcaattctcagagggctctgtcacaaggttggattggaattgtttccaagagattatgacatggagtccagtaagccctttggggaaaatgatattatcagcctggttcctgtttgcaagcatgttgggtgctcctcaatagatggacgcaatttattggagtcttccaaaattgctcttgataaaggaaagcttgaggatgctgtgacttatggaacaaaggcattagctaagatgatggctgtttgtggaccctatcatcgaaatactgcaagtgcatatagtcttctagctgtggttctctaccacactggagattttaaccaggccaccatctatcagcaaaaggccttggatataaatgagagagagcttgggcttgaccaccctgacactatgaaaagctatggggatctttctgtcttttattatcgtctgcaacacattgagttggctctgaagtatgttaatcatgctctattccttctacattttacatgtgggctgtctcatccaaacacagcagcaacttatataaatgtggctatgatggaagaggccatgggaaatgttcatgtggcactcagatacttgcatgaagctcttaaatgcaacaaaagattgttaggagcagatcatatacagactgccgcaagctatcacgccatagctatagctctttcattgatagatgcattttctctgagtgtgcaacatgagcaaactacactaaagatacttcaagcaaagcttggatcagaagatcttcgtacacaggatgctgctgcatggcttgagtattttgaatcaaaagccctagagcagcaagaagcagctaaaaatggaactccaaagcctgatgcatccattgcaagtaaaggtcacctgagcgtgtcagatctcctggattttattagtcccgacccaaaaggaaacgatgctcggagcaaacagaggcgtgcaaagatactctcaacaagtgatgacaacagtcaagaacatgacgatgcaatagccaatgagagcattctttttgataactcaaaagatgctccaagtatgacagaagtcaagatagaagaaacaaatggcaaacttgattctcaagtacagaaagaaaatggtgatttcactaggtacggaccagtgacaagtgaacctgtttatgaggcatcatctgatgaaggttggcaagaagccaattcaaaagggcgatcaggaaatgctgctaaccgcaagtttggacacagaaagcgacctcacctatcaaagctcagtgttaatggttctaataattacatttacagggaaggcagttctaggaatgagattacttcgccaccacaaagaggagttccaaaagtcatgttagacatgtcatctccatctagacaatcaaaatctcgaaacttaactttgaatgaggattctgttaatcattcaacaaaagcttctgtgtccaaaatttcatctccggctctaagttccttggcttcaaagtctatatcctacaaagaagttgctctagcaccaccaggaactgttttaaagccattgttggaaaaggctgagatggacaaggttaatgctgaagatgagatatgtggcaatatagctgtaacatcaataaatgaaggtacctgccaaagttccataactaatacagtttctcagaatgatgaaacagaggaaactcatgaaattgaacctcaacaagaaagttctggatcggaacttgagaaggtttgtgcttctgatcaggaaaaacctacagaaacaaatggcagtaagctttcggctgctgccaaacctttcaatccaggaatgttgtccatgtctcaccatctaaattcagcttccttcacaagcatgtatgatacagatgttagtcaaggcatgcacgtggagcctgtgcttccccctgctgttgctagggtcccttgtgggcctagatcacctctgtattatagaaccaactatacttttcgcatgaaacatggttctactaaaggtcaaacctctatcaaagaaagaagtggatttgggtctccaagaataatgaatccgcatgcgccagagtttattcccagaagtgcttctcaaatagaagccaaggatgccaattcaaatgtttccaatgagcataaccctttgtctgacgaaggcatgccagaaaaaaacaagctagatgaaaattttgttgaaatcaaggggagctccacaaaaaacagtatttctgaatctgagaagtccgagatagcaaggcagatattgctcagttttctagtgaaatctgtcaaggaaaatattgattatgtggatgagtctaaggatgatgaaggaaaaattgagaacttggaaagttgttctgatgaaattaccaaagaccgtgctgtcataaacattatgtatggaaatgaagaaaagaataagacagtgcctcattccagtgatagcgttgagccagagaaattaggagttactgaaaataagaatggagatggtgaagggtttatagttgtctcaaagaggaggaaaaacaggcagaagatcacaaatggagtcacagaattgtacaaccaacagtccatttgtgcttcagttcgttga

SEQ ID NO: 12012 - DNA, 1392 bp, Glycine max
  Peptide Sequence Number=SeqID_128790
atggcggcccacttgactcatctattgacaactcctcaattggtttggtcaatcgaagctcaaaccgcttttcagcagctgaaagatgtcgtgagttctgtgccaaccttacaactcccgaatttctctctgtcgttcatggtcgagacctatgcgtcgggtacagggataagagctatcctatctcagtcagtaccccatttcgcttttctggaccaactcaaacccgagctggctattcaccctgagttcattgaactcaaatggaatatcagagaaccgcatttggttgcccaatggcctcaactttatcctgtcattgttgatggagttccatacgtcacctacgggagggcacatgggaatcaagaaaactttgccgcgcttgggggagaatttttcacctctagaagaaagccgcccagtattccccaataccttacgggctcttcaccagttgcggtggtggatgatatgttaacgagcagggaagctatttttgatagtgggtcatggtcaagctcagaccttaccgtcaactttcagttacccgaaccttttattcgaaacttgtcaaaagattatatggtttgtgatcaccaacccgtcatttcacctctcacgattgttgacacccgttgggatgatttgaagggtgagcctcatttgatggtgctagtgcagtgggaagggttgcatcctaaggacacctcttgggaggtttggaccaatttaaaagcagatttccaccttgaggacaaggtgttgccagatggtgtggggattgataggcccacagtcaagcatcagcttggcccaaatgctccaaccaattatgcattggaaggatcagttgctatcgccggagctgcagtgcagtggcttagagacagccttggcatcatttctagtgcttcagagatagaggagatggcattacaggatgctcgcggggtttgtattggaataacaaggtttacaagcaaagctcacattgctcgagctgtgctcgagagcatgtgtttccaagtgaaagatgtcttggattcaatgcataaagattcaggagaaagtgaatcccaaaagaagttgttgcttagagtggatggtggggcagctgtaaacaacctgctgatgcagattcaggcagatttggtgggatgtccaataattagacctgctgacatagagacaacagcacttggagcagcctatgctgcaggattagctattgggatttggaaagaagattatgttttcaatactgaggagaagttgaagaatgctaatgttttccgccccttaatgactgaggaattaaggaaaaagaaagtggactcttggtgcaaagctgttagtaaaactttcgacttagctgatcttgctctttga

SEQ ID NO: 12013 - DNA, 900 bp, Glycine max
  Peptide Sequence Number=SeqID_128791
atggaagaactcgcccttcatcgggagaaaggtctgtgttttaactacgatgagaaatttagccgcgaccacattgtagaggatgatggcagttctccccaggatttgcttctctctatagagctaaaaggtcaacaggtgtggatattaattgatgggggtagtacccacaattttatccaagaaagtttagttctagcattggggctacctacacaacccactcaacctttacgggtcatggtgagcaattggcacgagctcgagtaccatcagtggtgcagagacatcgctcttcaggttcaggaccaacaattcttagtcaatttccatgttcttccgctatgtgtcctaacggactacaatgaccttaccacggaattccttctcgacggcatagttgttgagttgaaaggtggattctatgttgaagaatggagttatcagaccaagcacgagccccttctcctctctggtcttactgctcttaacaccatcatcatcaaggataggttcctaattcccatgatggatgaatttttggatgaattggggggagaacagtggttcttgaagcttgacttgcttcaagggtaccatcaaatattgatgaaggaggaggatatcagcaaaatggcgtttcacactcatcacaggcattacaagtttcgtgtaatgccctttggcttgtgtaatgccccgtccttgttccaagctacaatgaatgacaccttcaggccttatttgtgcaagttcgtcattgaccagtttttcctcaaaatgtccaaatgctcattcgcgcaatcccatattgagtacttgggccacctagtatcgatgcgtggtgttgaacctgttcaggataaaaaccaggcgattcaacagtggcccatcccatga

SEQ ID NO: 12014 - DNA, 315 bp, Glycine max
  Peptide Sequence Number=SeqID_128792
atgcaagctaatttgggtcgggaagggttcagtaccctatgcttcatctccaacctctatagagagaagcaaatcctggggagaactgccatcatcctctacaatgtggtcgcggctaaatttctcatcgtagttaaaacacagacctttctcccgatgaagggcgagttcttccatcgacaatcatttgaatgggatggaaggaggttttggcggcatcgacaagaggccagggtcgtagcctgcaccatagtcaaaggttgcaaggcttggacctccttttggatttccagtgccaatccagaaacaaaataa

SEQ ID NO: 12015 - DNA, 351 bp, Glycine max
  Peptide Sequence Number=SeqID_128793
atgctgaaagttgatgagaacaccaaggcaatggttgcacagttgaaggctatgaaggtcgaggttagtaaaaccaaggaacttggtttagaattgtctaagaagcaacaagtaaaagacttaggcaagaagacagaggacctaacctcagagaaaaagatagctgaggaagggttgagggtggccaaggacaagattgcccagatgaaggaaaccgttgccaaaatggagagccagttgcaaaagaaagaaagggttgagtttgccttgaaagccgagttggatgaagccaaaaggttgatcgtgttgaaccatagggaggactttatgagtttatgcgagacgtcttga

SEQ ID NO: 12016 - DNA, 414 bp, Glycine max
  Peptide Sequence Number=SeqID_128794
aaaccggcgaagcttgtggaaaagcatgttgagggtggtggtgccgaggtggagattgtttatcaggatggccccgaggtagcgaacaagggattgaaggaaggcaacacagctgaggacaagaaggtgggcacaatcaagaagtcagccgcatccaagaaggagaaggtggtagatgttgctaagaaatctacctcaattgggttcagggacaatatgagcacggggatacctcagatgaacaaagtcgttcttcatcatcataagggtaaactccaccacttggatcatgtgtcgatggcccccaacattgtttccttgtggaatgctaatttgagcagtcccaaatttgtccaatcttttgcttttttgagccaaactgaccacaagatgatggattatgttgggccatag

SEQ ID NO: 12017 - DNA, 3198 bp, Glycine max
  Peptide Sequence Number=SeqID_128795
atggcagaccatcggaatggaagtgcccaagcagccaatggaaaggctagtgcggcaggaactgcctattccattgatctcaatgcatttcaaaccagactaaggtcattttataaacattgggatgctcacaaaacagatctttggggctcttctgatgcaattgctgttgcatgtcctccaccttcagaagatctgagatacttaaaatctactgctctgaacttatggttgcttggatttgagttccctgagacaattatggttttctcaaagaagcagatccatatattgtgcagccagaagaaggcttctattctcgaatctgtcaaaaaaactgccagagaggctgttgatgcagatcttgttttgcatgtcaaacctagaaatgatgatggaactgctctaatggatgctatattccgtgctctgtcaaagtctgatggtcgggatactcccactgttgggtacatatcaagagaggctcctgaagggaaattgcttgaaatgtggactgaaaaattaaaaaatacaaaatttcagttgaatgatgtggccaatgggttgtcttctttgtttgctgcaaagaataatgaggagcttacatcaattaagagagcagcatacctgacaacaagtgtgatgaaaaactttgtcgttccaaagcttgagaatgtaatcgatgaagagaagaaagtttctcattctacgttgatggaagacactgagaaagctatcctggaaccttctaaagtcaactgtaaactgaaggcagataatgtagatatttgttacccaccaatttttcagagtggtggagagtttgatctcaagcctagtgctgtcagcaacgatgagttacttcattatgactctgccagtgtgatcttatgtgctattggggcgcggtataagagttactgctcaaacatagctaggactttcttgattgatgcagaccctctccaaagtagggcctatggggttcttctgaaagcccatgaagccgttattggatcattgaagcctggaaacaggttgagtgccacataccaagctgctgtttctgttgttgaaaatgaggctcctgacttgatttcgtacttgacaaagtctgctggaacaggcattggtattgaatttcgagagtcaggtttgaatattaatgctaaaaatgagcagatagtaaaagaaggcatggtctttaatgtgtcccttggatttcagaacgttcaaagagaaagcaccaagtctaagagcaagcacttctccttgttgcttgctgacacagttatcataaacaaagataaaactgaagttgtgacctctatgagctcaaaggctctaaaagacattgcatattctttcaatgaggatgaggaagaggaaaatcccagtgctaaagctgatgccaatggtgctgagcccttgatgtctaagacaacgctaaggtcagacaatcatgagatgtcaaaggaggaacttcgaaggcagcaccaggcagaacttgctcgtcagaaaaatgaagaaactgcaagacgacttgctggtggtggaaatgagacaggagacaaccgttcctcttcgaggacatctgcagaactggtggcctacaagaacataaatgaccttccccctcccagagaaatgatgattcagattgatcagaagagtgaagcagttctcttgcctataaatggaagcatggtaccttttcatgtggctttcattcgaactgtttccagccagcaggacaccaaccggaattgctatatcagaattatttttaatgttcctgggacccctttcagccctcatgattcaaactcaatgaagttccaaggatctatatatttgaaggaggcttcattccgctccaaggattcgaggcacataagtgaggttgtgcagtccattaaaacactcaggcgccaagttgtagcaagggagtctgagagagctgagagggcaaccttggttactcaagagaaactgcaacttgctaataatagatttaagccaatacggttgtctgacctttggatccgtcctgcttttggtgggcgtggaaggaagatacctggtacacttgaggctcatgttaatggatttcgttattctactactaggcaagatgagcgggtagacataatgtttggcaacattaagcattcattttttcagccagcagagaatgaaatgattacactactgcacttccatctgcacaaccatattatggtagggaataaaaagaccaaggatgttcaattttatgttgaggttatggacatggtccagaatgttggaggtggaaagagatctgcctatgaccctgatgagcttgaagaagaacaacgggagcgagataggaagaacaaaattaatgtagaattccaaacctttgtgaatcggctgaatgatctctgggggcaacctcaattcaatggccttgacctggagtttgaccaacctcttagagagcttggcttccctggggtgcctcataaatcttcagtatttattgtacctacttctgcctgccttgttgaactgatagagacccctttccttgttgtcacgcttagtgagattgagattgttaatcttgagagagttggacttgggcagaaaaactttgatatgacagtagtttttaaggacttcaagagggatgtcctcaggattgattctatcccttctacatcactggatggcatcaaggagtggcttgacacaacagacatcaaatattatgagagcaggctgaatctgaactggcgtcagatcctgaagacaatcacggatgaccctcagagctttattgaaggtggtggttgggagtttctgaatttggaagctactgattcagaatctgagaactcagaggagtcagataaaggttacgaaccatctgatgtggaacctgaatctgattcggaggatgaagcttctgatagtgaatcacttgttgagtcagaggatgatggcgaggaagattccgaggaagattcagaggaagagaagggaaagacgtgggaagaactggagagggaagcaagcaatgcagatcgggagaaagggaatgagtctgacagtgaagaagataggaaaagaagaaaggcaaaaagctttgttactctatgtatgttgttgcctgcggtagcagcttttgcgtttgtaggagtagtctcatga

SEQ ID NO: 12018 - DNA, 2937 bp, Glycine max
  Peptide Sequence Number=SeqID_128796
atgaagaagcagatccatatcttgtgcagccaaaagaaggcttctattcttgaatctgtcaaaaaatctgccagagaggcagttggtgcagatcttgttttgcatgtcaaacctaaaaacgatgatggatctgctctaatggatgctatattccgcgccatccgtgctctgccaaagtctgatgaccatgattcttccactgttggatacatatcaagagaggctcctgaagggaaactgcttgaaacatggactgaaaaattaaaaaatacaaaatttcaactaattgatgttgccaatgggttctcttatttgtttgcggcaaagagtaatgaggagcttacatcaattaagagagcagcatacctcaccaccagtgtgatgaaaaactttgtggttacaaaacttgagaatgtaatagatgaggagaagaaaatctctcattcaacgttgatggaggagactgagaaagttattctggaaccttcaaaagtcaattgtaagctaaaggcagataacgttgatatttgttaccccccaatttttcagagtggtggagagtttgatctgaagcccagtgctgtcagcaatgatgagttattgcattatgattctgccagcgtgattatatgtgcagttggagctcgatataagagttattgctcaaacatagctaggaccttcttgattgatgcagaccctcttcaaagtagggcttatgaggttcttctgaaagcccatgaagctgtcataggttctatgaagcctggaaacaagttaagtgttgcataccaagctgcagtttctgttgtggaaagggatgcacctgacttgatttcatatttgacaaaatctgctgggacaggcatcggcattgagtttcgtgaatcaggattgaatcttaatgcaaaaaatgaacagataattagagaaggcatggtctttaacgtgtcacttggttttcagaatttacagtgtgagaacagtaagtctaagaacaagcaattctctttgttgcttgctgacacagtcatcatcaccaaagataagacagaaattgtgacttctacaagctcaaaagctctgaaggatgtagcatactctttcaatgaggatgaggaagaggaaaggccaagcacaaaatcagatgccaagaaagcggagccctttatgtgtaagacaactcttaggtcagacaatcatgaagtttcaaaggaggagcttcgcaggcagcatcaggcagaacttgctcgccagaaaaatgaagaaactgcaaggcgtcttgctggtggtggaagtgaaacaggagaagcccgttcctctgcaaggacttcagcagaactcatggcctacaaaaacataaatgaccttccccctcccagagagatgatgattcagattgatcagaagaatgaagcagttctcttgcctataaatggaagcatggtaccttttcatgtggctttcattcgaactgtttccagccagcaggacaccaaccgcaattgctatgtcagaattatttttaatgttcctgggactcctttcagtcctcatgatgcaaactcaatgaagttccctggatctatatatttgaaggaggcgtcattccgctccaaggattcgaggcacataagtgaggttgtgcagtccattaaaacactcaggcgtcaagttgtagcaagggagtctgagagagctgagagggcaaccttggttactcaggagaaactgcaacttgctaataataggtttaagccgataaggttatctgacctttggatccgtcctgcttttggtgggcgtgggaggaagatacctggtacacttgaggctcatgttaatggatttcgttattctaccactaggcaagatgagcgtgtagacataatgtttggcaacattaagcatgcatttttccagccagcagagaatgaaatgatcactctcctacacttccatctgcacaaccatattatggtaggaaataaaaagaccaaggatgttcaattttatgttgaggttatggacatggtccagaatgtcgggggtggtaagaggtcagcctatgatcctgacgagcttgaagaagaacaacgagagcgacagaggaagaacaaaattaatgtagaattccaaacctttgtgaatcgggtgaatgatctctgggggcaacctcaattcaatggctttgacctggagtttgaccaacctcttagagagcttggcttccctggggtgcctcataaatcttcagtatttattgtacctacttctgcctgccttgttgaactgatagagacccctttccttgttgtcacgcttagtgagattgagattgttaatcttgagagagttggacttgggcagaaaaactttgatatgacagtagtttttaaggacttcaagagggatgtcctcaggattgattctatcccttctacatcactggatggcatcaaggagtggcttgacacaacagacatcaaatattatgagagcaggctgaatctgaactggcgtcagatcctgaagacaatcacggatgaccctcagagctttattgaaggtggtggttgggagtttctgaatttggaagctactgattcagaatctgagaactcagaggagtcagataaaggttacgaaccatctgatgtggaacctgaatctgattcggaggatgaagcttctgatagtgaatcacttgttgagtctgaggatgatgatgacgatgaggattccgaggaggattcagaagaagagaagggaaagacatgggaggaactggagagggaagcaagcaatgcagatagggagaagggaaacgagtctgacagcgaagaagataggaaaagaagaaaggcaaaaggctttggtaagtcacgaggagctagtctaagcagtagtatgccaaagcggtctaagttaagatag

SEQ ID NO: 12019 - DNA, 1113 bp, Glycine max
  Peptide Sequence Number=SeqID_128797
atggaaacggaaaattaccatactgttggcacaacctcactagatattagtgttggtattgtttgccactatcagtttgaaaatgggtcatctcagtttgctttcatggatgttgaaagtgaaagaggagcttcccttgaccattccctcagcttctctacagaaaactttgtgcagacccttgctttttgcaacggcttgattctcttgtctggctttagtggtgaccaatcctgttaccatgtgttcaaccccctcaccaagcacaatgtcatgatccctcaaactagtacccaagggggtgttgttagagttggattggcctatgatggagaccaatttgaggttgttcttgttgaagcagggtcttcaaattccaatggactaaaactgcatgttttctcttctgacactggccaatggaggtgccactaccccaccaatataacttctgccccatctttgcaagaacttgagttccaagaacttggcacacctcctctttatgcgaacagcgcgattcattgggaaatatgtggatatttgttggtctatcaagttcaaggcagccattgtgcactatatgagctacccaactactttgatgattggtcttggcaatcaactttgagttatcgccgtagcttgtgcgaatcaggaggagaggtctactactgctacactgatttcgacggctttcacatttggaaactcctcaatgaggaagagcatcccggattcttcaattattgtgattacaaaaggtttccatggaaactagtccatagtgtcatgcatcaagtgcttatgcctaagcaccaaaacttttttggcagctcctttgtttgggagccttacaaggttgcacccattgcctatagtgaacaagcccagatcatatatttgcagcttccaggaattgttgttgcttacaactttgatacaggaactatgggatcagtctgcacctactcttatccaggcataaacttcaattgctgctcattcttttcttcaactgcttctgggcctcaccatgcacaaagagacagcacaaatggacaatcggagctgaatctacccatagcagagatggaaaagttaaccctctaa

SEQ ID NO: 12020 - DNA, 126 bp, Glycine max
  Peptide Sequence Number=SeqID_128798
atggctacaattaaattaggagcacccaacattattgctggtgcacccagcaccctacgtgaaaagttgatccgtaacaagattgcggatcaacttgatccgcaagtgacttgtggatcaacttga

SEQ ID NO: 12021 - DNA, 229 bp, Glycine max
  Peptide Sequence Number=SeqID_128799
atgaaggtgaaggtaccgatattcggtgttgcggtggtggtcgtttgcggcgagtttggttatgtgttctatgtttgtgttaaaaattttgatttattgttaagatggacgaagatcagtgaatgtatgaaggtgtttgacagtcgagaggatgttttgcggtgggctcgatccgttgcttatgaaaatagatttgtggcggtgattgaaaggtctgacacaaacacag

SEQ ID NO: 12022 - DNA, 351 bp, Glycine max
  Peptide Sequence Number=SeqID_128800
atggagaaagcaggctctaacagtcctaaatctgctttgaagtttgtgaagaacacttctcagtctgcagctcaatggagcagtactaattctagaggaatgacaaaagatgtactcaaagacaagttctatgacaagactaaagcttcacgaaggtctccacccaaagaaagtaacatggcttcaccaaggtctccacccagagaaaatactaagccacaagaatttaaactccacacccaagaaagagctgtcaagcgtgcaatgttcaattatgctgtgacgacaaaattctatatcatggagctgcaaaagaaacaagaggaaaagctgcaaaaggtaggcacataa

SEQ ID NO: 12023 - DNA, 351 bp, Glycine max
  Peptide Sequence Number=SeqID_128801
atgactctatccaaaatactctttgttcctgttgagttccgacgaggtctgatcgagttgtctggttctctttttcttagtggaatcttcgatgttgaagtggggggaggtacttgcaaaaggaactctgtcgagcaagtcagtggtgctctgagatgtttatatgtctataactggaatgagaaaaacgtacctgacggaggttgcgtcatcctcggagtcacattggccaatcgcccctctatgtgtcgtgccgacttcatggattgcatgtttatggattatacggtacataagccctccaggcatgcgcaagtagctgggccaagatgcgtaaagaggtcagattag

SEQ ID NO: 12024 - DNA, 417 bp, Glycine max
  Peptide Sequence Number=SeqID_128802
atgtccaacaaggcaatgagttttcctgctttagttacatgtctttaccagttctatggagtacaggtcacaccaacaaaacacatccggcctccaattaacagatcatttattggaaaatattgcatgccaagcatcgccaggaacctagcccttacccttagcttactcccgaacagtttagagccactgttgcctggcctggagacaagcctatttttcaggaggaagcaagacctgcagatgctcaaggagctacccacaaagatggaggaagagctaaggaagatgaagacatggcgaatttggttgatgatttcattggaggagactcagcgccttagccatgatcttcaaaaactcatgaacttgtctttatgtttatttatcgcttttgtagacaaaggatcaagctga

SEQ ID NO: 12025 - DNA, 282 bp, Glycine max
  Peptide Sequence Number=SeqID_128803
atgatcgaactgcagagaacacaaacggtgcatagtgaacttgaaaacttgggagtgagtgcgagaaaaagagtggtgggtggggacatggctcgtaaccgaacctcggtccgaaccagccatcggaaggcacgtggcgaatatggtaggtgcggatttaaaagagtacggaagggattgagggattctcttgactttatccatttggaagagcaggtggggcccactcggttgccttgcgaactttgtgcacgcaattatgctaattgctttatgtcttga

SEQ ID NO: 12026 - DNA, 3588 bp, Glycine max
  Peptide Sequence Number=SeqID_128804
atgtcgcagcagcacgggacaattaccctcgttctggagctgaaggacagcttttctagagagcgagcgagtagattagttcatttccgcgaggagagagaaagtgcaagaattggaagagagagagagagagagttcactgttgctcattttagtgtgtatctaatcgaagacgagggggttccgatgtcttctctcagtagggaattggtgttcctgatcttgcagtttctcgatgaggaaaagttcaaggagactgtgcacaagcttgagcaggagtcagggtttttctttaacatgaaatattttgaggatgaagtgcacaatggcaattgggatgaggtggagaaatacctctctggtttcacaaaggtggatgataataggtattccatgaagatattttttgagataaggaagcagaagtatctggaggctttagataagcatgaccggtccaaggctgtagaaatattagtgaaggatttgaaagtgtttgctacatttaatgaagaattgttcaaggaaatcacacagcttcttacattggaaaatttcagggaaaatgagcaattgtctaagtatggtgatacaaaatctgcacgagcaatcatgttggttgagctcaaaaagctaattgaagcgaatcccttatttcgtgacaaactgcaatttcccaaccttaaaaactcaaggttacggactctcatcaatcaaagcctaaattggcagcatcaactttgcaagaatccacggccaaatcccgacataaaaactctttttgtggatcactcatgtggacaaccaaatggtgcacgagctccatcacctgctaataacccgctattaggtgccttaccaaaggctggaggatttcctccacttggtgcacatgggccttttcagcctactccagcaccggtgccaacacccctggctggttggatgtcaaatcctaccactgtagcacatgccgcagtttctggaggtggagctataggtcttggtgctccatctatgcctgctgctttgaagcatcctaggacccccccaactaatccttctgttgactatccatctggagactcagatcatgttgctaagagaacaaggccaatgggaatatcagatgaggtaaatcttcctgtcaatgtgttgtcagctacattcccaggtcatggtcaacatagtcaagcttttaatgcacctgatgacatacctaagactgttgtgcgaactcttaatcagggttcatctcctatgagcatggactttcatccaatgcaacaatctttacttcttgttggtacacatgtgggggacattgctttgtgggaggtgggttctagggagcggttggtctcaaggaatttcaaagtttgggatcttagtgcatgttcaatgccatttcaggctgctcttgtcaaagatccgggtgtttctgtcaatcgtgtaatttggagtcctgatggtgctttatttggagttgcttactcaaggcacattgttcagatatactcttaccatggtggggatgaaatacgacagcacctggagattgatgctcatgttggtggagtaaatgatctggcattttcccatccaaataagcaactatgcgtgataacttgtggtgatgataaaaccattaaggtatgggatgctgcttcgggtgcaaagcagtatacttttgaaggtcatgaggctcctgtttattctgtctgcccacattataaagaaaacattcagttcatcttttcaacagcattagatggaaaaataaaagcatggttgtatgacaatttgggatctcgtgttgattatgaagctcctggtcgttggtgcacaaccatggcttatagtgctgatggtacaaggctcttttcatgtgggacaagcaaagatggggaatcctccattgttgaatggaatgaaagtgaaggagctgttaaaaggacttatcaaggatttcgcaagcgatctttgggtgttgtgcaatttgatactaccaaaaatcgatttttggctgctggtgatgatttctccatcaaattctgggatatggataatgttcagcttttgactactgttgatgctgatgggggtctccctgcgagcccacgcattcgcttcaacaaggatggaacacttttagctgtctctgcaaatgagaatggaattaaaattttagccaatggggatggtattcgtttgttgcgtacgctagagaattctttatatgaagcatcaagagcatctgaagctttgacaaagcctacaattaatccaatttctgctgctgccgctgctgcaaccagtgctgcactggcagagagggcttcatctgtagtagctattgctggaatgaatggggatacccgaaacttgggtgatgttaaacctagaataagtgaagaatccaatgacaagtcaaagatatggaagctcactgaaatcaatgaacaatctcaatgtagatccttgaaactaccggagaatgtaagagtaaccaagatatcaaggttgatatatacaaattcaggtaatgctattctggcattagcatcaaatgccattcacctgctctggaaatggcagcgaaatgagcgtaactcatctggcaaggccactgctaccttgcaacctcagttgtggcaaccatcgagtggcatcctgatgacaaatgacattgctgatagcaatcctgaggatgctgtaccctgctttgcgttgtccaaaaatgactcgtatgtaatgtctgcatcaggagggaagatatctctgtttaatatgatgacttttaagactatgacaactttcatgcctccgccacctgcggcaacctttctagctttccatcctcaggataacaatattatcgctataggcatggatgattcctctattcaaatatataatgtccgtgttgatgaggttaaaagtaaactcaaagggcatactaaaagaattactggtcttgctttctctcatgtattgaatgtattagtttcatctggagctgatgctcagatttgtgtttggaatactgatggatgggaaaagcagaagtctagattcttgcagcttcctcctgggagaacaccaccagcacagtcagatacccgtgtacaatttcatcaagatcaaatacagttcttggttgtacatgaaactcagctcgccatttatgaagcaactaaattagaaggactaaagcagtggttcccgcgagactcatctgcaccaatatcgtatgcaactttctcatgtgatagccagctggtatttgccagctttttagatgcaacaatctgtgtatttagtgcttcaaacctcagattacgttgtcggatcaatccttcttcatatcttcctgcaagtgtcagttccaacatacaaccacttgtaatcgctgcacacccacaagaaccaaatcagtttgctttaggactgtcggacggtggagttcatgtttttgaaccccttgaatctgaaggcaagtggggtgtgcctcctccgattgagaatgggtctgcaagcaatgtggcagctacttcagttggaccttcagatcaagctcaaagatga

SEQ ID NO: 12027 - DNA, 339 bp, Glycine max
  Peptide Sequence Number=SeqID_128805
atgggtgaaaggatgaatggaaaggatggatcatcattgtcttcctcatctcctacgatggtgaagtgcaaattatgtaccattcggagagaaggttttggagatgtccacattggaatgaatcaagttcttgtagattttttcaatggattggtgatactgagactgacaataacgtgtctgcaaaagggagttggtagatttttggtagttgtcttcttaaatttggagaagtcaaaagaagaagattttaagtgctttagagaaaaaattgatgaaaagattgaagaaaaagttgaaagaattggacagctcgctcaacgtgcaatccaggcttag

SEQ ID NO: 12028 - DNA, 129 bp, Glycine max
  Peptide Sequence Number=SeqID_128806
atgaataaagaggtcgactttaagaaatgtgtagctattggagttcagaatggaccagtcaatgtagttgagggtggcactgaaggagcaactcatgatggaaatgagggtgcacttattggagtttag

SEQ ID NO: 12029 - DNA, 333 bp, Glycine max
  Peptide Sequence Number=SeqID_128807
atgagaaagaaggcaataagaaaggaggaggttgaaaggacaagtatccaccatgccctcactgtaagaagaagaatcatacaaaaaatatttgctggttcaggcctggagttaaatgtagggcctgcaatcagcttggtcatgtggagaagtggatgcacaaatcatatgacccacgatgccatctttaaggagctagatcaaacttacttctccaaagtcaccataggcaatggagatcatgttgatgtcaaaggcaaaaaggagttgttgttgttgaaactccttcgggtatcaaatatgtcaccgatgttttatttgtgcccgagttaa

SEQ ID NO: 12030 - DNA, 318 bp, Glycine max
  Peptide Sequence Number=SeqID_128808
atggcttcaagcagtagttctttatctccacctcctatatttgcaaaaaacccaacagtagctcaaataagaagtcacaatgatgaaatggcaaaggaaagcaaagcacttgtcattatacaggcagaactacatgatgacatttttatgaagatccgaactcttgagactgcaaaagaggcatgggatcagttgaaggaggagttccaagggaatgaaagaggaaaaagaatgcaagggctgaacttgagaagggagcttgaagcagtcaagatgaaagaaagagaatctgccaaagagttcagtgtcagactttga

SEQ ID NO: 12031 - DNA, 498 bp, Glycine max
  Peptide Sequence Number=SeqID_128809
atggcgggagattcatttgccacccctaatcaaactgttgttacccttgactctaatacatggatgcacaacatatactttatgctgatggaaggttatgggtatttgtttagcaaacctgtgctgaacataggaagaatatcaaacttactttctgggcttgagatggttgagcttgatattttcattgttctgattgatttgtcattatgttttaaccagaatgagggatccgaaagtcaagggaaagaggagatttgtgaagcacgtgaaagcagtggatctgaaaaggaagatgcaagtgacaatggggaaagcaatgaagatacattgcaaaatgaagctgaactcgttaagaacttgagtaagcaacgacgacatgccatagcgaaagctcataagggacgaaagactgttgcagccagaaattcctacaaagacaaaggtggtagatcatctcacaattctaaaatccagaaacagttgagcagctggtga

SEQ ID NO: 12032 - DNA, 258 bp, Glycine max
  Peptide Sequence Number=SeqID_128810
atgacggttgttgtttctgacacgatgacactcatagtgccaatgataacaacaacaattataatgataatgacacatggtagtcatgatggtgacactgacgacgattattgtaatgacaatcatgatgctgatgagggtaacattcctctcggggaggatgttcctcgaatgtacgttttgttcatatcgatcctaagcgacctcggaaacaaatctcgtcgtgtcatagggttcttgaggtctgaaggcggttga

SEQ ID NO: 12033 - DNA, 231 bp, Glycine max
  Peptide Sequence Number=SeqID_128811
atggcgaagttgatatcggactactttaaggatggaacaatatcggtttatataatggaaatagtaaactggattgatgaattagtgatgtcgttgtttctaactgaagaggaagtggatttcaattctgattcaatattgaaaactaacgatgagataggtattcaactagattggttatccactgaatttctaaataatataagatgttcaagacttccggatcattga

SEQ ID NO: 12034 - DNA, 247 bp, Glycine max
  Peptide Sequence Number=SeqID_128812
tgcagaaaaatgctatgcatttgctggttgtggaaagagcagtgcagaatgagttctgcatagttttctgcctttgccctgttttcttggctgtgatggtgggcaacaggggatggtgggtttatgcgcgatttgtggatgtggaaaacttgttgtgcaccatcgcccgaccgccacctagtaccacatgtgatggagtggtacctggagatatgtcgcgggggtcaggagaccttggggacgtcag

SEQ ID NO: 12035 - DNA, 192 bp, Glycine max
  Peptide Sequence Number=SeqID_128813
atggttcaagttgaagaagtggggggacattgtcatgaaattgatggagtggcctatgggatatggatcaacttgaagaagtcagagaccttaatatggctggactttgtggagtgtcctaagcctatggttcaagttgaaaaagtggggaccttgatatggatttggtggagtagccagcgatttgtctag

SEQ ID NO: 12036 - DNA, 438 bp, Glycine max
  Peptide Sequence Number=SeqID_128814
atggcgcctaccaggcaccctctggacccggataagtccaacaggtccctgggatttctcgccttgatcacaggactctgccagtcgttcggagtccctgtcgcacctagcaagagacaggcccagggggatgctccgcaggccgcagacgcgccgccacctcatcaggccggtccagccggatcgtttgatacggagcagtatttgcggcatttgatgagcctcagcctgcagagccagggatttacttcttttctgtgccctactccagaccagttcagggcagaggtcgcatggcctggagattggcctgaggcccgggcaggagaggtacctgcagaggcaccagcagaggctcccgacgaggcagatgaggcccgcgaggacgaggagatggacgatttacttgatttcttaggaggaagcggggccacatga

SEQ ID NO: 12037 - DNA, 496 bp, Glycine max
  Peptide Sequence Number=SeqID_128815
atggagattcctcatggactgccaccttcaagaggcatagaacatcaagttgatctccttccagaagcttcattgcctaataggccaacttccaacagcaagccccaagagactcagcataaggatgcacagaccaaagttacgtatgtgaaaagattgtatgaccaagtgaaggtgcaaattgcaaagaagaatgaaagctatgtcaagcaagcccacaagaaaaggaaggaagtggtacttgaacacggtgatgatcctgaacatttgaggacaaatgttttccaagaaggagggaatgatgagaatcatgaaactggccaaatacaggctaaaggcccaagtaatccttgtggcgtctacccggacttatcttccttcactggaagtggcgtctacccagacttatcttccttcattggaagtggcgtctacccagacttatcttctttaaccggaagtggcgtctacccagacttatcttccttcactggaa

SEQ ID NO: 12038 - DNA, 333 bp, Glycine max
  Peptide Sequence Number=SeqID_128816
atgacgttgctacttagcaacattctgcctagcgaccacaatgccgatcatgacataggtaagtatgcatgtggctcaactgaagtatcagttggtctgtcccgtcatgacatagggatcgcgcccacaagacacccagtggacctggaggagcccaacaaggtcctagggtttctagctctgattacgggcctttgtcaattctatggagtgttcgtcgcccccaacaaggtcatcagaccccctactaaccgagctttcatcaagaagtattgtgcccccaggcaagcacagggcgaaacaccacaacaaccaggggatgatcggcaatag

SEQ ID NO: 12039 - DNA, 678 bp, Glycine max
  Peptide Sequence Number=SeqID_128817
atgtggagcccactgaaagtgaggacgcgtagccctctaaaggcgagggcgtgtagccctctgaagtcgaggaagtgtcaccttttgaaggcgagggcgtgcagcccacggaaagtgagggcgtgcagccctctgaaggcgagggcgtgtagccctctgaaggcgaagatgtgcaaccctctaacggcgagggcattcagccctctgaaggtgagggcgtgtagccctcaaaaggtgaggacgtgtagccctctgaaagtgagaaagagcagccctccgaaggtgaggacgtgtagtcctttgaaggtgaaggcgtgcagctctctgaaggcgagggtgtgtagccctctgaaggcgagagcgtgcagccctttgaaggtgagaaagtgtagtcctctgaaggcgagggcgtgcagccctctaaaggtaaggacatgtagtcctctgatggcgaggacttgtagtcctttgaaggtgaggacgtgtagtcctctgaaggcgagggcatgtggccctctgaaggcaaggacgagtaaccctttgaaggcgagggcgtgtagccctctcaagccgaggacacgtagtcctctgaaggcgagggcgtgtagctctctaaaggtaaggatgtgtagttctctaacggcgagggcgtgtagccctctgaatgtgaggacgtga

SEQ ID NO: 12040 - DNA, 575 bp, Glycine max
  Peptide Sequence Number=SeqID_128818
atcttgtgagcgcggaagatgacgtaaatcaccacgtgtcaacgggcttgtcggcagcgattgacgaaggcttttcgtcttatagacagcaaaaagtttatacgaataaccactcgggtatttccggccgtcagcgtgactcaaaagtcagtatgacagatcttgtgagcgcggaagatgacgaaaaagtttatacgaataaccactcgggtatttccgcccgtcagcgtgactcaaaagtcagtatgacagatcttgtgagcgcggaagatgacggcgcagaagacgacgttagtctctgcgtgctatcaggcttttcgtcttacagacagcaaaaagtttatacgaataaccactcgggtatttccgcccgtcagcgtgactcaaaagtcagtatgacagatcttgtgagcgcggaagatgacggcgcagaagacgacgttagtctctgcgtgctatcaggcttttcgtcttacagacagcaaaaagtttatacggataaccactcgggtatttccgcccgtcagcgtgactcaaaagtcagtatgacagatcttgtgagcgcggaagatgac

SEQ ID NO: 12041 - DNA, 321 bp, Glycine max
  Peptide Sequence Number=SeqID_128819
atggaagccaatgcgattgcaattaccgctaccagcactgttgctaaggtgaacctgacgctcccatctggcctcaaccaaatgaatcatccaacctcagttatggtaggcaaagatttgggaacgggtaaaaaccctcatgctatggcagaaatgggaaaattggatcatctagaggaaaggctcagggccattgaaggacgcaaagattacgcctttgctatcctagaagagttgttcctagtacccaatatcatcacccctcccaagttcaaggtgttggactttgacaaggggactacttgcccaagaaccatctaa

SEQ ID NO: 12042 - DNA, 250 bp, Glycine max
  Peptide Sequence Number=SeqID_128820
atatggaaaagccgaaaacagcaaacaatatccaccattgcagagacatgcctttgtaaagtggtggtcacaattcgatacctcaaaggatgctccagaacaatctcaacttgcagcattcttagcaagctcaaaatctaaagagagtcttgctcagaatcttaaggaagttctccaactacttcaacaggaagaagaagaagaaccccccaagaaggaggccgaatcatctgagaataatgatgactag

SEQ ID NO: 12043 - DNA, 311 bp, Glycine max
  Peptide Sequence Number=SeqID_128821
cgttgatcacgagtctctgccagtcattcggggttcccgtcacacctagtaagacggccaaccacaaggggcaggtgcagactcatgagtgtctctaccagctcagcctcagtctgcagagccagggtttcgctccttttgcgtgccctactccagatcagttcagggcagaggttgcatggcccggagattggcctgaggcccaggcaggggaggcacccgcagaggctcccggcgatgcagatgaggcccgcatggatgaggagatgacagatttactcaatttcttgggagggagcggagccacatga

SEQ ID NO: 12044 - DNA, 186 bp, Glycine max
  Peptide Sequence Number=SeqID_128822
atggaatcgcacgaagacggtacaaatggaggcttcaatcccttctcattctctctaacgtttgggaaccctatcagagcaatcagagagaaacttgaggaatctcaagaaatttctagagatgttgttattgttgtcagaacatacgtgagcccgcttagagtatgtgataaattgaatctatga

SEQ ID NO: 12045 - DNA, 348 bp, Glycine max
  Peptide Sequence Number=SeqID_128823
atggatgagtttgattctcatgtggcctggccaggagaccagccctcttcctctggagggggtggggcctctacagcccaggagcctgtgactgaggagcctccagcagcaacagaggatgaggataagctcactcctgctgagccttttgattttgatgcaggtagacatacgactcaggaggaggaggctattccagaactgattccagagccatctccagcccctgcgcatgcacctgatgatgccacactagtggtggagcctgagcaaactattcatgattctttagcagctccagcactggatcttaatgaaaaccagccacaggaggagcaggacgtttaa

SEQ ID NO: 12046 - DNA, 189 bp, Glycine max
  Peptide Sequence Number=SeqID_128824
atgtcaccggtcaatgaattcattgaagttgaaagtatttctagattacaagatttaagaggtggtgtagaagaagtaaaccctaattttgttgtgatatggaagtttgttaagcaacaatttggtcagccttggcctacttggggagcaattccaaaagatcataggattttttttccagtgttttaa

SEQ ID NO: 12047 - DNA, 297 bp, Glycine max
  Peptide Sequence Number=SeqID_128825
atgtatatacatcaagcatggccaaaaatacatcatcaagcatggccaacaaaaacatatcatccaacttattcccaaaacaattccaaagctccaaaattccttaagggtagggtgagatcatggctcatttggctagaggcttataagaacaaaatgcctaaatcatctcccaacatgcatgtgaagcaagaagtatcaacaagagtcaagccaaggctattgtgcaagcaatcaatggggcaaaacacaccgaataaaatagatgatgatggctcaaattctcaccaagggtaa

SEQ ID NO: 12048 - DNA, 549 bp, Glycine max
  Peptide Sequence Number=SeqID_128826
atgatattggggaatctcattgctattacccaaacaagcatgaaacgtatgcttgcgtattcgtccataggtcaaatcggatatgtaattattggaataattgttggagactcaaatggtggatatgcaagcatgataacttatatgctgttctatatctcgatgaatctaggaacttttgcttgcattgtatcatttggtctacgtaccggaactgataacattcgagattatgcaggattatacacgaaagatccttatttggctctctctttagccctatgtctcttatccttaggaggtcttcctccactatcaggcaggcttatatttcttagtttcaataggactccttacgagtgttgtttctatctactattatttaaaaataatcaagttattaatgactggacgaaaccaagaaataactcctcacgtgcgaaattatcgaaggccccctttaagatcaaacaattccatcgaattaagtatgattgtatgtgtgatagcatctactataccaggaatttcaatgaaccctattattga

SEQ ID NO: 12049 - DNA, 207 bp, Glycine max
  Peptide Sequence Number=SeqID_128827
atgacccctactcatgatgccctgctatattacaacaggaggtggaacatgccacgccaacgtgagtttgttggttacttgttcacaggaaaaaatcccaaaaagtttgacattccttccggatgtaccatggatgaactgaaggatttgatcaagcaagttgcgcctcatgggattcccccttatggtattcatgaaacacaaacg

SEQ ID NO: 12050 - DNA, 921 bp, Glycine max
  Peptide Sequence Number=SeqID_128828
atgacaattggatgtggaactacttggatgttgtggaagcttgggaggattgatggggacccggcgttgagaggaacgaggataagagctacgtgggagtacgtgagctcagttggaggtgggcaacaggggatgtgtggaagggtgagacttcctgcttttattgttgaccacaaagtggtacctggagatatgtcgcgggggtcaggagaccttggggacgtcaggcgagctcctggcagtcaacagataaaaggaacaaagaccacaaagcaaggaggcttgcttgaaaacgaggtcaagaagctaggagggcttctggtaatcgattaccaaggggcctctggtaatcgattaccaggctgtgtaatcgattacacagaggaacatgccactggtaatcgattaccaatcgcgatggcggcgcaactaatccatgatcgtgtggagatggagtgcctagagggagcttgggagaccctcgaaggcaacgcaaggtgccgatttcggggtacgattcgattcacggctacctcattggtgcatccagatgaacccgcgcgtatgcttcagcgcactgtggagtggatattacccacgcctacaccatatcgtctagtggagccagtccaagtgatcgaggtgacgtcatctgaggaagacccagaggagctacctcctgagcctgctgtggatgctcttgactttctagagggcgacgaggacccactccttgaggtggattctcccgaggacgtcatgtcggcatctgaggcagactctacggaggatagtggccctagagagatggcgatcagtgtaagaaatgtcaaggaagatgatgtgatcctgactaggagcggatcgtttgatataggctacagagatttggatgacgccacttccagtgaaggaagataa

SEQ ID NO: 12051 - DNA, 683 bp, Glycine max
  Peptide Sequence Number=SeqID_128829
gggtgggaaaaaccactcttgccaagcaagtttatgaccaggtgcgtaacaatttcgagtgccatgcgttgatcaaagtttctcaatccttctctgctgaaggattgctgaggcatatgttgaatgagctttgcaaagaaaaagaggaggaccctcccaaggatgtttctaccatcgagtcgttgacagaagaagtcagaaaccgcttgcgcaacaagaggtatgttgtcttgtttgatgacgtatggaatgaaacattttgggatcacattgaatctgctgtaattgataataaaaatggaagtaggatattaatcacaaccagggatgagaaggttgcagaatattgtaggaaatcatcatttgttgaggtgcataagctagaaaaacctttaactgaagaagaatcattgaaattgttctgtaagaaggcatttcagtatagttccgatggagattgtccagtaaaggtgattggtgtaataatcattgtaatggagatccttagatctaccaacattagtcatcattttctgatgagaatactgaaactggccaaatacaggctaaaggcccaagtggagaaggacgaaggcccaagtggagaaggacaaagcctccgagcggagaaggatgaaggcctagagacagagacactatcaagactattaattgttgcttaa

SEQ ID NO: 12052 - DNA, 162 bp, Glycine max
  Peptide Sequence Number=SeqID_128830
atgaggctcagcccaacagtggcgctaagcgcgcatcaggtgctaagcgagcaaccaaatgcaggcgctaagcgtgacgttaagcacgaaggagcagaaaccgttacgcgcgctaagcctggttacgcgcccagtgcgcgatccaacagaagcacaggctaa

SEQ ID NO: 12053 - DNA, 264 bp, Glycine max
  Peptide Sequence Number=SeqID_128831
atggcgactgcaccgtgccatgtcagggccactcgtggtggcattcttggctatctcggcgaattggctgatttggcaaaagtttttatccaagttcttggtaatgagaaagccaccaaagaagtattcaacatctcgagagagaagtatgtcacgtttgatggatgtgctaagacgggtttaggggtagaattctacatcggtttgacaccacaaccgatgcagaatggtcaaaattctaagacagtcggtcaaccgatgtag

SEQ ID NO: 12054 - DNA, 192 bp, Glycine max
  Peptide Sequence Number=SeqID_128832
atgaagatgaaagcaaacaaaacaagaaatgaattgaaagtgtcggattcgaacacttaccgattgaagaacgaagaacgaatgaagaacggacaaagaacggtgaagaacggaggaaaatcttcacagatttgctcacaaaaacgtcttggaaggaaaaagggaggtgcttgccgcccagaggcttcttga

SEQ ID NO: 12055 - DNA, 264 bp, Glycine max
  Peptide Sequence Number=SeqID_128833
atgaaggtgaaagtgggtgatgagctcatcaattttgtgagtgagcttgtggagggtatcattgagggagatgacaatgtcctgacactaatgccatgtcagcagggctcatatgtaatgcttcagtgtttcctatcaaccgaaaagtccaacctcatggacgtcatcagcttcatcctcggtagcggtgcgcaactcaaggacctcatctacaccttcgacaaccacgagaaggagcagaaaggtcagagattttgtcagtga

SEQ ID NO: 12056 - DNA, 630 bp, Glycine max
  Peptide Sequence Number=SeqID_128834
atggcgcaggcagcggggttggcatggttacaggaagagaaactcctggatgctcgtcgccaagtgcgcaataggtttggtcctccttaccttcctcattcttctcacccatcgtccatgtatcatcgcggacacaaatgcccgtctagggcatttttgttgattggggatgaagacgaagccccttttgaagacagtgtgactcgagaccaaccacctgacctgccagatgaaccaaaccctaccccggcccaaatcagctttcattccatatcaggccacatcgcccctgagacattgcacctattgggttatatcgatgcgcaccccgtggtgattttagttgatgggggcagcacccacaactttatccaagcacctctggctaaatcgttgggcctgccttcccgagttacaaccccattgaatgtcatggtgggtaacagccaacatttacactgtgataagctttgtcagggagttaagctgttgattcagaacacaacattcatggtagacttgcatctccttcccttgagtggtgccaatgtggtgctaggagtccagtggcttaaggctctaggacccattctcacatattacaacaccctctccatgaaattcttctag

SEQ ID NO: 12057 - DNA, 899 bp, Glycine max
  Peptide Sequence Number=SeqID_128835
atgttgcagaaaggacttattcgcccaagtataagccctttctcctcccctgttttgcttgttaagaaacacgataggtcttggcgcgtgtgtgtggactacagggcattaaacacaattacaattaaagaccgttacccaattccaactgttgacgagctattagatgaacttggagccgcaagctggttttcccaattggaattactacagggctactaccaaattcggatgcatgagcctgatgtcgcaaagactgtgtttcgtactcaccatggccactacgaatttaaggtgatgttgtttgggttgtgtaatgccccttcttcattccaagctacgatgaatgacatttttcgaccatacctccgacgtttcatcatcgtcttcttcaacgatatcctaatatacagtcacaccctaccagagcatttgattcacttagagaaagctttcgagggcgttacatctatagctttaaagtccacgatatccaacaatttcccatcccgaaaaccacaagagctttacgaagctttctgggtcttgccggtttttatcgcaggttcatcaaaggctctgaaggaagctttgacttcagcccctgttcttattctgttggatttttccctcccttttactctggagacaaatgcctcaagggtgggcatgggagcagtgctttcgcagaaaggccacccaatcgcattcttcagcaagccattcagccccaaattgttacaagcctcaacttatgtacatgaattatgtgcaatcacaactgctgttaagaaatggaggctcatgggatatgattactgtattcaataccgatctagcaacactaacttggtggttgatgctttatcgcgtttgaaggagggatcagaggggaccat

SEQ ID NO: 12058 - DNA, 287 bp, Glycine max
  Peptide Sequence Number=SeqID_128836
ccaagcgcaattggttacagcatctgctgagctaagcgagcttcactcgatgagctcccataacttagtgaaatttctgctcagtgtagctactaccactcctgagcaatcccttgaggctacttcagagccttctgcacaagtggtaaacctaccctcacctcagccagcatcacacccctccactcctcttctacagattccagaggatccaactacaccagtcctagttgtggacacttctcctcccactactccagttcttcaactgacaaatcaggaggatg

SEQ ID NO: 12059 - DNA, 543 bp, Glycine max
  Peptide Sequence Number=SeqID_128837
atggagtaccattcaactccgacagggggccacatgggtgtagcaaagacgctagcaaggatcactgagaatttctattggccaggcataagaaaagacgtgaagcaatttgtagcagcctgtgttgattgtccacaaaccaagtacgagactaagaaggctgctggacttttatgtccacttccggtacccttgcagccatgggaggacctctctttagattttattactggcttgccatcattccgcggaaacaccaccatcctggtggtagtagatcgattctccaagggaatacatttaggttccggtgtctcaccgtttgaagttacttatgggaggaaaccacctagctggccgcagtatatcacaggctcttcgaaggaagaaattgcagaaggctcaagtaatcatgaagcaggcagccgacaagaagcgctgagaggtgatgttccatatcagcaatatggtcatggtccggctccggccacgcagacaagtttccattacgggccaacaccaaggatctttcaagctcaataa

SEQ ID NO: 12060 - DNA, 105 bp, Glycine max
  Peptide Sequence Number=SeqID_128838
atggctagctcaaatgcagaggcaactaacgaggttgctcagacgaaaagactgaagcgaacctcgtggatttatgtgcagattctcccaacacacaagtgttga

SEQ ID NO: 12061 - DNA, 549 bp, Glycine max
  Peptide Sequence Number=SeqID_128839
atggaggtggtattagtgatggtggtggtgatagcaatgtcggtgatgttggtgtggagtagtggtggtagcagtgttggtgatggttgcagtgacgttagtggtggtgatggtgacgaaagtggtattgttgttgttggtagtagtggtgatagtaatgataacggtgacagtgacattaatagtggtggtggtaacaatattagtagtgatggtgatgtcagtgacaacgatagtgatagtaacaatggtgttaatggtgtttgcaacgacattagtgatggttctactggtaataatgacggtgacggtggtggtgacaatggctatgacactaatgatagtgttgatggtggtagcaatgaggctagttatgacggtgataataacagttgtgtagtgatagtggtaatgacggaggtaatattgatggtgatagtgatagcaacaaaaaatatcattatcaaatgtgaaattagcaataatctcatgatgatcactcgtggtggtgataatgagacaggaattaacaataatctcatgaagtga

SEQ ID NO: 12062 - DNA, 133 bp, Glycine max
  Peptide Sequence Number=SeqID_128840
atggacgctcattcgtgtcaggatggcatataccaactgacacttcggcagagggagatcggagttatgatcgctaggcaagacattgctgagcagcaatgtcatccacatctgggtcaagttggtcatgctg

SEQ ID NO: 12063 - DNA, 1473 bp, Glycine max
  Peptide Sequence Number=SeqID_128841
atggaggaatcacagagaattggcatcgacttaatgcgtggtttccctcgccggagatcggtggaaaaccggtcatcttcccggcgaagacgctccatcttctccggcgccggcaattcggaatctgtggacgccgacgacttcgccgacgtctttggtggcccaccgcgaactctccttgcgcacaaattctcgagctccggttccttttacgaggaagttttccggccgccagagttcacgtgtccggcaccgaaggatggccggagcttgccggtgttcaggattccggcgaggaatgagggattttacagcgacatattcgggtcggacgatgaccggagatcgagagaccggtcaaggtcactttcgaaagagaattcgtcgtctgcgatgagttcggaggagttaagccctcgccggccggcgattgcagatgacgtggcactttctggttttgcttcaaagctaagtaatggaattctgagtgttcctaatgattgctacaggccaatcaatattccatggagatggaatccatccactgtgatgcctgaggctgaggaatacccaagtaaacttggggtgcccctttttgcatgcaaggatcagtcatttgaaattcagcatcaggacaatgagtacaaggagaacttcagaagcccccatttaggatcctcaagaagagtctcatccccagaaaccattagtcttgaatccaattcatatcaaagcaccaaagtgttcactgatgactgggagctcaattccccattttctgtcgtctcttcgctttatcaagaacctgaggcaaaattttctgtgcatgatcgagtgctttcagagcaaattatagaaggtgatgacaacgacgatgatgatgatattatgaactcctatgtcattgaactcaactccaacctcagaagggaagagtgtggagaatcagccattgatgaagcaattgcatgggccaaagagaagtttcaatcgcaaagctctgatgaagaatcaagtatgagaaacgatggcaaagagcaaactgttggaataggaagctctgatgcaagtgaataccatgacaatggaattggaatagttcaaactcaggagaagcgacagacagaaacagagaagttggacagtgatataagattgtggtcatctggcaaggaaacagatattaggctactactttcaacattacatcatattctaaggcctgagagtggctggtatgccattcctcttaagagtctattagaaagctcacaggtgaagaaggcttatcagaaagcaaggttatgcctgcatccagacaaactgcagcaaagaggagcgacactccttcagaagtatgtagcagagaaggctttctcaattcttcagttttgtcttgagatttgtggacaaacaccaagcttgacattcggaatgtcgggagtgtttgttgttgacaagcagtatatatag

SEQ ID NO: 12064 - DNA, 291 bp, Glycine max
  Peptide Sequence Number=SeqID_128842
atgatgacatgctccgtggatttgaacaacaaagatttggacataagcttctatgttttcaagccaactgtagtaattgttgatcatctagttcatggactccaacagttttccttactcactcagaatcttggttgtgtacaaagctctatatttaggagcatacatggaaatacgatcatatggtatggagcatggcagaaacggtctagtgatgaaaaagataagctgacagcaaatcttctgtcaagcagaatcacaatgcaaaatctgttgactagcagcttctaa

SEQ ID NO: 12065 - DNA, 324 bp, Glycine max
  Peptide Sequence Number=SeqID_128843
atgttctacagtcatttcgaaaagtggggctggacaggcaggacagttggatcttcttatattggatgcgttggaaaagatagttctttacttcttgatattcatctaacgttacaacagactggatcacctaacgttcacttttgtcttccacagactcttgaaactgtaaagaggttatgtccaaagcaaaccctattgataggaatgaatcacaagtttgatcaccacaaggacaatgagtttttaatggaatggtccagaagggaaggactatcagtgcagcttgctcacgatggtttgagagttcccataaacttatag

SEQ ID NO: 12066 - DNA, 267 bp, Glycine max
  Peptide Sequence Number=SeqID_128844
atgaagctccgaagaagagtgggttttatcggtgatgttgcgtgcttcattataagaacttctatcccaaggaaaagaaggaagttccgaagaggaatgacaagaaacatgagtacaaaggaagctttcatggcaaattgttggaatatggtggtggctactggtgtaatgagtaaactggaggatgttgtaagtttgaccaattttttccaaaacacccgtggaatatcagtagaagagaagcgccatatatttttgcctacataa

SEQ ID NO: 12067 - DNA, 210 bp, Glycine max
  Peptide Sequence Number=SeqID_128845
atggttcagcccactaatccaagtatcatgaggcatgtaaagcatgaaggacatgtcactcagtttggaactcccttgagactcaggctaatcatcgtgagggaggggggagttgcttgtgcacgacagggtgacctcgacacttactacctagttttcctaaatgagagtgtcgtgtggacacgcttaggctatttccttgatgaatga

SEQ ID NO: 12068 - DNA, 249 bp, Glycine max
  Peptide Sequence Number=SeqID_128846
atggagaggagtgctggattgattaagaagaaaggctttaaaggatcctttatagaagcaggatctaatgctaagacatttgcaattttatccggagttgatagtttggttgtctgcatattgggaagacttcgaggaaaggatgatgccattaatgctggggtagctggatgctgcgctggtcttgctacaagttttcctggtatatcccttcttttaataattgatgaactatcatcctttacttga

SEQ ID NO: 12069 - DNA, 258 bp, Glycine max
  Peptide Sequence Number=SeqID_128847
atggccaagctccgtgtggagcttgtaggtgtcgcaacctaccgttcaacgggagggcgacgcgactctcacgggatgcgtcttccaagggaggaaggcgcgcgaagttgccaccaacgtttattcgaggaaaacgtcaaaaaaattggaacatgtggtctacgaactttaattgtgaaaggttcgagagttgtttttacgcacggtgaaggtattagcaccccatgcgtccgtcacaagggcggcagccttcaatga

SEQ ID NO: 12070 - DNA, 186 bp, Glycine max
  Peptide Sequence Number=SeqID_128848
atgtccaacagtgctgtggcggcagggagaagaagggaagccgtgagcgacggagtagaggaaggacctacagattttatcctaaatgacgacgcaaatctgctaagaggcatccacaaagtgaaaacgttggcttatatgaatcactggcttatatcaatcgaattgaatcatagtgttaaatga

SEQ ID NO: 12071 - DNA, 408 bp, Glycine max
  Peptide Sequence Number=SeqID_128849
atggaggccttggttgcactaagggtaaaggtgaaaagtccagatacaggattgaaacagattatctcctcacctgaagagaccatggatgaaagtcatcaacaaaaagattctatggttggacctgaagataatcctcttcaacacgccaatagaaatactcattatgaggagcaagcagaagcaaacaataattacatcacaaaagatcccttcgaaatcctacagcacgtaaaggttgataatgttcctcaatctccaatatcaacaattaaaaaagcttttactgattccagtgataatgaattgagcttcagcaaagaagagctgagaaaagttaaagagcaactgagacttgtgtttgttgagttctatcagaaactcctccatctcaaagattacaggtaa

SEQ ID NO: 12072 - DNA, 1831 bp, Glycine max
  Peptide Sequence Number=SeqID_128850
ggatgagaaggttgcagaatattgtaggaaatcatcatttgttgaggtgcataagctagaaaaacctttaactgaagaagaatctttgaaattgttctgtaagaaggcatttcagtatagttccgatggagattgtccagaagaacttaaagatatatctcttgaaattgttagaaagtgtaaaggtttacctctagcaatagtggccattggtggtcttttgtctcaaaaagatgaaagtgcacctgaatggggacagtttagtcgagatctaagtttagacttggagaggaattctgagttaaatagtataacaaaaattttaggtttaagttatgatgatttgccgatcaatctcagatcatgtttattatatttcggaatgtatccggaggactatgaagttgaatctgatagattgattagacaatggatagctgaagggtttgtcaaacatgaaaccggaaaatctttggaagaagttgggcaacaatatttatcagggttggtccgtagaagtttggtgcaagcatcctcacttagaattgatgacaaagttaaaagttgtcgtgttcatgacttaatacacgacatgatccttagaaaagtcaaggatacaggattttgtcagtatattgacgggcctgatcaatctgtatcaagtaagattgttcgacgcctgacaattgcaacccatgattttagtggaagtataggaagctcacccattcggtcaattcttatcatgacaggaaaagatgaaaaattatctcaagacttggtaaacaaattccctacaaattacatgctattgaaggtacttgattttgaaggttctgttcttctcagtgatgttcctgaaaatttggggaatttatgccacttgaagtatttaagcttccggaatacattcatagaaagtctaccaaaatccattggtaagctccagaatttggagaccttggatataagaggcacatatgtgtctgagatgccagaggagattagtaagcttaaaaagctacgtcatcttctggcttattctaggtgttcaattcaatggaaggatattggaggcatcacatccttacaagagatacctccagtgattatggatgatgatggagtggtcattggagaggttggaaagctaaagcagttaagagaactgttggtgacagaatttaggggaaaacaccaaaagactttgtgttcctcaataaatgagaagccactcttggagaaactacttattgctgcagctgatgagagtgaagtaattgacttgtacattacgtcacctatgtctacacttaggaagcttttcctatttgggaagttaacaaggtttccaaattggatttcacagttcccaaatcttgtgcaactgtatttgggcggctccaggttgactaatgatgcattgaaatcactaaaaaatatgccaaggttgatgctcctctttttaagtgacaatgcttatgaaggtgaaactttgaattttcaatgtggagggtttcagaaactaaagcaactgcacctcgcaggtttggttcaattgaagtgcatccttatcgacagaggagcactgtgttctgtggaaaaaattgttttacaagacctctcccaactcaaaacagttccctctggaattcaaaacttggagaagcttaaagatatctatatcaaggacatgccaactgaatttgtgcagcgcattgctcctgatggaggagaagaccaatggatcatccaagatgtgccccatgtaggtatttggagtaagtatgctaaagaaccttcgcatatattcggcagaagtcatcactaa

SEQ ID NO: 12073 - DNA, 1178 bp, Glycine max
  Peptide Sequence Number=SeqID_128851
atggctgctgaaactccttccaccaatccactcattgagctagctacagtgtcatcccttcccaccaacatgaggggacttggccatgcatttcatgaattctctgcctccattcgagaatgtgattctccctttactacaaactacactaatggttctcacgcatcctcaactcatggccaaataaaccctcgtagtcacaattcctctacttctactgaccctccaaacaacaacactcaatggggtaatgtctctcactcagtccctgcatgccagtattgtggtcgttgtgaccacactgccaaaacatgttacaagctgcatggtattgggacccctctgatcatcatctctactaagcaaatatgtcacaacatgataacagttctgatcccaattggttgcttgatttgtgatcttggaaatttatccgtctcttttttcaacactctggctccacctctatactttggcatggttgctttttatcttggaagaccagaggagttcaaaataacagtgtcacgccctttctctttcttggcatggccaatctactgggctgtccaaggttgcatccttactggagtttgggtcattgcccatgagtgtggccaccatgcattcagtgaataccagttgcttgatgatattgttggccttgtcctccactccggtctcctagtcccatacttttcatggaaatacagccatcgccatcaccactccaacactggttctcttgagcgggatgaagtatttgtgccaaagcagaagtcctgtatcaagtgggtgtgtgttgacactgtatacgatgctgaagccattgtctcgttacccatttcagagattcagtatgtcagggacgccgtgaactcattcattggatggcccagacatctagtgaaacctttatcttatgattctgaccttaatgtgcggaagccagttgaacatagtagtgatgcaaagcttgcaggtgaatccgatccattgggagagttgatgaagatattgttttatgtgtaccagaatccagtggaagtgtcgtgggaggctcaccaatttggacttcctgagattggggcaaaattttacatcacacatgcagatctagcagaaataatatcaggtgacaagtgtttaaacatagcgatactacaattgtggaccat

SEQ ID NO: 12074 - DNA, 180 bp, Glycine max
  Peptide Sequence Number=SeqID_128852
atggtattaacaaagacaagtaaaaccaattttgtcaaagctgtagagacccttcatggaaggggttatgaatttcttgacgagaagttaatggaggaaaagaaaaagaaacgattggagcaagcaaaccaatctgggagtagtgaagcaattgttgatcctccatctcccattagatga

SEQ ID NO: 12075 - DNA, 249 bp, Glycine max
  Peptide Sequence Number=SeqID_128853
atgtctgaacattgtcattatacaattgtggattattggacattggcactggtagttatatgtcctaacgacaatgttgttgcttggttttatttcttgcacaataagtccgacaagtacttcaaaggaatagttaacagattcaatgataaacaaggaagtaaatccaagacaaatgttaaatggattccagttaaatgtaataagcaaagaggaagcactgagtgtgactattacgtcatgcattag

SEQ ID NO: 12076 - DNA, 158 bp, Glycine max
  Peptide Sequence Number=SeqID_128854
cccccgtccctcttgagtcagcaccttcaccgtctacgttcaagaggactagaaaagccacacgactcaaatctttgtctgccagacctgtgggtttggagagaccattggttcatgtggatcctaacattgagagtgctactggttcatacaaatag

SEQ ID NO: 12077 - DNA, 153 bp, Glycine max
  Peptide Sequence Number=SeqID_128855
atggatgctttaggacaatgtagattctttgtatacccttttaagatcttcatgtatcgctcaaccagtttttctgaaactaaggatacaacgactggaacgacgacaatgagctcaatggcaacgacgacaatgatgagagacaatgtttag

SEQ ID NO: 12078 - DNA, 954 bp, Glycine max
  Peptide Sequence Number=SeqID_128856
atggcagaaactgcagtgtccttggctggtcagcatgcactttcaaaaatattggaagctgtcaaaatgctgagagatctcccaaaagaagttagagacattacagatgaacttgaaagctttcaagatttcatcaatgatgctgataaaatggctgaagctgaagaagatgatggaaggcgtcatagaataaaagaaagggtgatgcggctgagagaagcagcttttcgcatggaagatgccatcgatgaatataacatctcctgtgaggataagcaacctgatgatcctcgatgtgcagctttactatgtgaggctgttgacttcatcaaaactcaaatccttcgccttcaaagtgcgtacaagattcaggatgttaaatcccttggaagagaaaaacgcactgtcatctctgtggtgggaattcctggggtgggaaaaaccactcttgccaagcaagtttatgaccagctttgcaaagaaaaaaaggaggaccgtcccaaggatgtttctaccatcgagttgttgacagaagaagtcagaaaccgcttgtgcaacaagaggtatgttgtcttgtttgatgacatatggaatggaaaattttgggatcacattgaatctgctgtaattgaaaataaaaatggaagtaggatattaatcacaaccagggatgagaaggttgcagaatattgtaggaaatcatcatttgttgaggtgcataagctagaaaaacctttaactgaagaagaatctttgaaattgttctgtaagaaggcatttcagtataattccgatggagattgtccagaagaacttaaagatatatctctagaaattgttagaaagtgtaaaggtttacctctagcaatagtggccattggtggtcttttgtctcaaaaagatgaaagtgcatctgaatggggacaaaaatttagacttggagaggaattctga

SEQ ID NO: 12079 - DNA, 630 bp, Glycine max
  Peptide Sequence Number=SeqID_128857
atgtatccggaggactatgaagttgggcaacaatatttatcagggttggtccgtagaagtttggtgcaagtatcctcatttagaattgatggcaaagttaaaaagtgtcgtgttcatgacttaatacacgacatgatccttataaaagtcaaggatacagggttttgtcagtatattgacgggtgtgatcaatctgtatcaagtaagattgttcgacacctgacaattgcaaccgatgattttagtggaagtataggaagctcacccattcgggagattagtaagcttaaaaagctacgtcatcttctgagtggctacataccttcaattcaatggaaggatattggaggcatgacatccctacaagagatacctccagtgattatagataatgatggagtggtcattagagaggttggaaagctaaagcagttaagggaactgacagtgatagattttacgggaaaacacaaagagactctgagttccttgataaatgagatgccactcttggagaaactacttattgatacagctgatgagagtgaagaagcttgtcctatgggggacgttaacaaggtttccaaattggatttcacagttcccaagcctgaacttgaattggagtga

SEQ ID NO: 12080 - DNA, 360 bp, Glycine max
  Peptide Sequence Number=SeqID_128858
atgatcatacgtgcttatgactatagagaaaagttgcaccctcatttcatcttagtcctctattgctgtcacatgtaccttggcatagaacttgtgttagcccttagtgctatcccgattcgaacccttttagggtttgagattgaacaacaattcaatgaaccctaccttttcacatcccttcaagacttttggggtcctagtcatgtgcttttttgtgcttcacgatgtgcacactgcggtgaagatgacgacaaagaaggtgatgctccgtcatgggtggcggttgcatcgcgttgcatcaggaccgctcgtggtggcgttcttggcggtcatcggaaggtgcctcatacttcttaa

SEQ ID NO: 12081 - DNA, 875 bp, Glycine max
  Peptide Sequence Number=SeqID_128859
ccctcgtaaaattaccttgtcctcaaggtgataatcctcatataattgatcccaattctcccacgagatgtcatccagggatagcccttcccattgcaccaacacttcccaaggcccttgttctaaagctcgccgataatctaatatggctagctaagggagtaatgactgtgaaaaataggatgtatgcggacttctttcggaaatttcaagcggtatgccacgggtcctatgcgttcaagaacttgaaatggtccgtagaatctcttagccaacttgcccatgattgcttgtgttatctttatacggtcttgtgctttgagaagcttcttgcgaatgacctgaaatgtttcttctctgttggtcaacatttcgtcaactgcatccaaagcggaagaacccgcgatatattcaagaaaattaaaggatttgcgtcggaatgtgatctcatatatggagtgggggtcgcagtcggagaccaggctgtgagggaggctgtgaatcttgcccatgatttccaagaacaacaaggctaccgcatgggctgtgtcccggtgatgaagtccagggataagtcttcccaaggtcgatggggaactggcagagggcatagtaatcctgctgctctatgtgtctccgagctatcattttcgcaatccccatgtgacctcccatgggtgttgtatgatactccaccagtaatgtgggaatcaggggcagatgtcaatactcaggatgatcctccaattggtggcgcagttcttcaaagaaaagagggcacaggacataaaggctcatgtaccgatggtgatggtggaggtgttggagaagaagatgacgagaggatgggaggagttcatcaattttctgagtga

SEQ ID NO: 12082 - DNA, 622 bp, Glycine max
  Peptide Sequence Number=SeqID_128860
gattctttggaggagcaggcgtcaaagggttcctttgtcccctatggacgtcaggatctcctgactgctgccattgggcgatcaaaacaccctagttgtgtgcgtgctgctggattcggtatccaatcacaaggacttgcatttcctccggagcctgaggttggtccctcaactgctcgtgtcagcacaaaggggagttgtgttgatccctcaatgaccgatctagacacgggggacttagacaaatgcgagttgtacatcgaagaaaatccttcccacctggttgccctagaaatagtttatgagggatccacagtcgttcacaacatccttttgttgcatggccaagtgaaggttggtgttgaggaggttaaagatgcagatgctcccgttcttgtacccactgacgatgttattttagtggggcaggcacttaacaccttccttgcttggccaacacatctcgtcaagcgtttactagaacaggtagttgtgtctctagcaaaacctacagatgggctggatcctcaggttacttgggatgttaccatgttcggggtgtttaatcaagactttcccttgtacataaagcacgaagatctatctgaaatagcacacgatg

SEQ ID NO: 12083 - DNA, 330 bp, Glycine max
  Peptide Sequence Number=SeqID_128861
atgatgttgtctatgatgatatcaagcccaagacaaccaggaaatgacattcatgtttatcttagacacttgattgaagacttggcaaagttgtgggatgagggggttgccgtgtttgatgttaacaagttcttgagcgggttgaggacatcaatactgttgcaacatgcccttttgcgggcgagtgaggcgaggctcacgggtgcgctttccaaaggaggaaagatgcgcggagtcgctaccaacgtttatttgtgggaaacgtcggaaaaatctaaggaaaccggtcaaaatgaaaattctaagttcgggagttgtatttacgtttga

SEQ ID NO: 12084 - DNA, 2103 bp, Glycine max
  Peptide Sequence Number=SeqID_128862
atggatcctctctttatcgaggaagatgatgttgtggggcttgatggccctagagatacactgaaaaattggttgacaaagggaagagaaaaacgcactgtcatctctgtggtgggaattcctggggtgggaaaaaccactattgccaagcaagtttatgaccaggtgcgtaacaatttcgagtgccatgcattgatcacagtgtctcaatcctactctgcagaaggactgctgaggcgtttgttggatgagctttgcaaactgaaaaaggaggaccctcccaaggatgtttctaacatggagtcattgaccgaagaagtcagaaaccgcttgcgcaacaagagggatgagaaggttgcgggatattgtaagaaatcttcttttgttgaggtgcttaagctagaagagccattaactgaagaagaatcattgaaattgttttctatgaaggcatttcagtatagttccgatggagattgtccagaagaacttaaagatatatctctagaaattgttagaaagtgtaaaggtttacctctagcaatagtggccattggtggtcttttgtctcaaaaagatgaaagtgcacctgaatggggacaatttagtcgagatcaatgtttagacttggagaggaattctgagttaaatagtataacaaaaattttaggtttaagttatgatgatttgccgatcaatctcagatcatgtttattgtatttcggaatgtatccggaggactatgaaattaaatctgatagattgattagacagtggatagccgaagggtttgtcaaacatgaaaccggaaaaacattggaagaagttgggcaacaatatttatcagggttggtccgtagaagtttggtgcaagtatcctcatttagaattgatggcaaagttaaaaggtgtcgtgttcatgacttaatacacgacatgatccttagaaaagtgaaggatacagggttttgtcagtatattgatgggcgtgatcaatcggtatcaagtaagattgttcgacgcctgacaattgcaaccgatgattttagtggacgtataggaagctcacccattcggtcaatttttattagcacaggagaagatgaagaagtatctgaacacttagtaaacaaaatccctacaaattacatgctattgaaggtacttgattttgaaggttctggtttacgttatgttcctgaaaatttggggaatttatgccacttgaagtatttaagcttccggtatacagggataaaaagtctaccaaaatccattggtaagctcctgaatttggagaccttggatattagagacacaggtgtgtctgagatgccagaggagattagtaagcttaaaaagctacgtcgtcttcaggcttctaatatgatcatgggttcaatatggaggaatattggaggcatgacatccctacaagagatacctccagtgaaaatagatgatgatggagtggtcattggagaggtgggaaagctaaagcagttaagggaactgttggtgctagattttaggggaaaacacgaaaagactttgtgttccttaataaatgagaagccactcttggagaaactagttattgaaacagctgatgagagtgaagtaattgagttgtacattacgtcacctatgtctacacttaggaagcttgtcctatttgggaagttaacaaggttgccaaattggatttcacagttcccaaatcttgtgcaactgtctttgaacggctccaggttgactaataatgcattgaaatcactaaaaaatatgccaaggttgttgttcctcgatttaagtgacaatgcttatgaaggtgaaactttgcattttcaatgtggagggtttcagaaactaaagcgactgtacctcggaaatttggatcaattgaagtgcatccttatcgacagaggagcactgtgttctgtggaagaaattgttttagaagacctctcccaactcaaaacagttccctctggaattcaacacttggagaagcttaaagatctcattatcgacgtcatgccaactgaatttgagcagcgcatagctcctgatggaggagaagaccactggatcatccaagat

SEQ ID NO: 12085 - DNA, 117 bp, Glycine max
  Peptide Sequence Number=SeqID_128863
atgggcaaagtgcaaaggagtaaacaaggtggttcctttagctacaatggagtgtccagaacagaagtaacaacttggtctctaaaattaaagaggttgtgcttcccagcttgctaa

SEQ ID NO: 12086 - DNA, 387 bp, Glycine max
  Peptide Sequence Number=SeqID_128864
atgattgcaacccgtgggagaaggggaggtcgtaacagtaaaggaggtcgcagtgaaagaggtggacgtcctcaatgctcttattgcaagaggatgggccacactcaagagaattgctattctctacatggctttcctgacaaagtagccaaagtagctcagacagaaaaatcagagtccaagttctctgatgaagagtaccaagagtatttgaagctgaaatctgagaaatccagcagtcgagcctcatcttcctctgtaccatgttattcgacggcatgtatttctcaatctattgacggtcccagtccttggattcttgattcaggtgcctctgatcatatttctggaacatggcacgggtcgactgattggagaaggacgtga

SEQ ID NO: 12087 - DNA, 192 bp, Glycine max
  Peptide Sequence Number=SeqID_128865
atgaagcaagacttcctaaataccatcatctcagagttttccctctacactctcataaaggagataggggaaagattcattggagatggagatgtagtggaggaagtgattgtgctggaagtagaagggacaaatctagatcttggtggcaacgttgatgatgcaaaaggtgttgaggatagagcgacatga

SEQ ID NO: 12088 - DNA, 1053 bp, Glycine max
  Peptide Sequence Number=SeqID_128866
atgcccaaacagaccttaaaggtctattttaggagaaagggcaaagtaccagttcaaaccggttttcagtaccggttcttgactggttttataccggttctggaatcctctggttttttagagtctccggaccggtcacctgaccgtttcccagttgaaccagccggtccggttacagtttgtgatatctgtggggatcaaggatttgaagagtatcttgctatttgtaacaagtgtcctgatggggcagaacacatttattgtaatgatgaaaagttggaaaaagtgccagatggtgattggtggacctgcgaagactgcaggaagtcaccaggtaatgaattaccaacattgggctcacaaaccgagatagaacatgctcaatgctctcctctattgaattcagaatttaatggacagctgacaaatcgggaggttgagaaaaatgtagctattcatgatactagaaagaggaaaaatcttggattgctgtccaaatctgtgtcatttgataatgctagctcagtgaaattaaatggcaaatgctctgaagttattgcagcaaatgactcggcatacacacctgtgtcaaatcctcttaagtgtcgaatgaatagagatatggttggagttcgtgaaattggtgaatctgatgctatggatacaaggtcttcaggtgacagaattttgttaggtggaggagataatttcaattctggttgttctgattcgagacaatcccttgatggaaaaaaggtaacacctgaatctgttccagaagatggcccctgtatgtctgttgagaatgtgggtgacaatcctagcaaagatgtgaaaagtaagatgccaatggaagagaataacaatgctgacaatggtaagctgcatggcaagcgtccaatggacgagaaaaacgatgctgacagactagaatcctctctttcacctgcaagctctgaggacctgcgtgattgggaaggtttagaaactttgagcactttgctgtggcttaggaaaattagcggtccttttgtgtacactggctcacagtga

SEQ ID NO: 12089 - DNA, 327 bp, Glycine max
  Peptide Sequence Number=SeqID_128867
atggaagaaaagtctacatcatgcaatgtgtgtgacacatggtgctcattttcattgtatgtgcatattgaacaagtggcagcaacagcggtgtgggaattgatgactttattgataaaacctataagggaaagcgaaccatcttgtgaagacattgaattgcttttaaatgtgagagaggcccaatctcgtgggcgatctggtgacactcccaaaggaaatattcattgtagatcggcttcggatgataattttcctgtggttgctggtattcattttcatgaagctgactgcaatcaccgtgattctcaaaactcggccgaataa

SEQ ID NO: 12090 - DNA, 210 bp, Glycine max
  misc_feature (22)..(22): n is a, c, g, or t
  Peptide Sequence Number=SeqID_128868
atgcattgccacattcccattntcatgcgtctctccaatctcaccatctccaaagggaagggaaactctcgagagattatgcactgcattacaaccatcttgttcctccacctcattgaaagtttacgtctacggctctatccccaccatcatctgactccactgcctcatgtgctcactcaacgtcatcgacaatttcatctttgttag

SEQ ID NO: 12091 - DNA, 678 bp, Glycine max
  Peptide Sequence Number=SeqID_128869
atgaggaggagaaaaattagccagaagttgattgccctctctgcccttattccagacctcaaaaagatggacaaggtgtccgtgttgggggaggctataaggtatgtgaagcagctgaaggagcaagtgaaggtgctggaggagcagagcaaaaggaaaaacgaggaatcagtggtgtttgcgaagaaatctcaggtttttcctgcggacgaggatgtctcagacacttcatcaaactcctgcgagttcggaaactccgatgatatctccacgaaagcgactttgtcactgccagaagttgaggcgagggtgtcaaagaagagcgtgctgattcgaatcctctgcgagaaggaaaaggcagtgctggtgaacatattcagagagatagagaaacttcatctctccgtcgtcaatagcagcgccttgtctttcggttcctctgttctcgacacaaccatcgtagccgagatggaggatgaattcaacatgggcgtaaaggaactggccagaaaccttagagtaggactgatgcaatttatacgaagaaataattgctatgtgggaaggaaaaagaatgaacaacagcatcacgctgaatcggttagagggaggcaattcagtgaccgtgacggacgaacaataaaggagtatgatccattatcggaaattgggatttaa

SEQ ID NO: 12092 - DNA, 153 bp, Glycine max
  Peptide Sequence Number=SeqID_128870
atgacaatctggaacttcattgatgatgatgagttaggcatgctgatgagggtgttcggttctgtctcctttttcgaggaagcctcttttgaggaagctaacgaagtcatcacaaaattgaaggatgttattgatcaaattgcggttatctaa

SEQ ID NO: 12093 - DNA, 993 bp, Glycine max
  Peptide Sequence Number=SeqID_128871
atggtaggcagcgcgttcttcgcgggaatcaccctgcatacgtattcaatgccgtttgcagggccgagcccatgctcggctgcgttccggtgctgcgcaccgccgcccgagcgtggtctcgggcgctacagcggcgcgcaggcaggaagacgttcaacggataggcgtgaagtgaatggcctgcccaccgcccggtgccagtaccagcgtcactgcatcggcgctggtcacctcgcgggtttcgcgtgcgaacgcgaacgggttgctgcggaaatcagcgccctcgccatcgcggtagatctcggcgcgatagcgcacgccgggttccaggaagcccagcgacaccggcagcacgcggccgtgttcatcggtgatgctgccgaggaaccagtcgcggctgttgcggtcgcggcgcacgatcgtcacgtagtcgcccacctcgccatcgagcacgcggctctgctcccagtccaccgccacgtcttcgatgaagcggaacgcctcgcgatgctgcaggtagtgctcgggcaggtcggcggccatctggatcgggctgtacagcaccacgtacagcgccagctggcgcgccagcgtgctgggaatggcctggccgtggcggcccttcaggctgaggatgccgggggtgtaatccatcggcccggccagcatccgggtgaacaccaggttgacctcgtgctccggcgggttcggcggctggccccaggcgttgtactccatgccgcgtgcgccttcgcgcgagatccaattggggtaggtgcggcgcaggccggtgtccttgatcggctcatgcgggttcaccgacaggtgccggcgcgcggcctcctgcaccaccttcaggtgatggcgggccatgaactgcccgtcgtgccactcgcgccagagcgagccgccagccggatttcgccggtcgacctggccatcgtcgcagacgtagccggtcttgaactggtccacccccagccgtgcgtacag

SEQ ID NO: 12094 - DNA, 349 bp, Glycine max
  Peptide Sequence Number=SeqID_128872
atgggctcggctctacagaacgatgcacctgaaagcgattacacccctgcaaacggcattgaatacgtatgcagggtgattcccgcgaagaacgcgctgcctaccatagcggcgacgacagcggccaccgcgtcgcacgtccacggggaaaatgttgaaccacaagcgcagcgcgctgagcatcgcgctggccgttgtcctggcgccgacgctggcgtctgcacagtccacgcagagcaccaccacgccggccgccaccgccgccaccaacctggatacggtgcaggtcaccggcatccgccgcggcatcgaaaacgcgatcgcgatcaagcaggacgccacctcggtg

SEQ ID NO: 12095 - DNA, 1783 bp, Glycine max
  Peptide Sequence Number=SeqID_128873
atggcacacttccgactttcccctctctcttacagctgcgcgctggcgctgctggttgccagcggtgcacaggcggcctcggcgtggcaggcgctcgacggtgccaaagtcgcggcgaccagcggctacgaatcacgcagcgcgcgtgactatccgctgctggccagcggcgccggcagtctgctcaccaccgccgtgcccggcctgaacttcgtcaccaccggtagcctgctgtatgcggcgcaggcactgaacggcggacgcatcgaactggatggtgcccatctcgccactgacggcgtgatggcacacggcgcgaatctcagcgacggacagttagtgatgcgcggcggcagcatcagcacgctgggcgacagcagcgccggcgtgatggccagcggcgacagcgaggttaccctgacggatgtcacgctcagcagccgcgggcgcgatgccaccggcgttaccctcagccagggccagttgacgctgcgcgacagccgcatcagcgccagcggtgaaaacggcggcggattagcgctgggcggtggcggacgcggcaatgcgcgcgcggcgctcagcgatgtgaccattgaactgagcggtgccggcacgcgtgcggcaatcgagctgggcaacggtacgctgaacggcagccaggtggcgatcaatgtcagtgaccgtcatcgcggcatcgaaatctataacccgcagggcagcagcggacgcggcagcgtgacgctgagcgatagccagatcgtgactgacgccggtgacggcgtgtacacgctgggcggcgatgtgctgctcaataacgttacggtcgacacgcaaagcggtatggcggtcaacgtcaacaatcgctcgaccgccacgctgctcggcggcagctttaacacgcatgccgataacgcgcacacgctgtggatcgcctcggagagcgcctccgcccatgcgcaggacagtcgcttcagcagcgagggcaacaacgcacacgcgtttcacgcgcagtttggcaacgccacgctggataatgttgcgctcagcacgcagggagccggcagctatggtctgtacagcgaagcgcaggttgatgcacagcatctgacggtggaaacccacggctccggcgccatcggcgtgtttgccgcgcgcggcggcaacatcaatctggccaacactcaggtgcgcaccaccggtgattccgccaccggcctgctggcctatccgggctcggcgatcagcggtaaacaggtcgatgttaaaactgaaggcgctggcgcgcacggcgcctgggtgcgctctggcagtatgcagctgcagcacagcacgctcagcaccgcaggccagcaggcagcgggtttgcaggtgaacgccaacagcaacggcgacagcagcacggtaacgctcgacagtacgcaaatcgtcagccagcaaggtgcggccatcaaagtgaccaacagcagcgctgacattacgctgaccaacggcagccagctgcagggcggcgacgcgctgctggacgtggcgagcggcacgctgccgtcagaagtcacgctgaacgcggataaccatgtacggctgcaaggcgacgtgcgcgccgacgccgccagccgggtggcgctggcgctgagcaacgcctcacagctgagcggcagcgttcagggtgccgatagtctgacgctcgacgccagcagccagtggcagctcagcgccagctcaacgcttaatacgctgcacagcgacggtaacgtgagttttgccccgcaggccagcggcttca

SEQ ID NO: 12096 - DNA, 204 bp, Glycine max
  Peptide Sequence Number=SeqID_128874
atgacattggcagaacaagcctgcaccaatactgccactttgactggcggaaataaacacatggatgatggatggatgcatggaggtgaactgacatgggcttttcatccctattttagggaggctaacatggctcaccatgtgagtcctggtttgctttattttgatgaacctcctatggtctgtataagccttttatggtag

SEQ ID NO: 12097 - DNA, 231 bp, Glycine max
  Peptide Sequence Number=SeqID_128875
atgagttggatcgatggtggtggtgatagcatgataaagtgggacaaaggttcatgcgaggccttgtgcaattttctgactcataaatatgttccaattgcatgctatgaatgcactatgcagatccttctacttgaaaaactactaagcagcaacatggcaccccaagagggcctaatggtcatgctcaaattaccaatgcaccctcttttaaaggacgactatgcatga

SEQ ID NO: 12098 - DNA, 404 bp, Glycine max
  Peptide Sequence Number=SeqID_128876
atggcagtgaggttccctgcacaggcatatggtggtgctgttggcatcaaaacccttcttctagtgatgccatctcactacaaggacatgctgaagggacctttcttgaaggtggacttgcattctggtgctgttgctgaagggctgttgactttcattcacaacatggctatcttctttgtcatgtttaagggtcctaggaacccttttgtgaaggtgtatttgctctctgtgactactgctgctttggctattcttggaggtggcttcactgggccttccatgaaccctgccaatgcctttggatgggcctttgtcaacaacaagcacaacacttgggagcaattttatgtctattggattggtcccttcataggggcttcctcagctgctttgattttcag

SEQ ID NO: 12099 - DNA, 261 bp, Glycine max
  Peptide Sequence Number=SeqID_128877
atgaaaaatctcatgaatgaatatcgcaaaaaaagcaatgtaactgttaaagatcaaattaagcttgactaccttgagtgtaactctcatgtcgccaaaaccattgaggcctgtatgacctttgcgggaccaaaaataagtgctcttgaactggaggatgacaaatttgggtcagaagatctaacacaggatgggagatctgagttgttgatgtcaggaaattcccatggatcattgtccatgatgaaagagagtttgtga

SEQ ID NO: 12100 - DNA, 1446 bp, Glycine max
  Peptide Sequence Number=SeqID_128878
atggctacatcctcagagacagaacctaagtcatttaaagaagcttcccaatcagacaaatggatcaaagcaatgaatgctaaaattgagactttagaggctaatcatacttggattttgactgacccccctcctaacaaatctgctattggatgtaaatggatttataaagtcaaacacaaggctgatgggtcagtagaaagatataaggctaggttagtagccaagggatatactcagattgagggtcaagactaccttgatactttttccccagtggctaagataactattgtgagattgttacatgttttagctgttgttaacaactggcatttaaagcaattagatgtgaataatgtctttttgcatggagaccttaatgaagaagttttcatgactttgtctcctagtatacactcaacaaaatctaatcaagtttgtcgattgcaaagatctttgtatggccttaaacaagccagtagacagtggtatgctcgattgtctactttcctcatctcacatggctatagacaatgctcttctgatcattctttgtttattaagcagcatcttcaatcttttactgctttagtggtttatgtagatgatattgtcttgttaggaaatgatcttctagagattaagtccatcactcagcttctggatgaagtttttaaaatcaaagaccttggtgacttaaaattttttcttggacttgaagtggcttgtagcatgttaggaagcaaacatgtctatactccaattgattatgctgtaagactataccaacaatttggaattccacttgatgatacaacaacttcatcatatcgtagtctcattggtcaccttatttacctcaccaatacaaggcccgatatcacatatgcagcctataggattcttagatacttgaaagctcatccttcttcagctcatcaacaagcagcctataggattcttagatacttgaaagcatcaccaggttctggtatatttttctctacttccagcatattgcaactcaaagcatttagtgactctgactgggcaagatgcattgatatcaggcgatctatcactggctactcagtttatcttggtaattcccttatttcttggaaatccaaaaagcaggccacgatctctagaagttctttcgaggctaagtatcgggcactagctagtgctacatctcttttgtttagtgacaatcgcttcgctcttcatattgctgctaatcatgtctttcatgaacacacaaaacatattgagatagactgtcacattgtgcgagagaaactgcattcagaccttatcaagttactgcccattgcttctgctcaacaacttgcagacatatgtactaaagcacttccaccaggcgccttcaattttcttcaatgcaagctaggaatgtcaaatatacattctctagcttga

SEQ ID NO: 12101 - DNA, 426 bp, Glycine max
  Peptide Sequence Number=SeqID_128879
ggccatggaggaggatttggagcgggtggtggtgtaggaggtggtattggtggaagtggaggaggaggaggtggaggaggtggcggaggaggaataggtggaggttctggccatggtggaggctttggtgctggaggtggtgtaggaggtggaggaggaggaggtggcggaggcggtggcggtggtggaataggtggtggctctggtcatggtggaggctttggcgcaggtggtggtgtaggaggtggaggtgttggcggcggcggcggacgtggtggaggtggagggattggtattggcattgggattggagtaggagttggggttggagctggtgctggtgaaggtttcggcgttggtgttggtggaggaggtaggggtggggatactatcttatctgctgatacttgtgttgaagtggtttag

SEQ ID NO: 12102 - DNA, 783 bp, Glycine max
  Peptide Sequence Number=SeqID_128880
atggctggagaagaagaggaaccggactggatgactccttataggaatttcctaatccgaggggtgtttccattagacaagaatgaagcccgacacctaaaacagaaggtcagctattacatcatcctcgatggcaagttattcaaaagagggttaacaacacccttcttaaaattcctgaacaaccaacaagcccttaactccacaaagaaatgcaaacaatgccaagagtttgcagacattccacgcacccctcctgacaatctccacagtttgagctccccttggccttttatcatgtggggaatggacatactgagaccattgccaaaggcatcaggagtagtcaaatacttactagtcgttatcaactacttcaccaagtggataaaagcaagaccagtgtgggaaattacgaccattgaggtggagaaattcacttggaaacacctcatatataggtacaacctcccatatgctattgtcatggacaatgacattcaattcaaagctcagacttacgaagatttgctaacaaagctaggcattaagcacttagtcacctctattgaacatcctcaaatcaatgatgccacgatccccattgaagtcggggaaccattgacaaggagactattgttccagcaacaacaaaatgaagaaagcataaagcgaatccgaggtgaagccaaaaaagatccccgagcaggaaagcttggcctcaactgggaaggcccattcagggtcataacaagcctagacaatgaagcctacagactataa

SEQ ID NO: 12103 - DNA, 962 bp, Glycine max
  Peptide Sequence Number=SeqID_128881
atgagaaattgcacttggtctcttgttccttttcctactaatgttaatcttgttgggtgtaagtggattttcaggatcaaacgacgttcagatggttccattgaacgtcacaaggctcgtttggttgctcaaggatttagtcaggaggctggcattgattactttgacacatttagtcctgttatcaaaccaactacaattcggttggtcctatccatagctttttccaatggttggtgcattcggcaacttgacataaacaatgcattccttaatggggatttagctgaaacagtgtacatgaaacagccccatggctttgaagattcctctcatccatcacatgtttgccgtctccacaaggcactttatggcctgaaacaagcaccccgtgcttggttcaacaagctgaaacactatcttgtcactcacggattcaaggcttgcaaaattcagcagttcatcactcagttacatacgacttttgctcttaaagacctcagtgatttgcactactttttaggcttgcaaatccgtaggtctccagctggtttaactctctcacaggaaaaatacatacatgatatactttgtcgcaacaatatgacagaagcctcatctatttccacaccagctaaccctacttctcaccttacaagtcgtggtgatccttttcatgatccaaagctctttaggaaaatcgtgggttctctccaatatgttgtaaatcgtgtcaatttatgcattctcctacatctttacactgatgctggttggcttttagacactgaagatagcagcaccgaagctaagtattgttcactcgcatacactgctgctgagctgttgtggatcaaacaactgcttcaagatctttgtgttcctcttagacgtcctccattattgttatgtgataatgtcagcgccatttttctgaccaagaatcctgttatacacactag

SEQ ID NO: 12104 - DNA, 1153 bp, Glycine max
  Peptide Sequence Number=SeqID_128882
atatgacttggggaagaatattttgctagaaagaaaggttgagatataccacacggagttcgacgacttcaagacagagttggagaggcgtaatctttacaaacgcctcaccaacttggctgatgggactattgatcttgctttggtgaaggaattttatgctaatctctacagctttgagggtccttcaccaaagcaagctagagttagaggctacctggtgtggagtgttctctcatactccaacctggcccccacatctcctacctctgacctgactgtggacagagctaggcttatctttggcttagtctctcacatggacatgaacatagaagcactcatttctagccaaatgacttctatagcccagtctaactcttctagacttgggtttcctgctctgatcaccgccctatgtcgagccagagaggttgtctctaacagcctcacttttgagcgcctgagcccggtcattaatttggcctacatcaggaagaactgttggaatcttgattatctatcagtttctatccaaggggctaggagggcgagggtgaggccagctgatcttccttccacatcagcagctcctactctagtatccacttcagcagctccttcagtcctgctcagattgattcttagcgctttaaagcttcagagcattcatcagggacaaatcattttacttcaaagtttacaagtggtggcgcctccaggatccattccttccattgaaaagtttctggagagggtagcctggcctggggcccaaccttctcttcatatggaagatgaaggtcccacagcccaggaaccccgacaggtacatgatgcttcctctgggaccaccattccagagccatttacttttcaacaggatgcaggtgaagagcaggttagactagagactgccaccattcctgaaagatctcttgagggcacttcagagccccctacttcagtggtagacctctcctcaccacagcctacagctgacccctctactcatgtacttgacataccagaggatcagaccacaccaatcctggcactgaacacctctcctccagctactccagtacttaatctgacagatgaggaggatgttcagacgcaggatactcaggacatgtctctggaattttaa

SEQ ID NO: 12105 - DNA, 219 bp, Glycine max
  Peptide Sequence Number=SeqID_128883
atggttgtggttgtgggcgaaactgagggccctccaaagtgttttcaaagggtataccaccaactgcttgcccttcagtggcatatccgagccaaggctcgaagtcagctagattgtggtggggaatttcatgggtctcttccacggtttgagagatatgtgcctgatcagattgagttgggaggcaagccatatgatgggaaggcgtgctcgttttga

SEQ ID NO: 12106 - DNA, 423 bp, Glycine max
  Peptide Sequence Number=SeqID_128884
atggcttcgaaaaatctttccgcaaagagatctaggagagacgctacggctgaagggaccagtgccgcccccaagtttgatagccaccgtttccggagtgtcgtgcaccagcaaatcttcgaggccattaaaggatggtcgttccacagagagaggtgcgtccaactcaaggaggatgagtactcaaattttcaggaagagatagctcgccgacattggacgtcgctggtgactcccatggctaagtttgaccctgaggtagtcctggagttttatgttaatgcttggcccacagaggagggagtgcgagacatgcgttcatgggtgaggggccaggagtgcgagttcagtcagaggaggaacatgggccgatgggttcgacgaggaggccattgcccagctgttatgcacaccggggcatga

SEQ ID NO: 12107 - DNA, 1077 bp, Glycine max
  Peptide Sequence Number=SeqID_128885
atccagttccacgcgggccacgtccgacaggtgcgtcacggcgccgtcgggcgaggtcttgaggatgatgtcgcggaattcctcttcggtctgcaggcggccgcgcgcattcacgttcagctgcagcggcacgtcgcccagggtcggggacgcgccgatcacgccggcggcgacctgcacgttctgctcgcggatggcggcgaccacttcggcggccgtcatgccgcgctgcgccaccttttgcgggtcgagccacacgcgcatcgagtagttgcccgcgccccacaccgtcacttcacccacgccggtgatgcgcgccaggcggtccttgatgttcaggatcgcgtagttgcgcaggtaggtgatgtcgtagcggtcgttgggcgagatcaggtgcaccaccagcgtcagggtgggcgagctcttggtggtcgtgacgcccagccgctgcacgtccggcggcaggcgcggcaacgcctgcgacacgcggttctgcaccagctgctgggccttgtccgggtccacgcccagcttgaagttgaccgtcagcgtcagattgccgtcgctgttggcctgcgactgcatgtacagcatgttctccacgccgttgatggattcctccagcggcgaggcgacggtttcggcgatgaccttggggttggcgcccggatactgcgcgcgcaccaccaccgagggcggcaccacttccgggtattccgagatcggcagctggaacatggccagcaggccgcccagcaacaccagcacggacaacaccccggcgaagatcggccggtcgatgaagaatttcgagatattcatgaacgttctcgttctgctttgcggttcaccggcggcttagttggcggccgcggtcttgaccgggttgcgttgcgccgcgaccatgggcaccacggtggggctcacggcgtcgccggggcgcacgcgctgcaagccattgaccacgatgcgttcgccggcggtcaggccggagtccacgacccgcaggccttcctggttggagcccagcttcacctggcggtagttggcgtggttcttgtcgtacagcaccagcac

SEQ ID NO: 12108 - DNA, 297 bp, Glycine max
  Peptide Sequence Number=SeqID_128886
atggcattcctttacgatcttaaattaggaaagttttacttggtcatatacataagtgtaacaatccgttgccatctttcaatggttcacgtggtcaaagacttatatttccttgttgtgcaggctccttatggagcttgtaggccttggatcttcttcatcaatggagtcctttgcctcttgaagattaatagtagcggaatggagaaggagaaagatgattggagatgctacttcaaggagaagatgagtcaagaagaagctcaccaccataggaaaccatggataagagcttga

SEQ ID NO: 12109 - DNA, 327 bp, Glycine max
  Peptide Sequence Number=SeqID_128887
atgagattgctatcaaatgctccccaacagcccaacaatgaggagctcaaacaattttcagattggctacttgacataggagatggaaaaattggacaacataatgacggattttcagaaatcactattctagatgagtttcttatcaaggattatgatgattatatccatgctattgttgaagtcacctatcccagcttgatagataactatagtgacacagattatttgcaaaaaagagttgttcttgcctctaaaaaggaaattgttgacaaaataaatgattatgtcctatcacttatacccaataacgaaaaggagtattag

SEQ ID NO: 12110 - DNA, 267 bp, Glycine max
  Peptide Sequence Number=SeqID_128888
atgtccattgttcttcagttgagtctaatcagtgttgttggtgatgattgtcgatttggaggctgtaggggtggcttgggtcgtcgtggtggcggagtagggggaggtattggtagtggtggtggctttggcagtggcggggcgggacaaggtggaggtgttggtggtggagttggaggaggcattggtggtggaggaggaggtggattgggtggtggctcaggacatggcggaggctttggagctggtggtggtgttggtggagga

SEQ ID NO: 12111 - DNA, 222 bp, Glycine max
  Peptide Sequence Number=SeqID_128889
atggacgatagcaatgaagatcaaaggcttcctcaccatcgcaatcccaacgaattagttgcattgtaccaattagcagaattgagggtgttatgttggaagctccatccaactatctatgagaatgatcaagagttgaccaagattagagaagatatgggatacaactacatgatattacttcaattgttacctcttcagtcttcattgattaacccatga

SEQ ID NO: 12112 - DNA, 312 bp, Glycine max
  Peptide Sequence Number=SeqID_128890
atggtaataatctccttggaggaaacatccacatctttggagagcaaatggaaagagacaaaggtttcaatgacactcgcggtgagaatggcaaaagctttattgttttcttcagagaaagaagcgtgtgtcgtggcgcgacaaagaagatcgatgctcttgaaggtgtacctaatggaagaagaccaatcaaacaaacaacacaatgaggagagtgagagtgagaggtcgagaacgagggtgagacagacaaagggtttgggctccaaaccttcttttataaaagaccctacaacattgatttttaaataa

SEQ ID NO: 12113 - DNA, 534 bp, Glycine max
  Peptide Sequence Number=SeqID_128891
atgacacagtatgagtatgcatgtgggaaagtaatgactaaagacaacaaagagcatgtggtttctagaggtatcatcccctttgatatcaaacattgcggcggtagggactaccagcagcaacatatcaccaaaagaggaaaactctatatgaggcttcactgttatcaagcgagtcggagacccaacatgaccacagatcgacctccacttcctatgtcttacacagacccgggtaggcaaccacataccaaatacaaaaacacagagaaaaaagtggagtcaccaactgtcgcaacccatccttcggcgggagggcaaggcgagatagaaaagaggcatcttccaagaaggagaacgtgcgaaagtcgccgccaatgtttattcgaggaaaacgttagcaaaaaccaaaaagaaagaaagatgatttacgacactaatgatcagttgaggtttactttacaagaagaaaagggattactgatgatagaaaaaggagatgaagatgcacaaaacaacaaagcggacccctaa

SEQ ID NO: 12114 - DNA, 411 bp, Glycine max
  Peptide Sequence Number=SeqID_128892
atggggtcggaccaagcaccctcctttaaaaagaggttctatcatgtcaaagttaagaacctagaactagccagcttgcgagaactaggacaacggatggatcaagttggacatcaagccttcagcaaggcgtatgggaaaatctgggagttggacatggtagaagtgttcgttgaagccatcgcatccctcgctcaatactatgaccagtcgctcagatgcttcactttcagagattttcagttggcaccgaccatagaagagttcgaagggatcttaggatgcccgctaggagaaaggaagctgttggatttcccctgcagttactttttggtccactttttctttatacaaatatgttcaagggaaatctggtttgccggaaagcgcaccggatcgtcaagtatttaa

SEQ ID NO: 12115 - DNA, 1299 bp, Glycine max
  Peptide Sequence Number=SeqID_128893
atgtgctgcggggaagcgctgccggcggcgctggtggcagagttttaccgccggctgccgcaggcggagttgcataacctgtatgggccgacggaggcggcggtggacgtcaccgcctggcactgttcgcgggaggcggaccgggtgtcggtgccgatcgggcggccgatcgccaacacgcgcatctacctgctggacgagcgcgggcagccggtgccgctgggggcggtgggcgagctgtatatcggcggggtgcaggtggcgcggggctacctgcaccggcctgaactgacggcggagcgcttcttgagcgatccgttcgcgccgggcgggcggatgtaccgcaccggcgacgtggcgcgttatctggcgaacggcgacatcgagtacctggggcgcaacgatcagcaggtaaaaatccgcggcttccgcatcgaatgcggggagatagaggcggcgctggcgacgcacccggcggtgcgcgaagcggtggtggatgcacgggcggtgggcgacgacaaacggctggtggcgtgggtggtgccggccgcggacgtggcggaagagacgctggcgggcgcgctgcggcagcatgtgagcgcggcgctgccggactatatggtgccgtcggcctgggtggtggtggcggcgttgccgctgtcgccgaacggcaagctggatcgtcgggcgttgccggagccgcagggggcgcagagccaggcggcgtacgaagcgccgcagggtgaacacgaaacgctgctggcggcgatctggcgcgaactgctgaacgtggagcaggtaggccgccacgataacttcttcgaactggggggccactcgctgctggcggtgaagttgatggctcagctgcggcgcgccggttggggagcgaacgtgcagacgctgttctcaacgccgacgctgtcggcgctggcgcaggcgatgagcgcgcaaggtgagatcgacataccggaaaaccggattttaccgggcggggcctccattacgccggagatgttgccgctggcgacgctgagccagccggaaatcgacgcagtggtggcgcaggtgccgggcggcgtggccaacgtacaggacatctacgccttgtcgccgctgcaggaggggattttgttccaccatctgctggcggaacggggcgacccgtaccagctgtctgcggtgctgcgtttcgacagccgtgcgcgcctggacgcctggctggcggcgatgcagcaggtgatcgatcgccatgacattctgcgcactgcgttcatcacgcagggcatgtcctcgccg

SEQ ID NO: 12116 - DNA, 261 bp, Glycine max
  Peptide Sequence Number=SeqID_128894
atgcttagacagccccctcagcctttttataggaaaaagggggaggaggttgccgcccagctcgcccaggcgacattagctcgcccaggcgagctgggttgcttcctccggaagcaacccagcttcaaaaaacagttatgggaattttacggaagcattacgggtgtcccggaagccccggaatccctttttccaacaaaatggggggtgtggtggccacctagctcgcccaggcgagctcagcttgcccaggcaagctag

SEQ ID NO: 12117 - DNA, 332 bp, Glycine max
  Peptide Sequence Number=SeqID_128895
atgtgtcgcaacctaccctacaacggggagtgcgggcgaaaagccaaagaagcgtcttccaaaaaggaaaatgtgtgggagtctccaccaacgtttattcgaggaaaaacgttagaaaaaacaaaaagagatctgggaattttgaaaagaaagggtgttgcccttgctcctatgtatcctcaggcaaagggccattttgggggacttgtagctcacccaagcaagctaaggcttactcctgaagtaactagctcgcccaagcgagctggtgccttcaccttgaagtcatttggtggcccaggcgcgccagaggctagcctgagcaagctagg

SEQ ID NO: 12118 - DNA, 1185 bp, Glycine max
  Peptide Sequence Number=SeqID_128896
atggtggcggcggtaaaaatgacgatcgtgttgatggtgacgatcgcggtggtgattgttgttgtggtctccaagcataagaaaacacttttgcattgtttgtcactctttatggtctataaagtaatagaaacttatgatacagaaaaaccaagtaaccaagttgtgaacaagatgaagaagaagctttctctttatgcttttttgctcaatttgagtctcttggttcttcttccttacagcaaagccactcaggctgataagcttcaagatttgattctgtctaagagctcgcagaagccacctgtgaccctttcttgggcagaggaagatgcgttgaaaactcattcttctgcatatgttgcatcccaagaggggcaaaaggaagctgacaagattgtcgcattgcctggccaaccctatggggtgaattttgaccaatattcaggctatgtcactgttgatccagaggccggaagagcacttttctattattttgtggagtcttcatataacccttcgactaaacctttagtattgtggctaaatggaggacctggttgttcctcactggggtatggtgcctttgaggaattgggacctttcagaataaactctgatggcaaaacactatatcgcaacaaatatgcttggaatgtagtggcaaatgtgttgttcttagaatcccctgctggagtgggcttttcctactcaaatactatttctgactatgagcattcaggagataagtcaactgcaaaagatgcctatgttttcctgatcaattggctagagaggtttccagagtacaaaacccgcgatttttacataactggagagagctatgctggccattatgtgcctcagcttgcatacactattttggtgaacaataaattcagtcaacaaaatattaacctcaaaggcattgctatagggaatgcttggattgatgatgttacaagtttgaaggggatatatgattacatatggactcatgctttgagctcagatcaaactcatgagttgattgagaagtactgcgatttcacttctgaaaacgtttctgcgatatgtgccaatgcaacaagaacagcctttgaggagaatggaaacatagacccttataacatctatgctccactgtgtcaggactcttctcttaaaaatggatcaactggttct

SEQ ID NO: 12119 - DNA, 279 bp, Glycine max
  Peptide Sequence Number=SeqID_128897
atggatgcaccgggtagtgttaaagattaccctagtcagtctgagtataaggggcgtgtcaagatgtttggaattgtatgttcaccatgggagtactttgttgagtatgtgaagaatacatggttgatccctcacaaggaatgttttgtaaaagtatggatggataaagttatgcacttagggaacacaataagcaacaggttaaagaggttgattcagaatagcatgagagacttatataaatgttgggatgccatgaacaacttcatcacattgtag

SEQ ID NO: 12120 - DNA, 630 bp, Glycine max
  Peptide Sequence Number=SeqID_128898
atgctcctgttcgtcgggggactcaactcgaaaccctgcgtgaagctactagcaaaggccggcgtgaacttggatcattgcgaccagagtggcagccttacggtgttacacatggcggtggggtatgtgaggcccgacatggtgaaggttttcctaaatctcaatgcatatctcgaggtggcggatgaccataggagaacgatgcagttcgggcataggattgtacttgaaggagtgattaaggttttggaaggggaggtatttgagtatgcagaggtgcaggagattcttgaacggagagggaagggtgagaatttggagtaccttgtgcggtggaaggacggcgaagcaaacgagtttgtagcagaggatttgttggccttaagtatagagagtgagagggagattatgccacatacaacaggtggtgaccgcaccagacctactgcatttgtacgtaggcgtgaaagatgtgcagttgtagatgaggagcaagagatttatgaaggtcctgaaggtgttgcacctgacaatgtagtgtttggtggtggacccgaggacaaatcaatccttattgaatatgctgatcacgtggcttgtaaactgtgggatggcttagtataccaataa

SEQ ID NO: 12121 - DNA, 111 bp, Glycine max
  Peptide Sequence Number=SeqID_128899
atgtggcttcaactagtcatggcattgttcgattatactttacagaaattgaacttgcctgtatatccacaatccaatgtcactgtcgatgagatacttgatgacgggtag

SEQ ID NO: 12122 - DNA, 270 bp, Glycine max
  Peptide Sequence Number=SeqID_128900
atgagtggtgatactgattcagttgttccagtcacatcttcaagatattcaatcaacaccctcaagctccctatccaggttccttggcgtccatggtattctggaaatgaggttggaggatatgtggttaaatacaacggtgtgacatttgttacagtaagaggagcgggacatctggttccaagctggcaaccatcgcggactctgactttgatattttcattcctccatggaagcttgcctcctacttcaccatggaagggtttctag

SEQ ID NO: 12123 - DNA, 354 bp, Glycine max
  Peptide Sequence Number=SeqID_128901
atgaagaagctaaagaagaacaaggatgcttacaatcctcagaaggaaaagaaagaaatgagagtgaaggggagagttaggcaaaagaaaggggcagttgtcgaaactgcctacaacaagggattcgaagagaagttgaagcctgaggattcatgcttagcgtgtcagactcacttagcgagctctagtcgcttagcaagaagatccccacatagcgtgaagaagctgcttagggagcctgaagtcaggaaggagaagaagacaaccattgggagccactccttatccacatatccatcttccttccatttcccttcatatttctgttggatcgagtggcctcagaataattaa

SEQ ID NO: 12124 - DNA, 294 bp, Glycine max
  Peptide Sequence Number=SeqID_128902
atggctgattctaaattactgatttatgagggatcgacgaccatccacaatgtccctttgtgtagtgatcaagtgaaggttggtgttgaggaagttcgagatgctgatgcttgtgttcctatacccactaaagaggttcagttagtggggcagacacttaacacctttcttgcttggccgacacatcttctacaacctttttcagaacaaggacttgagggaccgctgaaacctgtagataggtcggatcttgatgtcgatcccctatacctgatgacattgaccattgcatag

SEQ ID NO: 12125 - DNA, 150 bp, Glycine max
  Peptide Sequence Number=SeqID_128903
atgccaacatacctttcagagaaggtgtttctgaacttttttgagtttctggaggttaaagagaaaaccatagccaccagaaggagtgaaattaagactattatattcccttcagctaacaggagagattttgatgatgagcaatcttag

SEQ ID NO: 12126 - DNA, 948 bp, Glycine max
  Peptide Sequence Number=SeqID_128904
gcaagtgatgtccttgcagtagagcttttacagaaggatgcacggcttgctgctattggggagttgggaaaagcatgtcctggtggagcgtacgtatggaccttaggtggaacttgtatatcaaggacagtgtttatctcaacaacgtctttgaaagtagacattcaaagacgatgcttacctcagcaacgtcttagaatgcctactttcaaagatggtgttgaggtcgattggatggacctccttgatccttgttcaaatgattcccaggatgggacctccaaccttggccctaattgtgagagaagttgcccccttgctgtagcccacagaaacaatccagggcttcactcaaagattcatcagggaactggtggaatgcagaaatctctgcctttccttcagctccatctcttggcttcaccaactagtgagaaggataataagttgagttgtatggcatcttctgagactcccgctattttcgctgatcttcactcgataggccatggaagaggttgccctaaatcagctgaatcagggaatgtggatatgagatattggccgctttggccatgcaatactagtaaagaactaaggtgtggaggagctagagtagtcctcaagggtcaccttcggcggtctgtctttgcaatgatagtttccccaaaagtatacacagcggctcctccaagtgttttgatgataacaatgatgacaataaaagatgatgacaaaggtgatgaacaaaaagctcaaagatcaaagaacaactcaagtgaatcaagaacaagtcaagagttcaagaatcaagaagaattcaagactcaagaagaaagcctagaatcaagaatcaagattcaagattcaagatctcaagaatcaagatcaagattcaagactcaagattcaagaatgaagaaaagactcaatcaagataagtattaa

SEQ ID NO: 12127 - DNA, 207 bp, Glycine max
  Peptide Sequence Number=SeqID_128905
atgcagcaagctatatggttgcgcaaagaacaggactgcagatacaaccaaattcaaagaggggcaccacaaagccctcttacctcagagactatgctagctagactacgagagtacgcgagggaaagattaaatttaccagcatacaaagacggtcgttataaaacccgtcgttgggtaatccagttcaacgacgatgcctattaa

SEQ ID NO: 12128 - DNA, 240 bp, Glycine max
  Peptide Sequence Number=SeqID_128906
atggctgatggtaaactgatagagatgaagggtagagttaacctagggatccaatttgggcaattttggatgagggcaagggtgatttcgaaaatctgcacttatatgcagaattttgctgttaaaaaaatgcttatgcatggctggttgtggaaagggttgtacatattgggttctggacgtttcctagcagatcccaacggtccaaatgtagacttatgtactagggacctccagtaa

SEQ ID NO: 12129 - DNA, 300 bp, Glycine max
  Peptide Sequence Number=SeqID_128907
atggtcaaagtaggtgatctcagactccttctactcacgaacaagcagaacaagaggtgtaggaagccaatggagttgcaggggtgcaggggcagcgaggaggggggaagaggaggtgttgtagagcagaataaaagaaagaagaagcctaagttaagttctgatgtttctgcacaaggcatgagatcgttcgatgttttggtcaaggatgcggaaaatacccaaggggaggggcaaaagggtcattccaggcaattttttggaccctggctcgcccaagctaccctctggctcgcctag

SEQ ID NO: 12130 - DNA, 306 bp, Glycine max
  Peptide Sequence Number=SeqID_128908
atggaattaatagaaattttggaaagtgctgaagttcctgtctcgctaagcctggtccatgcgcttagcgagattcatccgctaagtgggacatcagcccgcttagcgagtaagaggaatcttggagagaatttgcctcgtcagcatgtgctcagcgcgtcaccaagtaacccaacgatatttttgtctcttcttgcgctaagcgcgccaggctcactgagccaaaatttacatactcacgctaagcatgaaagtggagctaagcgcaccttcgaggacataaaaccctttttaagcatgaagtga

SEQ ID NO: 12131 - DNA, 876 bp, Glycine max
  Peptide Sequence Number=SeqID_128909
ggctcaaagtcctccctgttggaactgcttctgagttctgagcctcatcgggtgctgttggttaaagtattgaataaagctcacgtggcccaagacatatccgtggaaggcttcgagagcattgtcaacaatattacggccaataactacctcaccttcgtcgaggaggagatacctgttgaagggcgaggacacaatagggccttacacgtgtctgtcaagtgcatgaaccacattgtggccaaggtgctcatcaacaatggttcatcactcaacgttatgctcaaaagtaccttggacaagctgcctttcaatgcagcccacctgaggccgagctcgatgatcactttccaagtgatggatatcaatccggcttatagttgtcttttgggccgaccttggattcacttagttggggtggttcctttgacactccaccaaaagttgaagttcgtggtggaagggcgtttggtcatcgtcttgggggaagaggacattctagtaagttgtccttcttctatgccgtatgttgaagctacggaggaatctttggaaatggctttccaatcctacgaggtagtaagcaatgcttctgtcgagtccctccctgtgcgacttcacatcaatggcgtggacatcttggtggaattcaaagagaaccacagaaggttcgggcttggatataagcccatgcgcgccgatgtgagaaaaagagccctagagagaaagagcaagagtatgggccaacaacaagggtcacaagtaaaaacgaccccttcgtgtcacatcagcggaaactttgtaagcgcgggctggagatatggcgggcaagtcaccatgatccacgatgaagcccctcaagagcattcagactag

SEQ ID NO: 12132 - DNA, 300 bp, Glycine max
  Peptide Sequence Number=SeqID_128910
atggataaatttgacatctttgtccctcatcctctcgtaattacatctttgcttccactggaaagtgggtgcaagccattgagagaatgtgatacgccctcgccttcagaggactacacgtcctcgccttcaaaggtctacatgtcctcaccttcagaggactacacgttctcaccttccgaggactacacgtcctctcctttagaggtctgcacgtcctcaccttcagaggactacacgtcctcatcttctgagggatacacgcctcgccttcaaaggattatacatcctcgcctttag

SEQ ID NO: 12133 - DNA, 213 bp, Glycine max
  Peptide Sequence Number=SeqID_128911
atgcctaaatcatctcctaacatgcatgtgaagcaagaagtatcaacaagagtaaagccaaggctattgtgcaagcaatcaatggggcaaaatacattgaatacaatagatgacaatggctcaaattctcaccaaggagaaaaacaaggattcaattcacaaaatgccaagaaactcctatttcaaaaacaattaccctttacctgtacataa

SEQ ID NO: 12134 - DNA, 171 bp, Glycine max
  Peptide Sequence Number=SeqID_128912
atggagacagagacaaaaacttcgattgctccgatttcaacttcagtgcacagtgaagaattggcagagtgcaatgcagtaacagtaaaattcaaatattcagttttgcttatgtttaggaaaggttggtggatggaaacagtcgaaaacaaaatggatacaataatatag

SEQ ID NO: 12135 - DNA, 222 bp, Glycine max
  Peptide Sequence Number=SeqID_128913
atggtcatcaacgaagaatccatgcataggatcactcgtaaccacaactcctatccctctcaacacatacgcaagccatacggggaaatccatctcaaggcacaacctagctccactcctggcaacttaatttcaattattaggtttttgacgattcacgagagcaaattgaatgagaagcaaatttcagtattcatggggatgaagaggctctacctttag

SEQ ID NO: 12136 - DNA, 660 bp, Glycine max
  Peptide Sequence Number=SeqID_128914
atggaatgctttgagttcaaatctatgggtggtgcagtggtcaatgttagaaacagattcttcatcactgcactagctggaaatctcttgctaggccagcagattaaacactatgatcataatagaactatagaagctaagttgttgcacatctatgatcctccagtggggaagaagcccgaagctctttacaaagtagacaatacggaggttaggcaatttgtagagaaatgcttagcaactgtgtccctcaaactttcagctagggatctcttggatgacccttttctccaaatttatgattatggatttgactcaaaagttgtgcagtatcaaagacatttctatgaagtaaacccattaattagacaacctttgaatggaatttacagcattaacaacaagttaataagtggggacactgataatgttggtggttatggacctgtatctgaattggattatcatcgagatgatttcgaagcaagtgaaattggtctatttggttgtgaagaggatgacaatttggtcgaagttgacaccacaataaaaggtagaagagaagatgatggcatctttttgacactcagaatagcagataaggaagattttaataaggagaggaacaagaaaggaggtcaaggacaacataagtactaa

SEQ ID NO: 12137 - DNA, 339 bp, Glycine max
  Peptide Sequence Number=SeqID_128915
atgggaatctcagctgaacaagaaagaatagaacttgccaataactctatgtatctacatagctttcaggttaaaccttctgaaactttatatacagatgagttgaacttgacaaaaatagcagaggaaaatattaggaaagaaaaagaagaacttgagaatatgaagagcttcagagacaaggagttggagcagaagattttatctcctgtgggtttgttacaaagctacaagaatgaacgagatgaattgcagatgcagcacgaaaatgcattgagagaggctgaggagttaaggaaaaaacaaggagaagcaattcaattcaagttgtgtaaataa

SEQ ID NO: 12138 - DNA, 264 bp, Glycine max
  Peptide Sequence Number=SeqID_128916
atgaggaagtttggagatgacaagtcttggattcaattaataaattttagttatttacatcttaatattcgtcctaatgaagaaaaatcgatgattttaccattgtgcatgtctaacaatggagacttcttcatgatgaaattcactagaaatgctgatgatgaataccaaacaattctgtataaccagagggatggtagtttcagaactttgttgtggcgcaacctcaagatttttaccaaaagtttggtcataccttattga

SEQ ID NO: 12139 - DNA, 315 bp, Glycine max
  Peptide Sequence Number=SeqID_128917
atggaagcgcagacacgaactccacaaacgcgaactcgacaatgtggttgcagtcacggaagcgcagcccagtttgcgacaaacacgaactcaggcagaaggagaaacaacaagaacgccctgggattaccctttccgggactctttcctttcctacttttcttcgacctgcgaaatggcaaagacgatctccacaatgtggttgcagtcacggaagcgcagaccagtttgacacaaagacgatctcaggcagaaggagaaagaagaagaacgatagggttcaagcgtgcgggttgtgcaatttcagaagtttaa

SEQ ID NO: 12140 - DNA, 479 bp, Glycine max
  Peptide Sequence Number=SeqID_128918
atggcgagtgacacacatgcaagagcatatcactttggtgagtctagtacatgccacccacaacaagtgacatgtgcgcacgagcaccctgacaagcctccacttcgtaggctttacaaaacccaggacaaacacgtccctggtccaatgctcgacaaacccaaggaatataggcttatcaaaaacccaaggtatgcccttggtaatcacatctccaaaacccaaggttggcccttgataccaaaacccaaggtccgcccttggtacacatgcttgcaaaacccaaggtcaacccttggtacatacttctataaaacccaagatgctctcttggtccgctcacatgcagcagctatgactaccaccatcaaaggtctaagttccaccaagcaaactatcacaccactatttggcaagacctttaatcaacttgaagcccatactcactcctcacaaccatcaaaggagtactttggacg

SEQ ID NO: 12141 - DNA, 1473 bp, Glycine max
  Peptide Sequence Number=SeqID_128919
atgaagaaactttctctgcatgcttgttttctcaatttgagcctcttggttcttcttccctatagcaaagccagccaggctgacaaacttgaagagttgattctatctaggagttcacagaagcctccagtgaccctttcttgggcagaggaagatgcattgaaaactcattcttctgcttatgttgcatcccaagaggggcaaaagcaagctgacaagattgcggcattgcctggccaaccctatggggtgaattttgaccaatattccggctatgtcactgttgatccaaaggctggaagagcacttttctattattttgtggaatctccatacaacccttcaactaaacctttagttttgtggctaaatggaggacctggttgttcctcattggggtatggtgcctttgaggaattgggacctttcagaataaactccgatggcaaaacactatatcgcaacaaatatgcttggaatgaagtggcaaatgtgctgttcttggaatcccctgctggggtgggcttttcctactcaaacactacttctgactatgatcattcaggagataagcctactgcaaaagatgcatatgttttcctgatcaattggttagagaggtttccagagtacaaaacccgcaatttttacataactggagaaagctatgccggacattatgtgcctcagcttgcatacactattttggtgaacaataaattcagtcaacaaaatattaacctcaaaggcattgctatagggaacgcttggattgatgatgttacaggtacaaaggggatagttgattacttatggactcatgctttgaactcggatcaaacacatgagttgattgagaagtactgcgattacagttctgaaaacatttcgcaaatatgttccaatgcaacaagaagggcattaactgaaaaaggaaacatagacttttataacatctatgctccactgtgtcatgactcttctctcaaaaatgaatcatcatctggttctgtatatgattttgacccgtgttctgattactacggggaagcctatctaaataggccagaggtccaactagctcttcatgcaaaacccacaaactggtcccattgcagtgatttaatagactggaacgacagcccaactaccatcctacctgtcatcaagtatctcaccgacagtaacattgtattgtggatatacagtggtgatacggatgcaagggtgccagttacatcttccagatatgcaatcaacaccctcaagctacctatccaggttccttggcgtccatggtattctggaaatgaggttggaggatatgtggtgaaatacaaaggagtgacatttgttacagtaagaggagcaggacatctggttcctagctggcaaccagcacgggctttgaccttgatcttctcattcctctacggaagcctgcctcctgcttcaccatggaagggttactaa

SEQ ID NO: 12142 - DNA, 135 bp, Glycine max
  Peptide Sequence Number=SeqID_128920
atgaagtgttatccaagatcgttctccttcatagcgacaatgcttccttcttgtgatgcggatgtaaaggagagaaagatgttaggtggtcaaccaccggggaagaaggtggagatgaagtggtcgggtctctga

SEQ ID NO: 12143 - DNA, 321 bp, Glycine max
  Peptide Sequence Number=SeqID_128921
atggtgaacaacattttcacactatctaggtacaaggaaaacatggtgcagcccaaaccaagtgttggccttaaggggaaacctcaccaacatgctctcactttcatgtcttcttgtatttcaacaaacaaaggcttgggccccctaggcctaagtcatgttttggcatttatcctaattttcgcaagctgtccgcatccaaaaatggcaaaaataccattgaggcatttcaccgagcacttggtgggcgcacttttaggtaccaacaacaggggaatgggggcaatgtggcttgccccatcatttcagaacacaacctag

SEQ ID NO: 12144 - DNA, 912 bp, Glycine max
  Peptide Sequence Number=SeqID_128922
atgttggctactggtaatcgattactgccttctggtaatcgattaccagagagtaaaactcttgaaaagtcaccaaaagaatgtgagttaaacactgaaactggtgatgatgatggctatgatagaaactttataatgttcatgccagatacagatatccctaaaccaaatcttttgtcaaatccaaactctagccccaacccagcttcttcaagtgaagtagtggatggtttgcaaatcactcaaatgttcaaggaacctaatggtgagaatcataagattttgtgtgatgctttggagaaaaaggttccacatcataaagatggtagtgttctagagattgcaagtattgtccttcattgtagatcaggaatgagaaaaagaaaattaaaccaattgatggagagaagaaaatcaagaaacttggatgttctttcttggtgtgaattctcaagccaaacatgttttgatgatgtccaaaagaatttgcttgataatgagcgtcatcatcaaaaaggggaagaatgtggattatgcattgttttgatgatgtcgaaaagaaatcacttgattgtcatcatcaaaaagggggagaatgtgaataagaatcaaacaaggccgcttcaaaggataagcatttgcttcaagattacttcaacaaacaaagccttgtttcaagattcactaaagatcaagccttgcctcaaaacaaagggtttcaaagtcatgcaaggctctggtaatcgattactagaagggaagaatgaaaaagagcttttgaaaagggttttgaatttgaattttgaacattgcaccctaaaccaattgcaggggcttgacttggcaggatttgaagatgctagtgcatctgaagtactgtttacactgtgcgcccattctaatagagtctag

SEQ ID NO: 12145 - DNA, 390 bp, Glycine max
  Peptide Sequence Number=SeqID_128923
atgaatgacataagatcacatcttaacacgttgctgaaaaatcactatgaggcaaagaagatattatgtcctatggatatggagtaccagaaaatacatgcatgccctaatgattgcatattgtacagaaatcaatttgctgaaatgcgcaaatgctccacatgtggggtatcacagtacaaagtgaaggatgacgaatgtagtgataatgcaaccaccagcaatggctgcccagcaaagatcgttgatcgattgtttccaaattttggggaggagtcaagaaacctaaggcttggaattgcttcggatgacatgaatccttttggtaacttaagcactaactacagttcatggcctattttgctgatgatttacaacctccctccttag

SEQ ID NO: 12146 - DNA, 267 bp, Glycine max
  Peptide Sequence Number=SeqID_128924
atggatttgagaggaagagagaacacagattcatgtcataaatatttgaagattggatactatcaaatctgcatgaaagaagatgatgaatggaaaacaacttttaaaacaaaatatggtttttatgagttgttggtgatgccatttggtttaactaatgcacctggtaccttgatgagctcaaatagaataagtgcagatgaagaaaaggtaaaggcaatcagggaatggcctgtacctaagaatgctaatgaggggctgtactga

SEQ ID NO: 12147 - DNA, 345 bp, Glycine max
  Peptide Sequence Number=SeqID_128925
atggagaacaacaatggtttgtggtggctaatggtggctgtgggtgatggagaaagtgctgggaactttagaaatggctttggaagaaagaaagaagaagaaatgacatttttcctaagctacacgaaagcaaaggctgaacttcgagcacactccagagatctactcaaagatcccaacggtcagatagtggaaaagtgtcttgtgaagctgcagaccaaagttcgagaagatccaacggttaacaaaggctgggcagcgtttttaccgaggcagcttcatgtagctttctctagaagcttcattaagaggcttcctccagaagcttcctcgtggcttctttga

SEQ ID NO: 12148 - DNA, 348 bp, Glycine max
  Peptide Sequence Number=SeqID_128926
atgcatctagtgaataagtgtgtcaatatgggacccccagatgggaatttttttttctacgggaatagggataaatattctctagtgagcacgacagagacgggggcatggatcacaccccttccagcgggggatgaagatagggaaaaaaactccaataatgaggatcaagaatggaaaccagggattagttggggggtggggagcaaggagtactcccctcttccctattcccgccctacccggttgacatccctactagtgaaagaggtgcaaacatttagtgttagaccatacttaatttggactgccttggagatagaatacttttgcaaatttaatttgtaa

SEQ ID NO: 12149 - DNA, 468 bp, Glycine max
  Peptide Sequence Number=SeqID_128927
atggctcatgaaccaccattcctcgagacctacaagacccttgtgcaaaaacaccaaggggattcaaggaatgggtactcctcctgctctatagtggagagatgtgatatacctttgatcgaccttagccggttaagtcttgagagagaagaatgcatgagagaaattgcagaagctgcaagagaatggggtttctttcaagttgttaatcatggaatttcacatgagcttctgaagagcctgcaaattgagcaaaagaaagtgttctatcaaccatttgtgaacaagtcatcaacacaagccaaagcttacaggtgggggaatcgatttgctaccgatctgagacaactgtcatggtcagaagcctttcatttctatctgacagacatctcaaggatggacaaacatgaaactctgagtaaaaacattgggatgcaacaactaaattttcaaggaaccaaaatataa

SEQ ID NO: 12150 - DNA, 159 bp, Glycine max
  Peptide Sequence Number=SeqID_128928
atgcagagtaagcaaaaggatttagagccagaggccaatgcattaatttccatgggaggaaaacatcaggttctgaaaatcttcaccttgccatgtaggtttttgttgacatattaccgtatgatgaagctcctaagctttgcggtgggtggcttctga

SEQ ID NO: 12151 - DNA, 357 bp, Glycine max
  Peptide Sequence Number=SeqID_128929
atgcatctccatggtgaaaaatcaccattgaaggacctcattgaagctcaaagatccagccttcatagaagctccacaagcaagcttccatcaagtggtatcaaaattgagtggaactttgaagtgtatctcataagactttcattcatcaaagttacaacaagtgttacacatgcttctatttatagactaggctcatacttagcccatgggcttgaaatctaccctaaggcccataagaaccctagggccttcccttggatctctagcccaatctacttggagtcttctacccaatgcccttgcgggataggattgcatcacgttgggtctgtctgtgtaaattcccaaccgtag

SEQ ID NO: 12152 - DNA, 426 bp, Glycine max
  Peptide Sequence Number=SeqID_128930
atgttatcaaagagaaaaactctagatgagggttcactgttatcaagcaagtcggagacccagcatgtccatagatttacctccactccttattttcccatggacccgggtatagggcccttccttttcaactcaccgtgtgtgcaaaaaggtgttggtgcttccccagtggagtcgccaattgtcgcaacctacccttcggcgggagggcaatgcgagactcatgggtgcgtcttccatgggatgaaattgcgcggagtcgccattaacgtttattcgaggaaaacgtcagaaaaatcggaaaagtgtggtctacgaactttaagcgtgaaaggttcgggagttgttttacgcacagagaagatattagcaccccacgcgtccgtcacaagggacggcaaccttcaatcaagtgtgaaaatatga

SEQ ID NO: 12153 - DNA, 510 bp, Glycine max
  Peptide Sequence Number=SeqID_128931
atggcttattccttcgctagcactacattgattatggtgcctactattgtaagcacgcctgaggaaacactcatggtgatgactacctcattcatttggcagcagatagacttagggatacataatatcatgtatcaactatctagacagttagccgaaatagtcaaacccatggtgcaaaataagatgcatcaatctaaagaattgaaggcaagaaaggcgcatgtcagcaataattatgctttgtttgtgcctataaatctagaagtgatgaatcgggaaacttcgccgaatacggtgttggcaggaatgtttaacacaatccaactgattggcaaccaaataagagcttgtaggccttggatcttcttcattaatggagtccttcattttttaagatcaatggcagtggaatggagaaggaggaaaggtgattggagacgtcacttcaaggagaagatgagtcaagaacaagctcaccaccataggaagtcatggataagagcttga

SEQ ID NO: 12154 - DNA, 288 bp, Glycine max
  Peptide Sequence Number=SeqID_128932
atggatgaaaacacccctgaatgcggtagcgagccacagttcaaccattgcagagacgtcatcttcattgcaggacatggaatctttcttacagtctctagtcctcaaattaaagttgatgcttctactacatcattccacagtgcgtcgaactctaatcatgatacgaacagggtcccattccaactgcgcaacgttaagctgaaatttcccaggttttatggcattcatgcccttgagtgggcatattactatggcactcctgatcacgagaggcttactattgag

SEQ ID NO: 12155 - DNA, 147 bp, Glycine max
  Peptide Sequence Number=SeqID_128933
atgactaaagcacgtcaaaagggggtacggaaagtaaatgaaatgaaaataaaaatacttggcaccctttgttgcacaatatgtaagtcacgagacgcgtcggaagtcaaaaggaagcagggttacgcgatccgtgaaattccgtaa

SEQ ID NO: 12156 - DNA, 273 bp, Glycine max
  Peptide Sequence Number=SeqID_128934
ggcccgactcatatatggtttggtgatgaagatggacctggatgtgggcaacctcatttctcttcagatcagctagatcgcccagtccagcacttccaggctcaggcttatcgtcagcaggatgcctggccaggagaccagccctccattgacaggggggaagagccttctggagccaccgctactgaggatcatgcagttgatgaagacctcatggctgacttggctggcgctgattggggcccatgggcaaacttgggcggaggcaactga

SEQ ID NO: 12157 - DNA, 408 bp, Glycine max
  Peptide Sequence Number=SeqID_128935
atgtcaatatatatgaaccacatggaacaatggagagtgttcaatgtaaaatccaagacgaagaatccatgttgcaagttagatatagctccttcccaaacccttaggagcggaaccaaggtgacgagggaagtgtttgaagctggggaaggaaggttgaaggttgtgggaagagcaggggtgtgcattgacagcgtggatctacaagctgccactgaatttggttacggcggcgagcctcgaatcactgccatatgccgctgcaaattcctaattccccttttctatacttatgttaaagaagaggagtatgctgctcatctttttctgcaatgcgaattctcttatcagttgtggattaaggtgtttggctggttgggagtctccatatatggtgcagattactga

SEQ ID NO: 12158 - DNA, 216 bp, Glycine max
  Peptide Sequence Number=SeqID_128936
atgatgaaatccatccaaggaggggacccatcaccagagccatggctagaagactctaggaagattgggtcagggatgcaggagaaggccctaagcttggcggctccaaaaaagaatctcactttgcgtactctactgttgtccgtctacttccacaaaactaaggttcatgatcatcataggtaccaaccacacggtacaaaattgcaagggtga

SEQ ID NO: 12159 - DNA, 2213 bp, Glycine max
  Peptide Sequence Number=SeqID_128937
atggaaaaggaattaagacaggaatatgtactctggaatttcctcagttgttgttgttgcaacaatagcagcactgatgtttttgctaaatttcacatgctttttcttcccaagagtgtggacaatgcccattttgaaaagatcgttggagcaaaaacctcatcggaggcatggaagatcttggagaaaggaaatgaaggtgcagaacagttgaagaaggtcactggtctcaccatcgtagagaaagtcctacataccttgaaccccaaatttgaccatattgtggtggccatagaagaatcaagaaatatggaaatcctgaaagtagaagaactccaaggctcactcgaagcccatgaacaacgacttcttgagcgctcagccaaagatattctagagagaaataatgaaactcaagaacatttcagaatcgagcaagatgtacctgaatcttcaagaagaagagggtacaaggggtatggaaagaaaaaaaaggatgaccgaaagacacttaagtgtttcaattgtggaaggattggacatttttcatctgaatgtcaatacccaatccagaatcaaaataatggaagacaaggcaatgaagcaaatatgaccaaggaagcagattcaaaagatgatgttctcttgttaatgatgaatgatatgaaaggatctgggggctcagaaatttggtatttggattcgggatgctccaataatatgactagtcatagagagtggttgatccactttgataaaagcaggaaaagccagataaggtttgctgacaacaggattatacaagcagaaggcactggagacattttgatcaggagaaaggatggcaacaaggcaatgatcaaagatgtcttgtacgttccagcaatgaaaagcaatctcatcagcattggtcagttaattgaaaagagctttagtatgaacttgcatcaaggaatcttggagctgtatgaccctaagcatagaaaagttctcaaaaccccactctcagccaacagagcattccaagtcacaattggcactctgaaatcccaatgtctatcagttgagtctaagatgaatgattcttggatctggcatatgaggtatggacatcttaacttcaaagatttaagtatgctacatactaagaacctagtcaatggtctccctcaaattaagaatccacaagctatatatgtatgtggcccctttgaagtttcttctctaggtgggaacaagtattttgtctcatttgtagatgaattcagcaagaagttatggacctatgactatccacttaaagctaagagtgaagtatttgatacctttaaggtgttcaagatactagaggagaaacagtcagggaaaagtttgaagatcataagaacagatgatggaggggagttcacttctaaagaattcgagaacttctgtagagataatggcatactccatgagatcatagctctatatacacctcaacataatggtgttgcagaaagaagaaatagaaccattatgaatatggttagaagcatgataaaaggcacaaatcttccaccgagtttttgggctgaaaaaaccatcagttcaacatctcagggtctctggaaccttatgctacactatgttccagatcagaaaagaagaaagctagatgataaaagtgaagctgatgcaatcctccctaggaagggaccagtcactagagccatgagcaagaggctccaagaggattgggctagagctgctgaagaaggccctaggactcatcttctccttgaagtggcatctcctctttctcttcctttctccatttcgctgtcattcatcttccaagaagcaaaggaatccattgatgaagaagatcctaggcctacaagctccaatggagcttccatcagaagccatgatttttattggctatcaccctatagagacaaccagaaagaacaagcaattgtcagcgtgcagatgcctatggagaattcagttagacatcaagatgaacctataccatatggagaaggtaatgctgaacaaatcacagaacgaataagatcaggaagaatgaggagcatgcttgcaagactcagagattaccacatgttccctaatagtgcaatcacagatgagggtgtgttcgtgaatatagccttgatggctgctacaaaaccaataaaatttcaagatgccgttaaagagaaagtgtg

SEQ ID NO: 12160 - DNA, 177 bp, Glycine max
  Peptide Sequence Number=SeqID_128938
atgtctctcaaaagcaacaacagacaacaatccgggtcaaggggagaaatcagaacacggatttctaaaggtttggaatgggccattgaagccaaccaatgcacgtatataacatgcaacccaacacccactaaggacgcgcagagtactgctgaatctggtggaccaaactactag

SEQ ID NO: 12161 - DNA, 219 bp, Glycine max
  Peptide Sequence Number=SeqID_128939
atgactttgcctacttctcgccctttattgtcatgccgaagaggaattatggatcgtattgtaaggattgatgttgaaatgtccaatgctcatgctgccactgttgctcagaacaccaatgttgctgcctcaagcattgatgttggcttgctaaccaagctaaaggggatggaggcaatgtcagcactttttttcccgagccagatgatatggcactga

SEQ ID NO: 12162 - DNA, 1183 bp, Glycine max
  Peptide Sequence Number=SeqID_128940
atgaatgaagaaataagagccattgaaaggaataaaacctgggatttagtcactttaccaattggaaagactcctatagcggtcaagtgggtttataaaaccaaactgaagcctgatggcaacatagccagtaggctagtagttaaagggttcatgcaaaaggaaggagaggattactcagaaatatttgcactagtggctagatttgagactgtaaggttactagtaagcttggccaattggaagaattgcaaaattttgcaattagatgtcaaatctgcatttcttaatggccctttagatgaagaagtttatattcagcaactccccggatatgaagtcataggcagtgaagacaagcatggtatctatgtgaaggcaactaaggatggtggagtcctgctaatatgcctatatgtggatgatttgctgattatagggagtaatccagctgagatagaaaagttgaagggcaatctcaaatctgaattcgagatgtcagatttaggcttgctatcatacttccttggtattgagtttgctgaaactaaggatggaatagtgatgcaccagaagaagtacattaaagaagtattgaagaggttcagcatggatcaatgtcataaggtagatactccagtggaagggaatctgaaactggatacagacgatcatgaagcttcagtagatgccacattgtttaggcagctagtcgaatgcttgagatttgtttgccacagtagaccagaaatctcatatggagttggtcttaaagaaaaaggtgagttatacctcatagcttattctgactcagattggtgtggggataaagtggagagaagatctacttctggctatgtgtttctactttgtgctgagtacatttcagcttgtagtgctgcatgtcaagcactgtggattctgtcccttatttctaaattaaatctgaagactagtgactttatggagctacaagtggacaataagtttgttattgacttagcaaggaatcatgtgtcccatggtcatagcaagcacattgaaacgaagtttcatttcttaagggatcaagttaaaaaagggaagataaggttgaaacattgtgggacagatttgcaacttgctgatattatgacaaaggtgttgaaggctgataaattcaagttgctgagaaatatgttgg

SEQ ID NO: 12163 - DNA, 222 bp, Glycine max
  Peptide Sequence Number=SeqID_128941
atggagaacaaagagagcaagaaagcatggatggagaagaagacagagagaaggagaagacaacgcgaaggagacgaaacatacctatgtatggtggcgaaggagaagaagcaaagacttgtgacgatgctcgagtgcaacgatgacgatgctcgagtgcgacgaacacgatgcttagatgcagacagggacggtttcgctagacggagattagaagaataa

SEQ ID NO: 12164 - DNA, 207 bp, Glycine max
  Peptide Sequence Number=SeqID_128942
atgactaagctttacatcctattgcttgaactgtgtgaagataaagagagaaaatattccacaagcagcctgaggttaaacaagttgctacaccagaaaaagggcaccccaaccccaagtcccaaacctgttagagatagggggagcaacacgagcaacatggtgaacaaactaaggctaaagcttgaagctcaaggaaaagcttga

SEQ ID NO: 12165 - DNA, 186 bp, Glycine max
  Peptide Sequence Number=SeqID_128943
atggtgaagatggtgaagaaggggttttttgatggatcatcactaaaggttgagaaattttttgaaatttctgagggatacgcgccgcgaaaaactttggcggctttaatgattcgtaatttggattggacggcgtgggagagaattcagaatactgttggtgtggggtgtagggtagttgaatag

SEQ ID NO: 12166 - DNA, 1770 bp, Glycine max
  Peptide Sequence Number=SeqID_128944
atgagagagcaaaacgttgagtcgttctacgctaagcttcgcgagtccgcgctatcttcttcctcttctccggttctgatttttccctcaacctccgacgtggactctctctgtgccctaaaaatcatcttccacatcctcgaatccgattccatccaatacgcgtgctacccagtgtcgtcttttcacgagatccacaagtacacgtcatcttcctcctcaaacgacgagcctctctccgtcgttttggttaattggggcaaccacagagacctcagcaaaaccctcaacctcgcccccaacgcccgcgttttcgtcgtcgacagccaccgccccatccacctccgcaacctcagcgatcaaaacgacgccgttctggtgctcttcactaaagacgacgagaaccaatccgatctcgcatccgacttcaacctcgccacgctcgccaacgccgcccccaccgtcgattcggattcccagtccgactccgaatctgaatccgattccgactccgactccggctccgaaagaaatggatctagaaagaggagaaagaagaaccctgaggatgatgatgaagatccaattaagctctaccggaagctgaagaaaggctattaccgattggggacgtttcacgggaagccctctgggtgtttgatgtatgaacttgctgacaagctcaggaagaacaccaacgagttgctctggctcgcatgcatttccctcacggatcaatttttgcacgatagattgagcgatgagaggtaccatgatggagtcatggagcttgagcagcacataaacagttctggtaatttggatgtggttactttggttactcttaaggatggcaccaagattcgtgccccgaatttgtcgcggattacttatgaggaccagccgaggctcatgctgttgcaggagtggagcctctttgactccatgatgtgctcctcgtacattgccaccaagttgaagacgtggagcgagaatgggatgaagaagctgaagcttctgtttgggacgatggggttcgctcttggtgattgccagcagaagtttcagcacatgaatgtggaggtgaagcgcaatatgaagaaggagtttgagaggtttttgcctgagtatgggctcactgatttttactacaggagtttcattaggactctcaagtatagttctaagatttctgctgcggatgtggtgtatggtgtcactgcattgcttgagtctttcgtgagatcagatggttcttgtgcttctaagcagtttggtgtggcctatgatgcgctttctttgaacaatattgacaacttgagaaccgggatgcagcatgctattaagattcagagagcaattttaaggcaaggcagtgctgcaattactaagattgggtgtataaggagtggaaggagtttccggtggctgaagctggaggattccaatgatgctatgctgttggggtacccacaggctttgactaagttctgtttatttatcatggatgctttgcgagagaaaggggccaaaatgaagcctttgatttgtgtttgtgtgtctcaggagcccgggaaggtgctgattgtgggggtttgtgggaggccgcgtttgggtggggctcaagcaaatgcatttgggattgcatttaggactgcggcagaggagattggaactgagttctttcatgagttatttgaatcatcgtggattgttctggatgcttcagctgtgaattctttcatggttaggttgaccaagaagctgtga

SEQ ID NO: 12167 - DNA, 576 bp, Glycine max
  Peptide Sequence Number=SeqID_128945
atggggaaagttcagttctatcaactggtatcagagctccaatctaggagctttggaacagttaatggtgacgaaggcgaatgtgagaatggagacacgcatggaagccatggagaaggcgaaagaggagaatcgcgattgagttcaatagaagggatgacacaacgattagcggcggcatgggagaaacaatctctagaatccagcgttcacgcggacgattcaataggagggaataaggggaacgctacgcatggcgacaattggtggaaaactcttgaaatgccaatattcaagggagaagattcgatgggctggttaacgaagatagaaagctctagggtggttccaatcccaaaccattcttgggaagggttcaagatcacaatctcccaaaggtttcaaccgtttaaactagggaatccttttcgggcattactggtgctaaaacaggaagaaacaatgcaagaattcatgggccattttgagaagcatgtcgaaatggtgaaggggttggaggaatcgttttctggtggaggtgtttcccaaggggctaaaaaaagagatcaacactga

SEQ ID NO: 12168 - DNA, 232 bp, Glycine max
  Peptide Sequence Number=SeqID_128946
atgggtgccaagtatctcgaagcggtcaagcaaaggttgcatgccatcaaagaatggtccccggacgaaattagggaaccgattgggaaaataacaaaaaaaccgtattttcccctcaccggaggctccgtacttgataacggaggatgcatgaacagcgctaggacgcatgaatggcaatcaattcatggggctccggacttgatggtggaggacgcacgaacagcgctag

SEQ ID NO: 12169 - DNA, 549 bp, Glycine max
  Peptide Sequence Number=SeqID_128947
atgaaggctcttggtggattagacgacatccattatgttgcccttattaacaaaccactatgggagcataatgtctaccatgttccatcattgccagacaacaatacttcaactatgaatctgaaggcaatgaaggtggacatccaaagaaatcaaccaattcctctagtggacgaggaggctataaaaacaagaagggcaacaaagcttgtcattgttgttcatgaagaggcaaaagaagggtttcttgccagggaagcaagaacgaagacaaggcatgagaagagcttagcatccaatcagccttatttagtggttgcttgtccaaagactgttgagaagcaacccaaaagcaaggaacatgtacttacttctgaggttcctagaagaaggaagaatagggcaacttgtctaaacaaagcctttactaaaaaagaaatagctccaccactccttgatggatcaagtgcttttgagaatgaagctgcaccttcaccacaacaaccatccacccctcttgagtccaagaagcgtccactcgctttttga

SEQ ID NO: 12170 - DNA, 612 bp, Glycine max
  Peptide Sequence Number=SeqID_128948
atgagtggaattgccaccaacgattatttaaaggaaaacgttagaaaaactaaaagaggtctacgaattttggaaagaagggttcgggagttgtttacgcatagggaagtcgacaagggtgttgcccttgctcctacgtatccccagactagcaagagaagcgatgtagggaatgatccacggttgcgattcggcggtgcctcggcttcgctttttccttcttctcttccttttcttacgtttcttcttttatcccaaactttcagaaccttttgtcctttccccttcatagctatttataggaaaaagccatttggggtaggggaagctcgcctaggcgagctagagcttgcccaggtgagccaattgcttagatctgaaggtataagctcacccaggcgagctggttacttaaggttgaagacatttgatggcccaggcgagccagatgctagcctgggcgagcttgggcccagaaaattccataaaatgactactttatccatttccttgtgtttttcgttcctggatccgacaatcaatttgagcgatccctcgtccttgtgttgcaaccagtgtcaaacgataaaagctttccctggacgaaattag

SEQ ID NO: 12171 - DNA, 210 bp, Glycine max
  Peptide Sequence Number=SeqID_128949
atgtttcttcttcatctgttgctcctctataacaattttttcctcctccttttgttgatgggcaggctttttggtttggacctttcccttctgctccctaaggatccttttaacctttatagcaaggccaaaagtttccaaagccttgtctttattagcaatagccttggccataaacaatgtaagctaactttcagtaatcactactag

SEQ ID NO: 12172 - DNA, 486 bp, Glycine max
  Peptide Sequence Number=SeqID_128950
atgtggaccaccacgggggagaagcttgccgcccagctcacccaggcaagcaaggttgcttcctccaaaaagcaacagccttctggaggaagaatctggaaggcccaagtgggcctgattgctatttctttcgaagaagttacgaaaactcacggattgcggaaaacacctcctttcgatttccgtcaccttacggaattttcacggatcgcggtgccaagtatctcgaagcggccaatcaaaggttgtatatcatcaaataataatccccagacgaaattagggtatgacaacaagctccaaaggcttagacaagggagtatgagtgctgaagaatatagacaacaaatggaactactgcttttaagatctggacttagggaggagaaaagaacaagcatagctaggttccttagtgggcttaatatggaagtgagggacaaggttgaactccttccatatagggacctagatgagctagtctaa

SEQ ID NO: 12173 - DNA, 396 bp, Glycine max
  Peptide Sequence Number=SeqID_128951
atggccatgacaatggttctctctcctccaaccatcgttgtgcccacacccaccacaaaccagggtcgatatctcctcttaacaaatcgttggagccaacatcgtggcttcagatctggtgcttgtcaacgactctatgggtctcttcatcaccaccgtaaacattcatcatcttcgtcagacctccccgcatggttcctgagcaatgaaacatctatacacagttatcacaaaaagggaaaatctatacagtgttcagatcatcaagaaaaaggggtttggtgtttgacctatgctcacatgagcagatcatcaagaaaagggctgttgaatggtaacttgatggctccaaaggctactaggagtaatatagcccaaattggtagaatccattga

SEQ ID NO: 12174 - DNA, 345 bp, Glycine max
  Peptide Sequence Number=SeqID_128952
atggacacgtcaaatcctgctgtatttgtaaatgctcagttgattcccaactttatagggaagaaagtaagaacagtggttcaggtgagccaatgtgatggtggggttgccacagcaaaatccacagatgactgtcaattaaccataaaagggttgccacaagtccctcttatgaactatattgaggtcattggcattgctgaaagtaacaactctattgatgccgaaatatggactgactttggcagcacatttggaactatgtttttgagtatatggtatccgcagaggagcagggcacatgtgctctgtaggaactgttccattatctctgatgttagctag

SEQ ID NO: 12175 - DNA, 1047 bp, Glycine max
  Peptide Sequence Number=SeqID_128953
atgggatccaaaattcttccaaaatgggcatcgaagccttgcgtaatgggaatcgacgaagctggaagaggccccgttttagggcctatggtctacggttgcttatactgctctcagtcctatctgaagaccctttccacgttgagttttgcagattctaagacactcaaggaagagaagagggaagaattgtttgaaactttaaaactcaatgattctattggatgggatgttgatgtcattgacccccgggaactctccgctaaaatgcttaagaagaataagattaacttgaatgagatttcacatagctctgccatgggcctcattgatagggtactgaaaatgggagtgcttctaactgaggtttatatagatacagttggagatgcagggaaatatgaaatgaagctctctaatagttttccatctatcaaatttgtggttgcaaagaaggctgatagcctttaccccgttgtcagtggtgcaagcatagttgcaaaggtcacaagggaccgtgctttaagagaatgggtgcttgatgagactgctgaaaacatgcagaggaattttggatccggatatcctggagatccccaaaccaagtcctggctagaggatcacaaacatcatatctttggatttccatcattggtccgatttagttggggaacctgcaactcttattttaaagatgccgcagaagtgttatgggccacccaccctggatatgggccaagtcccctttcccttatctactgtgtttatgttccaagggagtctgacaatttagatgaagatggtggtggaagcaacaataagaatggcaagcggcaattgaaattaagcaatgtgggtttcaccacatccaagagaagtgaagaaatagaatcaagtggtaaaggacgctctcaaccagacaaaattcttggatgtctgaatggagtagttgagttactgagcgtttccaggtttggatctgaacctggggagcgggataccagttctctccaacaggcctgcacacgtcatttactggctctctag

SEQ ID NO: 12176 - DNA, 402 bp, Glycine max
  Peptide Sequence Number=SeqID_128954
atggcagacaacacacgcatgaaagagatctatgcagaattaaaaaaagatgctgatgccattacgcgtgtcagtgaggacttccatcgtcagatcgagcgtttggaaggtgctaaccacgctcatatggaaaggatggaagcgattcagatagcaaatgagtcacagattacacagctcaattctgctatgacgcaaatcctgcaacgactacaatccattccggtgtctccccatggtgcatcgaactcaaacaaagaacaaacgaggactccttttcaggtgagatctgtcaaactggattttcctcgatttgatggaaataacgtaatggactggatatttaaggcagaacagttttcgattactatgctactcctgatgctgatagattactcatag

SEQ ID NO: 12177 - DNA, 651 bp, Glycine max
  Peptide Sequence Number=SeqID_128955
atggactgccccatgttcttatccatacttgtacttgagaagaacattcctcaggtccagtcattggaaagatttcctggagcctcaagggtgttgtttagtcccacattggctagagctgacttaaacagagcttataaagctcgagcagtccttatctgcaagctgagccttttagtctttacagatttatttgatgttcatattgtcagagacactgggcgcaaagttgaagatcctgatatgttagagagaattcgacttaccattattaacaatctgttgaaatatcatcctgagtccagtgaactactagcgatgggtgaagtgtttggcataaaggctccaaagaaaaagcttgatgatgatatcaaaactcgtatacaagttaaggaagatggacccaagaggagcttgctatatatagagacagcagataggccgggattgctggttgaaatcatcaaagtcattgcagatgtaaacattgatgttgaatcggctgagattgatacagagggtttggttgctaaggatacatttcatgttagttacggcggggctgcattgaacagttcaatggctcaggttttggtgaattgtctgcgttactacctgcgaacgccagagacagatattgacagttactga

SEQ ID NO: 12178 - DNA, 237 bp, Glycine max
  Peptide Sequence Number=SeqID_128956
atggggctgcacttatcaaacttgggggggtgcactcatcaaattggggtgcgctcaagaaacttgatcactaagcaacctagaggggggtgtactcatcaaattggagggtgcgctcaggaagctttatcactaagcaacctagaaggagggtgtattcatcaaattggggggtgcactcagaaaacttccttaagaagcctttgggcggcaaccacctccatttttctcctataa

SEQ ID NO: 12179 - DNA, 3969 bp, Glycine max
  Peptide Sequence Number=SeqID_128957
atggcgggtcaccaggtggcagcttctgaggcaacggtggccagccaccgacatagagaccctcatggacttgggtgggaagctaccgtcggtggttttgccgagaagtattggaaggttgatggatggcttcttcagtcagaactggaacttgagaatccgacgattagtgttgtactgttctcttggaaacttgcatttcagatcccgccaaaatccctttggactccagaggtgactatggaagcgaatcaagcgacggtgacgatgaatcaagaggatgacgagttggagtccaaggagagtgtgctccaaaagtacttcctccaagaatggaacatcgtcaagtcactcctccacgacatcgtttccaaatcccgcgtctctgacccttcctccgtccaccgactcagatccattttggacaagtatcaggagcaaggccaacttctagaaccctaccttgaaaccatagtttcccctctgatgaacattattcgctcacgaactcttgaactcggggtagcttccgatgaagttctcgaaataataaaacctatatgcatcattgtatatacgttagtcacggtttgtggctacaaatctgtgatcaagttctttccgcatcaagtttccgatctcgaactcgccgtgtctctgttggagaagtgtcacaacacaaattcggtgacttctttgaggcaggaaagcacgggagagatggaggctaaatgcgtgacgctgttgtggctctatatacttgtgttggtcccttttgacatttccagtgttgacaccagtattgcgaacaatgacaatttaactgagttcgagctcagtcctcttgtgttgagaattatagggttttctaaggattacctctcgaccgctggaccaatgcggactatggctggactagtcctctcgaggctacttactcgtccggatatgccgaaagcttttaccagctttgttgagtggacccatacagtcatgtcctctgtaactgaagatttactccatcatttccagttacttggtgttgttgaagcactggctgctattttcaaggcaggtagtcagaatctcttgcttgattcaattcctgttgtttggaatgatgcttcaatgctgtacaagtccttagatgcatctcgaagtcctttgctccgcaagtatctgatgaagttaactcaacgaattgggcttactgctcttcctcatcgtttgccagcatggcgatatatgggaagagttgccaaactgaatgtttctttgaatacatccaataaaattgatcagtccaatttaggtgtgaacagcaacgattccaactcaaacgaaatgtcagacagggaagaagatgaggatatggatgttccagaaaatgttgaagagattattgagatgttgttgtctggtttgagggatatggatactgttgtccgctggtctgcagcaaaaggtattgggcgcataagttcacatcttacatcttccttttctgaggaggttttatcatctgttttggagctgttttcacctggtgagggtgatggttcatggcatggaggctgcttagctttggctgaacttgctcgtaggggcttgctcttacctgctagtcttcccaaagttgttccttttatcgtgaaggcactacattatgatgttcgaagaggtccacacagtgttgggtctcatgtacgtgatgctgctgcatatgtatgttgggcgtttggacgtgcatattatcatacagatatgaggagcatcttaaaagagtttgccccccacctcctaacagtggcatgctatgaccgtgaggttaactgcagaagagcagcagcagctgcttttcaagagaatgttggaagacaagggaattatccacatggaattgacatagtgaatactgcggattatttttcactttcttcgcgagtaaactcttatcttcatgttgctgtttccattgctcagtatgaaggatatctttttccatttgtggatgacctgctggatagaaaaatctgtcactgggagaaaagcttgcgagaacttgctgcagaggccctttcgtttcttgtaaaatatgaccctcagtattttgcgagcactgtcatggaaaagttaattccttgtactctttcatcggatttatgcatgcgccatggtgcaacattggcaaccggagaacttgttttagctttacaccaatgcaattttgctcttccctcagataaacagaaaagtcttgctggtgttgttcctgctattgagaaagcacggctttatcgtggaaagggaggagagataatgcgtgcagctgtttctcgatttattgaatgcatctccatatataaagtggtattatcagaaaagataaagaaaaacctacttgatactctcaatgagaatttgaggcatcctaattctcagatacagaatgcagctgttaaaggcctgaaacactttatccgtgcatacttgcatgcttcagataataaaggtatgagtgatgtgatagcaaagtacctcagtatgttgactgatccaaatgtagctgtaaggagaggatctgcattggcaataggtgttttgccatatgagttattagccagtcaatggagaaatgtgcttttgcagctttgtggctcttgtaaaattgaggaaaaccctgaaaacagagatgctgaagtgcgagtaaatgctgtcaaagggctcacattagcatgtgaaacattaattaatggaagagaagatactgcaaccgcttttgttgaggatgatttttccctgtttattctgataaagaatgaagtgatgatgagtttatttaaagctcttgatgactattctgttgataatagaggtgatgtaggttcttgggttcgtgaggctgcattagatggcctagaaaaatgtacatacatgctctgtaagatagacaagtcagtttgtttgtctggaagatctgatggaaatgaaattgagcctattgcacatccctcaattgatagcatgcttaagaacaaccaagagctttctttatttgatgagaatcttgctaccaatttagttggaggaatttgtaagcaagctgtggagaagatggataagctgagagaagcagcagcaaatgttctctacagaattttgtacaaccagataattcatattccatatatacctttccgagaaaagttagaagaaatcattcctaaggaagcaaatgcacaatggggtgtaagtttatatagatctttcatcagtttgagagatgtgctatcaggtttagttatatctattggtgggttgcaagattctttgaagagggtatcactctccgcgctgttagagtatctagaagaggttgaatctgaagaccctaatacaagaacatctaggttatacatgctatctgctgatatcctgtgggttctccaacaatacaagaaatctgacagagttatcgtacctactttaaaggctcacactccagctttttgtggtgctgttttggattctgtgtcatttgaagtaaagggatcaaaagacttctctaagttgtatgctggtattgcaatacttggttatgtagctgcagttcaggaacctatcaatatgagggccttttcgcaacttcttaactttcttggtcatcgttaccctaagattcgaaaagcttcagctgaacaactgtaccttgtcctcttggaaaatgggaatcttgtggctgaagacaagattgataaagcacttgaaattatttctgagacttgctgggatggcgatatggattcagctaaacaccaaagattaaaattgtatgagattgtaggtctggaggtggggtcacttggcaataatagtgatggaacatcaaggaaaaccagcagtaagaagcctgcaaacttagatgaaaatgcttcatattcctcattagttgagtcatccgggttctaa

SEQ ID NO: 12180 - DNA, 345 bp, Glycine max
  Peptide Sequence Number=SeqID_128958
atgggaccagtaatgcagccagtgcggatacttgcaaatcgcaaattattaaggggcacaactcaaattgatcagatactggtgcagtgggagaacggggtgcaggaagaagcaacctgggaagacattgaggacattaaggcaagctatcctactttcaaccttgaggacaaggttgattctaaaggggaaggtaatgtaacggctagtggagcacgtgcggggcatgagagcaaggatgatgagtcacgcatagtggaaggcaggaataacaaacttccggatgatgcggaattgggacgtggaaagagagtgaggaggccaagctggaagctaacagaatga

SEQ ID NO: 12181 - DNA, 234 bp, Glycine max
  Peptide Sequence Number=SeqID_128959
atggaagcttcaagcttaagggttttcaaagcaggagagatatggagcattcctaaccaagcattggtactaatagagaggcctcagcctccccctccatcccaggatttggcaaagcacgaattgaaagctgcatatgaatttgaaaagggggcattgaaaaggtggttagaagaagttgacacacaaactcttccagaacatcagaaaagaaacagaaaaatagatcaataa

SEQ ID NO: 12182 - DNA, 336 bp, Glycine max
  Peptide Sequence Number=SeqID_128960
atggaagtaaatgagaagatgaggaaagtagaatgtttcacttgtgaagagaagtataatcctgctcatgtgcgtaagaataaacaatctagattgatgattatggaagaagaggaaggagaccctaagaaaaatcagtgggaggatagggaagaagagaagataaaggtcatattgaaggctgaaccaaaattgataaaggctgccatcaacatgaagatgatcaggggtaccaagctggaatctgacaagggatttatggtggaattaaaaacgatagagggggagaatagtgaagaagcaattcttgatctagtggtgcaggtgttgaaataa

SEQ ID NO: 12183 - DNA, 213 bp, Glycine max
  Peptide Sequence Number=SeqID_128961
atgcctccggcagtgcctctgccagcatcgcattgccactgcccctatggctgcctcgcatcgtcagccagtgacgccggggggtggacgcaccaccctctatggtggttccctagttattgcatcatttggaggttagcatatgcctacgctctgtacactccatgttggatctccgacttgcttggtggtgtttcattaacgtgtgagtaa

SEQ ID NO: 12184 - DNA, 696 bp, Glycine max
  Peptide Sequence Number=SeqID_128962
atgagcataaagtcagtaaaaaactttgggacaacgacagggtttggctcatcatgtggagcatgcaagttcctaaggagaaaatgcacgagtgattgtgtatttgctccttacttttcctacgaccaagcttcaacccattttgctgcagtgcataagatttatggtgctagtaacgtctccaagctactgtcacatcttccaatccacaatagaagtgatgctgccatcaccatatcttatgaagccttggctcgcatgcaggatccaatatatggctgtgttgctcatatctatgcattgcagcatcaggttgctagcttgcaagaggagatagatgctcttggaagtctaatggcaaattccacagttagtgttgtcaattgtggcagtgaccaagaaccaatgacctcaaacaatggaacacaatataatattttgcagcatgatgctacaagaacacagtattgtcagaataatctggctaattttctttcgcaagaagctattagtgctacggtcttcaaaagtctcgactcacagatggatatagagcttccaagcgcacacgtggaagaaccttcttcatttggtgatttcaactccaatccgttagaacagttcctatctggaattgaccaagaggtgttcgtgaatcatccatggttcaagcataatgcagacataaagaactag

SEQ ID NO: 12185 - DNA, 228 bp, Glycine max
  Peptide Sequence Number=SeqID_128963
atgaagtgtgatatatcttgggtgaagcatggtgtgaaggaaaatgtttgttatggatgtattccattacgtggggctttaggtattgttaaagagttggggtacataagtcgtgttaatatgttatggaagcttgcacctatgtggtgggtattaaggtcgtttggagatgcattgaatgagttagttgaagacaatgatgctttagaaatgcccaactatgcttag

SEQ ID NO: 12186 - DNA, 279 bp, Glycine max
  Peptide Sequence Number=SeqID_128964
atggcttcaaactcacacaacaataacaaggaaaattcttcttcttggacacgcatgcagaacaagcaattcgaaagcgcacttgccttgtatgatcaagacaccccagatcgatggcaaaacatagcaaaagtggttggtgataaatcggctgaggaagtgaagagacactatgaaatccttttggaggaccttagccatatagagtctggacgtgttccaattcccagctataagtccacagataacaatgaagagaggatcgaagaagaaaattag

SEQ ID NO: 12187 - DNA, 243 bp, Glycine max
  Peptide Sequence Number=SeqID_128965
atggagaacaatgacgatttgtggtggctaatggtggctcttcgagaacactccagaaatcttcttaaagatcccaacggtcagatcgtggacaagtgtcttgtgaagccgcagaccaaatttcgagaagatccaacggttaacgaaggctgggagatgttgttatcgaggcagcttcatgtagcttcctcaagaagcttcattaagaggcttcctcaagaagcttccccgtggcttctttga

SEQ ID NO: 12188 - DNA, 198 bp, Glycine max
  Peptide Sequence Number=SeqID_128966
gcgtggatgttggacaaggaaataggaaatagaaatcaaatgggtatttgttcacaacaaaaaacgcctttcaggactaaaatctcgacgaggagattggggacacgaagattgcagagagtggtgctacaatggctgacaactataaaggagctgtggaggcttgaagattatcccaaaaaagttatcctgaaataa

SEQ ID NO: 12189 - DNA, 1975 bp, Glycine max
  Peptide Sequence Number=SeqID_128967
atggcaggaaatactagatttgatttaattgcagctaaatcagatgaattggctttcaaggggagttttacaaatgggcagagagggaatttgatgaatgacactttggacaggtctgcaagctttcgtgagggtaatgaggggcagatgtttatttcgggtgctaatatgtcgcgggggaattccacatcagcaggggatttggcttctgttgctcaatgtttaatgttagatccaataaccatgggagatcaaaaatatactaggtcaggcgagttaagacgagtcctggggatatcttttggaaatactcttgaagattatgcttttggaactgctaatctgaagcctccccctccagtggctatggaggaactaaaacgattcaaagcaagtgtacaagaggcttctgtcagggctagatatagatcaaaaaggttggatgaatctttagacaaattgaacaaatgttgggaggctgtaagcataaagaagcaacttcggaatgatttggtgccaaatgaaaggctgggtggatcaaacttctcgaagatgggaactcagactcatcgaagcccatcagagtttgtgaatcaaagaccagaggacagacctaagaatgtcattctgaataagcgtatccgtacatcagttgctgagacacgggccgaaggactaagtaatagctttgcaaggcagcctctgcccatgggaaaggatagagacaacatcaaggatggtagcagaggttgtgatattgttgaagagaagattcgaagattacctgcaggtggagaaacatgggatagaaaaatgaaaagaaaacgttcagtgggtaccgttgttgccagatccattgatggtgaaggagagcagaaaaaggttatgcatctaaggctagctaatgagtcaggttcgcagggttctgatgcccaaggtttgagatcaggatattctggcagtaatagcaagcttgatggtgcttccctgcctgccacttccaatgcatgtacgactggcaataatgaacaagaaaaggtgtcaaggggttcagtggatggatctaataaggaacgggttgtgcttaaaggaaataagcttaatgtccgtgacaataactatacaggtggtatccatactttgaccaaaggaaaagtgtcaagaccacctcgaacaggtgctttgatggctggaaactcatcttctgttcctcgatcttctgaaatacttgatgctgaggaacaaccttcaaatgtcaacaagcctcattcagtaagtggtactataaatcgtaagcgtcctttgcctgtaggatcatcttcatctcctatggcccaatgggttggacagagaccccaaaaaatttctcgcactcgaagagcaaatgtggtatcccctgtcctaagttctgatgaagtgcatacgttgttagaaggttgttccccttcggatgtcagtaccagaatgacttctgctacaactagtggattacctatttccaatggtgctatcaatggtggcattcacccaggtaaaatgaaacatgaaagcgtttcatccccaaccaaattatctgaaagtgaagaatctggtgcgggagaaaatggtgaaagtaaattggagaaaggattggaaagtaatgaagttgatggaagagccataaataattctcataatacaagttcctccatgttaacttcgaaaaagaaaaaaatacccaacaaggaagaggttggagatggtctgcgtagacagggaaggggtagtaggggctcttcagttttgaagaatggcatctcaccaatgaaagagaagttagagactccaaccttgatgaagccaattaaaaatatgaagcctgcttctgaaaagaatggaagtaaatcagggcgtcctcctttgaagaaatcatgcgataggaaagctattaattgtattggtcatccatcaactcacaattccccagatattgcag

SEQ ID NO: 12190 - DNA, 408 bp, Glycine max
  Peptide Sequence Number=SeqID_128968
atgtctgctcctatgatcattgaccctatggtgatatcggcaccagaaactcaatcagcagcagctagcatactagttgcacaaagtgaacttgaatttggtgctgttaaggatgaaattgtgaggtttgacaagcttgtttgcatagaagaagcaatggctaagcacatgaacttaaccaataagttaaaggcatcaaggcctcctccaaatccggcattgcacttgatatcagccatgagacagattcttagaaggactttggattctcctaaactgaagagaacatgggacgatgctgcccctgtcgttgaactctgcaaagtctcaaaatttgatcgtggagttcaactaacgttgtttgtattcaaattgattaaacttgtgcaatgcacaaatgcagagtaa

SEQ ID NO: 12191 - DNA, 801 bp, Glycine max
  Peptide Sequence Number=SeqID_128969
atggatgagaaacaactgttctatcattttagattcaaagtgaaacagatcccagtgtactatatgcaacgttctaatgttccaatgttaggcaagagtgaagagaatgtttcagatacagctcattctgacaaagcccagaaaggtcagccaggttcaaagatgattaatccaaatgacaccaaggaaaattcagatgtagtttcttctgctggcctaccccattcaaaacccagagttcattcagaggatccatctggaaagggatcagtgagatcaatacatgagttacaaatgagtagggaggatggtgatcctaaacaatttactgactctccagctcgccatggtggcagtgattctgcctatcgaggtcacggagtaggttctgctgacaaccgtaaaagaccttcaagacaaagtactgggtctgagcacagcattgaccgttcaccccttcatcgccaggcaaagacccctggaagagatagtccttcttgggaaggaaaaaattcatatgacagtagccatggtaccccaggaaggtcccgattaagaccacctaaccgaggggatgaaactcctgataaaggtgctgctgttccaaagtttggtgagtgggatgagagcaaccctgcatcggctgatggctacactcacattttcaacaaagtgcgggaggagaaacaggtgggggctggacacgtgccagttacgcctaatgggagacaatatgctgctcggaaccaacctgccgacgacaaagctcagagttgctgcttttgctggggcaaaaaatga

SEQ ID NO: 12192 - DNA, 408 bp, Glycine max
  Peptide Sequence Number=SeqID_128970
atgtggaagctgcaacaagttggaaagatgagaggaggagttagtagcatacagctacagcctttgacactcgaggcttcaaccctagttaaagcagctattactgttggcttcacattgccactgtcatgcgcaatgatattcaacgaccataatgatgagaatctaaagattctatgtgatgcattggagcaaaagcctccacaaccgaaaaaaacagccaaggagattgcaagcattgtgcttctttctcatgaggagtccaaatataaaaggctaggagatgagtttgggggcagttatcttcagagatttggggaagcagtgaatgagaatcctcataggtttttctttatggaatatttggagcaagttgatgacttttctaaacagggtgttaagcaatga

SEQ ID NO: 12193 - DNA, 1071 bp, Glycine max
  Peptide Sequence Number=SeqID_128971
atgattcgtcaatctctttacaaccctccttccatccccttctcaaccccttccatgaaacgccaccgtttctcccctccaagttggagaattcgatgcgacgcgtcgtcggtgtcggtggagcagaaggttgttgggccacacacgggtagagacccaaacgtgaagaagccagagtggttgaggcagaaagctcctcagggtgaaaggttccaagagattaaggaatccttgtcccatttgaagctcaacactgtctgtgaggaggcacaatgccccaacataggagagtgttggaatggaggcggagatggcattgcaactgcgacaatcatggttcttggggatacttgcacgcgtgggtgtaggttttgtgctgtgaagaccagcagaaaccctccacctcctgatcctatggaaccgatatatactgccaaggccattgcaagttggggtgtggatcgtgatgatctgcctgatggaggaagtggccattttgctcagactgtcaaagctatgaagaatctcaaacctgagatcatggttgagtgtttaacttctgattttcggggtgacctgaaggctgtagaaattctggttcactcaggtttagatgtctttgctcacaacattgagacagtcaaacgcctccaaagaattgttagagatccgagggcagggtatgagcaaagcctgtcagttctaaaacatgcaaaacatagcaaggagggtttgataacaaaaacttctataatgctgggccttggagaaactgatgatgaggtgaaggaagcaatggctgatttaagggccattgatgttgatattgtgacatttggtcaatatttgcagccaactcccttgcacttaactgtcaaagagtatgttactcctgagaagtttgctttctggaaagaatacggggaatctattggtttttgttatgtagctagtggtccactggtgagatcatcgtacagagctggggagctgtttgtcaagacaatggcaacaccaactgacgaggtttttagcactttcattgctaaggagaaaacggttaagtgctaa

SEQ ID NO: 12194 - DNA, 1956 bp, Glycine max
  Peptide Sequence Number=SeqID_128972
atgccagtggaggaggatgatcgtgaggaactgttagctgctgccaactttgctagcaatgccagctatattggctgttctagttcattttggaagaaactggaacctatcttttctcctgtcagcttggaagacatgtcctacatgaagcaactggttaaaacaacagaggttgatctaagacgtttgtctcagatgcatggcattggaagtgatacactggatagacttacacatacagaaagccctttgtcacaaagttctatctctagagaaagagagagaattgttgtaaatcaaactggttccaaggagatatcctcaatgaatgacatggttgatcaacatctggatgttagtattttgtgcagacaaatggattcagaagtaaacaaagttgtgccgttgtatcaaagagtattgacagctctgatcattgatgatcaatatgatgaagaaactgttgaagatggaaatatgccttctctttgtgaaagagatgactcttctcaggcggcttgttacgttcaggatgttgagaaccaatccagcatcaggatggaatatgaattcaactttgacaaggtttcttgtaatgggaatgctacctttactagttgcacaaacatccatgatcaagaacttagtgtttttcagcaaatgaatcagggatcgttgcatccagaaactgagaggttgtccatgttatctgaaaatggtaatgacgagtcaatgggtatgcatggaatttcttgctcatcatctttcagtcgccattttgagcaaatgcgtatggaggataaactcttactggagctacagagtgttggcctatatccagaaccagtgcctgatcttgctgatggagattgtgaagctattaatcaagatattattcaattacagaaaggactcttccaacaggtcaataaaaagagagaatgctttatgaaacttatcaaagcagtagaacaagacagagaaatggaacaaggagccctcgagcaagttgctatggacaaacttgttgagttggcttataagaaaaagctggccacccgtgggactagtgctgcaagatatggactttcaaaggtctcaaggccagttgctctggcttttatgaagaggactcttgctagatgccgcaaatttgagggaacagggaaaagttgctttttggagcctctctttaaggacgtcctatttgctgctcctgctcatgacaacactggttcagctgttgctgcaaatctctcactaacccgtaattctcagcaagaatctgcaccatcaggttattttccttgcagggagcatgatgtgttgggaaatttagaccatccctccgaccaggattttgctaggactggaccaatactaaacagagggaagaaaaaggaactgctgcttgatgatgttggtgctagtccttcgctgagatctgcatcaactcctggtagttctttaataggtggagcaaagggaaagaggagtgaacgagacagggacaaagactcttctggaagaaattctgtttcaaaaggtggtcgttcttctgcaaagggtgagcgtaaaacaaaagcaaagtccaaaccaaaaacagctcaactatctagttctggaaatggatctctaagcaagttaatggtaaatactaactcggagaatcaattggcttgtggctctaatgagtttgtttccggtgatggcaacagaaaaagtaaagttgggtctgtatctcataactataatgctaatgatttgtccattggaactgaggaacccatagacatcacattagactccatagaactaggtgtaggtaatgaacttgatggacctcaagacctggattcttggttgctgaacattgaggaagatggtttgcaagatgatgcgtttggcctagacataccaatggatgatctgtctgggttgaatatgcttttatga

SEQ ID NO: 12195 - DNA, 210 bp, Glycine max
  Peptide Sequence Number=SeqID_128973
atgatgtccatcaaattcaatctccgcttgtggggctacaatggatccctcccctgcggtggtcttcctagcctttttagtaagaagcttctttggagccatttgcttgagtgggatgaatggaaagcaagaataattgagacaaatgcacaacaaaagcttgaagttggtgcaaaaatggtggttctcgtaggtcttagggagcctttg

SEQ ID NO: 12196 - DNA, 1221 bp, Glycine max
  Peptide Sequence Number=SeqID_128974
atggaagcacaattccaacctctgattgattggacgatgttccctcttaaagtcgaagaagaggaagcttttgaaaaggattcaccaaaagggatcaaagttcttccccctccaaagtggaagcgacttcaccttaaagcatccaatccttcatctctagcggcacaacaccagaatgtctacaaaatcaattatggagcttgcagacaaaaggttagctatgacaagaacaccattagttggattttccaaatcgattctcaagatattgatccttcttctgatgatttcttgtctcctttcctgagtccacaacatgtccaactctttactccaatgtctaagtttgttcccttagattttggacatcaagccctctccccgatgaaggatgataatgatgccatgctcttttactataaatacatgtataagaactctcgccttgcatccatctctgactgtgataaggaagacaactcctaccacaagcgcatgatgtgtttcctaaggcaagaaggagataatgagttttatcaatgtctaattcatgatactcttcactctgaatttgtcttcaacttgcataagtatcctgaagatgcaatgagaaaagccatcatcactgcctgggcaaggtttctcgcgatcaaggagcttctatactcttctaatcagaatccttgggttccaggtcaaggaatgacagctgaactccaaaggaaacaagacaagttgaattgcaatgttgttgagcctcatctgtttgaagttacttcacaacctccacaagttgttgaagataccttagccaccgttagcatttctagtactcctttgaccaccattgctctaagccaacttggaagagactatggaaaaaaaatcattgttgaacgcatagagaccaacttgttgatcaagaacgctttgaagtcttcactcaaatcctttaacaattttgttctctacaacatgaatttgatgatgcaacaaaggctgcctccatttgttcaacaccaatatgcacccatacctcaaccacctccaccaacaccaaccactattgtgcaacttcaccctgaggttcttacaacaatggttcctgctttagaggctgccatacttgatgatcccatgcctgctttagagtctagttatgtccaagtcacattggaccgtaccaaatcgttaagtccctatggttttgatgttaacaat

SEQ ID NO: 12197 - DNA, 465 bp, Glycine max
  Peptide Sequence Number=SeqID_128975
atgatcaacaaagtagcagttctattagttgttttgcttttcatcattgctgctttggcttctgatcctgatccagtcatagacttttgcatagccaaatcaccagacaatagcttcagttgcaagaactcatccacagcaacagtggaagatttcacatattctggcataaagtctcctgggaacttcaagcaaactggtttttcttctatggcagtgaattcgaatgtctttccagatttcggtgttggtggtgtcaatgtgccacacttccatccaagagcaacagaggttgcttttgcgctggaaggaaaaatttattcaggatttgtggataccaagaacaaggtttttgccaaagtgttggagaaaggagaggtcatggtgttcccaagaggcctagtgcactttcagatgaatgttggagatgggcctgctaccattttgggcagttttgacagctaa

SEQ ID NO: 12198 - DNA, 501 bp, Glycine max
  Peptide Sequence Number=SeqID_128976
atgcataagagaaataattgtgataaagaccaaactgataacaattatatggttgtcaatacgggccggcctagctcgttttggcctgactcgcttttggccccccataaatgggtcagtccggcccgcctcgctaagcaaaacgggctatcttttttagcccgacctgtttcaagctggcctacttggcccattttgtattgtcctttatcgttgttggtaacatcaagagactgtgagggactgagggtgagactctcgaagtccaatcgaagacgtgaggctaatggggcactagcctgtgagctggtccagcccgacccgtctctaacccatcgggcttgcggactaaacggggtgggcctgaacggtttacgggtctcaaattccaacccagtccaacttttttggagaacaggccggaccagcccgtcgggcttgacccggtttggcacccctaataaaaaccaaattgagaagagtggtacatgcaaggactaa

SEQ ID NO: 12199 - DNA, 510 bp, Glycine max
  Peptide Sequence Number=SeqID_128977
atggagtctgtggtgtgtgagctagaaggcacgctcttgaacgacaaggatgcgttctcctacttcatgttggtttcgtttgaagcttcgggtttggttcgtttcgccttgttgctaacactatggcccatgattcgtttccttgacatgattggcatgaaagatgcatctctcaagctaatgatcttcgtggctgtggctggtgttcccaagtctgagcttgaatcagtggctagggcagttttgccgaagttctacatggatgatcttgacatggacacgtggaggctgttcagcaactacgacaagagggttgtgctgaccaagactccaaagattatggtggagaggttcgtgaaggagcatctacgtgctgatgaggtcattgggaccgaactctccttcaataggtttgggttcgccacgggtttcgtccgtggtgactccaacaataccatttctgaaagggttgccaactttttcaacaatgaagctccaactttggttatg

SEQ ID NO: 12200 - DNA, 201 bp, Glycine max
  Peptide Sequence Number=SeqID_128978
atgacacgacatgagtatgcatgcgtgaaagtaatgactaatgacaacaaagagtatatggaactactagcaacaacgtatcatcaaaagaggaaaactctagatgaggcttcactattatcaagcgaatcggagacccaacatgaccatagatcgacctccacttcctacgtctcacacagacccgggtatagggcctaa

SEQ ID NO: 12201 - DNA, 804 bp, Glycine max
  Peptide Sequence Number=SeqID_128979
atgccttactatgcgctctatcagaagaagaatattccaacgttcacaactttagaagtgccaagtagatgtgggacttcttggctattacctatgaagggtcctctaaggaacaaagaaagggaagtcactagcccttcaactcaaagaccaaaacataattttacgtccaaagaatcattatgcaaagcccttgttgtgaatgatacttcagaggaagaacctaatgatgatgactccgatgaaggagatgacaagctaagtttgatcactagaatgatgtggaaaatcaagcactcctccaggttcaacaattcatccaagagatccttccacaagaaggagaaaagtccaatcatatgctatcagtgcaagaagctaggacacttaaagtcagaatgtcctgaccttgaaaagtcaaaggataagaagaagaaattcttcaagtccaaaaagaagagcctcgtgagcacttgggaggacccgaatgattcatcatctgatgaagacaatgaggaagaggccaaccagtgtttaatggttgatgcgtccaccagtaaagcagaaccaactctagatgcaatttcaaatgataaggatcctgagcctaatgacattgtcaactcttatggtcaaggattaatggacaaaaaggtatctattggacaagagattcttcttaaggattttcaagatttggaagaaagggacgtgaggaactacctctatgaggagattggaatcttgagggataacctaggcaaatttgttggtggccatgaagccattaacaaaatcattaag

SEQ ID NO: 12202 - DNA, 114 bp, Glycine max
  Peptide Sequence Number=SeqID_128980
atggcatttcttaagaatcgagtaacagttccattgcctatggactatgagccaagtgctaaagcacttgtcttcttgggactagatgttgaggcagcatcgtctactgaatga

SEQ ID NO: 12203 - DNA, 156 bp, Glycine max
  Peptide Sequence Number=SeqID_128981
atgtcgatcattctgtcattatctgccaagtgcaacaagtgtcattcatgcaacaagatgagtcattatggccattcaaggttcagattcgtttggaatatcttgcatgcggatccatctatatggagtggcatgaaaaggattgctgatttatag

SEQ ID NO: 12204 - DNA, 390 bp, Glycine max
  Peptide Sequence Number=SeqID_128982
atggctccaaagaaggacaaggctccaccaccttcctccaagcccgccaaatctggcggtggcaagcagaagaagaagaagtggagcaagggaaagcaaaaggagaaggtgaacaatatggtgctgtttgatcagggcacctatgacaagctcctttctgaagctcccaaatacaagctcatcactccttccattctctctgatcgtttgaggggacagaaagtactgtgtatctggttaggattcaagagctggcatcttgtaggacatatacatattaatggatcacttgcaaggaaggctataagagaattgatggcaagaggttctatcaggatggtgtctgcccatgcaagtcagcaaatttataccagggcaacaaacacctag

SEQ ID NO: 12205 - DNA, 873 bp, Glycine max
  Peptide Sequence Number=SeqID_128983
atggctgcgaacatgaaaacatcactgcataatcgctccaatagtgtgccctctgcacctcacccattcatttcacaatacgaagagcaattgcacagattgaaggcttctgaagccacctcatcatcatcaataagcagtaaatttgatggtttgcatgctttgcatgaatacactgataagattcttcaattgccaaccatacaacaagcgttggcaaaagaatcctgcaaaacacaggttgatgagttactagaagggtctttgaggctccttgatatctgtagagccaccaagggtgtcctgctacaatctacagaaagcagaaatggacttcaattaagtgttcgcaggagagggggtgaagcagcattcaaagttgagggtggcaaatacatgccatcaaggaagaaggcaaagaagactattcagaaggccttagaaaaaatcaaggaatttaagaagggtcttatcttaacttcctcaaacacggacaatgagacactttcaatgatcagaaacttcaaagaagctgaagctgccactctggttcaactagagtctttgttatcttttatctctggctcaagagggaaaccaaaagagagaaggtggttaattgtctccaagttgatgcagcctaacagagtacactgtgattctgatcaatcaaacacaaatgaatttgaggagttggatagagtattgcagtctctctttcacaagccttgcagtaatatgtctgttgagactttccaaaaccatatcgaaaatttggagttgtgcattcagggtctagaggcaggaattgagcgccttgaaaggcaactaattaggaaaagagtttcccttcttaacatctataatcactga

SEQ ID NO: 12206 - DNA, 411 bp, Glycine max
  Peptide Sequence Number=SeqID_128984
atgcccgtttcagcacctctcctgcaaaaagctgactcaagtccatacatgttttcctttgattgtagtaggcaatatttagctatactgcagacatccaagagcttcaaagacacttatagtaattcatcaatccatttgtcgctgcaatgtcacgataaggattattgggtgaccggcaattggatcaacttatcagtgcagtcatgcacatcctgcaatccaatgagtttttggcttatgaacataatgacaaagaagagaaggcttgagaatccttcaatctatttgaatgatcctcaaattgtggcacaagggggtgaggtgcaatatgcaagttgttgctgcgaagatgcagagaactctttgtatttgtctgccatcttctctacttggcaaaaagaattctag

SEQ ID NO: 12207 - DNA, 486 bp, Glycine max
  Peptide Sequence Number=SeqID_128985
atggcaccaaaatccgatagcgccgaaggtactatctctctctctcatttcgctgtttctctttcagaacctaacctaacatctctctttcatttcgcagcgatcgtgttaaacttcgtcaacgagcaaaataggccggtgaatgcacagaacgtggcggatgcattgcaaaagttcaatctcaagaaagcggcgattcagaaagcgttggataatctggcagatggaggtcgaatttcgttcaaggagtatgggaagcagaagatataccttgcgcggcaagatcaatttcaaattcccaacactgaagagctgaatcagatgaaggaacagaatgctgagctgcaaaaacagctggaggatcagaaaaaggctactagtgaggttgaagccgaaattaagtcattgcaatcaaatttgacactggaacagatatttgaaagagaagtgaatctgagattggaggtagctgatgtggatgcttga

SEQ ID NO: 12208 - DNA, 543 bp, Glycine max
  Peptide Sequence Number=SeqID_128986
atgagttttttgcaagatgacagagaatttgtggaagcaatcaaaaaagctaaggattggggcacaactaattatttgaggaaattatttgtcttaatgctattaacaggtgtcattactaaacttgaagaacttttgaatcagacatggaattggttagctgaagacattgcatatcattataaaaaaacaacagtaaacacagaattacacattgatgatgagaaacttaaaaatttaacattactggaaattgaaaaacttcaacatgcaaaccaaaaatcactaaaagactatcctacaatgccatatcctgagggtgcaaatcctgcatggtgtctagagaatagcttgatattatcagaactcaattacaacaatgatgaggctagattagaattcgaaaatcttttttcatctatgacagatgaacaaaagcaaatttatcaaaaaattatgcaagctgtcaacaacaatgaaggtgacatgtttttcctatatggatacggaggtacaggaaaaacatacatatggagacattag

SEQ ID NO: 12209 - DNA, 897 bp, Glycine max
  Peptide Sequence Number=SeqID_128987
atggcattcactccctttagcccaaaatctcatcaccaatctcgctcaaagagccttccctgtagaccacaccctcttattctacaatgcaatcaacacttgggaagtttagaggcttcagcttctgataattcaacttcctcttcatcatcattgttcagacacaaactaactggcttgcagactttgcacgattgcattgaaaagctggtcctactgactcttactcaagaggtactagtccaagagcgtcaagagaaatgggtagatgagcttttggatggatctttaaggctcctagatgtatgtactgtagcaaaggatgctctacttcacacaaaggaatgcgcacgtgaacttcaatcgattatgagaagaaagaggggaggtgaaatggaggtgacagctgaggtcaggaaatttttggcctctaggaaggtagtaaagaaggcaatcctaaaagcgttggagaatttgcaggcaactgtgaagaaagcaaaattctctccaagcaacaaggaccacccaaccgcaaccttggctagcttgttcaaagatgtgcaagtaatcactctttccatattggagtcactgctgaacttcatctccggaccagcacaatccaaaccaagcaaatggtctatggtttccaaactaatgcacaacaaaaaggttactaccacacaagaatcagatccgaatgaattttccaatgtagatgctgcattgctatcgtttgtgtttcacatgacaagaaagtcagacagtgtcagtcatttgcagaaccaactggaagatctagagtcagtcattcaagactttgtggaaggacttgaaactctttttaaacgttttatcaaaattagagtttcccttctcaacatcctcaatcactaa

SEQ ID NO: 12210 - DNA, 274 bp, Glycine max
  Peptide Sequence Number=SeqID_128988
atggcagccattgaaaagaaaactcaaagctctctacatcttcgaagcaacagcttgctctctgcggctcaccctcttgtatcacaatttgaggagcatttgcaccctcttgtatcacaatttgaggagcatttgcaaagattgagaggttctgaagccacttcttcattgtcatcatcttcagtgtgccacaaacttaatgacatgcttgatttgcatgactacactgataagttgcttcaattgccaatcgaacaagtcttggcacaagagt

SEQ ID NO: 12211 - DNA, 879 bp, Glycine max
  Peptide Sequence Number=SeqID_128989
atggaaacaagcacaaagaactctcttcacattcggtgcaacagtttaccctctgcacctcacccacttgtatcacaattcgacgagcacttgcagagattgaaggactctgaagccaccatcacttctttgtcatcatcttcaataacccaaaaactaattggcttgcaggatttgcatgactatgctgataagttgctccagttgcccacaacccaacaagcctttggacacaaatgcagtgacaagtgggttgatgtcctattagaagggtctctggggcttcttgatatctgtagtacagcccaagattgcctcttgcaatcaaaggaaagtgttcacatggttcagtcagtaattcgaaggaagtgccctgacactgaattcgcagttgagggtggaaaatacttggcatcaaggaaaaagatgaagaaggcaattcaaaaggccttaggcaatttgaaaggaatgaaaaatgagttaatggattcttcctcaagcaatgatagcgaggttttgtttatccttggcatcttaaaagaagcagaagcagtcaccatgaggttgttagaatctttgttgatgtttgtctctgacaccaagggacaatcaaagcagagaagatggtcaataatctctaagctgatgcagtctgatagaatgacttgcgactctcaagaatcagaaacaaatgaatttgcaaaggtggatacgactttgcaatctctcatcagtcacaagcccttatctattgaaaattttcaatgccatatggaaaatttggagacatgcattgaggatctagaagtaggtgttgaacacctttcaaggaaactcattagaacaagagtttccctacttaacatcttcagccactag

SEQ ID NO: 12212 - DNA, 993 bp, Glycine max
  Peptide Sequence Number=SeqID_128990
atgaaggatcagaacatgttggatgtgtatgtcaggattgaaggatactgcaacctcttgattgagagggtccatctcatcgagcaagagagagaatgtcctgaggaactgaaggaggcagcatcgggattactctatgcagcttcaaggtgtggagattttcccgagattcaagagattcgtgcaattttgacatcacggtttggcaaggagtttgctgctcgatctattgagttaaggaacaactgtggagtccatcctcagatgacacagaaattgtcaacaaggatgccaagcctggaaagcagaatgaaggtactcaaagacattgcttctgagaatggtattgttctgcagcttgaagaaacttctgtttcggttgaggaacaatccagtgtagaaaagcaaaaccagcatgaatctgagaagaaagaagagaatgtaagcatgttgcctaatagagggaaagatgagaagttaactgattcctacaagggaaggaaaaagtacaaggacgtagctgatgcagcacaagcagcttttgagtcagcagaatatgctgcagctgctgcaagagcagcattggaactctcccgatctgaatcacatgatcctgatgatcattatagtccaagactccaaccaagaaaagtggaggatggacatgatgatgtgagacctcaactggaagaaaaggaaatcctcagtgaaactcaaagggaagatgagttagaaaagtcagaagacattataagttgcaattcaactgatgaggctttgaagggggctactgccttggtagatggtgaaattgaggctgatcctttggaagaggaagtggttttcgacaatagtgatgatgagactgataataaacagaatagaaatcaatctcctaagtggacatcttcagggtatggtgctggtatagtagtaaatacaacgcctcagttggatttgcagaagaggcctatttcagtgaggactagatga

SEQ ID NO: 12213 - DNA, 855 bp, Glycine max
  Peptide Sequence Number=SeqID_128991
atggcagcaattgaaaagaaaacacaaagctctctgcatcttcgcagcaacagcttgccctctgcagctcaccctcttgtatcacaattggaggagcaattgcaaagattgaggggttctgaagccacttcttcattgtcatcatcttcagtgtgcctcaaacttaatgacatgcttgatttgcatgactacactgataagttgcttcaattgccaatggaacaacaagtctcggcacaagagtgcaatgatagatgtgttgatgacctactagaagggtctcttaggctcttagatatctgtagtacaactaaagattgccttctgcaatcaaaggaaagcatgtgcgacttaatgtcagtcatccgaagaaagaaaagcaatgaaactggattcgcggttgaaggtgtgaaatacttggctgcgaggaagaacatgaaaaagcaaattcgaaaggccctggaaaatttgaagcagaaggacaacaacacttcacccatgctcaacttcttaaatgaagcagaagcaatcaccctgtgctcattagaacaattgctactgttcatctcaggcccaaaaagacactcaaagcacagcagatggtcagcaatatccatgttgatgcagcctaaaagagtaatttgtgactctcaagaagcaaacacaaatgaatttgaaaaggtggatgcagctttgcaatctctcatcagccacaggccttcatctattgagaattttcatagtcatatggaaaatttggagttttgcattcaagatctagagataggagttgatcagctctcaagaaaattaattagaaacagagtttcccttctcaacatcttcaaccactaa

SEQ ID NO: 12214 - DNA, 879 bp, Glycine max
  Peptide Sequence Number=SeqID_128992
atggcagcctctcaattgaacacaaaatccaatttccatgctcgttcaaacagcttaccctctagaccacaccctctcatcctacaatgcaatgagcacttggaaaggttaaggtcttccaatgaagcctcctcttcctcttcatcccttagccataagctaggagggttgcaagatctgcatgaatgtgttgaaaatttgttccaactttccctcacccaagaagcacttcatcatgagtgtcaagaaaactgggtagatgagcttctgaatggatccttaaggctcttagatgtgtgcacagccgcaaaagactctctactgcatacaaaagagtgcatgcgagaacttcaatcaattatgagaagaagaaagggaggtgaagtggagctcaaggcagagattaagaagttcttgacttcaaggaaggtggtaaaaaaggccatctcaaaagccttggcaaatttgaagagtactacaaaaagttgcaacatctcatctacaaacaaagacaatcaattgattagcttattggagaatgtggaagtggtcactctatcaacatttcaggcattattgcaattgatctcagggactacacaatcaaagtcaagcagctggagtttggtttccaagctaatgcagagcaagaaagtaagttgctcacaattagcagatgaaaatgaattttcccaacttgatgaagcattgcaatcctacatgttttcccagacaagtaaatttgaaaacatgaataagctgcaaacccaattggagaaagtggagtcacttgttcaagatcttgaagaaggttttgaatttctgtttaggcgtttgataaagactagagttgcccttcttaacatcctcaatcactag

SEQ ID NO: 12215 - DNA, 462 bp, Glycine max
  Peptide Sequence Number=SeqID_128993
atggttgaaggtgaaaaatacttagttgtgagaaagaagatgaagaagaaaattcgaaaggtcctggaaaatttgaaacagaaggacaacaacacttcaccaatgctcagcttcttaaatgaaacagaagtgatcaccctgagctcattagaacaattgttacggtttatctctggcccaaaaggacactcaaagcaaagcagatggtcagcaatttccaagttgatgcagcctaaaagagtaatttgtgattgtgaccctcaagaatcaaacacaaatcaatttgaaaaggtggatgcagctttgcagtctctcattagtcacaagccttcgtctgagaattttcatagccatatggaaaatttggagctgtgcattcaagatctagagataggagttgattgcctctcaagaaaattaattagaaacagggttttccttcttaatatcgtcaaccactaa

SEQ ID NO: 12216 - DNA, 468 bp, Glycine max
  Peptide Sequence Number=SeqID_128994
ggaggtgaagtggagctcaaggcagagatcaagaagttcttgacttcaaggaaggtggtgaaaaaggccatctcaaaagccttggcaaatttgaagggtacttcaaaaaattgcaacatctcatccgcaaacaaagacaatcaattgattagcttattagagaatgtggaagagaaagtaagttgctcacaattggcatatgagagtgaatttgcccaacttgatgaagcattacaatcatgcatgtttgccaagacaagcaaatttgaaagcatgaataagctgcaaaaccaattggagaaagtggagtctcttactcatgatcttgaagaagggcttgagtttctgtttaggcgcccccgccttgcaacagatactgcactcccacccccaccctcaccgccggcacccgttgcaaaatcggccatcgacctctccgacacatgcaaaagcgagaaatggaaatga

SEQ ID NO: 12217 - DNA, 261 bp, Glycine max
  Peptide Sequence Number=SeqID_128995
atgactaagagtaagaccaaacagtcaatggatactgatgagaatcctaaaactgtccaagtacaaggacctatgactaggagtaagaccaaacagtcaatggataccctccaacaattgggacctatgaccaggagtaagactaaacagttaatggataccctccaaaaaatggtagcagacatacttagcaaggcccaagtggagaaggacgaagcccttgagtggagaaggatgaagcccccgagtggagaaggatga

SEQ ID NO: 12218 - DNA, 870 bp, Glycine max
  Peptide Sequence Number=SeqID_128996
atggaagcctctcaattgaacacaaaatatcattttcatgctcgttcaaacagcttgccctctagaccacaccctctcatcctacaatgcaatgagcacttagaaagcttgaggtcttccaatgaagcctcctcttcctcttcctcttcatccctttgttataagctaggagggttgcaagatctgcatgaatgtgttgaaaaattgttccagctccccctctcccaagaagcacttaaccatgagtttcaagaaaaccgggtggatgagcttctgaatggatccttaaggctcttagatgtgtgcacagccgcaaaagactctctattgcacacaaaagaatgcatgcgagaacttcaatcagttataagaaggagaaagggaggtgaagtggagctcaaggcagagatcaagaagttcttgacttcaaggaaggtggtgaaaaaggccatctcaaaagccttggcaaatttgaagggtacttcaaaaaattgcaacatctcatccgcaaacaaagacaatcaattgattagcttattagagaatgtggaagaggtcactctatcaacatttcaggcactacttcaattgatctcagggaccacacaatcaaagtcaagcagctggagtttggtttccaagaaagtaagttgctcacaattggcatatgagagtgaatttgcccaacttgatgaagcattacaatcatgcatgtttgccaagacaagcaaatttgaaagcatgaataagctgcaaaaccaattggagaaagtggagtctcttactcatgatcttgaagaagggcttgagtttctgtttaggcgtttgataaagactagagttgcccttcttaacatcctcaatcactag

SEQ ID NO: 12219 - DNA, 231 bp, Glycine max
  Peptide Sequence Number=SeqID_128997
atgaacatctatgtctggaaagtaatggcagatgttgataattctcaatcaccaatttcacaagaaagtgcatatcaaccaatttctgaaagaggtatgaaagagtgggagactggattttttgatgcagaaaatgcaaggaaagagcttgcaaaagcaattattatgcttgactatccactttcaataatggaccatcttggttttaggagattcatggctgctctctaa

SEQ ID NO: 12220 - DNA, 426 bp, Glycine max
  Peptide Sequence Number=SeqID_128998
atgggttgttggggatgtttcagatttacttttcagagaatccatgaggtgttaatggatttgagattgaaattgaatgttggattgatcatacaggtatgtgtgtgtgtgtgtgtgtgtgaacaacacaagatggatttcaaggataacaggtcaatggacccaaagaaatacactttcagcataacaggaaggaagcctattagtttggaagacaaaaggaagcttggtcaagggtatattccactgctgcaaacctctaaaccagagaaaatggagacacttacatcacatttttgtgttagagtaggaggattgaaagttaattttgggctccatggcttggtcaccatgcttcaattagttgaaacactattggaactttatgtcagtagctccaagctattcatcattacgacgaaatga

SEQ ID NO: 12221 - DNA, 201 bp, Glycine max
  Peptide Sequence Number=SeqID_128999
atggcgcggagacttgaagctttcctcgtacctcgatcagtgagcagaagttccccaaacaaagaaacaaagaaaaagaagaagaagaagaagacaacaaagactaaggtccttgcggttacaaagaagaagaagaagaagaagaaattgtacctaggaaacgtggctacgcgtcacggtcgcgaagaagctgtacaatga

SEQ ID NO: 12222 - DNA, 1200 bp, Glycine max
  Peptide Sequence Number=SeqID_129000
atggggaaggcgaaggggaagcaccgtttggacaagtattaccacttagcgaaagagcacggttacaggtctcgagcctcatggaagctggtccagctcaactccaagttcggcttcctggaatcggcccgcgccgtgctggacctctgcgccgcccccggagggtggatgcaggtggtggtccagcgcgtacccgtggaccacctggtgatcggcgtggacctcgcccccatcgcccccgtccgtggcgccatcgccatccaggaagacatcaccaggcccgagtgcaagtcccgcatcaagaagctcatgaacgaccacggctgccgcgccttcgacgtcatcttgcacgacggttcccccaacgtcggtggcgcctgggcccaggaagctatgagccagaacgccctcgttattgatgctgtcaagttggccactcagttcttagcccccaagggcaagtttgtaaccaaaattttcaggtcgcaagattacagttctgtggtgtattgtttgaagcagttgtttgagaaggttgaggtggataagcctgcggctagtcgttctgaatcagctgagatatatgttttggggcttgggtataaggcccctgctaagattgatccacggcttcttgatgtgaagcatctctttcagggatctgtggaaccacagcctaaggtggtggatgtacttcgagatactaagcaaaaaaggcaccgtgatggctatgaagatggaaacacaactttgaggaaggtgtcttcagctgcaaatttcatttggtcaaattctcctctggagatccttggttcagtcacttccataacctttactgatccagctgattcactgatcaaggatcatgacctaactagtgaagaggtaaaatctctctgcgatgatttaagggttctggggaagcaagacttcaagcatcttctaaagtggaggattcaagttagaaaagctctttcaccaactcaaaagcctgattctaccactacagaactgatggacaatgagcctaaggtggtggatgaagaagatagaatactcaatgaaatggaggaactgacttatgtaatggaccgcaagaagaaacgtgcaaagaagcttcttgcaaaaagaagagccaaggtttttagcttctcagctgccactgatttagttggaacttgggattggccacatacttga

SEQ ID NO: 12223 - DNA, 2250 bp, Glycine max
  Peptide Sequence Number=SeqID_129001
atgatgcctcagtctgatgatattgcggcggcacaagcacgttatgatggtgagagggttgaagctcaagcaatgcataggaaccaatcggcgtggatggctcattggaagcaaacagattataaatcaacaacccctgcttgcaatcgtttaaggattgattgtgaggtgaaagaagaaaaagaagacaatggcgctgagcagcgtgatttacttggtggcttagatagttctatgcacgctggagcagttggagaagcagctagggctacaagtgttaccttcaccaatgaggcagacgatgaaaaatcaaagaaagaaagcagtgattccaaatcatttcctacattcaaattttctcgaaagttagatggaggattgtctctgcagagggaacagcacgacagggaaggtggaaaatctgaaactgaaccctgctctggagatgaagatgacaatatttctctcaacagaactgggacttctggagcaggcttatcatcaacatctgcacatgcttctcctaaaatagaaacactagcaaaagagtgtcaagtattgtctcaagaagttttaccgacagctctgctaatgaaatctccttgggatgttgaacagaagaacctagctgtttcaacatcactatggaatgactttgtaaaatcagattctgacatagtgccaaatagatgtgacaaagggaaaactgtgataccccagttcacccatgaaccttttgaaatttgtcaatcaagctacaatttagcatccagagggcgattcacaagtaccaaatatcataccttttcgtctcttttaatcagcgagaagaaaatgagtagcctcttagatcctcaaaaatcttcttttccgagatggatgcaaggtggtactgctcatttaccgcataattctatggctagtagtgatgatagatattttattcgtggtcagcaccatgagattgaaaaatatgttgctaatccaaatattacatgccagactgaatccttagagtcagctaagccacaaaacctttatggactaagctccgtggcagcgcaaatgccttgttctattcatgatgtggggtgtatgaagatatacaccggtatagattcagttgaagaatcatcaagaggtcgtcccaaaatttcccagacaactcaccattttctaatgtcgaaaaacactgatgttaacttctctgacagtcagtcctttagagagccaatagcacctatcaaattcaagggaagtgctttcaatgagatccttgatttttctccacccacaaatggccatgctctgaaaggtctgaagctggaagctctagggagctccatgaagagtgaagtaaaggaaaatgtccaagatttcaaatatccaacatgcctgaagaatgaatcctctgctgaaacagatactatggacatcaatgctttacataagaataatcttcctggtgatgttccattgcaaacaaataagtgctccaaggatagtcaaaactcgcgtacgtctcaaggtgcaacaatttctgctagagagaaaactatagcaaaatcagtgaatacaacaataccagatataaaccaagagcctcaggagcttcttgccgaggaaagtcctgtggttgacagggagactagcacatcaagaacccacagccttgatttggatcactttctttctcattcagatgagcatgcaaggtcaagttctggaaatagtactttaagaatagacccaagcagcagatgggtcaaaagactcaagttgtgcacattgggctctgctcatggtactgggagtacaaaaattggagaaacttcttcacatgaaaaagttaacaatatatatggcaaaattatgaaagatagcagaactagtctggaacccaaaatggtacatcatgctgaaggacagatggtaccggatctacctgcaacagtatcaacaaatggcaagtcctctttgactgaagcaaagaaaactgtagaaattaccctttcacatccctggatacagagatggagtcatgatcgtgctacatcttcccgaaagaggcatgaattaggggagcttcatgaaccaaagtcttcaaatactgtgctagaagagtttcaaaagaaacagtttccaagcattgctgccatggccatgatgggaaaagcaatgaacagtttgaatccctccgagcttacgaaaaagggacctgtgatagtttggaatatgaagggattttga

SEQ ID NO: 12224 - DNA, 582 bp, Glycine max
  Peptide Sequence Number=SeqID_129002
atggagaagagcaaaattttggttattggggcgacaggaaatttgggttatgatttagcggaagcaaacctcaagttttgtcatccaacatttgctcttgttggagactctgctttctctgaccccatcaaagcccaggagctaccattctcaaaggttcgctggaagatgactgaggctgtgagggttcgagtatctgtgcttgaagatggctataatttctatgcacccaaagttgaaattagtagacttgtggaggctgaaggcattccttacactttcatctcatgcaatttctttatgaggattttgcttccttctcttgctcagccaggcttagatgctcctccaagggacaaggtcaccatatttggtgatgggaatacaaagggtgtcttcatgaaggaaagtgatgttgctgcattcactatcaatgcagttgacgaccctcgaaacgtttgttctttgaatgagctggttgagatgtgggagattaagattggcaagaagcttgagacattgcatgtctctgaagtagagttgctccagaaaatcaaagtgtgtttggatggagaaatttaa

SEQ ID NO: 12225 - DNA, 1338 bp, Glycine max
  Peptide Sequence Number=SeqID_129003
atggcgagtgagtcgcaaaactgggtattcatggtgactgcacagaccccaaccaacattgccgttatcaagtattggggtaaaagagacgaaaccttgatcttaccggttaacgatagtatcagtctcactctcgatccctcccacctctgcaccaccaccactgttgccgtcagttccgctttccaccaagatcgcatgtggctcaatgccaaggagatttctctttctgggggcaggttccagagctgtttaagggagatccgtgctcgtgcttgtgatgttgaggatgaaaataagggtataaagatcacaaaggaggattgggccaaattgcacctacacattgcttcgtacaacaacttccctactgcagcaggactggcttcatcagccgcgggttttgcctgccttgcttatgcccttgggaagctaatggatgtcaaagaagatgaaagccagctatctgctatcgcaaggcaaggatcaggtagtgcttgtcgcagcttatttgggggatttgttaagtggataatgggaaaagaggataatggcagtgatagtcttgcagttcaacttgctgatgaaaagcactgggatgatcttgttattgttattgccgtggttagctcacggcagaaggaaacaagtagcacctctggaatgtgtgagagtgttgaaacaagtttgcttttacaacacagggcaaaggaaattgtgccaaagcggatactgcaaatggaagaagccattaaaaatcgtgattttgcatctttttcgcaattgacctgtgctgatagcaaccagtttcatgcagtctgcctggatacatccccccctatattttacatgaatgatacatcccacagaataatcagcattgctgaaaagtggaaccgttcagaagaagctccccaggtagcttatacatttgatgcagggccaaatgctgttctaattgcacgtaataggaaagctgctacctctttgattcagaggttgctttactacttccctccaaattcagatgacctcagcagttacattattggggacaagtcaattgcaaaagatgcggggatcaatggaatacaggacgtagaagctttgccacctcctccagaaatcaaagataatattccaccccaaaaatacaagggggatgtcagttatttcatatgtaccagacctggaaggggacctgttttgctttctgatagcagtcaagcacttctgaacggtgaaactgggcttcccaagaccctttcaaggaagcccgtgtgctacccatggcatgatgattcgttccttcctagttcgcagtatgtgttcgtttaa

SEQ ID NO: 12226 - DNA, 183 bp, Glycine max
  Peptide Sequence Number=SeqID_129004
atggcaaaaccaaagcttcacttgctgtcctttctcttgtgcaccatcttgctaagcttcttccactgcacattttcactgatcaacccagaggatgagaccagctggattgacatggaaactgaagacattaacgttgtgcaaagcttattcttcaatggctttccatgctatggattttga

SEQ ID NO: 12227 - DNA, 330 bp, Glycine max
  Peptide Sequence Number=SeqID_129005
atgaagtcccacatggttcttcagtctgcctattccaaaatgggcaatgtgaataaatgtgaggagattcttaaccaaatgtgtaaatctggtctgaaactaaacacttatgttctcaaaagcatgctgaacttgtatggacggttgggccaatttggaaagatggaagaagttctgagagtgatggaaaaaggatcatatgtatggtcaagcaggattattgagagaatggaggacttctttcagttgctacctagcaaaggcttaaaacctgatgtggtgacttggacttctcgtatgggagcctactctaaaaaaagctttacttaa

SEQ ID NO: 12228 - DNA, 378 bp, Glycine max
  Peptide Sequence Number=SeqID_129006
atgaataatccaagtgcagttgtatacaatgcttatataaatggactaatgaaaggaggaaattctgacaaagcagaagagattttcaaaaggatgaagaaggatgcatgcaagtcaactactgaaacttataccatgttgataaatttatatggaaaggctggtaaatcctttatggccttaatattgttccatgaaatgacgacccataagtgcaaacctaatatttgcacatatactgctctggtgaacgcatttgtgagagaaggactatgtgagaaagcagaggaagtgttcgaacagatgcaggaagccggacttgaacctgatgtatatgcttataatgccctcatggaaacttacagtttgataccttag

SEQ ID NO: 12229 - DNA, 345 bp, Glycine max
  Peptide Sequence Number=SeqID_129007
atgtcgcgggggtcaggagaccttggggacgccaggtggggtgctattgcccaaaaccaagcttggccaatcctgacccaacccgggcatagtcagtcagtgagaacctgtgacgtacctaagcaggcgagctcctggcagtcaaccaataaaagaacaaaagtccacgaagcaaggaggtttgtgtggcggctggccagctatctatcttgggttgtatatgaaaaattccctctggttccaatgtgcaaaggctatggaaattcgtttttgggcactggtaatcgattacttactttggtaatcgattaccagagaggaaagcttttgaaaaagacattttga

SEQ ID NO: 12230 - DNA, 1572 bp, Glycine max
  Peptide Sequence Number=SeqID_129008
atggtaacaacagatccagatgcagaggtgatagcactatctcccaagaccctaatggcaacaaacaggtttatatgtgaggtgtgcaacaaagggttccaaagagagcaaaacctacagctacacagaagaggacacaacctgccttggaagcttaagcagaagacaacaaaagagccaaagagaaaggtttatctgtgtcctgagcccacatgcgtccaccatgacccttcaagggctcttggagacctcacagggattaagaaacactactctcgcaaacacggtgagaagaagtggaagtgtgacaagtgctccaagaagtatgctgttcaatctgattggaaagcccattctaagacctgtggcaccagagaatatagatgtgattgtggcaccctcttctccaggagagacagtttcatcacccacagggcattctgtgatgcactggctcaagagagtgcaagacaaccaccgagccttagcggcggcggaattggtagccacctgtacggaagcaccaccaatatggccttaaacctatctcaggtcggttctcagatacaagaccccagcaacgcccaacccaccgagctcctccgcctcggcgccacctccggtcgaaccggccatttcgaccacatcctcggttcacccttcagaccctccaaccaacaacaacaacccttcttcatgtccgaacaacccaaccaaacctaccaccaccccgaccaaaacaaacccttccaacaagggttaatgcagcagttgtctgatcaccaccaccttaacaacaacaattcacccttcaaccttccttttctctccagcaacacagccaacgcttcgttctctgaacacttcaacaatgccaatggaggaggcaacaacaacaacaacaacgagggcactaactacttcgctacttcaagtgcaccttctctcttcagcaacagtgccaatgcgaatgcgaatgcgttatctcacatgtctgcaactgcactgcttcagaaagcagcacaaatgggtgcaacttcgagcaacggcaccgcttcgcttttgaaaagcttcggaagcgcgtcttccagcagcggcggcggctcaaaatctgaacaacaacacagggtgccaccactggtgaatgctgcaaactacgttggtggaatgttcggagggaatcacgtgaacgaacaacagagtaacagtaacctccaagacctgatgaactcgttcgctgttggtggaaactcttccattttcgaagctggtggctttgaagcatatgatcatagtaataacaataataatagggacccaaaagtgcttgcaatgagtggaagtaacagcgttggagggtctgatagactcacccgcgattttctgggtgttggtcagatagtgaggggaatgagtgggagtggaggggttgcacagagagaacaacaacagcaacatggcttcaacttgagttctttggaagctgaaagaaataataataataataatagtaataatgctgcgccgtcatcagggcaagcttttggaggtggtggagggaattttcagtga

SEQ ID NO: 12231 - DNA, 291 bp, Glycine max
  Peptide Sequence Number=SeqID_129009
atgggatttccaaagtttttaatagaggaatttatagctggacaattaaagaatagagtttcgtttcgtaaagcaatgaaaaaagctattgaattaactgaacaggcgggtacaaaaggagttcaagtacaaattgcaggacgtatcgacggaaaagaaattgcacgtgttgaatggatcagagaaggtagagttcctctacaaaccattcgagcgaaaatcgattattgttgctattacagttcgaactatttatggggtattagggatcaaagtttggatattttctaa

SEQ ID NO: 12232 - DNA, 816 bp, Glycine max
  Peptide Sequence Number=SeqID_129010
atgcatggcgtggatgtgactgtaatgaccacaccagcaatcgctgccattttccaaacctccatcgaccgcgattctactcgcggttctcggttaccggattggcttagagcaccaaatggatacactcgtttaaagaagatgatgcaagaatcagagaaaaagagctacggatcactgttcaaaagcttttatgagtttgagggtcataaggctggtagtggacatgcaaatgaagaagaagaagaagggttacttacatggcttgattcgaagaaagaggaatctgttctctacgtgagttttgggagcatgaacaagttcccttccacacagcttgttgaaatagctcacgcacttgaagattcaggccatgattttgatttcatctgggtgcacaacttcttatactggagctgtggtgactcactgtttgaaagtgccatcgcaggtttgccaatggtgacttggcctatttttgcagagcagtttttcaatgagaagtttctggtagatgtgcttagaattggagtttcagttggagcaaaagaatggaaaagcttgaatgaatttgggagtgaggtagtgaagagggaggacataggaaaaactattgctttgttgatgggtggaggggaagagtctgtagaaatgaggagagtcaaagcgctcagtgatactgcaaaaaaagcaattcaggttggtggatcttctcacaacaatttgaaagatcaaattgaggaactaaagtcattgaaacttcaaaaggttaaacacaaaatggaggtaatcgaaaagggagaccgtaacgcctag

SEQ ID NO: 12233 - DNA, 1518 bp, Glycine max
  Peptide Sequence Number=SeqID_129011
atggatcctagattatcattgatggagtcatcctctgatgaaatggtgctaaagggtatttttctgccctttatatcaccgagtcatctggtgcccgtcgtagacatagcgaggatcttcgccatggaaggtgtggatgtgaccataatcaccacaccagcaaacgccgccgttttccaaagctccatcgaccgtgattgtatccgcggtcgctccattcgaacccatgttgtcaagttccctcaagtccctggcttgccacaaggattggagtccttcaacgcttccactcccgcagacatggtcaccaaaatcggccacgcgctctccattctcgaaggtccattccgtcaactcttccgcgatatcaaacccgacttcatagtctccgacatgttctacccttggtccgtcgatgccgcagatgaattgggaattccgaggctcatttatgtcggcggaacttactttgctcattgtgctatggactctctcgaacggtttgaacctcacaccaaggtaggttctgatgatgagagctttttgattcctgggttgccccacgagtttgagatgacacgttcgcagatacccgatcggttcaaagcgccggacaacttgacttatttaatgaagacgattaaagagtcggagaagaggagctatggatcagtgtttaaaagcttttatgcgtttgagggagcctacgaggaccattacaggaaaatcatggggaccaagagttggaacttgggacccatttcgtcgtgggtgaatcaagatgcttcggataaggcttcaaggggatcacgtgacaacaaagctaaagaagaacaagtagaagaaggaaaagatggttcttggcttgcatggcttgattctaagaaagagggctctgttctctatgtgtgttttgggagcatgaacaacttccctaccacccagcttggggaaatagctcatgcccttgaagattctggtcatgatttcatctgggtggttgggaaaactgatgaaggtgaaactaaaggttttgtggaggaatttgagaagagggtgcaagcaagcaacaaagggtatctaatatgcggttgggcaccacaacttctcatactggagcacccttccattggagctgtggtgactcattgtgggatgaacaccgttattgaaagcgtggatgcaggcttgccattggtgacttggccactttttgcagagcagtttttcaatgaaaggttgctggtggatgtgctgaaaatcggagtggcaattggagccaaaaaatggaacaattggaatgactttggggatgagatagtgaagagggaggacataggaaaggcaattgctttgttgatgggcggtggagaagagtctgaagaaatgaggaagagagtgaaagcgctaagtgatgctgcaaagaaagcaattcaggttggtgggtcttctcacaacagtttgaaagatctaattgaggagctcaagtcactcaaacttcaaaagctcaacgcctaa

SEQ ID NO: 12234 - DNA, 571 bp, Glycine max
  Peptide Sequence Number=SeqID_129012
ctggcaggcatcgggttctgtcagtggcgcggtcgccgttcacagcggcggtatcaccctgggccataccgtaagcgacacctttgccatcgtagaagccaaaggagctgagggtgcgacggtgctgaacggccagaatattaaaattgacagttcaggttacgccatcgttccttcgctgatgccgtacagacgtaacaacgtcaaccttgatgcaccggaggggaagtccgctgatgtggatattatcgacagtcatcaagtggttaccccctatgcaggttcagtcaaccgggtggtcttcaaaacccgtcagggaataccggtcatgatgcagctgaaacgccgggatggcagctacgttcccctgggagcagatatctttgattccagtggcaatagtgttgcaacggtcagtcaggcggggaatacctatctgcggctggaaaaccgtgaggcgctgagcgcccgctggggcagcgcacaggatgaacagtgtgttatccactatgcgccagtgaatgcgacgcccgtaaaggccctcaattatgtcactgcactctgtgaataa

SEQ ID NO: 12235 - DNA, 2025 bp, Glycine max
  Peptide Sequence Number=SeqID_129013
atgggttgctatagtttgaagccatttagatttgaagggcttaaacggcaagatgaggtgaaagccttgatgcagaaacttaaggagaacacacatttacttattgaaattgatattgatgcactgctcgagaaagacttattgactctagatgaggccatgaagaccgctaatgatgcagttttgctagctattaaggctgtctctgttctaaaatctgagatgcacaaaaaatttatagatagattgaatgatggcatgaaagaggccagctcttcagaaattaataaaatattggaatcctataaagaagcagggattggatttggagctgcatataacatcaaagcttcaattttgcagtctatatttgatagtcctttcctgggtgttcgtttgaaggatccaaatagcctagttatatgcacccttgcgtgttcagaacccatcaatgatagtgatatagcaatctttctgcatactttccgtcaaacaacaaaatacacgagggatattataatatcaacaatacatgaccatgctgttgagcccaacctattcataacaacagtccttacacttggctgtttaaatgtgcaacggtcttcccagaatggtggtatactgtccagacttgccctgcattttcctcttatttttagcttttggggaagacataatcagcaacaagttggcactggtaaacagactgaagtatttcctcatgaagtgatgagttctgatgacattgatgagaggacaaataggattacttctgacaacatagataacaatcttgacaaatactatgaagagccagcattgagaaacaacagctcaaagttgcctacttcaagggattctggaaaaaatggagaagatttatctgacaccacgtccaactataacatcctttatgactctattaccgaaggaggtgactctgcttttcaaagggaacaacttgagaactggaatctaggtcctggatttgaggtggcaaaggagtgggcccaagaaaaagcagctgatgctacacccgctgttgataacctaagcatcttccaccttcctgttggtgtgaggcattcagaagatttgaaagactgtttggaaatctcatttctgacaaaacagcttgagccagatactgataacgatgtgaaaacacaaacattaaatggaggtatgtctccttggagtgcagcaactgatgcaagtttggaagcagtgatggaatttgcatcttcacttttgaaaggaaagaatgctaataaatcaaagaaagacggagttctatctgttcgtgctgcgtctatgttggtaataatgtcattgaaatttgttgatgttcatgcatatactactgaaagagaatctgaggaatattctgttactacttttcaaagaaataactcccaggactgtaatacctctggtgtttatctagcgcaaggaaatttcaaattttttgaggtcaaagaggcagaacgtgatttgtcaaaaaagtggagtccggtcgtggaaatgcaatataggggaggaagatacaagggacgatgccaaggaggtctacctgaagggaaggggcgtcttgttctcagagatggcagtatatatgacggtttatggcgctatggtaagagatcaggtccaggttcattctacttcaaaaatggggatatgtttcaaggatcatggagggacgatgtcatacacggcaagctaaagataagacaaaaagtaattgttttggaattttttataatcgatatggcatatttatacataaattacatgggttggttttactttcgcactggtgatcggtggtttgcaaacttttggaagggaaaggctaatggtgaggggcggttctacacaaagtccggtgatgccttctttggcaatttcaaagatggatggcgacatggccagtttctttgtattaatgcgaatgggacaaggttgattacagtggaaagagaaatgttgaatggacctcagcttcaacgtgataactaa

SEQ ID NO: 12236 - DNA, 330 bp, Glycine max
  Peptide Sequence Number=SeqID_129014
atgtcagagttggaccctaaaagacatggtgctgcatttgtctcaagaactccacttgtgtggcatggttcttggcaatccgtgcatcatgagcagcaaagcattcatcaaagtgagcctgcatacaatccaaccaccccaaaagtgtatgcatgtcaaatgcggatggtggtggcaactgttttctcagagctctttgttatgggtgtcgtggagctctctgatgtggggatctctgctcctcctgtagttagtgttgttcttccttatactacttcttgtcagcctactccccctctattttctctagagcatactgattccaattaa

SEQ ID NO: 12237 - DNA, 393 bp, Glycine max
  Peptide Sequence Number=SeqID_129015
gatgctgatatcatgtggttcagggacccttttccgcagtttgaccttcatgcagatttccagatagcgtgtgatcatttcacaggtggatttgatgatgtacagaacagacccaacggagggttcaactatgtaaaatccaataataggtcaatagagttttacaaattctggtactcttcacgagaaacctatcctggataccatgatcaagatgtccttaacttcatcaaggttcatcctttcattactgatattggactcaagatgaggtttttggatacaactaattttggtggtctttgtgaaccaagattggaaacattatttatccttgccaccaagtttgaagaggttgtcagttgtttcctggagggttcctcagaaatgcag

SEQ ID NO: 12238 - DNA, 429 bp, Glycine max
  Peptide Sequence Number=SeqID_129016
atggagtgcagggttcctaatggtggtacctttagagtggccctagtagaacatgtagctgcaagcaatggtgtgctaggctttagaatcttagtatcttgtaggctctccaaacaatgcctccatgtactcctgtgtagccatagtctctggtgtctcaaagctaatgatgatattgaaatcatcttgagtcatcctccacctctctcccatcatacaaaaggccaccatgtgtgggaggcattcaattggaggtggaaattgaacaaagtcaaggttgggattccactcctaacatggtgcaagaaactcaatagtgggctccctgtagccccgctcctgaatgtctactgggtggagaaggaggtggtggtgatgactgatgatggtgagagtaatgtagctccatgtagagcttgtaggccctga

SEQ ID NO: 12239 - DNA, 423 bp, Glycine max
  Peptide Sequence Number=SeqID_129017
atgcacgggagtcgccaccaacatttattcaagaaaaacattagaaaaaccaaaaaggacattagaaaaaccaaaaaggggtctgcaaattttaagaatatgggttcaggagttgttttacgtgtagggaagcgtttcccttgctcctatgtatcctcaagtgcgatgaggaactcagacctacgtagtgtagaagcaaagcttcatgatgatgacaaaggtaatgacaaaaggctcaaaggtcaatcaaagatattcaagatagaatcaagaacacttcaagattcaagagatcaagatttaaagaatcaagattcaagagatcaagatttcaagaatcaagaatcaagagatcaagattcaagaatcaagagaaggcttcatcaagataagtatgaaaaggttttctcaaaaattgagtag

SEQ ID NO: 12240 - DNA, 501 bp, Glycine max
  Peptide Sequence Number=SeqID_129018
atgggcaaacagactagcaatgaatatccacttgaaaagatcctgaatgacgctgccatgaaagacagaactgtaatcttgaccacattaaatgaagcatgggcaactccaaattcagtcatcgatcttttccttgagagctttagaataggagatcgtaccagtacatttttaaatcatttggtaattattgcattggaccaaaaggcatttgcacgctgtcaggttatacatacccattgcttttctcttgttagtgaagaagccgactttcatgaagaagcatattttatgactcctcgctacttgatgatgatgtggaaaaggattgatttcctacgtactgttcttgagatggggtacaattttgtgtttacaccatggaaacattctcaaagttgtgaagtttattgtttttttgtgattgattttcatatgataatgcttaatgggaaaaaatttctggtatatgactgggggaatgagttacttatgagttga

SEQ ID NO: 12241 - DNA, 900 bp, Glycine max
  Peptide Sequence Number=SeqID_129019
atggtagcaccacctcctccagttcctggtccttcacaggctcctcggatgtttggcatgccaccaccactgccaaatcaatctatgactactactatatcacctgctgttggtcaaactggagcccctatggcagggccttccaaaattgatcccaatcaaattccaagacctactccaggttcctcagtgatcttgcatgaaactcgtcaaggcaaccaggcaactattcctccgcctgctacaagtgaatacattgcaagagatacagggaattgcagtccacgttacatgaagtgcacaatcaatcagattcctttcactgctgatcttttgacaacatcaggaatgcagttggctatgttagtccaacctttggcccttccacacccatctgaggagcccattcaagttgttgattttggggagagtggtcctgtccgttgctcacgttgcaaggcttacataaatcccttcatgaaattcattgatcaaggaaggcgtttcatctgcaacttgtgtgggtttacaaacagggccaagaacaaaacccttgcgccaattcaaatcaccattgagcaaattctccatgagaaaattgtcaactccactgagctcggcaagtaccgtctccagaagcacaaagagtttaaggacatatttagcatgtttgatggaacatcggtgtgtgggcttgtggaagaaatcacacttcaaacgtgtgcattccattttgggagaaagtgttggaggtggattataaataaaaaccacaccttatggctgaagtatgtggaggtggaggtggagactaagaacaagttcataaaccatgcaaggaacttttgggaccgcgttgtgatgctattgctgagggtttatcatgtgaggaatgtttag

SEQ ID NO: 12242 - DNA, 342 bp, Glycine max
  Peptide Sequence Number=SeqID_129020
atggaaagatttagtgatgaaactccacgggactaccactgcaatttaggtccagatggtcggcgtagagatgctgatgaaaggcctgagctgtgtagaggaacagttgagtttgttgctacaaaagaattcatggaccataggatgatctcatttcatgaaaaagtattgctgcactacttcataacaggattaattattccagaggtccgtgagcccatgcctgctgtgtacttctttctcattgatgtatccatgaatgctgttcaaactggtgcaacagctgcagcttgcagtgccataagtcgagttattaaagacaaagaccttccttttgtatga

SEQ ID NO: 12243 - DNA, 484 bp, Glycine max
  Peptide Sequence Number=SeqID_129021
gcaagctaagcggaccatgtctcactatagtatatgcaagagtatcggttcaagacccacatctcaatatgatacaaggagatttcactccttagatgcatggaaccggtacacggataatgtattggggagaaacatcttgccagagaggaaggtggagctctaccacactgagtttgatgattttaagactgagttggagaggcataatctccataaatgcctcaccaatttggttgatgggagcattgatgtggctttggtgaaagagttctatgcaaacctatacagctctgagggtccttcaccaaagcaagccagggaaggcataggtcacatcttagacctcactcccatagaagagaaaaggaaagaaagtctcaagaggctaacattaaactctcatacttccatggtgtcataccctaatttcgtccggggacctttgcttgatgacatgcgacctttctttggtccttgtgag

SEQ ID NO: 12244 - DNA, 261 bp, Glycine max
  Peptide Sequence Number=SeqID_129022
atggaactacccatcatatctcccaaaacccaatacccacgaaaatcatgtgagaaagaagtctacccaaacctgaaatttgaagtcccacgacgtagcggtgcgcttcacgactccgaaaatggcttcctttcgcgatttggagcagaaatggtgagcaaaggttggagctttgatggagcttcaatggtggaggagaaagggagaaaaagcaacgtgagggaaagggaaaagcttctgcacttttggctgagtgaatga

SEQ ID NO: 12245 - DNA, 777 bp, Glycine max
  Peptide Sequence Number=SeqID_129023
atggatataagagttgcttttgaaatgtataatgatacgaaaaatgaggttacattaagcaaaaagggcaacagaaatgaagagaaagcaagagttatgaagcaggcccagcccaacactggcgctaagcgtgcgtcaggcgcaactatgaagacccagaagcccacttcagcaactatagatagaaagccaaagaaatctcatttcttggctgccaagagggttctaaggtatgtgaagggaactatgcagtatggtgtgatgtttccaagtagtgttgatggtgctgagatgaaattgattggttactcagatgctgattggtgtggggacaggacagataggagaagcacatctggttacttgttcaaatttggtggagctgctgtgtcttggagctcaaagaaacaaccagttactgctctctcaagctgtgaggcagagtatatatctggttcctttgctgcttgtcaagcaatttggttgaaatcactgcttgatgagttgaaatgtgaagtacagatgccactgtcattactgatagataataaatcagcaattagtcttgctaaaaacccagtctcacatgggcgtagcaagcacatcgaaacaaggtttcatttcatcagagaacaagtgaataatggagttctgaaattgatttactgtcccactgaagatcagttagcagacctgctaaccaaggctgttaaaccagacagattcataaagctaagggaagagattggagtcatttgttttgaagatttgaattaa

SEQ ID NO: 12246 - DNA, 1758 bp, Glycine max
  Peptide Sequence Number=SeqID_129024
atggaattaaaaatgtacttggacgttgtttggaatgaaccaggaaaacatggcatgtttcagagaatccgtgggacagatttctcagtcattgcagcaaacgagaatatagtggagatttcatttttaagaacatggacagcttccatgaaaggctcaagtgtccccatgaacatagacaaaaggtatatattgcgaagaggtgattatgggttttattcatacgcaatatttaatcgaccttcaggattacctgcagtggagattgatcaaattaggattgttttcaaactcgacgaaaccaggttccactacatggccatatccgatactaggcaaaggaacatgccatctgtgagagatagagcatcgggtcaacccctggcgtatcctgaagctgttctcttaaccaattcatctgagcaacaatttaagggagaggtggatgacaaataccaatactcgagtgagaacaaagataacactgttcatgggtggattacccaggatggtttagcacccgtgggcttctggttgataacacccagtaatgagttccgccacgctgggcccgttaagcaagacctcacctctcatgttggcccaactactctttccatgtttgtgagtactcattatgctggcaaggaggtaaccatggcatttggtgaaggggagacatataaaaaggtttttggtccagtttttgtctaccttaactctgttccaaacaaatcccagtttcggtctctctggtcagatgctgtagagcagttatccaatgaagtcagaagatggccttatgatttcgttggatcaaaagatttccttccacccaatcaacggggaacagtgacaggacgactactagtccaagatgggggaaagagagatcaacctgctaacaatgcttatgttggtttagctttgcctggagatacaggatcatggcaaaaagaaagcaagggttaccaattctggattcaagctgacaaagctggacacttcttgattaaaaatattgtacccggggattacaacttgtatgcatgggttcctggttttattggagattatagatataaaactaaaattaccatcgagcgggggggcaatatcaacttgaattcacttgtttataatcctccaagaaatggtcctactctatgggaaattgggatccctgatcgctcagctgcggaattctatatgccagaccctaaccccaagttggtgaacagattattccagaacgataagcaagacaagtttaggcaatacggcttgtgggaacgttacactgagttatatccaaaccatgatctcgtttacactgttggtgtatctgactatcacaatgattggttttatgctcaagtcaccaggagcacaccagaaaaatcatacatgccaaccacatggcaaattcaattccaacttaaaaatatcataatgccaggaaattacacattccaagtggccttggcatctaccactaatgctagattggaggttaggttcaatgacctgaatgcaaagcttccccacttctcaacagggctaaaaggcgatgacaatgccatagcaagacatggaattcatggattgtataggttgcatactatagctgtaggtagcaatcatttggtgaatggaaagaacaccatctatttgacacagtcaaaaggcataagtcctttcatgggagttatgtatgactatgtccgcttagaaagtcctccaattaaaagtacttga

SEQ ID NO: 12247 - DNA, 381 bp, Glycine max
  Peptide Sequence Number=SeqID_129025
atggcgtcaagctctctcagcaaacaaaaggcttctgactcctcttggacaccaaaacagaacaagctgtttgaaaaagcacttgcaaaatatgacaaggatacccctgaccgatggcagaatgtagccaaagcagtaggtggaaaatctgcagatgaagttaagagacactatgaaatcctcttggaggatctgagacacattgagtctggtcatgttcctcttcccaagtacaagtccacaggaagcagcaccaatgttgaggaagaagagagattgtttcaaatttcaatgaattatcctattctagaaacagcacaggttcttaaccaggatattctccccatccaacctctctccacaccctttaaaaaggattaa

SEQ ID NO: 12248 - DNA, 333 bp, Glycine max
  Peptide Sequence Number=SeqID_129026
atggcttccgcggtgaggttggcttcaaggtccttcttcgctaatcgttctagaagcttcgtcaagagctcaacgacgccgtttgtcttctcttcgtcttccgcatcacgcatctctcgtgcttcgagggttctgtcggttgtgataagcgttgagtcgttgatgcctcttcacagtgctattgctaatgctaggctcacctccaatatcgccttcgattccacctgctggagctcgctttctcgagggaaaaagaaattaactctcattgcatggaatttggaatcaccactcccaccatttttgcaggctatggtgattcctagtttgtag

SEQ ID NO: 12249 - DNA, 1875 bp, Glycine max
  Peptide Sequence Number=SeqID_129027
atgtttttttcatgtaaaacatacaacctctaccttccctgctcctctgttcccctgcgcaattcaacatcatgcaccattttcaattgtcaaaacccaaacgagcatcactccattctccgcaaacacaattccaaatccacagcatatctccttcaccacctctcccacaaggatggggcacccaaccccattcccattcccaaacccagcgagcttcaagacccaatgccccacgaagaaaaagtcaaggttttggagctttccctcgtcagaaaaaggaccccccagttccctggctccatctacgctcaatctcccagtgactccgatgtgggttcttctctgccccctctccgcactctgtttcaatcaagtgatgataaagacgaggaggaggaggagaaggagatgataatgcgcgctctcgatattcggaggaaggtcactgaagaggttttcaaagaagccatgcgaaagggaaagtttggaatcacttacactaccaatttggttggcaggttatccggtttcattgattacatcatgattgaagctgctaacttgaagagattgcccgaatattcaaactccaccttcaatttgcgcgccaaaattgtcattgatgactctaaagttgtgccacttattagatggttgaagcacaatgcactatcatatccccggatagcgaagcttattttgatgtcaagtggaaaacttgaggctgtcaggagttttgtcgagtggttgaaatcggtacatgtgaaaggagagtttctcggtgttgtaatggtgaatgctggggaaaatattttccagcgcagccatgtggagctggatgagattgttctgtatttggagtccaatggagtcaggagggattggatgggttatgtcattagtcgttgtcctcagttattgtcttatagcttagatgaagtgaagaatcgtgcacagttctaccatgatatgggcttaaatgagaaagattttggcacaatggtttttgattttcctaaagttcttggttactattcgctggaagaaatgaatgcaaaggttaattacttaaaagaatttgggcttcaaactaaggatgttggcagattgcttgcttttagaccacaattgatggcatgcagcattgaagaacaatggaagcctcttgttaagtatctgtattattatgggatcactcaagatggtatgaggagaatgcttaccattaaaccaatggtcttttgtgctgacttgcagatgactattgtgccaaaggtacggttttttgaggatataggggtgcgcaatgatgcgattggcaacatgcttgtgaagtttcctcctctactcacttacagtctgaacaagaagattagaccagtggtcatattcttgatgaccaaagctggagtcagtgagaaagatatcgccaaggttgtagctcttggacctgagctgttgggatgcaatatagcacataagcttgatctaaatgtaaaatattttttgtctcttggcatacgtcttcggcaattgggtgagatgattgctgattttccaatgctgctcagatacaatccagatgtccttcgtcccaaatatatttatttgcgaaaaacaatggtccggcctttgcaagatcttattgagtttccaaggtttttcagctattctcttgagggtcgaattatcccaagacataaggttctagtggagaatcagattaatattaagctaagatacatgttgactagcactgacgaagaattcaacaaaatggtcaagggcataattagaaagcgcctcagatttgaatctgctgtcacaaatgaggatactacgttaatactggagactacaccccaggcataa

SEQ ID NO: 12250 - DNA, 126 bp, Glycine max
  Peptide Sequence Number=SeqID_129028
atggtgcttatcatgacaatttggtatcagcatggctctgctgttcccgtgaagctgaagcatgtcctttgcaagatcaatggctctgcaacccatgccccccaagttgaagtaacacaagactga

SEQ ID NO: 12251 - DNA, 930 bp, Glycine max
  Peptide Sequence Number=SeqID_129029
atgcagaacattggttcagacgagatcaaagcactcaaagtgagaaagctcattgttccacagacgtggaagggttactcattgaaaagaggtcctaattatgcgcccaaaagaaagaaggttgtcactgatctgactcgtgataattttcagagtggtgagtggaaggaacttgagttcaaggagtacaattatagtgctaaaggtcaacctcttgagggttatatgtctgctctcgccttaaatttacatctgaatgttttaattggcagcttctggaactttgatgccttgttccagccccaacaacacccagcccgtgattcacatgatacattctttttggaaactccttcaacaacaaagattttgccagaagattatgttcagagagtgaggcaagttcatgaatctggtggttatgggtctagagggtatgcatatgactggaagagagaggaagcaaataaaaaccttctgcgaacccatacaactgctgtttcctccaggatgctttaccaattagcacagaaaccatttgcccccaaaaaatatttctctatagatcgtgtattcagaaatgaagcagttgatcgtacacatcttgctgagttccaccaaatagaaggcatgaccaagctgaagttcaaaccagcttacaatccatacaccgaacctagcatggagatttttagttatcatgaaggctttaaaaaatgggtagaggtaggaaattctggcatgttcagacccgaaatgttgcagccgatgggacttcctgaagatgtccaagttattgcatggggcctttcccttgaaaggccaacgatgatactatacgggatagataacattagagatctctttggacacaaggtggatcttgggcttataaagaagaatccaatatgtcgacttggaattgactaa

SEQ ID NO: 12252 - DNA, 366 bp, Glycine max
  Peptide Sequence Number=SeqID_129030
atgtctccctacacggattcaactccaaacgagagtattgttatgtgggaaaagattggattatggtcttggattgagccattgctgaataatgtagaatcgttttcagagatggtgtttaagtgtttgaagagcttcagtgcagaaaataccaggttttggttgtgtgcttcgagatggagaaggcaattttgtacagggtggattgatgttgtaatggaggtacaagaaaaagagactttagccatgtttaaagctatgaagtgggtggaacaattaccattctcggtagtgatttttgagagtgattgcaaaggcttagtaaatcaagtcaaaagccgaaataatagcactactgaattttga

SEQ ID NO: 12253 - DNA, 276 bp, Glycine max
  Peptide Sequence Number=SeqID_129031
atggtgaggtcatctccaccaagaacaagttacaaaacatttcaaaagataaactcaaggtcccaccgagatttgaactcggttatcaacgatcgtgtgactgaaagatccaagggatttgaatttgttaccttcgcctctgaggatttaatgagagatgcgattgaaggaatgaacaagcagaaccttgatggacgtaacgccattgtgaacgaagctcaatctcgcgaaagccgtagtggaggcgatggcaattacggaagtggtggtggatag

SEQ ID NO: 12254 - DNA, 270 bp, Glycine max
  Peptide Sequence Number=SeqID_129032
atgtctatgttgaatcgatttggagaagatgtgaaggagcttagtttgcactggtggaaaaaggaggatgtggtggcggttgggattatcagtgacattggcggtattaaggaagatgatggaggtatctacaccaacgacaaggggttcactggcattagaacaacaaatgttgctatcaaaaacactcacaacgactatgtggttctattcgtggaagcatacaaatctgttagttctggagcagcaggtcaccgatcgaataactaa

SEQ ID NO: 12255 - DNA, 2649 bp, Glycine max
  Peptide Sequence Number=SeqID_129033
atggctcagccgctcgtgaagaaggacgatgaccgcgacgacgaagctgagtattctccctttttgggaattgaaaagggagctgttcttcaggaggccagggtttttaatgacccacaactagatgctaggagatgttcacaggttatcacaaaacttttatatctactgaatcagggagagacatttacaaagaccgaagccacagaagttttcttttctgtaactaagcttttccagtctcgggatcttgggttaaggagaatggtctacctgatcataaaggagctctccccttctgcagatgaggttatcatcgttacaagctctctcatgaaggacatgaatagtaagactgatatgtacagggctaatgctattcgtgtcctttgtcgtatcacggatggaactctccttactcaaatagagcgatatctgaaacaggctattgtagacaagaatccagttgttgcaagtgcagccctagttagcggcattcatatactccagacaaatcccgagattgtaaaaagatggagtaatgaggttcaggaagctgttcaatcaagggcagctcttgtgcaatttcatgccctggctttgctgcatcagcaagctggttacaagcttaaccaggggaaatgttcgctctcctttggctcaatgccttttggtctgttatacaagtcaggaaataatacacaatcaggggaccgccccttctatgattatcttgagagttgccttcgtcacaagtcagagatggtgatttttgaagctgccagggcaattacagagctcaatggagtaactagccgagaattaacaccggcaattactgttcttcagcttttcttaagttcatctaagccagtcttgagatttgccgctgtccgcaccttgaacaaggtggcaatgacacatccgatggcagtcactaactgcaatattgatatggaaagtttaatctctgaccagaacagaagcattgccacacttgccataactactctattgaagacaggaaatgaatcaagtgtggaccgtcttatgaagcagattacaaatttcatgtctgatattgctgatgagttcaaaattgttgttgttgaagcaataagatcactatgcttgaaattccctttaaaatatagatctctgatgaatttcctaagtaacattcttagggaagaaggtggctttgattacaagaaagcaattgtagattcaattgtgattcttattagagatatccctgatgctaaggaaagtgggttgcttcatctttgtgagtttattgaagattgtgaattcacttatttgtccacacagatactgcacttcctgggagttgaaggaccaaaaacttctgaccccagcaaatatattcgttatatttataacagagtacatcttgagaatgcgactgttagggccagtgctgtgagcacattggcaaagtttggtgctgctgttgatgcactaaaggtgttactcacctcgccccgcatatttgtactgctaaggcggtgtctttttgatagtgatgatgaggttcgtgacagagcaacactttatctgaacacacttggaggtgatggttcagttgtcgagacagataaagatgtgaaagatttcctctttgggtcatttgttatcccgcttgtcaatctggagactagtttgaaaaactacgagccttcagaagaggcttttgacattgattcagtgcccagggaggtcaagtctcaaccacttgcagagaagaaagcccctggtaaaaagcctactggtttgggtgctcctcctagtggtcccccatctactgcagatgcatatgaaaggctgcttctatccattcccgagtttgcaaactttgggaagctttttaagtcttcagaacctgtggagcttactgaagcggagacagaatatgcagttaatgttgttaagcacatttttgatcggcatgttgtgtttcaatacaactgcacaaacacgataccagagcaattattggaagatgttattgtgattgtggatgcatcggaagcagaagagttctctgaagtgttctcaaagcctctcagatctcttccttatgattcacctgggcaaacatttgtggcttttgagaagcctgagggattgccaattgctggaaaattttcgaatgttctgaaatttattgttaaagaggttgacccaaccactggtgagacagaagatgatggtgttgaagatgaataccaactggaggatttggaggttgtcacagcagactacatattgaaagtgggggtgtctaatttcaggagtgcatgggaaagcatgggccctgactgtgagcgagtggatgaatatggtcttggccccagggagaatttggctgaagctgtaaataccgtcattaatcttcttgggatgcagccttgtgagggaaccgaggtagtcccacccaattcaaggtcacacacatgcttgttgtcaggtgtattcataggaaatgtgaaggttcttgtgcggttgtcttttggacttgatggtccaaaggatgttgcgatgaaacttgctgtcagatccgaggatgaaactgttagcgataccatccatgagatttttagcagcctcatagatagccgtgtgtaa

SEQ ID NO: 12256 - DNA, 756 bp, Glycine max
  Peptide Sequence Number=SeqID_129034
atgccttcccgaagaagaactctcttgaaggtcatcattctcggtgacagcggggtggggaagacgtctttgatgaaccagtatccttctgtttctgtctacatactccgtgttctttactttgcgatgcaatttgctttctattgtttagtactgcattttagtaatcagtacaaggcaaccattggagcggattttttaaccaaagaagtgcaatttgaagataggcttttcaccttacagatttgggatacagctggccaagaaagattccaaagccttggagttgctttctatcgtggtgctgattgttgtgttcttgtatatgatgttaattcaatgaaatcatttgacaaccttaataactggagggaggaatttctgattcaagcaagtccttccgatccagagaattttccttttgttgtcataggaaacaaaatagatattgatggtggaaacagcagagtggtgtcagaaaagaaggctcgggcttggtgtgcatcaaaaggaaatattccatattttgagacatctgccaaagaaggtattaatgttgaagaagcattccaatgcatagcaaagaatgccctgaaaagtggagaagaagaagaattatacctgccagacacaattgatgttggaaacagcagtcagccacgggcaacaggatcaaccatgattgttgcggtcatgcttagagcttcagtgatcaactctcaacaggagttgctcagtgatctcttgaagtattga

SEQ ID NO: 12257 - DNA, 1308 bp, Glycine max
  Peptide Sequence Number=SeqID_129035
atggctacactttccaacccttcattcctcctccacctttccctgatcatcactgcaatgtgctttgctgtttcgcagcccttcatcggcgtgaactacggccaggtcgccgacaaccttccggcgccggaggcctcggcggagctcctcaagtccacgaccgtcggaaaagtccgtctctacggcgccgatccggcgataatcaagtccctggcgaactccggcatcagaatcgtaatcggcgcggccaacggcgacattccgagtctggcctccgatcgactcggcgactcagtcatgagctccggcgacgagagcctcgtctcgcagcttctcccggcgatgcaaaatgtccagaatgccctcaactcggcgccaaaaataaaggtttctacagtgcactcgatggccgtgttgactcactcggatcctccatcatccgggtcattcgacccggctctcgtaaacaccctccaacagttgctcgcgtttcagaaagataacgaatcacccttcgccttcaacccgtacccgttcttttcttaccagagcgacccgagacccgaaacactcgctttttgtctttttcaaccgaattcgggtcgggtcgatacgggtagtgggaaggtttattctaacatgtttgatgctcaggtggatgcagtgcatgctgctttgagcagtatgggattcaaggacatggagattgtgattgctgagacaggatggccctctcgtggggacagcaatgaagtaggagcaagtgttgaaaatgccaaggcctataacgggaacctcattgcgcaccttagatcactggttggcactcctttgatgccaggcaaatctgtggacacattcatttttgcgctctatgatgaggatttgaaacgtggtccagcatctgagcgagcatttggtttgttcaaaactgatctcaccatggcatatgatgttggcctagacaagtctggttctacccacaagaattcaccaactagtcctattactccagctcctaaaacgggaacacaatggtgcatccccaaagtggaagtgactgaggctcaattgcaggcaaatattgattatatttgtggtagccaagttgtagattgtgggccaattcaaccagaaggtgcttgttatgaacctaacacgatatcatctcatgccgcctttgctatgaatctctactaccagaagtttggcagaaatccatggaactgtgatttctctcaaacagctatgcttacatcccaaaatccaagttacaatgcttgtgtttatcccggtgggagtacctga

SEQ ID NO: 12258 - DNA, 2565 bp, Glycine max
  Peptide Sequence Number=SeqID_129036
atgttgccttctttctttagtggcaagactgaaaatcggacttctgatgtatacatggagataaggaattggataatgaagaagtttcattcaaatccaaatgtacaaattgaattgaaagatatgtcacagcttaatgttggagactcggatgccaggcaagaggtaatggagtttttggactattggggtttaattaacttccatccattcccttcaatggattcttctgtggccactgccagtgatgatggagaagcagaaaagagtttgttgcttgaaaaattgtatcactttgaaactctccaattatgtccacctgttcaaaggtctagccaaatgactccagctacgacctctggcttgtttccagagtctacaattgctgaagagttggtgaaacaagaggggccagcagttgagatgcttgagtaccattgcaactcttgttctgctgattgttctcgcaaacgttaccattgccagaagcaggcagattttgatctatgtaccgactgcttcagtaatagaagatttggctctggcatgtcttcattggattttatactcatggaaccagctgaagttgcaggggttaatggtggaaagtggactgatcaggagactctcctgctccttgaagcattagaactgtataaagaaaactggaatgaaattgcagaacatgttggaacaaaaacaaaagctcagtgcatattgcactttgttcaaatgccaattgaggatacctttgttgactgtgatgatgatgttgatgctggttgcaaagaaactgcggatccagttgcaacaaaaagtgactcatctatggacaaagatgcttcagaatgtattgagaatcatactagcgatggcatcaaagacagtgaaaaaacttccaaagctgaagatctcgaagtcaaagtgaatcagaaggagactccaaagttacaagaaggcagtgatgagaaagccagcgaggaaacttctaaatcagaagatgctgttaaggtaaagattgatcaggaagcagacaatgactgtgctataaatgctcttaaggaagcatttgcggctgttggttattctcctggacctgaaggcccttcttcatttgctgatgtgggtaatcctgtcatggcactggcaacttttcttgcacacttggtgggttctgatgcggctgttgcttcagctcacagctccataaaatccatgacaagaaattctcctggcaccgagcttgctgcaaggtgttgctttcttctagaagatccgccagatagcaagaaggaaccaactagttctgagagggattctaaaagtgagggagaccaggatgaagtaaatgtaaaccaggataaatcaacgttggaggataaagatttaccaactgatcacaataataagaaaattgaaagtaatgctttagaagacaagggaaagcctgcttctgcagatgatggcgcctcggaaatacccatttcttcaaaggaacaagcggtggttaataatgaatgtgggcttgacaagtgtcatgatctcaacaatgcaaagctacccaatgatcaagcacctggcactctgcataattcaggtggttcaacatccaaggctgaaattccatctagttctgacaaggctcaggaggaaactttaattgaagaaccttgcccttctgtaaaggacaggcatgtgtctgattctcttccatcagagacatcaaaagatgctgagatggtttctgatgctattccctcaactaagagcaagcctcaaaatccagagtctacaaatccagctcatgaatctctagaaacaacagactcagtaatggatgtggatggagtttctaattccttgccattggaaaagattgactctcagccactaattacatcaaaatcatcccaatgtaatgggacagaaaaggatgtagaagtgatgtcaccttcaaatccagttagatcaaattctagtgctgaaaatggtccaaatacaggtaaagataatgcagataatggagcaaaagtggaagatgatggtacaaagactaaacaggatagcagttttgagaaagtgaaacgtgctgctgtttctacacttgctgcagcagcagtaaaagcaaaacttctagcaaatcaggaagaagaccaaattcgacagcttacttccttgttgatagaaaagcagttgcacaagttggaaacaaagttggcttttttcaatgatgtggagaatgtggtgatgagggcaagggagcatgtagagcgatcacggcataagctttatcatgagcgtgctttgataattgcatcaaggcttggtataccaccttcctcatctagaggtgtaccaccatctataccaaccaatagaattcctacaaatattgcaaactcactcccaagaccacaaatgatgatgaatccaccaagaccactgatttctagacctgcaggcacggtagcaactattcaaaacccattaacaccttcaactgcagcaggaaattcagttcggccatctaatcaggaaaagctttcttctgttgggacaaaataa

SEQ ID NO: 12259 - DNA, 1569 bp, Glycine max
  Peptide Sequence Number=SeqID_129037
atgtctgttacggagctcaaagagcgtcactccgctgccaccgacaccgtcaacaatctcagacaccgtttaaagcagaagcgcctttcgttgctcgacacagatgtttctgggtatgcaaggtctcagggtagaacacctgtgacctttggacctacggatctggtttgctgtagaaccttgcagggtcacacgggaaagagcaccacagtagctgcttatcacttttcagtttgtggttcgttaaatgattatggaattatctcctcaaacgttaatgagtttgaggtgtattcattggattggacttctgaaaaaagtcagattgttagtgcatctcaagatgggcgattaatagtgtggaatgctctaactaggcagaaaattcatgccataaagctgccttgtgcatgggtcatgacatgtgctttttcaccaactggtcagtctgttgcatgcggtggtcttgacagtgtttgttctattttcaatcttaattcacccactgacaaggatgggaatctacctgtttcccggatgcttagtggacataagggttatgtttcctcttgtcagtatgttccagatgaagatactcatttaattactggttctggtgatcagacatgtgttttatgggatattactacaggccttaaaacctctatctttggaggagagtttcagtctggacatactgcagatgtacttagtatctccattaatggatccaactcaagaatgtttgtatctggttcttgtgatgcaactgctcgattgtgggatactcgtgtggcaagtcgagcagtgcggacatttcatgggcatgagggagatgttaatgcagtcaaattctttccagacggtaatagatttggaacaggctcagatgatggaacctgcagattatttgacattaggactggacaccaacttcaagtttattatcagcagcacagtgacaatgacatcactcctgtgacttccattgcattctctgcttcaggaagacttctttttgctggatacacaaatggagattgctatgtttgggacactttattggcaaaggtacttggtgctctagcaaaacatacaacaacttcaggttccattgtttctggttgcactgtgattgaagtggtcttgaacataggatctctccaagactctcatgaggacaggatcagctgcttaggtttgtcagctgatggaagtgccttgtgtacaggaagttgggacacaaacttaaagagtaacgatgtggatgccaccgattatactggatacggtgtttttggagttatggggatctcctctgtcctgtgccctatgtccatcatccgtcgggtctccaaggcaagtctttgccaaggaggacctgtcagtagatgggcatggagcaaagaaaatctctggggaggcgagagtgatctcggaggcaactgcggtcgtggagtgccagttcgtggcagaggagaatggggcagtggagatggtggaggcacctttcattttagccttgcatctattgcagcggcttgtttgtgctcatgtgcacgtgtgtga

SEQ ID NO: 12260 - DNA, 404 bp, Glycine max
  Peptide Sequence Number=SeqID_129038
ctgcaagccaaggagcacttctccttgctggaggtgagaagggaatgcgctatgcgatgccaaatgctcgcataacgatacatcaaccacagagtggatgtgggggtcatgttgaggatgtcagacgccaagtgaatgaagctgttcaatctcgccatgttagtctttcttcctttgatttgcacaattctaataatttgtacaactttaatgctcctatgatcttcatcacactgaaaatagattttttgttaactcataagaaaattgacaagatgtatagtgtttttactggacagccattagagaaggtgcaacagtacacagagagggaccgttttctgtctgtttctgaggctttggagtttggtcttattgatggtgtcctggaaacagagtattga

SEQ ID NO: 12261 - DNA, 834 bp, Glycine max
  Peptide Sequence Number=SeqID_129039
atgtcttggaaagggctacttatggagtggttgactagaaaggttgagtggagcattgtagagggtcctcgcacattggtgggagttgcaacttttgactcaacgattcatttctacaacttgaaacgtgcattgcagcagccactgatgctcattgttcctgatgtccaagatgtttatactcccttgcaaactgatgtaattgttccactatctgagtgccgtcaacacttagaattacttctggaaagcattcctaccatgttccaaaataatagaacctctgaatcagcttttggtgcagctatcaaggcggctttccttgcaatgaaggacactggaggaaagctgttggttttccagtcagtcttgccatctataggcattggtgcactttctgcacgggaggctgaaggtagaacaaatatctctgcaggtgaaaagtttttgtatattcttcaacgaaatcccattcttgtcgaatttcaggaagcccataagttacttcaaccagcagacaaagcattcaaggaactggctgttgaatttgctgagtatcaggtttgtgttgatgtgtttgtgactactcagacttatgtagacatcgcttcgatatctgttatcccacggactactggtggacaggtctattactattaccctttctcagctctttctgatactgcaaaactttacaatgatcttagatggaacatcactaggccacaaggttttgaggctgtaatgcgtgtgaggtgcagtcagattctggatgtaactatatgcatgtgtataggcaaccttgagcatatctatatctgtgtgcgtgcatga

SEQ ID NO: 12262 - DNA, 318 bp, Glycine max
  Peptide Sequence Number=SeqID_129040
atggcacaggagcgtgttgcttctttgcccctatttggaaacctatgggataatatctatgggtctctatccccagtggagtcgccaactgtcgcaacatgcccttcgcgggcaagcgagggtgaggctcgcgggtgcgctttccaaaggaggaaagatgcatggagtcgccaacaacgtttatttgtggaaaacgtcgggaaaaccgaaggaaaccggtcaaaaatgaaaattctaagttcgggagttgtatttacgcttgaggaaggtattagcacctcttacgtttatctcgaaagacaacagccttatttctag

SEQ ID NO: 12263 - DNA, 126 bp, Glycine max
  Peptide Sequence Number=SeqID_129041
atggcagcgccggagaggaagtcaaatctgaaaggtggcagtgtgacctttaatgcttttgtcgtcttcaaacggcatcgccttttgcgtttcatctcttccacactaatttctaatgtattttga

SEQ ID NO: 12264 - DNA, 756 bp, Glycine max
  Peptide Sequence Number=SeqID_129042
atggaggacgcagacgcatacgcagtagggatgaatccgtgggagcaacactcgggtgttatcaagctgcctcgctatgactacaactctccctcttctcttctcttctcttctcttctccgtaactcccattccgattttctcatcacttgtactatcagttcagtaaactcacttacttctcttcattctcattcttctccttccaaccttccttttcattttttcaattcctctttccatagcgctacaaaagaagcaatctctatccttcataagtttgttgcttatgactcttcaaacaaccctaaagaagaaggcactagttctaagaaaaggaagttatgcacacaagatactgctgacgaatattatacaatgtctatgattctgatggcaggtgttaaagcagagggagagaaagatggagtagcttgtctttctttggttaagctcacaaggaatgggttgcttctccttaactttcccagtaacacacctcccaacactgttaatattgtgtccaatatcattcaagctttggagtctggaactgtaactttgccagtgattcaatccctatctaacaaaagggagattgtatcatctgattttaggataaagaagatagaatatgcaagagcagatgttcctcagcctaggaaaattcctttgcccccaagttataaaccaaaactgaaagtgttaggatccaattgcaaggttcaggacttgaatcccacattggaaatatga

SEQ ID NO: 12265 - DNA, 171 bp, Glycine max
  Peptide Sequence Number=SeqID_129043
atgtggcagcagcaaaaacaagtcatgcagaatctcagtttgcatgtgaaaaagaggctaagttttgaattgcaaaaagtagtagttgggctaagctcagcagttgagctaagcgcatatccaccgctaagcgcagcttcagtgcacttagcacaaaggagaatctgctag

SEQ ID NO: 12266 - DNA, 135 bp, Glycine max
  Peptide Sequence Number=SeqID_129044
atgttgttggtgctagtcataccttgtccatgtagggacttgaatggtattggcttccttctgaagaggttcaacaatgatgaacttagaaaaggaagtttcagatgttggatcaagtggcctcagaataattaa

SEQ ID NO: 12267 - DNA, 318 bp, Glycine max
  Peptide Sequence Number=SeqID_129045
atgccagaaagtgcagaggttgtggccaaggctgggagtgtggtaatggtagtaatggtattagaagagaggcaaaaggaatggagagaattaacagcactctctctctctctgaagtgtgtcagtgtgataatgatggaaatggcagaaggtaaagggaagggaaggaatgctggaaattcctggccaaatggaatgatgggttatgaaacagtccaaagaacattaaataaaatgcgaccatgggcactgttggcatctgataggataggagtcgagactgcccaggcctcgaggccgccggtacccttggcgtga

SEQ ID NO: 12268 - DNA, 183 bp, Glycine max
  Peptide Sequence Number=SeqID_129046
atggaagggcccacgatacatgagaaaaatgtgatcagagttttttttttccctctagaaagctcgtacatggaatggaattatgggtttgaagaaggcatatcgacaccaatggtttattggtcatttagacaaaaaatccaccatgacttcaaaaaagcaaaaagggagggtgtttcctaa

SEQ ID NO: 12269 - DNA, 120 bp, Glycine max
  Peptide Sequence Number=SeqID_129047
atggaagaagatgatagcgacgcaggaggagatggtggaggccacatgctcatccctctcaacagggtttttttgaagagaactgggatgactaagctgagacatcatataagcttatag

SEQ ID NO: 12270 - DNA, 1401 bp, Glycine max
  Peptide Sequence Number=SeqID_129048
atggaggtggcttgccaaatccagtgcttatcaagcctttacggcaatgaatggaaagtgaattggacaaaacagaacggtgaggtgtggttcgaaaaaggttggaaagaatttgttgaacattactccctagatcaaggacgtttgattttcttcaaatatgaaggaacttctcagattgatgtactcatacttgaccaaagtgcactagagatagactatccttgtgacacttgtgatgaaaacgacaaccttgatcatactcatgaggcacccgatataatttttggtgaatggccatatcagaaggctggacaaatgacagaagcttattcattggacctggaccatcttttggtgttcaaatatgtcgggaggtcagagtttcaagttgtaatacttgatcaaagtggcttggaaatgagttatcctctgacggaagcaactttagatggtgaagacaatggtaactctttgccccagagtaaaagggcaagttctcccttaccattttctccttccactaagaaggtgaaaaccaacacaagaaaggaaactaatgcttatcccctccaagatgaagatgttgaaactaagtgtgctcaatctaaaaggaacaaggccaaaaaaagaggtggaagaagggtaatgtatgccaataggagattctcaaaatctaaggctattcaaaatgaggagttgttacaaaatactgaaagtagcactgctttagagagagccaactatttccactccgaaaatcccttcttcattcgtgaaatgcataaatcttatattaaatatcatattctggccatgccaggcaatttcataacagaagaccaacaaaaagagaatgatcatgtttttctttggatctctgaggagagaacttggaatgtcaagttctatccgaatcgttgcagtggccaaataatactaggtgctggttggatggaatttttaaaggataataacttgaaaataggggatttatgtgtttttgagcaaattaagaaaccaggaatttcttttagagttgttatttttcgtgaccgagaacaatcaagtgcttcccaagtttccagatgcaacaacgaaatgttagagaatgacttcaccctctctgtcaaaccgaatcaaaactatatgagcataccaattgaattcgcaaggaatcatggcatggagaatataactaaggtgatcctgcgggttgggaatagatcatggcctgtgaagctaaattattattcaaagcataactactgcagattaacttctggttggtctgaatttatgagtcaatgtaagttgaagagtggggatgtttgtcactttgaactaattgataagggcaaatttgtgtttgaagttagagttacgggatgcatcgattga

SEQ ID NO: 12271 - DNA, 981 bp, Glycine max
  Peptide Sequence Number=SeqID_129049
atgtctgatgaacgagctgtgcatcctgattgccggaatgctagtaacccttatcatgaatgcagtgattactgttttagagtaatagctgaagctaaaattaggtcacaacaacaggaatcagaagttggacaagctagtggtggaagcaactctaagcaagctatcccagatgaatcctatctcggtgaggaaatacacgacgacagacctgatcttgaagaaaactctgatagtgatcctgaccagcccgccctccaggaagcagagcaagaggaggttgattacacaaaactttctgcgagacagaaaaagtggatggagttgagagccaagatgaaaactaagactgaagatgccttattttcctggcagcaagaagccaaaaagcgtaatcaaattgaaatagctgctgagaaaaagaggatggaagctccaactgagtctaggggtgtttctaaacagaaatggctcgaggataggaagaaaaagattggaaaacttctcgatgcaaatggattggatatgacaaaggcatatatgcttgacacacaggaggcagcagaagaaaaatacaagaaatgggagaaggatcctgctccattcgggtgggacgtctttaatcagaagacattatacaatgcatacaaaaagcggaccaagaatgttgaagtcgatgtagaagaatataatagaatgaaagaagctgatccagagttctaccgtgatgcttcaagtctccaatatggaaaggcaccaaaaatctcagaggagaagattgacaagatggttcaagagctaaagaatagggacgagaagcgcaactcatttagcaggagaagacgcttccatgaagagaaagatattgactcaatcaatgaccgtaatgagcatttcaacaagaagattgagcgagcctttggtaaatacacactggagattaaaaataatcttgagcgaggaactgcattgcctgactaa

SEQ ID NO: 12272 - DNA, 1425 bp, Glycine max
  Peptide Sequence Number=SeqID_129050
atgtcttctcatggcaggaacattcacttcttcaagaggattgaggaagataccattcgaaagggggagctgaggattcctcgaagttttgtgaacaaatattgggaaggaatatcaaacccagtactccttctgcttcctaaaggtgctgaatggaatgtgaaatggaaaaaacttgacgctgatatttggttaatcgatgaatggaagaaatttgcagaattttgttctttggatcaggaacatcttttggtgttcaaatacgtggggaagtcacggtttcaggttgtaacatttgatcaaaatggcttggaaatgcagtatcctttgatgtcagaaacattattagatggtaattctatatgccagcgtaagagggcaaaatctcctttttcacattctccttctattaagaaggtgaaaaccaacccaagaaaggaacctgctaattatcctagccatgatgttaaaactgaacctgcacaatctcaaagggcgaatgttgagttgtctaaaaatttccatgctgacgatcttgttaaggcaaagccaaaaaaaagaggtggaagaagaaggatcatgtgttccaaatctaaagctattcaaaatactgaaagtagcactgctttagagagagccaactctttccgctctgagaatccattcttcatttgtgcaatgagaaaaacatacattcaaagaagtgtgctgtttatgccaggcaatttcataacagaagaccaacaaagggaggatgaccatgtttttctttggatctctagtgaaagagcttggcatgtcaagttctacccgagtcatagcagtggacaaatattgcttagcatcggttggatggattttgtaaaggataataacttgaaaataggagatgtatgtgtttttgatcaaattaagaaacctggaatttcatttagagttgttatttttcgtgacacagaagaatcaagtccttccaagtttccagcttatgataaggatggcgcaaatggaagcaaacaaacagggcttcaaaatgttattgctaaaaggggcagtgatggaattccaaaaaagtattcagagaacaataacttcgatgattctgaatttcgtagatgcaacaacgaagtgtctgagaatgacttcaccctctctatcagcaagccttgccaattctattgtatgtacgtaccaaagaaattcatcagaagccatgagatggatcatataaatgaagtgaagctgcaagttgggaagagatcatggaatgtgaagctagactgttacggtagattcacttcgggtttgcatgattttttgagtcaatgtaatgtggaggccggagatgtttgtcactttgagttgattgataagaagaaatttgtgtttgaagttagagttacgagatgcatcagcatcgattga

SEQ ID NO: 12273 - DNA, 1323 bp, Glycine max
  Peptide Sequence Number=SeqID_129051
atggccaagccagtgtccattgaggtatggaacccaagtggcaaatacagagttgtcagcaccaaaccaatgcctggaactcgttggatcaatcttctcattcaaaatgatgttcgccttgaaatatgtaccgagaagaaaacgattttgtcagttgaagacatcattgctttgattggtgataagtgcgatggagttattggacagttgactgaagactggggagaagagttgttctctgctttgagcaaagcgggaggcaaagctttcagtaacatggctgttggttataacaacgtggatgttgatgctgcaaacaagtatggtgttgctgttggaaatactcctggagtgctcactgagacaacagcagagttggcagcttcactaactttggcagctgctagaaggatagttgaggcagatgagttcatgagagcaggattatatgatggatggctacctcatctatttgttggaaacttgctcaaggggcaaacagttggtgtaattggagctggtcgaattggatctgcttatgcaagaatgatggttgaagggttcaagatgaacctaatttattatgatctctaccagtccacacgactagaaaagtttgtcacaggcatgttcctaccaacctatgccgcattcttgaaagcaaatggtgaaaccccagtgacttggaaaagggcagcaaccatggatgaggtcctccaggaggcagatataattagtcttcatcctgtcttggataaaaccacttatcatctagtcaacaaggaaagactagctaagatgaagaaggaagcaattcttataaattgcagtagagggcctgttattgatgaagctgcacttgtggagcatttaaaacataacccaatgtttcgagtaggccttgatgtgtttgaggaagagccctacatgaaacctgggcttgcagagttgaagaatgccattgtggtaccccacattgcatctgcctccaagtggactcgtgagggaatggctacactagcagctctaaacgtgctggggaaggttaaagggtacccagtttggtttgatgccaataaggtggaaccattcctcaatgagaatgctcgaccaccagctgcatgcccaagcattgttaatgcaaaagccctggagtgtcgatggcactgtgcatataaagactgtgatgttaataagcatcatcttcatagatgtctaatgatacttcacacgagcaagcaaaatgttaacaagagcattacagcagagcacaacatatcaacaatgacagatcatgaacgcacattgaaactaacaaattag

SEQ ID NO: 12274 - DNA, 1359 bp, Glycine max
  Peptide Sequence Number=SeqID_129052
atgtcttctcatgtaagtgacattcacttttttaagaggatcgaagaagaaacacttcgcattggagagctgattttggaagccgttgtcagtaagctaaagtgtggctacattttcagctataaggggattcctcgaagttttgtcaacaaatgttgggaagggatatcaaaccctgtagtccttgtgcttcctaatggtgctgaatggaaagtgaattggaaaaggcttgatcttgacgtttggttaatcgatgaatggaagaaatttgcacaagttttatctttggataaggaccatcttatggtattcaggtatgtggggaattcacagtttcaggttgtaatactagatcaaagtggcttggaagtcgggtaccctttgataaatgcaactttagatggtgaagagacaggtaatgtttttcaccagagaaaaaagagggcaaagtctcccttaccaatttctccttctactaagagggtgaaaaccaatccaagaaaggaacctactaatcccggtcaagatgttgaaactaggcatgctgaatctgaaaggactaaggccaaaaaaagaggtagaagaagaatgatgtatgccaataagagatgctcaaaatcaaaggcttttcaaagtgaggagttgctagaagataatgaaagtagcactgctttagagagagccaactctttccgctttgagaatcccttcttcattcgtcaaatgtatccatcgtacattcaaaaacattttatggccatgccaggtaatttcatatcagaaggccaacgaatggaatttgacagtgttactctttggagctctgaggaaaaaacatggcatgtcaacttctatctgaatcgttccagtaagcaaataatactaggtgctggttggggggattttgtaaaggataataacttgaaaatagggaatgtatgtgttcttgagcaaattaagaaaccaggaatttcatttagagttgttatttatcgttacctagaagaatcaaatccttccaagtttccagattctgaatttcgtagatgcaacaaggaaatgtcagagaattgcatcaccctctttatcaaaccaaatcaaagcaatatgatcataccaatgaaattcgtcagaaatcatgacatggagaatgtagctaaggtgatcctacgagttgggaatggatcatggcctgtgaggctagaccattgtccaaagcatagctactgtagattaacttttggttggtctaattttatgagtgcatgcaaattgaaggcaggggatgtttgtaaccttgagctggttaataaggacagatttgttttccaagttagagttgcaagatgcatccattga

SEQ ID NO: 12275 - DNA, 550 bp, Glycine max
  Peptide Sequence Number=SeqID_129053
gaaatgggcacttgcagccaacaaggacagtgtggatgacactgtttatgaaaaatatgacattagcaggatgtgcggaaaaaggcacaggccatccataagcaaaacactgccccctacgtgttgtctcatggggaaaaaactggagaaaacttctcaatctggaagcactaaggccgttattgacccttcatcttccatcagacgacacgtgaagtggaagttggcctgcactaagaaaactgggcagatgacgtctgaggcagcaaaggaaattgctgaaaagattttaagattctttggagaagcaggcgccacagggttcctttgtcccctatggacgtcaggatctcctaactactgcccttggttcttcctccatgtctcccgaagaactcgagcagctgactcaacaaaccagggaccagctggaggagtcaatcacagaaaaagtgactcgacagctaatgttattccatcagccagatgcagtcccaagttgcaattcacagatctaatcacagggacttgcactggctccagagcctga

SEQ ID NO: 12276 - DNA, 264 bp, Glycine max
  Peptide Sequence Number=SeqID_129054
atgtctcgggacttcatttattgtgcaacaaaggatgccaagtacctcaaagcggctaaccaaaggttgcatgtcatcaattgttatactgagaacaagagagggtacatctcttgtggatcagttcaagtggagggtacatccacttggttgttcaaagaggataagggagggtacatcccttgtggatctttggcttgtaaaggattttacaaggttgaaagaaatctccagaaccgttggttgcttggggacatgatgtag

SEQ ID NO: 12277 - DNA, 609 bp, Glycine max
  Peptide Sequence Number=SeqID_129055
atgactatttatagaaaaagccatttggtgcaggggaagttcactcaggcgagctggagctcgcccaggcgagctagttgcttaggcttgagggtatcagctcgcccagatgaagaaagtaaagacgaagaggatatttctttagagttattaaggttggtagagcaagaaactaaaaacattcacccccatgaacaaccagttgatataattaattttgggactaaagatgagaaaaaggatgttaaagttgacacattaataagcaaaaatgagtgcaacaagttgataaagctcttacatgaatataccgatgtctttgcctggtcataccgagatatgcagggactttatatatccctaaagattagggaagaggtcaagaagcaactcaacacaggatttgtagttgttgccaaatacccacaatgggttgccaacatagttccaatccctaagaaagatggaaaagttcaaatgagtgttgactgtcgagatctaaatagagctagccaaaaagatgatttcccattacctcatattgatgtgctagtagataatacatcacaacattctttcttttccttcatggatggatactcggaataa

SEQ ID NO: 12278 - DNA, 801 bp, Glycine max
  Peptide Sequence Number=SeqID_129056
atgtcctcaccatcaggggactacacgtccttgacatcagaggactacacgtccttcccttcagaggactacacctcctcgccttcagaggactacaagtcctcaccttcagtggactacatgtcctcgccttcagaggactataggtctttgcctttagcggactacacgtcctcaccttcagaaagctacacgccctggccttcagaggactatatgtccacaccttcagaggactacacgtccacaccttcagaggactacacgtcctccccttcagaggactacacgtccacaccttcagaggactacacgtcctccccttcagaggactacacgtcctccccttcagaggactggacgactaaacgtcctcgtcctcagaggactgacgtcctgaccttcagaaggctacacgccctcaccttcagaggactatacgtcctctctttaagaggaccacacgtcctcgccatcagagggctacacgccctcactttcagaggactatacgtcctccctttcagagggctacacgccctcgcctttagaaggctactcgccctcatttttagaggagaacacgtcgtcagcttcagagggctacacgtcctcgccatcagagggctgcatgccctcaccattagaggactacacatcctcgccatcagaggactacacatcctcaccatcagaggcctacacgtccttgccttcagaggactacacgtcctcgccttcagaggactacaagtcctcaccttcagaggactacatgtcctcaccttcagaggactatag

SEQ ID NO: 12279 - DNA, 592 bp, Glycine max
  Peptide Sequence Number=SeqID_129057
ttatccagaactacgtaggtctgagttcctcattggaggatacgtaggagcaaaagcctcgctttttgtcgaccacactgctttctgttaccatgacccaagagctggtagcccgcggagacaccttacggttatccgcacctcgagtgtgattaataagcggaggccaatatggtcatctgcgccctttccggagatgatacgtaggagcaagagccttgcttttgtcggccgccccacaagctctgtcatactgaccctgagagacaaaattgggtcattctgcaccctttgtcatccagaggcggcgggcccgatgacaagcagagacaaaatttggtcattctgcacccttgtgtcatccagaggcggcgggcccgatgatacgcggagataccttacggttatccgcaccctttgtcatccagaggcggcgggcccgatgacaagcagagacaaaatttggtcattctgcacccttgtgtcatccagaggcggcgggcccgatgatacgcggagataccttaccgttatccgcacccttttgtcatccagaggcggcgggcccgatgatacgcggagataccttacg

SEQ ID NO: 12280 - DNA, 985 bp, Glycine max
  Peptide Sequence Number=SeqID_129058
atggcggcgctgacgctgctgcagaagcacatacaccggcgcgacctggccgatctgctggaccgtcttgccgccactctgctggccggtcacctgacgggacagcagctggtttcgctgataaactacctcgtacaggcgggcgaaactgacgacgccgaagcctttgtacgcaacctggcgctgagagtgccgcagcatgaggacgaacttatgacgattgcacagcagctggagcagaaggggcgggagaaagggcgcatggaaggaaaaatggaggtcgcccgtaatctgcttgcaaaaggtattccgcttgaatccgtgagggagcttaccgggctgaaatttatgtccactgcactgtataaattactcgacgatggcgctcagatgctgtcgtcctttctgccggcagaactacgcacgcttctgaatgccggtgctcagctgttcagccccctgattgaaaaaaacctgatgggatcgccgttagggtggctccttgtagcggcagtatgggttcaaggcctggcaatgataggtgtgataatgggttccgctaccccatccgttaagaagcagggcgcccctgaaaccagcgccatcatcgagaacagcatacacagcacgacgatcagctctacgctggcatgcaagagcggccacggtgatggggttgaaaaagccccaggcggttgcgctgcccacgacggagatccagtaaaaacacgccagcaccacgacgccggtaatgccgaaaatggaggcatactggataaattcgttatgcagcggacaatccaggcgttacgggccggctgcgtctgcccgaaaggatggtgttcaaacgccagcagccccgtcttccacatcgtgaaacgtgaccccagcgactgcgccggcgatagcaagccccgccagggcaactgccgctttgctgcgcgtcagccagaaaaagcgcgtggccagaaccgcaatcagcagg

SEQ ID NO: 12281 - DNA, 207 bp, Glycine max
  Peptide Sequence Number=SeqID_129059
atgggcgcgctaagcacaagaagagacaacgtcctcgctggacaaactggctgcgcactggacgtgcagatctctgacttatcctcttctagggttttctatccgctaagtgagttggatgcctcgctaagcagatgcatctcgcttagccaatttgtctcgctaagcgagtcatcaacaactttaaccttttcttatttggcctga

SEQ ID NO: 12282 - DNA, 522 bp, Glycine max
  Peptide Sequence Number=SeqID_129060
tacctatcgccttcagagggctacactatcaccttcagagggctacacgccctcaccttcagaggactacacgccctcaccttcaaaggactacacgtcctcgccttcagaggactacacgtcctcgcctttagacggcgacacgccctcacaatcagagacctacaggtcctcgccttcagaggactacacatcctcaccttcgaagggctacatgccctagcctttagaggcccacacgtcctcgccatcagagggctgcacgccttcacctctagaggacttcacgtccttgtcatcagagggctgcacaccctcaccttcaaaggactacacagggctgcacgccctcaccttcagaagactacacgtcctcaccttcagagagctgcacgtcctcaccatcagagggctgcacgtcctcaccatcagagggctccacgccctcacctttacaggactacacatcctcaccatgaaagggctgcacgtcctgaccttcagaggaattacacgtcctag

SEQ ID NO: 12283 - DNA, 234 bp, Glycine max
  Peptide Sequence Number=SeqID_129061
atggcagagctgtgcctagtgcctggcgtcgtcatacatccgaagttcattgtgccagattttgacaagtacaaggggactacttgtcccaagaatcacctgatgatgtattgcaagaaaatgggggcatacgtgaaggatgaaaaactcttgatgcacttttttcaagagagtctggctggggcggctatcacttggtacaccaatctggaatcttcccgggtccattcctag

SEQ ID NO: 12284 - DNA, 303 bp, Glycine max
  Peptide Sequence Number=SeqID_129062
atgaaggtcgatatggagatcatgaaggaactaatgacaacgatgatggaagcaatgatgagcatgaggaagacgatagaggataacactgctacagttgttgctatgagtactgctatcaagatggacccgattcacccggtcgatttcaatcaagtgaatcatccagtctcagatgtagtaggtcaaggaggcgaggcaacgaaaaatgcatgtgggcctcatcatgttcagattcagaggaaacattccttcctactatatgggttgcctcttaattatacattgcccactgttgtatag

SEQ ID NO: 12285 - DNA, 459 bp, Glycine max
  Peptide Sequence Number=SeqID_129063
atggctccaaaaaatctctttggtctcctcatctttctcattctccttgttacttgcactgctttttccttccaattccatggcttccataatagtgaaagaaatctcacccgtgaaggggattcaaatgtcacaccccaaggtatacttcagctcaccaaaagagaaaacaacattgttggccatgcattttataacaaacccatcaaaatattagagaaaacaaattcttcagtgccccaaacaaaattttcctcctttagtacatgctttgttttctcaattgtgccaccaaactctggccttggtggctttggtcttgccttcaccatagctcccacaacacaattcccagaggctgaaggtggccattttcttggtcttttcaacaattccaatgatatgaacacctcaaatcatatcttggtggttgaatttgacacagtgaatggctactaa

SEQ ID NO: 12286 - DNA, 357 bp, Glycine max
  Peptide Sequence Number=SeqID_129064
atggatttagtgaccaaggatgagcaccggaaagctcatatttatgcgtgtaaagctgatcttccagggcaaaaggaggaggaagcgagggcgcagtcagctgatggcaaagtgtttaagattgttccatggcaccatctggagcatagcaccagcaactccctgagcatacaggccttaagccatgacttgactggtttagatagatcatattttctaaagttgttcatgtcattgcatgcaatgtttgctttcacccaaaggggtggctttgatcaaattgacaaggatgattccaacctacctctggatacagctcctattaagcatgtcacgcaggaaattttaaatttataa

SEQ ID NO: 12287 - DNA, 291 bp, Glycine max
  Peptide Sequence Number=SeqID_129065
atggaatcgaagaccaacgaagaggtattcagaaagtgtaaaaggccaaatttctctttttcacacaaatggcaaatctcacaccccattcgcatatgccctactttatcccctcatttctcactacaaattccaccgacaccttcttctccttctcccctcattcctttgttcattgagatccaaggtatagaccaagaaacactgccagctacaaatcccatgagggcacaatggtgttcggggtgtgattgtgttggggcacaatggttatggaggcttcatggctag

SEQ ID NO: 12288 - DNA, 867 bp, Glycine max
  Peptide Sequence Number=SeqID_129066
atgggcgttcagcatcacgaatttgcgcacccctcttttatgttccaactcggcgatgccgagccagcgctcgatggcctcatcgtatcgcagcgtcttcgtgcccggcacattcatgtgttcgatggaatatccgaccggctccgctggcaggaaggagacgggcagatgaccgggcaaggcggcggcaaggcgggcgacgatgccttcagcaatcagagtatcggtctcgaagggcaggtgggggccatgctgttcatgcgcgccgagcggcagcacggaaattgcgcctgttgcgtgaagatgagggtctgttacgttttcgtcgtgataatgcgtggtaaaaggcactcgcgtatgagcaaggacaaatccgggaacaaggacaaaagcgccaagaaggataagggcggcaagaaggtcaaggacgccaaaaagagggatgaaaacttcaacccggaggagttggcgcaatcgataacccaagccgcccgctccatgcgtaccgcgctcagccacagcctcgccgaaagcgggctttatgccggacaggacggcgtcatcctggcgctggcgcaggaaggcagcctgacgccggggcaaatcgcccagaagctgggtgtcaaggcgccgaccatgacgcgcaccattggccgcatggaagcccagggtttcgtggaacgcagcggtgacgacggggacggccgtgtgacgctggtgaagctgaccgaagcgggcctgaaaagcgtcgagcacatcaacgtttccatcgccaattgtggcgcgaaagctgtcgaaggcctttcggccaaggatattcgcaacattgttaaactcttgaaagccatagacgccaatcttcaataa

SEQ ID NO: 12289 - DNA, 345 bp, Glycine max
  Peptide Sequence Number=SeqID_129067
atgtcattcttaacatcggttttccaaaaaaccgatgttaacgttagtagtgaacagaggaaaaacaacattcataatagaggaaaagagaagcggtccctcgtcagggtggacgtggccaaggaaggctctaagatctcgcacgtcagactaagagtagcctttgttaaaaggacaagaggggatacctgcaaaataaaggacttcgacactgaaataattgaatacctgccacgagataaagaggtcacaacatattcaaataatgggtgcttagagataacctgtcagtttgggagctcgcctgctaagcgtggaacgtccatgctcatgaggcagggctaa

SEQ ID NO: 12290 - DNA, 282 bp, Glycine max
  Peptide Sequence Number=SeqID_129068
atggcttgtaggggatgctgggaatgccttttgaagcttttgaacttcatattgacccttgctggtctggccatggtcggctatgggatttatctgtttgttgaatacaataaaactccggataatactctcactgtcggtgatgatcaaactctagttcaacttggccgacccatgctagtggctgtgtctctgtccaacagttttttagatgatttgcccaaggcttggtatgaatgctgctcttctcctgccaatttttggggcgtatctaatgagtaa

SEQ ID NO: 12291 - DNA, 240 bp, Glycine max
  Peptide Sequence Number=SeqID_129069
atggctcttctttttgtattagctcttattgtcagggctgcaaataggccaacagagtatgatagcgatgaagagtacattaatccaaggcagcaagctcgtcagcctttgctcaacagaccagcaggcccagtatcaggtgcaccagcaactggcacacttgatcagcgtccaagcagaaatgatgcttggagtacacggatgagggagaagggcacttacttcagtcacttgcaatag

SEQ ID NO: 12292 - DNA, 1062 bp, Glycine max
  Peptide Sequence Number=SeqID_129070
atgagtgaagtagaggaggtgcaagaccagatgaaggctgacatggaagccatgaaagaccaaatggcagccatgaaagaccaaatggccgccatgatggaggtcgtgttgagcatgaagaaaatcatggagggcaatgcggctgtggtcaccactacgagtgtcgccattgaggtagacccgactcacctatcgggcctcaatcaagtaaatcatcctgcctcggatatggtaggtcaaggaggcaaactgttaagaagtatgggcggcccccattttgtgcaggttcaaaacaagcattccttcccacaatacggcttgcctcccaactatacgccactcaatgtggcacacactcccaatgaggatgacaacaactctgcatctatgcccattgagagccaacaccctcaatatgatcatgcgcatgtctctcaacccataggggagacacatgaagcatctcgagaccacaatctagtcgactccgagccttgcctcgaatatttcactgaggggcaggcattttgtggcgtacccttaccaaaaagtttggagggccctcagtacctcccacaaccacaacccttgccttttgtaatgggaatagtccctcttgccatggtggaaagggaaaaattcaatcatatagaggaaaggctgagggccattgaaggaggcggaggtcatgcttttgctgacatggcagagttgtgccttgtacccgatgtcatcatccctccgaagtttaaggtgctagatttcgataagtacaaagggactacttgccccaagaatcacctgaagatctacaacaagaaaatggggtcatactcgaaaaatgaaaaattgttgatgcatttcttccaggaaaatcttactggggcaaccgtcacctggtatgctaatctagaaccttcccgagtccattcttggaaggacctaatggtttccttcattaggcagtatcagtacaattctgatatggcttcgaatagaatgcaactacataacttgtgcaagaagaagcatgagtcgttcaaagaatacgcccaaaggtag

SEQ ID NO: 12293 - DNA, 393 bp, Glycine max
  Peptide Sequence Number=SeqID_129071
atgaggaaaaaaaacaagaaaaagaaggatagtaaggccttgtcttcaaaggccaaagggaaggaaaaagaggaaaaagattcctccaagaagattgttaagaaggaaattcgttttgcaacaaaaggtgatatcaaaagagcactccttcttaaacaatccttctaccttctcctatcaagggaaacctcccatagcactgccacaattcctcatcgcaccctaggatacgtaggagtgaaaaaagaggctaagcttgaattgcaaaaaagtagcagttgggctaagcgcataaccactgctaagcgcagcttaagtgcgcttagcgcaaacgagaatctggcagagcatcagtatcaaagtcacacgctaagcgcgagatcagtgcgttaa

SEQ ID NO: 12294 - DNA, 748 bp, Glycine max
  Peptide Sequence Number=SeqID_129072
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagaattcgattgtttgcttcaaagttcggcgtccctatctatgcaacccgtctagtaggtggagtaatggccgttgcattttcaaggggacttaacaaggttagatcagaaactatgaaggagattgcagcattatggttagtcattatctcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 12295 - DNA, 649 bp, Glycine max
  Peptide Sequence Number=SeqID_129073
atggaagtggataacggcggcggtagctaccagtattacaacgccgccgtcagcgcgacctcggatggcaccagtaatgccctgagcatcgtcgcgaccagcgccagcagcattaacagcttcagtgcggtaaacagcgtgaccggcacctcttacatcagactcgatccggccaatgtggatgtgcgctataccgatgtcgacggcaacagcagtaatgatgtgctgaaactcgacgccgacggcaattactacatggatgtgccgaacggcaatctggataaaaccgccaccttcgtccgcagtgacagcagcggcaacctgatgctgaaaaccctgcagggcgtgggtgacgtgcagatttacttccaggcggctttgtcgtcagtgaccgatgcctccaccaactttacgacgctgcgcgtggccgagaccggttcagagatccgcctgaagcatccggacgatccgctcgccacgctggatcgcgccatcgggcaaatcgacagtcagcgtacccgcctgggcgccgttgctaaccggttgctctcggcgcaaacgctgcagggtaacgcgaccgccgccattgcggcatcgcgttcccgtattgaggatgcggattacgctacggaagcctccagcctgtcgc

SEQ ID NO: 12296 - DNA, 255 bp, Glycine max
  Peptide Sequence Number=SeqID_129074
atgccgatctccccctgcggaagtatcagttggtctgtgccatcccgacatagggatcgcacccacaagacacccagtggacccggaaaagtccaacagggccctggggtttccagctctggttacgggcctctatcagtcctacagggtgcccgtacccccccggcaaggtcacgtcatcatagggatcgcgcctgcgagacacccagtggacccgaagaagtccaacagggtcttggagttgtcaagctctaa

SEQ ID NO: 12297 - DNA, 246 bp, Glycine max
  Peptide Sequence Number=SeqID_129075
atgacgggagatgaatcaaagtttactcatatttctcccaagaatagtggacatgtgacctatggagacaacaccaaaggtaaacatgaccaagaaataaaatatgtaggacataggactaattatgtgtacatgataaatctagataaaacctcaaataatgctcaatgctttctaagtaaagaagatgaatcgtggttgtggcataagagaattgctcatataaatatggaacacttaaaataa

SEQ ID NO: 12298 - DNA, 309 bp, Glycine max
  Peptide Sequence Number=SeqID_129076
atgtccgattcaagcgcatcacatatcgagacgctcgaaatagaacaacggaagctctcgacatattccaatggtcataactattcacacggaggtgtatcacatatcgagacgctcgaaattgaacaacgaaagctctcgagatattcaaatggtcataacttttcacacggaggtccgattcaggcgcataatacatcgagatgctcgaaatggaacaacggaagctctcaggaaattcaaatggtcgaaacttttcacacgaatgtccgattcaggcgcatgacatatctagaggctcgaaattga

SEQ ID NO: 12299 - DNA, 251 bp, Glycine max
  Peptide Sequence Number=SeqID_129077
atgacagatcttgtgaaggtggccgacaaaagcgaggctcttgctcctacacttgaaaagtctccatcggaagatgctgacatctccggaaagggcgctgtcgcaacctacccttcggcgggagggcgacgcgagactcgcgggaggcgtgttccacgaaaggaatacgcgcggagtcgccaccaacgtttatttgaggaaaacgtcggaaaaaccggaaaagacgcgatctacaaacttttaagtgaaag

SEQ ID NO: 12300 - DNA, 507 bp, Glycine max
  Peptide Sequence Number=SeqID_129078
atggcagagccatcgaagaagagaaagggatcatcctccaccgccgctgctgctgcccatcgccgccacggaccatccgaaacacccacaacatctattcttccctatttatcatctccaagatcatccacattgttttcatctgatgatcagcgtctacggtacctttctcaattttcttctaggatcatcttagaccctaagtacctagacgtagaattctttaatgatgaaacgtttgattgctatcaagtgtttcaaaattctggccttgttgatttcatgtcattaaaattgccatattatcctgaacttgtaaaggtcttctactgcaatttaaaaattcaggatggcgttattatctctgaggtgcatggtattcctatggtcattgatcagtcattgttcttttcattaactaatttacccagtcaaggtgcaccttttgagggcaccattgttgatgactggaagtttgattattctagtcatgatgctcgccgtatg

SEQ ID NO: 12301 - DNA, 256 bp, Glycine max
  misc_feature (204)..(204): n is a, c, g, or t
  Peptide Sequence Number=SeqID_129079
atggtgggagcaggtttgaaaaaggatcttagagtgtctagggttgtgccaggagggtctcttaatgccttcctttttcttctcatcggagttatttcacaaagacttgccatggaatctattgattctctcccaattggttggactgtaggtgcgatgatttacttcacgggcgaggtctctgctcagttggtagagctccgntcttgcaattgggtcgttgcgattacgggttggatgtctaattgtccaggcg

SEQ ID NO: 12302 - DNA, 504 bp, Glycine max
  Peptide Sequence Number=SeqID_129080
atgagtggtgaagtggtgcgcgaagtttttgagcgcggacacgccgccgtgctgctaccctatgatcccttgcgtgatgaagtggtactgatcgaacagatccgcattcccgcttttgattccagcccaacgccctggctgctggaaatggtggctggcatcatcgaacctggcgaaacaccagaagatgtcgcacgacgtgaggcggtagaagaggctggccttaaggttggccgcgtcaaaccgatagtgaattacttagccagccccggcggaacgtctgaacgtttatcggtgctggtgggcgaagtggatgccagcctggcagagggaaatcacgggctggaggaagagaatgaggatattcttgtccatgtggtgagccgcgaacaagcttatcgctgggtggaagaggggattattgataacgcggcatctgtcatcgccttgcaatggctggcgttgcaccatgaaaaactacgacaagagtggaagctaaaatga

SEQ ID NO: 12303 - DNA, 321 bp, Glycine max
  Peptide Sequence Number=SeqID_129081
atgtatacatacattcacaatcttggcctacctttaataattggcaaaaagaaaaacaagcttttggtttcatcaaagaaagactttggaagcacatcaaacattgggcttccaaaattttttcaaaggccggttgttgtcaaggaaggcatattgaagtgtaatgtagctccatgtagagcttgtaggccttggatcttcttcatcaatggagtcatttgcttcttgaagatcaatggtaacgaaataaaaaaggaggaaaggagatttgagatgccacttcaaggagaagatgagtcaagaagaagctcaccaccatag

SEQ ID NO: 12304 - DNA, 156 bp, Glycine max
  Peptide Sequence Number=SeqID_129082
atggacacccgtctccgtgtgattggtgatcccatgaatggagttcaacgggtagcaacaaaattgggtgggggtcacaaaccactctttgaggattcacctagtgagtgtggtggtggggccaccactgtgagatatgggttaatctctaagtga

SEQ ID NO: 12305 - DNA, 1023 bp, Glycine max
  Peptide Sequence Number=SeqID_129083
atgtgggttgcttttcaagaatggaagaacataggtgtaatgggtggcaaatactacaacctcaatgaggggcaatttcttaccactgatgtgttagtaaaccttgaaggattggcagtgtatctgaatcttcccaatgaaggattacagctgtttcataacaactcttttgagttggttggaacctctcgaaaagatgttgtaactcacttcattgggaagaacaatgtggatgttaagtccaaagatcttcctcctatgggtttaaagacctttcctttacctaactttgtctctttctacttcagccatctcttctctgcctcaaccagcgatggtggaattttgagcctttcccttgaaatcaatgcatcaaagtggcaaaagggtctgtgtttgtttgacttgaggagggttcttctttttattaagtgcaaagaacgcaaaaggatgattcagttgttgttcatggtgatttttgtcgagggggttctggcatttcttttgttggttaagataggacctttgagagatcttgtgataaagagcctggatcagttgaagatggggaagggtccagctacagtgaaaaccattgctggtaccatgtcggtgattctcctttcaagtctcatgagcattgtcaagatccagaacaaaggtgctaaacttggtactatgtcgcccatggatcaagttctgtggagaactcatttgctcgaggcttcactgatggcttcaaaagaagaattggaaaaccttaaaaaagaaactgtccaacttaaagaaaaggatgagaaagcatccaaggagattaaacagctaaaggaagaactttcacatctgtccaaaagtttggaaaagataaaattggaatctgaagagaaggataagaaagttgagaccgccgaagcacatgttgcttccctccaaaagcaagctgcagatctactgcttgaatatgatagactcttagaagacaaccaaaaccttcaggctcaaacactgggacacaagagttga

SEQ ID NO: 12306 - DNA, 468 bp, Glycine max
  Peptide Sequence Number=SeqID_129084
atgggatggtcaatgctgatatcttctttcgtttggtgtgttgaagattattttgatgcgatgattaatgacactggtctgagcaatctggttggtagaacctttggtcttagagagtcaagttttatgtctgaattagacgatcaaattcctactgccttcgatccttttgctgatgcaaatgctgatgactcgggtgctgggtcaaaggagtatgtgcatattcgggtacagcagcgaaatggtaggaaaagcctgacaaccgttcagggattgaaaaaagaattcagctataacaagatacttaaagatgttaagaaagagttctgttgcaatggaacagttgttcaggacccagaactaggacaggttattcaacttcaaggtgatcagaggaagaatgtttctaccttcctagtccaggctggcatcgtgaagaaggagcatatcaagattcatggtttctga

SEQ ID NO: 12307 - DNA, 120 bp, Glycine max
  Peptide Sequence Number=SeqID_129085
atgacagatttaaagcgagaattgtttcccgaggctttactcaaaaggagggaattgacttcaatgagattggcagatcaaagtggaatggaaatatggggaactgggatcttgttctaa

SEQ ID NO: 12308 - DNA, 3318 bp, Glycine max
  Peptide Sequence Number=SeqID_129086
atgaatggctcactatcgcctccttctacatggatggttgtgccttggtctggtaccaatggatggccgacaatggccaactctcttcctgggcaggttgcctccatgccctacaaacgagattttgcggatgttgcaaatcgcagggtgggccttcctccacatttccttcttagctgcttcatttcgaggttgaatcccgacattcgctgcgaggtccaggcgttgcaaccgttgaagctggtccaggcggcaggtcttgtgcgcttacaggagaagaagctcgcagagacaagacgcgccttacgcagtcgcatgccttctttttccacttcgaccgtgccacaaacgcacacccagatttcgctccctccctcaccgagaggccttcctgcgcaactactttcgttggtaccgttgaaacgcctgacaccagaagagcttgcatcccgcagggagcgaggactttgcttcaaatgcaatgaacgatatcatcgcggccatcgttgccaggctagggtaaacctccttattgtagatgatgaggagcggtccactgaagatgctgtgtctttgggcctatcacccgacccgcctgacccaactgacccgaatgaagtccaacttaatttacactctctcacgagtccgttagctccagaaacattttgtttttcaggcttcgtggcttccaaacaggtattgatcttggtggatgggggtagtacccataacttcatccaagatgccatgcttgcggaactgggcctttctccttgtgacaccacccctctcaaggtcatggttggtaatggacaatacctccattgcaaccaaatctgcaccgcagttctgatagtcattcagggcgttgaattcatcattgaccttcatgtattaccattgtgtggtgcgaacatagtgctagggggtcgtaccatcggattcaaaggtgaagacacctctacgctccaacccttctctgtcaatcaagttcgatgcctagttcgaaccgccggggccagtgcttgttttcttctttctgttacaccattagaaccaccatctgccaccacatctccatccacctaccctccgaaaattcattctttattgaacaaatttgcctccttattccaatccccacaagccctcccgccatcacatcccacagaccaccatatccacttggctcctaactctgaacccgttaatgtttgcccatataggtatccacactatcagaaagctgaaattgaatctcaaagcattgaatgctctaacgatcaagatcattttccaatacctacaattgatgaattgttagacgaattagggggtgcatccagtgctacactcgaagatcatgtttttcatttagagcaagcttttcaggtgttgttacaggagcagttcatcttgaagttagccaaatgcatatttgcccaacctcagtggccgaagcctcgatcggcgcgtgcacttcgcagctttttgggactcgcgggattctacagaagattcatctatggctacgcgacaattatcctaacctcaacccctgttcttcggttgccggacttcacccttcctttcacggtggagacggacgcgtccggcacgggcatgggtgcagtgttatcacaacagggccacccaattgcttacttcagcaaaaattttccaccaaagctacttggtgcttccacatacgttcgtgaattattcgcaattatgaccgccgtcaagaaatggcgccagtacctccttggccagcgcttcaacatcctcactgatcattgcagtttgaaagagttacttacccaggagttcaaggctcaactggatcaatttccggactacatccagctccgacaaagcattgtggaccaccctgaccaaaatcctgagttttcaattaccaaggacttcattcttcataaaggtcgtatatggcttccttcaaacttaccattcttgcacactttgttacaggaataccattgtacacccacaggtggccatatgggagtcgcgaagacattggctcatctgaccaagaatttttattggactgttgtgcccactaccggtaccttgtcggccatgggaggacttatccctggatttcatcaccgagctgccggcattccgcggcaatactaccatcttggcatgcttcctactcatcatacggcgtacacggtggccatcctcttcatggaccttgtcggaaaactccatggcatgccacgaagcttagttttagactgcgatcctctgtttctcagcaaattctggcaggaacttttttgcctgagtggtggtaccaagttacaattaagctatgcttatcatcctcaatcgaacggtcaaacggaagtcctaaatcgggtgattgaacaataccttcgggcattcgttcataagaagccttcctcatggggcaagctactgggttgggtggagtggtcttacaacacctcttggaactcaagctcaggtctttccccgtacgaaatcacatttgggaagaagcctttcaacttttcacaatatttggcagagaactctaacattgatgttgttaatgtcatgctcactgatcgcgaggctattttcacagaaatcaagaaaaaattggagaaagctcaaaatcgcatggagtatttagcagataaaaagcgccgtgaagctgaataccaagttggtgatatggttttggtcaaacttcgcccacacagacaaatttcggtctcgggtcaacccagtggtcactccaagcttgctaaaagattctatgggcctttccgggtcgttgaacgaattggattcacaacttacaaattgcagttgccagaggaagcccgaatacatccggttttccattgctccctcttaaagtcatattactccactgagttcgataccaacccacactccaccactttactatggcaaggactctcgccggaagatatgacttgggagaaatgggaccagctgcaagctgattatcaccttgaggataaggtgctttcaaaagtggcgaggaatgatagcaacataggagcaagaccaaggaggaagagcagagcaccaacctaccttaaggatttcactagccgggcgcttaccggaggaaggcgacacgtggccgctgctgcaggcggtgctgcaggtggtgcaggcggtgctggaagcgccctgcaacaaagcgccgaaggtcgcgccctgcatgcaggcgctactggtcgagccctgcacgcaggcgcgtcccgtcgtgccgttcccgaggcgccttggttcgcgccctag

SEQ ID NO: 12309 - DNA, 231 bp, Glycine max
  Peptide Sequence Number=SeqID_129087
atgaagaaagatggaatgcagttgtaccatcacagaaaagtcttccttagtttacacaataaccctttagcattatgcaacgatgatagtgaaaaccacggtgatgcagacgatgatggtattgacgagcctgatgatgaagaggaagaagaagcggcaggtggcaaagaggaggatgaagaacacaacagtctacatggcactaaaattactaacaatgcacctcactaa

SEQ ID NO: 12310 - DNA, 597 bp, Glycine max
  Peptide Sequence Number=SeqID_129088
atggctctctggaaattcatcaagtcctttctacaagatttgcttcctggtttggcccttaaaatatttttctacattctacccacagttctaatgatcatgtcaaaaattgagggatatattgcattgtcaacacttgagcggaagacagcagcaaaatattattattttatgctggtgaatgttttcttgggaagcatagtgactgggactgcatttcagcaactgcatgctttccttcaccagtcacctactcagattcttagaacgattggagtttccattccaatgaaggctaccttctttatgacatacataatggttgatggatgggctggaattgctggtgagattctcagattaaagccattggttatataccatctcaaaaacatgttatcaaaaaagtgtgttagtatcagtacgcgtggtgtacacagggtagagtatcaacttccaaatctttttgttggggctattacaaaagaaagcttgtatagtgcttttgaaaatggcattacagcagagcagatagatggtaatgatttatttcttgctatgcttttgctaggaataaggggcctagtactaaactga

SEQ ID NO: 12311 - DNA, 1185 bp, Glycine max
  Peptide Sequence Number=SeqID_129089
atggctggtccaacgcagccagagaatgatatcaatgtctatcttgctctcttgattgaagacttgagaaaattgtgggaagacagggttgatgtgtgggatgcgaatatgcagcagacgttcaccttgcatgctatggttggagattatcctaaccatccacaatcacccactaatggagttaagaatttgtcatcaagtgaggttgatggctcatccagtgctattcaagagaataacgagtccaagcaagacaatgctttgccatctggaggtcatcaacactcatgggtacttacttctccaaactatagttttggattcgtgcccccaatgttgggtactcaactaacacagtttgagtatcaaacacatgatgcttcccaacttccaagttttattgttcataaacaattggatctgactagttattatgcccagttttaccgcataggtggtgatagtgacggtcgcctttcacctttttcttctggtggggctaacactaagtacaatggcaatattacattacatcctgctccaacttgtcaatctactcaagagactcaagcctatatgctatgtggtaccatgtcagtgaaaaaccaccctgggcgctcaggagtacataacaagacacaccacacaatgggtttgtcaggcttaaagaagcactcaaacccggtgacccccaaggcctacactccgaagagttcgtcagggcctctccctcctgattcaggctcgtcaataccatcatcgtctgcatcaccgtggttttcactatcatcgtctgattcgacactgtcatcatcacttttctcaaagttctcagaagcagcaggggaagacttttctgtgatggtacaactgcattccatctttcttcatttgagaaaagtgagacgaatggccggtattcgggatgcaaagagcattcttgttaagttagaatggtttttgaattgggtcacctttgtggcaagatctgtacctcacattctcatcacagccaagctcatcaaggatacttacaaatttgaaaagggtatggagctaccactggctctgttgggcatggctgggatgaatttgctcaacattggtcttggcattgatctccttaaagcttttatgagagagaggaggtctcagcagggtaatcttcagcatcaccgtgaatga

SEQ ID NO: 12312 - DNA, 213 bp, Glycine max
  Peptide Sequence Number=SeqID_129090
atggggagaagaggtgggggaagaatcaagggatttagaggtggaaagggtagtgataagggtgtccaatttgggggtcatgttctggagacatttgttgaggctcatctggtgtgttgtcctaacagaaagggaatattcctagtaatggcaaacaagatcaagggctattcccttgatatccagttcaacaatttccaactcagcaggtga

SEQ ID NO: 12313 - DNA, 276 bp, Glycine max
  Peptide Sequence Number=SeqID_129091
atggcacgcagcgtgtccgctttgtgcccctattcaagggacctatatgggagagagctaaaagggtttttagtgataatccccaaggtggtcatatctctcttgatggtctctagaggggagtcgccaactgtcgcaacctacccttcaacgggagggcgacgcgtgactcgcaggtgcgtcttccaagaaaggaatacgcgcggagtcgccaccaacgtttatttgaggaaaacgtcgaaaaaaatcagaaaagacgtggtctacgaactttaa

SEQ ID NO: 12314 - DNA, 246 bp, Glycine max
  Peptide Sequence Number=SeqID_129092
atgaaacggagggcagatggttttatagggaacagggacgtgccaggggccccaccactagtggaagtgcctgccaggctaccactagtggtcgcgcctggcagggtcccaagcagaatagcagtcccagacgggctcggtgagcgtgttgggggcgggaccaaacccggaggtggcgatgccggggcgaggcggagatggaggatttggggaggggagggggcggagggaggttggaagagatga

SEQ ID NO: 12315 - DNA, 354 bp, Glycine max
  Peptide Sequence Number=SeqID_129093
atggggacgcgggaggtggtgggacagctgtggaagaaaaagtggttctgtgagagcttggtgatggcatcctccaaacgatctgagtttgctttggaacgagtggactcagccatgagcaaggacaatgaaagcaccaatgttagggaaagggaaagagcgagactgggcttcgagggccagtgtcctcctaacacagataagaaagcaaaacaggggacaggattgccaggtcaccacaagccgttacacataatcgtggagggtttccctgaacatttgttcaattcccaaatgctaacaattcagaatatgccccttgacctccctcttctaccttttcctcctatttaa

SEQ ID NO: 12316 - DNA, 1085 bp, Glycine max
  Peptide Sequence Number=SeqID_129094
gttttcctcttctgtggaaatccatcgaaatctaccgcgcgccgctcccgttcgatcgaatcgacgccttctcctcccaaatcgaatcgaaacccttgtccttcccatgccactttcaagccattttcatcggtttcgatttcgatttcaaggtttcgcacgacgatgtaggagccgcgatcgcgaggaaaatgtcggacctaagtcacggcggcggttgcggcggatgtggtggtaattactctgttgccgtggcggtggacaggggagacattaatgcgtttgattttggcgagaagctgagaggtagtgacgaggatgctgatgaattggtgaagagtgtggtgagtgagtatggaggagggaatgcgtatagcgttgtggtggtgaatgaagagggggaggtgaggagtgtggtggggaagtataggcatgcgtggatcgtggggcgggttgaggaggaggaggcagtgttgcatgtggctgaggtttttgttaaggtttttgttaatggcggggacgtggagggttcagttcgcagcgagtttatgcctgttggtgctgatgggaggattgttctctctttcagtttactcaatgcagaccctcgagattggatatatgattggaattttcgtgaaattgatgagactttgttacgaccagtgattgaggctttacaacctatagcaaacatcactgttgaaagccaggttttgtaccatacaccaaagtcttcattttcttactgggatgataagcatggaagccacatgtttagaaccgaggatcttcctttcttcgtgaattcaaatgagtggcacttggatacttctgttgcagcaggaggaaggtcaaaaatgtggggaggtgttgttgtctggaatccccaaagctgtataaaagattttgaaagtatggatccagttaggcatacgatttctccccaggatctcctgaagctttttgaggttctcatggggcagttgcggcaactccttggtctgaagtcagataacctttatgttggtgagtcaggcacatctattctcctaggcagtgaaagaggtttcacagaatggtaa

SEQ ID NO: 12317 - DNA, 360 bp, Glycine max
  Peptide Sequence Number=SeqID_129095
atgaatgccattttccggccgtatctccgtcacttcatcattgtcttctttgatgatattctaatcttcagcaagactctcgaggaccatgtcgaacacttggaaaaagctttccagattctcatgaaggagcaattcttcctgcgtttgtccaaatgttcatttgcacaaacacaaattgactatttgggacacgtggtctcatctcaaggggtagcaccggtgccggcgaaaaccctagcaattcgtcaatggcctaccccacactcggctagaaccttgcgcagttttcttggcctcgccggattttaccgcagattcattcgcggttacgcttcgattgtggcgtctctaacgtga

SEQ ID NO: 12318 - DNA, 1116 bp, Glycine max
  Peptide Sequence Number=SeqID_129096
atgctcttcatggacattgtgggtaagttccatggcatgcctcggagcttaatctccgatcgcgaccctctattcatgagtcatttctggcaggacttattccggctgagtggcacgaccttaaggatgagctctgcctaccatccgcagaccgatggtcagacggaggtattgaaccgggtcattgagcaatgtcttcgggctttcatgcatcagaagccatcatcgagggaaaaatttttaaattgggtcgagtggtcctacaacacctcgatccattccggctcgggtttgtccccatacgagttgactttcggcaagaagcccctttccattccacaataccttacgagcacttcaaagctagacgcagtggatgatattttgaaaacccgagaggaagctttttccgttatgcgcaagaagctgataaaagctcaagacctcatgaagaaaatggcggacaaggaccgcagggacgtcacctttgcggaaggagattgggtcatggtcaaactacatcctcataagcaatcctctgtctcgggaacttattccaagcttacgaaacgattctacgggccctacaagatcgtggaacacatgggcaaagctgcgtataagctacagttgccagaagatgctcgcattcacctcgtgttccattgctccttactcaagcccttccatcactctactgcagagcacattgattactcctttggtgattttggatacggctttccacccgaagagaccacgtgggaagattggacgccattgaaggacaccgtccaccttgaggacaaggttggttttaaaatgttcctcggtgttactgcatctgtgaccaattgggatgctgatggaacatgttgtagtattgttttggaggataatcctttggtagattttgttgagcttcctgacaactgccaaggtttgtactattgcaacatcttaagtggagtcatcagaggagccttagatatggtgtcaatgaaaactgaggtaacttggcttcgtgatgtgcttcgcggtgatgatgtgtttgagttgcaggtaaaacttctcaagcatgtcccagaagagtatccatacaaggatgacgagtga

SEQ ID NO: 12319 - DNA, 309 bp, Glycine max
  Peptide Sequence Number=SeqID_129097
atgaaaacacggaaagtaagttcattaacattcgtagaagaagcgattgaagtactgcaagcaaaacaacgaaaatcaaatcagtgttgcttacttattttcttactcactgaactcaaagctttgcttcttgcatttgcatcgcaaagaaaggtgtttctggctctaggtgaaaatgaaggtcacgcggtgatgaaggagaagaggggtagtcccatccaaattttcattaacccaccttcgcaaagaaaggtgtttctggctctaggtgaaaatgaaggtcacgcggtgatgaaggagaagaggtag

SEQ ID NO: 12320 - DNA, 315 bp, Glycine max
  Peptide Sequence Number=SeqID_129098
atggaactaatgagactgaatcagcatgaggagaatgataagaaaaagaaaggaatcacacttaaagcttcatcctcaattcaagaaggaagtgataaagaagatttgaatgaaatagacgaagatgatgatttcagtttctttaaagcaaagaagccctacatcacttgggaagacaacgatatggactcatctaaagattcagaaaatgaagttgtgaacctgagtctgatggccaaaaattatgaaagcaatgaagaggtaatcgattacaggattagtgtaatccattacaggtttaacaatttgaattaa

SEQ ID NO: 12321 - DNA, 3777 bp, Glycine max
  Peptide Sequence Number=SeqID_129099
atggggaacaatagtatgtttcgttatgcagatggagtggacaagttgttgatgttctttgggaccttgggatgccttggagatggactacaaacccctctcatgatgtacattcttagtgatgtaatcaacgcctatggcgacaagaatagtcatttgacaaagcatgatgtgaacaagtttttgaaattgccacttgccttttttcagtatgcgttgaagcttttttgtgctgcacttggagttggactttcagcttttattgaaggaatatgttggacaagaactgctgagagacaggcttccagaatgagaatggaatacctaaaatcagtcctaagacaagaagttggcttctttgacactcagattgctggttcttcaacaacctaccaagttgtctcactcatttcatcagatgcaaatacaatccaagttgtcttgtgtgagaagatacctgactgcctagcttatatgtcaacattcctattctgccacatctttgcatttgtactttcatggagacttacactggcagccataccactgtctgtcatgttcattgttccggcacttgtatttgggaagatcatgttggatcttgtaatgaaaatgatcgagtcttatggggttgctggtgggatagcagaacaggcaatatcttcaataagaactgtttattcatatgttggggagaatcaaacactaaacagatttagcagtgcacttcaaaaaactatggaatttggaataaagcaaggttttgcgaaggggttgatgttgggaagcatgggagttatttatataagttggggttttcaggcttgggttggaacttttctgatcactaataaaggagaacaaggtggccatgtatttgtagctggcttcaatgtcctcatgggaggcttgagcattttaagtgcccttccaaatttaactgccatcacagaggcaactgctgctgttactcgtctttttgaaatgattgatcgcgtgccaagtatagattctgaagataagaaaggaaaggccttatcatatgtgaggggagaaattgaatttcaagacatctatttctgttacccatctaggccagacacaccagtcttgcagggattcaatctcactgtcccagcaggcaagagtgtaggccttgtgggaggtagtggttctggtaaatctaccatcatagcacttcttgaaaggttttatgaccctgttgagggattaatactcttggatggtcacaagactaataggcttcagctcaagtggttgagatctcaacttggcctagtaaatcaagagcctgttctctttgccacttccataaaagagaatattttgtttggaaaagagggagcctcaatggaaagtgtgattagtgcagctaaagcagctaatgcacatgatttcattgtcaagttaccagatggatatgaaactcaagtagggcagtttggatttcaactgtctggtgggcagaagcagcgcattgccatagcaagagccttactaagggatccaaaggtcctcttgcttgatgaagctaccagtgcactagatgctcaatctgaaagagtggtacaggcagcaattgatcaagcttcaaaaggaaggacaacaatcatcattgctcaccgcttgtctacaattcgaacagctaacttgattgcagtccttcaatcagggagagtcattgaattaggtacacataatgagctcatggaattgactgatggtgagtatgctcacatggtagagttgcagcaaataacaactcagaatgatgaatccaaaccttccaatcttctaacagagggaaagagctcccacagaatgagcgttccacaaagtccaactgtaagtttcagatcaagcactgtaggcactcccatgttgtatcccttcagtcagggattttccatgggaacaccctactcctattctatccaatatgaccctgatgatgatagttttgaagataacttgaaaagaacaaatcatccagctccttcgcagtggcgtttgctgaaaatgaatacccctgagtggggaagagcaatgctaggaatcttaggagcaatagggtcaggagcagtacaacctgtaaatgcatactgtgtaggaacacttatatcagtttattttgaaactgatagctctgagatgaagtctaaagctaaagtgctggcccttgttttcttaggaattggtgttttcaacttcttcactagtattctccaacactataactttgcagtcatgggagaaaggttgaccaaaagaataagagagaagatactagagaagctgatgacttttgaaatagggtggtttgatcatgaagataacacaagtgcatccatttgtgcaagattgtcctcagaagccaacttggttcgttcccttgttggtgatcgaatgtctttgttggcccaagcaattttcgggtctatctttgcctacactctaggacttgtgctcacatggaggctttcccttgtgatgattgcagtgcagccattagtcattggaagcttttactcgagaagtgtcttgatgaagagtatggccgagaaagctcgtaaagcacaaagggagggaagccaacttgcaagtgaagctgttataaaccacagaaccataactgccttcagctctcagaaaagaatgttggcacttttcaaatccacaatggtggggcctaaagaggatagtattaggcagtcatgggtttcaggctttggtctattcagctcccagttttttaacacttcatcaacagcattggcttactggtatggtgggaggcttttgatagatgggaaaatagaaccaaagcacctcttccaagcctttttaatattactcttcactgcatacattattgcagatgctggaagcatgacttctgacttgtccaaaggaagaagtgcagttggatcagtttttgcaatcctagacaggaaaactgagattgatcctgagacctcatggggaggtgagaagaagaggaaattaaggggcagagttgagcttaagaatgtattctttgcatatccatctagacctgatcaaatgattttcaagggtctgaatcttaaagttgaacctgggagaactgtggctctagtggggcacagtggttgtggtaaatcaactgttattggtcttattgaaaggttttatgatcctgcaaagggaacggtatgcatagatgaacaagacatcaagtcctataatttgagaatgctgaggtcacaaattgcattagtgagtcaggagccaaccctttttgctggcaccattcgagaaaatattgcctatggaaaagaaaacactactgaatctgagataagaagggctgcatctctggctaatgctcatgaattcattagtggaatgaatgatgggtatgagacatactgtggggaaagaggagttcagctatcaggaggtcagaaacaaagaatagccttagcaagggccatactgaagaatcctgcaatcctgcttctggatgaggctactagtgcacttgatagtgtgtcagaaatcttggtccaagaagcactagagaagataatggttggaagaacatgcattgtagtggcacacaggctctctacaatacagaaatccaactacattgctgtgattaagaatgggaaggttgtagaacaaggttcacataacgaattaatttcgcttggacgtgagggtgcatactattctcttgttaaacttcaaagtggtagctcccctaggtaa

SEQ ID NO: 12322 - DNA, 596 bp, Glycine max
  Peptide Sequence Number=SeqID_129100
ggcgagaatacttcaacttcggctggcttgagcgccagctggcctccttcccggcgctcgcaccacaggatgttcaggcgacgctcgccgagcttacggccgtgtcggtctccgaacaggtgttgctcagcggcggatgcgaacgcctgctggtgtgcggcggtggaagccgcaacccgctggtgatggcgcgtctggccgggctgctgccgggtaccgaagtgacgacaaccgatgcggcgggcatcagtggcgatgatatggaagccctggccttcgcctggcttgcctggcgcaccgttgccggactgccgggatgcagcgtctataaccagctccttgagcgcatgcagacagatacgctggagtatcgctgcgacgaaaaaccgctgaccgtgaagctcaataatccccgccaggaagccagttttgtttacgacaataagttgctgacgctgaagcagggtatctcagcctccggcgcgcgttataccgacggtatctatgtcttctggtcgaaaggtgacagcgccacggtctacaaacgcgaccgaattgtgctgaacaactgccagctcgaaaatccgaagcgttga

SEQ ID NO: 12323 - DNA, 317 bp, Glycine max
  Peptide Sequence Number=SeqID_129101
agagggtcgtgcggcaatttggatacacacagaccattcctgctccgcctgtcgattcatgggtgtcgtatgatgatatacacgacaagtggatgcactactcggatcatatcattccagcaggtgaggtgtgcactgtgccagtttgctatgagattgctgagaggttggagcgccatctgaacctaggggtggtcacgccaggctcatcgacacatgaggtgatcgaagaatgcctcaggatggccaggagtgtgacacaggaccagctagtatatgttaggtctcgacacaggcggcacacggattgggcatag

SEQ ID NO: 12324 - DNA, 228 bp, Glycine max
  Peptide Sequence Number=SeqID_129102
atggtatttggtggagatttctggcagattctgccagtcattcctaggcgtagccgctctgatattgttaatgcaactattaattcatcttacctatggaatcatttccatgttttgacactgtcaaaaaacatgcgtttagaagccaatacagatgcaacagacagagaagaaactgcagcttttgcagagtggatccttaatattggtgatggaattgctggctag

SEQ ID NO: 12325 - DNA, 264 bp, Glycine max
  Peptide Sequence Number=SeqID_129103
atggcttcggaacgttcattggatccgagaggcacatctgggtgttggcaaggtgctcgcgctggttgtagacgttgtggtttggaacccaaagaagaggtccaactagtccgggaggtccattcccagctgccattgcgggggacggtggagggaagggtggacgctagcagcgaagacgtcactgaggtcggacagcaaggtacaaaggcgtttcatgataaggaacattgcagtggaccgtggtcaaagggattgagttaa

SEQ ID NO: 12326 - DNA, 228 bp, Glycine max
  Peptide Sequence Number=SeqID_129104
atggatgccctacaatatattcaggaagtacaatatacatttcgcgacagcagagaaaagcttgacaagtttacgaatgtcatgaaagattacaaatttcatagaattgatgttggggttgttgtagcaaaaatggaggagattcttaaagatcacggggatttgattttgggatttaacaagtttttgccaaagggatatgaaatcttacttctaaatgagggataa

SEQ ID NO: 12327 - DNA, 707 bp, Glycine max
  Peptide Sequence Number=SeqID_129105
agcttaaaccgagtgattttgatctgaaggagaagttctggacaaggtttccgactgaaggatctaagattacgctgccggatcaatcagtggagttccgctggaaggactactgccctatggtttttagacaattgaggaagctttgtattgaggaagttattgtgatgggcaatcttttctgctctgaatatcaaatccgtagacgatttgacttgaagggatcttcacatggccagacaacatataagaccaaggagattgatgaaactaccaccctcaaggacctggatctcaactttgtgtttcgtttacaaaataattggttccaggatttcatcaaacaaattgagtgggattgtgagttcttggaggctgagggaattatggattacagtcttttagttggccttcatttccgtgatgatgatacatatgaaaaagatgggattgtcaccatttcttttccgcaccgtgaaaagttcatgcgtggttatcgctttcttgaagcagagctgcaggatagggatcgagttaaatctggccgaaaatacagtcttgatgataacactatagacttcattggtcatgctttggcgcttcatagtgatgattgccacttggctgagccagcacaggacactgtgaagagaatgaagtgggttcttggagaagaagaagtgaatggaatgaaaggtttcttttga

SEQ ID NO: 12328 - DNA, 267 bp, Glycine max
  Peptide Sequence Number=SeqID_129106
atgtcgtaccagatgtcacgacatcacgtttcagaacatgcagaatatataacagatttatatgtccagtattttcgggcaagatgtcctggacatcgtatccgacatcgtggatcctgcaacttcaatgcttttagcaactccagtattttcgggcaggatgtcctggacattgtatccgacatcgtggatcctgcagcttcaatgcttttagcaattccagtattttcaggcaggatgtcctggacattgtatccgacatcgtga

SEQ ID NO: 12329 - DNA, 573 bp, Glycine max
  Peptide Sequence Number=SeqID_129107
atgactctaaagaaactcctctctaggagagctaggaagatcactgcaggagaaggatctagcacaactccacctgaaagaagggtccaattagctaagggtgagtatatggaattccaaacagagattgctaggaggcattggacacaacatgaaggtgttatggataagtgctccaaagtgtgtggccaatggattccttatgacacagatgccatcaaccaatttttagggaatccattaatcttagaggaggggcaagaatcaaatgcaccaccaccacctccacatcagacaccatccttggagtccatctcaactcacttgcagaggatagagctccagatgcacatatacatgcgtcatttggctaaccaacaggtagcgaatcataggggccaaatgcagttgaatgacaacttctaccattacacactgcaccagcatcgtcaggatcctagcccttacccttggcctactcttgagcagtttagagtcattgttgcatggcctggagacaaacctatttttcaggaagaggaaagacctatagatgctcaaggagcagcctaa

SEQ ID NO: 12330 - DNA, 705 bp, Glycine max
  Peptide Sequence Number=SeqID_129108
atgaccttaaattaccttaaggcgtggatatggagcccactgaaagtgaggacgcgtagccttctaaaggtgaggacgtgcaacactctaaagttgaggacgtgtcaccctttgaaggtgagggcgtgcagtccactaaaggtgaggacgtatactcctctatgggtgagggcgtgtagccctatgaaggcgagggcgtgcggccctctgaaagagagggcgtgcaaccctttaaaggcgaggacgtctagtcctctgaaggcgaggaagtctagtcctctgaaggcgaggaagtctagtcctctaaaggtgaggacatgtagccctatgaaggtgaggacgtgtagtcctctaaaggtgaaggcgtgtagccctatgaaggtgaggacatgtagtcctcttaaggtaagggcatgcagctctctaaaggtgaggacatgtagtcatctgaaggtgaggacgcatagtcctctgatggcaagggcgtgcagtcctctgaagacgaggacgtctagtcctctgaaggtgaggatgtgtagtcctctgaaggtgaggacgtgcagccctctgatggtaaggacgtgtaaccctctgatggtgaggacgtgtagtcctctgaaggtgaggacgtgcagccctctgaaagcgaggacgtatagtcctctgaaggtgaggacgtatagtcctctgaaggcgagggcgtga

SEQ ID NO: 12331 - DNA, 231 bp, Glycine max
  Peptide Sequence Number=SeqID_129109
atggccctggggtttccaactctggttacgggcctctgtcagtcctatagggtgcccgtccccccagcaaggtcacgccatcgtgagataggtaaggatcgcacccgcaagacacccagtggacccaaagaagtccaacagggtcctagggtttccagctctgattacgggcctatgtcagttctatggagtgcccgtcatccccagcaaggtcatcaggcctcctactaa

SEQ ID NO: 12332 - DNA, 525 bp, Glycine max
  Peptide Sequence Number=SeqID_129110
atggctgagcaacaaaagacaaagaagactagaaaaaaatcacaaaaggatgaagtacaatgggagcttcttaccaaggagcataaaactaaaagaagacatgagtatgctacatccgttcctatatgtccatcgactttgacctcagttccacaaaggttgaaagacctaagtgagaccgatgatgatgatgaatgtttggcattttccttaactggaaacaaggaatatccagccttttcctcatcagatagctctatcatcagattccatacttcatcttccacctccacaatagactcgtctagtgcaaccaaacattgtcaagatgcctctatactggctcgcacttggaactcaacaatgagtttgaccatctatcgaagtgacccagcctcaagcatggcacaatatgtcaaatttaaaggacaaaaagaaatctcaaagccacatctctcaagatctgttcacagaacaataaagggatccttcgcaagaagtggaacctccaagatagagttttag

SEQ ID NO: 12333 - DNA, 129 bp, Glycine max
  Peptide Sequence Number=SeqID_129111
atggagttgcagcggaagataaaggcgaagagaaatattccaagaatatgccaaaggcatcttagcatattccctttagatgccacaagcatggaaggtgtgatgctagcacatgggaagcttccttga

SEQ ID NO: 12334 - DNA, 126 bp, Glycine max
  Peptide Sequence Number=SeqID_129112
atgtatgctgatcgggtggatggtggaactcggagatcagtgaaggaacgccttgatgggaattttagcactggttctactcgccaacacagaatcaccggaaagagatggtgtggtgtgggctag

SEQ ID NO: 12335 - DNA, 234 bp, Glycine max
  Peptide Sequence Number=SeqID_129113
atgtcaaactgctcaattgccatgggaggaaggcgacgcgagggctcacgggtgcgtctcccatgggaggaaaatgtgcggagtcgccaccaacacttattcgaggaaaatgtcggaaaaaccagaaaggtgtggtctacaaattttaagtgtgaaaggttcgagagttgtatttacgcacggagaagatatattttgaccgaacaaaagtcgtttaaggcattggaccattaa

SEQ ID NO: 12336 - DNA, 324 bp, Glycine max
  Peptide Sequence Number=SeqID_129114
atggtgcgtcttccaaggaaggaaaatgcgtggagtcgccaccaacgtttattcgaggaaaacgtcggaaaaacccaaaatggaaaaggtcaagggtttacatcttttgaaaatgagggtttaggagtcatttacgcagaggaaagcaaaatagggggaggagcttgccgcccaactcgcccaggcgagctggtggcttactccagaagcaacttgctcgcccaggggctaaggaatgttccagaatggaccattttcccctatcttgagtttcttgcccatttccttccgaaatgtcgcgaaaccctacggattgcactgtga

SEQ ID NO: 12337 - DNA, 264 bp, Glycine max
  Peptide Sequence Number=SeqID_129115
atggataggaagtggccatgtaatgcattggtacctggttttgcaagagcaagtgttaggcatctcattgagctagaaaatgcttgccacataaggaaagtgcaagaaggggttaagaggttggatgatgagtacataaagtcagggatagattggttggaggtgaacaaaggggcaccttgtatggaagatagtttctcattggtggcatggtggagactagggctagacacaattgcaaaaaagacatttaacgatagttaa

SEQ ID NO: 12338 - DNA, 354 bp, Glycine max
  Peptide Sequence Number=SeqID_129116
atgattggtctacatgagagcaccaaatgtgcacaaattattaaggtttttgagtattcatacaagtcaccattgagtgtcatcattcttgatgacattgagagattattggagtatgtgcccattggtcctcgattttcaaacttgatttctcaaacactacttgttttgctcaaacggtttcctccgaaggggaaaaactcatggttctatgttttgttctatgttgaattgttttgttcttattggattgttttgttctatgttgggttctttattgcttgttgtttcttgaaaaccattgatggccatggagaagcaacgagtctatcgatggcaaagaggcgtttgtga

SEQ ID NO: 12339 - DNA, 288 bp, Glycine max
  Peptide Sequence Number=SeqID_129117
atgaaatttacaagattgcacatgtttgagattgcttcggaatatgactttcttaaaccccacaatgccaaaaaatccaagaaaccaatcctttgccataagagcaacaaagaacaagtgcacattctctttacacttctcaagtcccaaagcttatatggtgaccctaatgatgcctgtggatttgaggtcgaaacattggggttagaaggagagcctaagtcactattgcctctagactcaactgggggacatgtttcggtagccgcaaagtcccacgtcgcttag

SEQ ID NO: 12340 - DNA, 138 bp, Glycine max
  Peptide Sequence Number=SeqID_129118
atggatgactttttgaatgcactacatgaagtgacttccgcattaggagcttcaactgatgatcatgaaagatgcagtttttggctaactgcttctatcctcttggcagcaatatctgttttagatgtagttggttga

SEQ ID NO: 12341 - DNA, 414 bp, Glycine max
  Peptide Sequence Number=SeqID_129119
atgcagagttcaaaacgcgatgtctatcttggggcctacctgaatggcgaacactggcagatggtggccattgtgcccaaggaacaccgagttgtttggtttagttcattgcatattaggctagacagctaccttaaggaaataattaacagtgctttaaaaggtcttgatgatgctccacagcctaaatcaaaggttcctgctaggtggattatcgtcaagtgtaatagacaaaaaggaagtactgagtgcggctattgtgtcatgcaatggatgtccaccattattttaggaagtttcaggaataactgggaagcgtattttaacgatgctagaccattggagccagagagattaaaggcgttgcggatccaatgggtacagtattatcttcgagttaaagatcagagctag

SEQ ID NO: 12342 - DNA, 291 bp, Glycine max
  Peptide Sequence Number=SeqID_129120
gttgcatctcgactagcggaaccagtggatccgcaaatgctacctgcaaatgctactggcggaaccaacctaaggtcttctcgccagtctaactggtggaatcaaacatggatgcatggcagctatgatggatggatgatgggttgtgccatggggtatctcgccagtgggattggtggaaccctttgggttgctttacgccagcaccactggcggaaaccatggatgcatgggaatttgcataatcaagggttccgccagtccaagtggcgaaacacttatataaaatag

SEQ ID NO: 12343 - DNA, 231 bp, Glycine max
  Peptide Sequence Number=SeqID_129121
atgtttcagggagaagtgtttgaggatgatgatgatgagttggatctaaaggaaatgcgtgaaaatgaacatccaagaaatcagttaacatatgcccttacggacaatattcctacttccccgtcaggcttttataccagagatcagcggaaaatgaacagcggacagaaaggaaaaatagaagcagcggcagagccgcacaggatcggtcaggagggagaagagagatga

SEQ ID NO: 12344 - DNA, 678 bp, Glycine max
  Peptide Sequence Number=SeqID_129122
atggataaaagagttgccaagcatgatgaaaaaaagtctgcgcccaaaaatgagacacaaaacttgccccaacccttgccatctccatggtctacttctacacagatatggcatatgccaattccatatgattctgtacatcaaaggaggtcattctccaatctctatcctatggcaacagcagggtttggtcagagttctttgttagtttctgtggatggatcgatacaaagggcatctactgaattaaacaataatttaatgggaaaaggccttcaatcccaggaatccaggccttcaatcctaaaaaccaatggggaaggactaacaaggagtgcgactagcaaaagcagggaaacaacagttgtaggccatgatgttaagaatgccggtggagcaacaaaatttaaaataaaggatttgccttcagttaagccgcagcaatccagtatgatgccattgcctggaaatgggggaggtgtacagaatgtgattagtaatgaaaatcgcaatgctgttcatgagaatagaaatattgcatcggatcattttgaagcaaatccaactgagctgaatcagaaattgactacagctcccaatgcaactggcaataatccacatcttaaagaaaaggaaaggggagccatctgccatgttctgaaagaatacataagataa

SEQ ID NO: 12345 - DNA, 872 bp, Glycine max
  Peptide Sequence Number=SeqID_129123
atgagtctccgccaccgtcaatctccggcggcggcggcctccgccgtccccggccgcgacgaagagccgttcaacatcgttccagtgcacaacctcctcgccgaccacccgtcgctgcgcttccccgaggtgcgcgcggcggcggcagcgctgcactccgtcggcgacctccggagaccgccgttcgggcaatggcggccgaacatggacctcctcgactggctcgcgctcttcttcggcttccagcgcgacaacgttcggaaccagcgcgagcatttggttctccacctcgccaacgctcagatgcgcctcacgccgccgccggacaacatagacacgctcgacgccggcgtgctccgccgcttccgcaagaagctcctgaaaaattacacctcgtggtgctcctacttaggaaaaaaatccaacatctggatctccgaccaccgccgcggcgaagacctccgccgcgaactcctctacgtctcgctctacctcctgatctggggagaggccgcaaatctccgattcatgccggagtgcatctgctacatcttccacaacatggcgaacgagttgaatagaatcttggaagatttcatcgacgagaacaccgggcaaccggtcatgccctcggtttccggtgagaacgcgtttttgaacttggtagtgaagcctatttatgatactattaagcgcgaggttgatagtagtaggaatggaactgctcctcatagtgcttggaggaactatgacgatataaatgagtatttttggagtaggaggtgttttgagaagctgaagtggccacttgatattgggagtaacttttttgttactgctggtggtggagggaagcatgtggggaagactgg

SEQ ID NO: 12346 - DNA, 894 bp, Glycine max
  Peptide Sequence Number=SeqID_129124
atgtcgcctaaggcatcaggaacctccctaagaggaggaagaagcactggtaatggttttaggttggctctacctaagccaaccatcaaaaagagttcatctacaacatcttggtcaccaaaccaggctgggtcatctacccaaaaacccaaaatagaggggtcatcaacccagataatatcaatcaaacctgagtcatcagctcaggaatccccaaaaccctcaacttccaaacaaacaaaggctgattatgccttccctatagaaacactccaggccttacaagaaataagtattaccaaactaccaaagaaaacttgggtagatgtcacctcagaatctgatgaagattctgaaattgatttgcaaaccatgatccaaaaaaccaaaaatttcaaaacaattgtcaattctaaagggaaacaaaccatgtctcaaccacaaacaccaccaccaaaacagactaatagttataatattgagacaaaaatcccttcaaggctacaacgaaggtacaacaaaaccgaagaaagcaagaatttcctgtcacttcagacgcatgcctttgtcaaatggtggacacaatttgatgtatccaaagtggaaccagaacaggtcaagctttggttcatagctcatctagagcccctcaaagcagctgatcctgagacttcgtcactccttaaccagaagtcccaaatcgctacattccttgcaagttccagatcaaaagaaagtctggccaaaaatcttaaagaagtcttacaacttctgcaacaagaagaagatgaaggctcctcctcaaagaaggaagaaactaattcttcaaaagaagatgatccattttaccaaaatgagaatgactattttggtatttcattaaatgatgattaa

SEQ ID NO: 12347 - DNA, 285 bp, Glycine max
  Peptide Sequence Number=SeqID_129125
atgcctcgtattcatgacgcgatcctgtattacaacgggaaatggaacatgccaccgcagaacaaatttgttggatgcgcgttcacaggaaaaaatcctaagaaatttcaaattccttcaacatgtaccatcgatgaactgaagaatttaatcaagcaagttgcacctaaagggattccccctcttggaattcacgaatcacaaacggtaagacaattgtttttccgccaaccagctcggtttgagtattcagacgaggtcagtgggacgtcgctaaacaactga

SEQ ID NO: 12348 - DNA, 513 bp, Glycine max
  Peptide Sequence Number=SeqID_129126
atgcttggggatggaaatgaaggaatgtctacactacctggattgaatcagatacaatttgaagggttttgtaggttcattgatcggggcttaccagaagggctttttaagtttccaaaaattgaggatacagatcaagaaattgaatttcaattatttgtagaaacatatcaattattagaacccttgataaacgaaaaagatgctgtatatgaatcgcttacatattctgctgaattatatgtatctgcgggattaatttggaaaagtagtagggacatacaagaacaaactatttttgttggaaacattcctttaatgaattctctgggaacttctatagtaaatggaatatacagaattgtaatcaatcaaatattgcaaagccctggtatttattaccgttcagaattggaccctagcggaatttcggtctatactggcaccataatatcagactgggggggtagattagaattagagattgatagaaaagcaaggatatgggctcgt

SEQ ID NO: 12349 - DNA, 423 bp, Glycine max
  Peptide Sequence Number=SeqID_129127
atgacacgcagagacaaaatttggtcattctgcacccttgtgtcatccagaggcggcgggcccgatgacacgcggagataccttacggttatccgcacccttttgtcatctagaggcggcgggcccgatgacacgcggagataccttacggcggcgggcccgatgacacgcaaagacaaaattcggtcattctgcacccttgtgtcatccagaggcggcgggcccgatgacacgcggagataccttacggttatccgcacccttttgtcatccagaggcggcgggcccgatgacacgcagagacaaaatttggtcattctgcacccttcgtcaatcgcggccgacaagcccgttgacatgcggagatttacatcatcttccgcatttacaagatctgtcacactgacttttgagtcatgctga

SEQ ID NO: 12350 - DNA, 216 bp, Glycine max
  Peptide Sequence Number=SeqID_129128
atggttaaggaagagtgtaaggaggtaagtgtctcctccaacagtaagcaaggggttcccacaaacactaagagaataaaggtcaatcctgagtggcctactccgccaagtgttgaggaaagaaccccagagtttaaagaacctttggatttgaggtcaaatccttttcaagggggagggaatgatgcaatcctaccccccaagggcattggatag

SEQ ID NO: 12351 - DNA, 183 bp, Glycine max
  Peptide Sequence Number=SeqID_129129
atggatctcattgaaaatatgactgttgtaggatgtaccatctgtgggggagctcatgaatttggatgttgtattcctattgaagaacaccctactcgtgaagtcaattacatgagaaatcagcccaaaaataatttcaatgcagggaggattttctggattccaacatggccaacaatataa

SEQ ID NO: 12352 - DNA, 246 bp, Glycine max
  Peptide Sequence Number=SeqID_129130
atgtacatggtgaacaacattttcacaccatctaggtacaaagaaatcatcatgatgcagcccaaaccaagcgctggcctaaaggggaagcctcaccaacatgctctcattttcatgccttcttgcgttcaaaatcaaaggcttgggttcctaggcctaagtcacatttcggcatttaccctaacctctgcaagctgtccacgcatccaaaaatggcaaccatgggtgctcgcccaggcgagctaa

SEQ ID NO: 12353 - DNA, 240 bp, Glycine max
  Peptide Sequence Number=SeqID_129131
atggtaatatggaaaaaggggagccctaagatcaagcttcttcctatttgcagaaagtgtgctagggaaacaaagacaaccaaagactcttataatggtaatgtcatagggatgtccatagagttcctcataaggagctttgttgtcaaggaagggagtaagcatacagtttatacgagtagcggaatgaataagagcataggaccaaaagacaagaggcgagttagactaacagagtag

SEQ ID NO: 12354 - DNA, 429 bp, Glycine max
  Peptide Sequence Number=SeqID_129132
atggcagtggaatggagaaggaagagagagaggagacgccacttcaaggagaagatgagtctagaagaagctcaccaccataggaggccatggataagagcttggaggaagaaagagatgaatgaagggagaggaagagaagagcacgaaattttgtgctctaaaagagatgtgtttgatgcaaaaaccttttggagtcaaattgtatggaatgacacactcaaagccttagcttctggatatgatggatgtaataatgatgatcaccatggcttcattcaaatgctacatctcgttaagacatatcactttgatgcttgtgtgtgctccacaaaggacattgatagttctgccttcatcaataagttgaagaaccttcccactatttttcatgaaactaattatgatctcaccatgatggatgaatga

SEQ ID NO: 12355 - DNA, 294 bp, Glycine max
  Peptide Sequence Number=SeqID_129133
atggataagggagaggtgcattggcccgtaatgccttatgcatccggtaccgaactaaatggacctagtcaatctgacgaccgcctagtcattgcagaccaagcgatgagcatcatgactagaataatcgaatttccagtcatcaacaagggtgccctcaaaaggaacaccttgactgggaaattttgtcaaggaaaagaacaaggactgatcaataataattggaatattatgcacctcagaataaataataccatcctgaattttcaagttattatagatgactctaactaa

SEQ ID NO: 12356 - DNA, 231 bp, Glycine max
  Peptide Sequence Number=SeqID_129134
ggaaggaggagatgctgaagagagtggggtggtaactgctaaaggcaatttgattggcctgcaactcgcgcttagcgggcaatggccacgcttagcgaatcaattgcttcttaaatgcaaagatggctgtgctaagcccaattcgaaagaattgaaatctagagaagtttttaggcttagcgtggagcacgcgcttagcgagaccactacagccaatggtcaggggttaag

SEQ ID NO: 12357 - DNA, 258 bp, Glycine max
  Peptide Sequence Number=SeqID_129135
atggctcctccaaaccatgaggtatcattggtgatggaaaatagtggtggtgggaacaacatgaagggcgtgaccgtgctaggtctgtttctggaactcgtggttaagctaaggaccttttttggtttctggtgcaaggattggcaaagtggtggtcacctgaggtacaatctcaccggcattgtcgctgttgtgttcgagttactactactagctagggtttggaatgcaggtagtgttgcttggaaagctgtgtaa

SEQ ID NO: 12358 - DNA, 603 bp, Glycine max
  Peptide Sequence Number=SeqID_129136
atggtgaggacgtgcaaccctctgaaggtgaggacgtgcagttgtttgaaggtgagagcgcgtagccttataaaagtgaggacgtgcagtcctgtgaaggtgatggggtgcaaccctctgaaggcgaggacgtgtagtcctctgaaggtgatggtgcatagccctctaaaggttaggacgtgcagtcctctgaaggtgagggcgtccaaccctctgaacgcgaggacgtgtagtcctctaaaggtaagatcgtttagccctttgaaggtgaggaagtgttgtcctctgaaggtgagggcgcgtaacgctctgaaggtgagggcgcgcagtcctctgaaggtgatggcgtgcaaccctctgaaggcgatgacgtgcaatcctctgaaggtaagagcgtgtagccctctagaggcgatgacgtgtagtcctctaaaggtaaggtcgtgtagccctctgaaggtgaggctgcgtagccctctgaaggttaggacgtgcggtcctcagagggtgagggcgtgcaacactctaaagccctctgaaggtgaggatgtgcaatcctatgaaggtgagggcgtgcaaccctctaaaggcgaggacgtgtag

SEQ ID NO: 12359 - DNA, 612 bp, Glycine max
  Peptide Sequence Number=SeqID_129137
gactccttagaagagcaggtaacgcagggctcgtttgtaccccatggtcggcaagacattctgaacactgcgattggccgacctgagcatgggggtcgcgttcgggcagcaggctcaggtgtcactattactcagtactacggaagggcatcaaggacatgcagcagctcatccacatccatcagccaacaacaactagatgaagttgttgcaaggcttagggaagacatgactgggcagattagggaagaattgaggactcaaattaaggaagaattgaggactcagctagaagaggaaaataagaggagcttggaaataatgaccaatgcattgaaagaggctattaaaaaagagttgtcaaataaaggatccccagagctactccaaattcagccggacatacaacaagtagctgcgcgtgtcagcacacagggaagtaatgttgttaccaatgtccaggcttcacaagaacatcatgctgatgccataccattgatgggactgtatgtgcagcttaaggatggtacaacaaggttggtggccatggggccaatcatggagggggattcagtcatacacacagtggcatatgcagatgatgttgtcagg

SEQ ID NO: 12360 - DNA, 1075 bp, Glycine max
  Peptide Sequence Number=SeqID_129138
atgcagcagagttcaagatcacgaaaagcggcattgagagtcagagttccttcgcggaagctcatgattctctctctcgccattttcgccattctccctcccattttcttccacttccgcctccgacgcctccaacagctgcaactcacaaagtgccgttggctcaacgatcctcctctagtctgcgcccacggtggcgattcctccaaggcttctccaaacactatggcgtcgtatttccacgctcttcagtctcgcgtcgactgcattgagatcgacgtttctcgttcttctgacggagttctctttgctctccatgacagggatttgcagcgcttaaatggaaacactagttctaaagttggttacatgaactcagaagagataagaaagctcagtgcttcacatcagtctacctcaaagtttactgatgaaagtatacttacaatccaagatgctctgatgttgactgcaaattcagtacgacagatagttctagatgttaaggttggacccccgttttatgagaaaaagcttgccaaagatgttctctctattgtaagtataatacttccgttccttactgtccatctactgccttctgaaagggctatcaatactcccggtctcagaaatgtctttgtccttaaagacagttgtgagagcaggttgagtggtgttggaaggtccgggagtgcattgccgcccttgggagtccatagcagaagtgccacatggagagtcattaatggttgggtgatggaggattctggcccttgtatttacgaaggaggctcacatggaaaactggatgaatcttggctgtctctggtaaagcaagcttgtaaacaactgtgccaattcacttttctacttgatacagtccacggaaacatcgagatagcttggaatctcattgggaacgaacagaggactgatgatagtgttggagtttcaaccatgcccattcacctacgtcgaaagaaatggcagtgcgacggtggacatttggcagagtggtgttgtgaacatcataatccgcaatggagggagggctgtgtccatacaaagcctg

SEQ ID NO: 12361 - DNA, 1173 bp, Glycine max
  Peptide Sequence Number=SeqID_129139
gtgaaatatgtagtgaaacttgctcgtgctctagccaacacaaaaggaatttaccgtgttgatctattgactagacaaatagcttcaccagtagaagtggactctggctatggagagcctattgagatgttgtcatgcccctctgatggcagtgactgtggggaagcatacatcattcgtcttccatgtggacatcgtgataatcacattgttaacatggcaagagttttaggggagcaagtgaatggtgggaagccaacatggccttatgttatccctggtcactatgctgatgctggggaggtagcagcacacttatcaggtgcattaaatgtgcctatggtgctctcaggccactcgttaggccggaacaagtttgagcaattgttgatgcaagggaggctctctagggaggccataaatgcaacctacaagatcatgaggaggattgaggctgaggagttaggtgtggatgctactgaaatggttgtcactagcacaaggcaagagattgaagagcaatggggactgtatgatgggtttgatctcaagttggagaggaagcttagggtcaggagaagacgcagagtgagttgccttggaagacacatgtcaaggatggtggcatggacttcagctatgccacaacacaagactcggtggaagataatgagatttttcacaaatcctcacaaaccaacaatactagccctgtcctatcctgacccgaagaaaaatgtcatgaatttgctcaaggcttttggggaatgccagaccctaagaaaactagctaactcgaccctcatacttggcaacagagatgacattgaagaaatgtctaacaacagctctgttgttcttaccatggtgctcaaactcattgacaaggagttttatcaacccaaccctgatggaaccatttggtctcacactgatcgagcactcaacaatggactcttgattgatccacacgaccacaaatcgatagaagaagcactgttaaagcttgttgcagacaaaaatctttggctagaatgccgcaaaaatggcctaaaaagcatccatcggttttcttggcctgaacattgccgcaactacctctcccatgttgagtatggcaggaactctcgctccacatcccacttggaaattacaccaattgctgaagaatga

SEQ ID NO: 12362 - DNA, 969 bp, Glycine max
  Peptide Sequence Number=SeqID_129140
atggaccctgtagcaaggcagaagcaaattattgaagcaatcatgtgcagggtctcttccactggcaattctaatgccaattgttactttcctggtaggaggcaaaggctagttatggtagctgctgattgttatgatagtgatggaaatatagccgaggaggcttttcaggcagttgtcataaatgtgatgaaagtcgtacgaccgggcatcagatcaggcagggttggtgtgatgttgcaaactggtttaagttttcaagagacaattgaagcattgaacaacttccaagtgaacatggaagaatttgatgttgtggtttgcaacggtggaagtgaaatgtattatccatggaaagatttaatggcttatactgattatgaggcctatgctgagtatgcatggccaggtgagaatattagatcaacaataccgaggtttgctaaagttgatgatggagaggagaatgacatcgtagagtatgctagtgcttgcagttcaaggtgctactcctatagtgtgaaaccaggagccatgatccagaagatagatgagcttcgccaaaggttgcgaatgagaggcttacgctgtaacctggtctatacacatgcaggattgagattaaatgtgataccattgtttgcttcaagaaaacaagcactaaggtatctgtcagttaagtggggaattgatctatccaaagtggttgtatttgtgggagaaaaaggtgacacggattatgaagaactagtgtctgacatacagaagacacttgttttaaagggggctgttgaatatggcagtgaaaggcttcttcgcagtgaagagagttacaaaagagaagatgtgttatcccaagatagccccaacattatctatgcagagaagagctatgaggattgtgtgatatttcagcaattctggagcatctcaaagtatcatgatttctgttttggtaactatttctaa

SEQ ID NO: 12363 - DNA, 1319 bp, Glycine max
  Peptide Sequence Number=SeqID_129141
gtgatggtggttcgaactcgaaagtggttgttgtcccaaacaggaagggttcatttgggtttgaaatgggtaagttttgggtgggtttgagtttggttagggttcatggttggtggaattgcgatgtagatgcgaatgtgcattgggttaaggtttttgtgggttccatttgggttatgttgataaatctttgttcatcaggtatgtggtttttagttgctattcactccatgggctactgggttatgcaaccaacattgaaatgggaggggaaaaaggagaatgcctttcacgagttggatattgacacatggtcattccttgaagttgtggtgctgatccacgacattgaatatgatgttaccgatgggcttaaaatgtggtggaaaggggctaatgctgattatgaaatcttgaaagacttgaacaatgaccacgatgctatggatttagtaaagtattcttttagtcataagtgtgaagttgatatttatgtgaagtttgggattaactttgaaggttatgatcttgacatggactatggtgtaaatgattgctttgatagggacattgctatggaatatgatgacaattacccacttgagatgcattatgacagtgtgcctgaccccccctcccctcaagaagacccttatctagattttagggagatgcatcatttggagacttgttatgaaactgaggagctgtatagtaatgttgaatttaaggatgacactacaaagcctggaaaagagtttctgatgttcagaaaagacactatgtgcaaggttttcaaatggacactaggaatgaataaccatacttgtgcaatttctgctaggaaaatagcacttcaacaaattaaaggtgatgaagtaaagcaatacacattgcttagacgctacaataatgaactcatatccagaaatgcaaacaacaccttcaagattcatgtgaatagacttgttcctactttgccaccaccatttgggtctttttacatggggcaaatgcttgtagctatggccagagatgctaatgaccagtactaccctttagcatctgctgttgtcgaaactgtgaacaaagacagttggaatcggttcttaaatgagttgctagttgacattcgacctatggaagctatgggatctataattttagaacaatcaactgaagtgacaactattagatttgagacacaagttgttggatatgcaattccaacacaaccaactgaagtggcaattgctggatctaagacaaaagctactagatctgatgtgagaggaggtggattagcaattctagcataa

SEQ ID NO: 12364 - DNA, 210 bp, Glycine max
  Peptide Sequence Number=SeqID_129142
atggcatttgagaccatggcagcttgcccaggcgagccaagacttacacttgaagtaactggctcgcccagtagtgggttgagggtcttgtcaatgttaaaggaggaaatgttgttgggaggcaagtggatgttgctcgaaggaaagctactactgatgcaagccaaggcacatttcataagacagggcaacaattggagtagcagttag

SEQ ID NO: 12365 - DNA, 324 bp, Glycine max
  Peptide Sequence Number=SeqID_129143
atggagcatctactaaagaggaaaacacgcgggagtcaccaccaacgtttattcgaggaaaacgctagaaaaacaaaaaagagatctgcgaattttgaaaataagggttcgagagttgtttacgcatggggaaggcttttgaaagattcattttattactgtaaacaaaaagaggtcgttaaggcgttggaccttgaacgatctcaaatgataacaaaagatgatgacaaaggtaaggacaaaaagctcaaaggtcaatcaaagaatgagttcaagatattcaagatagaatcagaacacttcaagattcaagaggaaagttga

SEQ ID NO: 12366 - DNA, 1044 bp, Glycine max
  Peptide Sequence Number=SeqID_129144
gtgctaatgggggccccttccacaccccgtattttccatgttggtcttgacggcacgatgcataatattaccccttctccacgagctcattctcaccttcataatactgctggttttggttctaataaccagtttcctccaccattggtggctcttcatataataccacccctaacccttccatttgtttttcaaaacttcaactcaatccctttgatggccaagacccctttaactggtgaatccatgagttggttcaaatggatgcacaacaaccatcaactcacagattgggagacgtttacccatgccttagaagttcgtttcagaccctcttcctatgagaatcaccaagttgagcttttcaagctccgccagtatagcacagtggctgagtatcaacaccgctttgagaaactttctaaccaactggctgtccttaaacctttttccatccatcatgccatcggattagccaagttggtggaggccaaattgaaagacttcaagcctaaacctaaccccaaacctccttaccctgctacttcgtctaacaccacccaccttgccaccccttcccttaaacacttaacccaagcccaataccatgaacagagagccaaaggcctttgctattactgtgaagaaaaatatgtcccaggacataggtgccaagcatccaagtttcttttgttgcttatggatgatgatcctgtcgaatcaacttgtcagcccatgcctccacatgagcctttatttgagccacaagaggaacctacccatcatcttcaactatccacctatgcccttatggcttgcataacatcttgcaacccagacgcactcgctgcccatttgaacctttccatttccccaactgttgcttttccagtgatggtagggaatggtgatcacatttattgctcgggactatgctctaaggttcccttggagattcaggaccaggtttttgaggttcccatgtacttcttcctatccaaggtgctgacttggttttgggtgtgcaatggctcagttctttag

SEQ ID NO: 12367 - DNA, 360 bp, Glycine max
  Peptide Sequence Number=SeqID_129145
atggtggatggtggaaggccaaaattcctccatattaacacaccattgcggcctatggcactgccattgtgggcctccctcctcaaattgcctatggcgtttggcaaaaaatcaccatgccattcttccatggcgccgccatttaacaacactgctgtggatgccatgagtttaaatcctagaaatagcctgggggtaaatcctcagactcctctggatgagagccttgtgcactgggtcacccttttggtcttattggttgaactgatagatgttggtgaacctgttgccatcaacctaatcctgttaggactcatccctctccattacatttgtcctggtcctgtagcaagtccttag

SEQ ID NO: 12368 - DNA, 390 bp, Glycine max
  Peptide Sequence Number=SeqID_129146
atggaagagattattgcagatcctgatcagttttgggaagggacttatcacttatacgagtgctttttgctggctgttcttaccattttctttttgtctgacacagatggtggccttctggtgaatgttgctagaggtggtcttgtagactatgaggctgtgatcaaccaccttgaatcaggtcatttaggagggttaggcactgatgttgcttggactgagccatttaaccctgatgatcagatatttaaatttaagaatgttatcatgactcctcatgttgcaggcgttacagagcattcttatagatccatggctaaggctgttggtgatgtcgttcttcaacttcatgccgggcttcctttgacagggatagagttagttaactga

SEQ ID NO: 12369 - DNA, 561 bp, Glycine max
  Peptide Sequence Number=SeqID_129147
atggctattgcattgcttggatcattttgccatgctccaactgtgatgcttgcaaactttattgctactcccatagagttgagtctggttgtaccctttctacgccttggtgaggttatctctggtggatctcatttccctttaacatctgatgctttaaagaaagttcttactggccaagcttcacgtgaagtcttattaagtgtggcccatgcgcgacgcaaaagtgattgtcaaccggaattcatagcaaatcttctacgaggacctgcctcggctcgtgttgttgccgaagtggaacctgtacgactctatgatgtgctcgtcctacactgtcaccagcgtcaaccacttccaccgtcgttgtctccggcaccgtctagatctcccatggctgctagatctttggctacaactcaatgcccactcatttatatctccaccaatgtccccggtgtccccggtctcactgctttgggtcgcacggctgaagggctcgtacatacgaaaccagatctgaaatttgtgacgctgaatgcggctttgaggttgagatggtga

SEQ ID NO: 12370 - DNA, 255 bp, Glycine max
  Peptide Sequence Number=SeqID_129148
atgacgaacgaagaacgatgtagaagtcgattacgatcgcaatttggtagcgcctcaacttcatttttctcttctttctttttcttttctgtgatttctcaatttctctcaatgttggaccttggaaccctttactcaacctccctcacgcctatttatagcaaaagatggctgtcgcaacatgcccttttgcgggcaagcgaggcgaggctcacgggtgatttttttgcggacgagcttgactttgcgagttga

SEQ ID NO: 12371 - DNA, 354 bp, Glycine max
  Peptide Sequence Number=SeqID_129149
atgcctatgatgaagttgagttgtggtgctgagttgtggctggatatggctttgactcctacaaagacgaggactttgagtcctatgaaggcgaggactttgagtcctctgaaggtgagaactttgagtcctatgaaggcgagaactttgagtcctctaaaggcgaggactttgagtcctctgatggcgaggactttgagccctctaaaggcgaggactttgagccctctgaaggcaaggactttgagccctctaaaggcgagaactttgagtcctctgatggcgaggactttgagccctctaaatggcgaggactttgagccctctaaaggcgaggactttttagccctctga

SEQ ID NO: 12372 - DNA, 336 bp, Glycine max
  Peptide Sequence Number=SeqID_129150
atgcagagttcacagcgcgatgtctatcttggagcctacctaaatgggccagacaactaccttaaggggattattaatagtgcgttaaaaggtcttgatgatgctccacagcctaaatcaaaggcttctgctaggtggattgtcgtcaagtgtaatagacaaaaaggaagtactgagtgcggctactatgtcatgcactggatgtccaccatcattttaggaacttttaagaataattgggaagcgtattttaacgatcctagaccattggagccagagagattaaaggcattgcggatccagtgggcacagttttatctccgagttagagattag

SEQ ID NO: 12373 - DNA, 219 bp, Glycine max
  Peptide Sequence Number=SeqID_129151
atgaggctaaatcttgaagtgctaaaagtggtagttgtgctcaactcaccatttgggctcaatgcgcatcgtgcgcttagcgtgacagaagaatctggaaaggcatcaatatcaaggtcgcgcgctaagtgcgagatcagtgtgctaagcgtagcggttgtcttcagccaggctcaacacatgactggcgctaagctcaaatccacttactcgcgctaa

SEQ ID NO: 12374 - DNA, 996 bp, Glycine max
  Peptide Sequence Number=SeqID_129152
atgaagcttgcttctacacctccttatctacatatatctagggcaactgacatcaagatgattgtggatagggtctacccttgtgtacaagtatgggatgctgccgagaagaagggatttgagctttattacaaggcaaatatggcttcaaggaaaatgaagatagtgtggatggattcccaaaaagcctccacctttggcaatgatggaagtgatattgttgtgccacgcaatgtttttcaagcgttacaacctaccaggaagtatctctttgatgacgcttgcgtctacttcacaaaagatgttgacaactactccttcatccaacgtcttcttcagcttcccttcattccatatcagggaacctacaacttgaagaagatgacaaaagctcaaatgatagcccatgtgactaagatccatgaggttcaacaaaagaggagagttgatgtcgttactgttgagattgttgcaaaagaagttgccaccactgttcaagctgaagcatttggtaaagttatggacgacactgttgtgtgtggggtcctcattgaccttacaaacactagtgatatggacaagactagtgaagcatccaatgtggctatagcagatggagttgaaccactaattctagctcctgtgtccaagcagtcaacaaattcaaatgaagcaatttctcaagataaaggtgaccatgatgttgtaattgtctactcaacaaattctggtcctacccctctcaattatgcacaacccaccatcatcactcgtgatcaggttcaatatatgatacgacaagccatggagtcctttgttgaacgtcaacgtcaagagaatgggcagttcttcctgtctatgcaaaatgccattacaatgcagttttccaaccttggtgtcgtccttttacaaaacatccaacaagctcagttgtcaatgcttggagctattgttgcaccggtatttcaacctgcctctcttgaaccttcaccataa

SEQ ID NO: 12375 - DNA, 210 bp, Glycine max
  Peptide Sequence Number=SeqID_129153
atgatcatcatcaaaacaccaaaggcatttgcttctacaaacaacaagttaataagtggggacactgataatgttagtggttatggacctgcatctgaattggattatcatcgagacgatttcgaagatgacaatttggccgaagttgacaccacaatcaaaggtagaagagaagatgatggcatctttgacactcagaatagcagataa

SEQ ID NO: 12376 - DNA, 258 bp, Glycine max
  Peptide Sequence Number=SeqID_129154
atgattgactcacctaacaacaacaaagccagagtttcaggaatgaagggtgctttcagtgttgctgcaaagacaaatgcaccagtagtaccaattacccttattggaactggtcaaatcatgcctgcaggaaaggagggaatagtgaacataggttctgtgaaagtggttatacataaacctattgttggaaaggatcctgacatgttatgcaaagaggctaggaagacaatagcaagtgtgctgactcaaagctga

SEQ ID NO: 12377 - DNA, 276 bp, Glycine max
  Peptide Sequence Number=SeqID_129155
atgaaggtttttggagcgaagatgatgatgaagatgatcccaccactgtttctgtttctgcgtggactgtcgtgccaacgtcaatctcctgcagcacgtgccaccaaacacaaacagccccctcaacatactactaccatcgacgatcaattaattatactatgtttatttatttatatgattgtggttcaagtcatcggtggtgtgaagatagagaaatgcaaaaaggaagaaggaaatgtgaatctaagagataaatgtgacagtggaggctga

SEQ ID NO: 12378 - DNA, 507 bp, Glycine max
  Peptide Sequence Number=SeqID_129156
atggagagtaatgggaactcggtgaaggatgctgagaaacaaatcacccgtgttttgttttgtggaccccgtttccctgcttctcatgaatatacaattgagtatttgcaaaatcattcacatatcaaggttgatgttctccctttagaagatgtgccaaaggatattgccaactatcatgtctgcatagtaaaaaacatgaggctagattcagaaataatttctcgtgcagttcagatgcagcttataatgcagtatggtgttgggctggaaggtgttgatattgatgctgcaacaaagcatggaatcaaagttgctaggataccaggtgatgtttcgggaaattcagcttcatgtgctgaaatggccatatatctaatgctgggtctcctcctggcacatctaaatgaggtggcaagaaggaaaaataaccttgtcataacacctaggttaatgatgcttaagaatatgtgctttggttatgcttttgtgatggagatgctttag

SEQ ID NO: 12379 - DNA, 300 bp, Glycine max
  Peptide Sequence Number=SeqID_129157
atgggcaggtgcagatacatgactgtctctaccggttcagcctcagtcagcaggggcagggctgaggtcgcatggtctggagactggcccgatgccctggtaggggaggagcctgcaagagccaccggtggggcagatgaatcccatatggataaagatatgactgacctgttcggtttcttgggagggagcggagccacgcccacttgggccttccagattcttcctccagaaggctgttgcttctggaggaagcaaccttgctcgcctgggcaagctaagctcgcctgggcgaactgg

SEQ ID NO: 12380 - DNA, 452 bp, Glycine max
  Peptide Sequence Number=SeqID_129158
atgggcttgggtctgatgcgagaggcttgcccaagcgtgagaatcatctcgttcaagcgagtcctttttgtcaatctcagttcagctactaactatcctcgcttaagcacacaaaatgtcatgtttaagtttgtgcttaagcgagggcccctagtgaatccaaggttactctctgactatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 12381 - DNA, 615 bp, Glycine max
  Peptide Sequence Number=SeqID_129159
aaaacaccgagactttttcaagtctcacaagttatccagaactacgtaggtctgagttcctcattggaggatacgtaggagcaagagcctcgcttttgtcgaccacaccgccttttgttgccatgactcaagagctgaggccaatggtggtcatctgcgcctttttccggaggatgttagcattttccgatggagacttttcaagtctcacaagttatctagaactacgtcatgtgacgtgcacccttgtatcatccagaggcggcgggcccgatgatacgcggagataccttacggttatccgcacccttttgtcatccagaggcggcgggcccgatgacaagcagagaccaaagaccaagtttggtcattctgcacccttgtatcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatctagaggcggcgggcccgatgacaagcagagaccaa

SEQ ID NO: 12382 - DNA, 294 bp, Glycine max
  Peptide Sequence Number=SeqID_129160
atggttacgcgatccgtgaaattccgtaatgtggcggaaaccaaaaggaagtattgttacgcaatctgcccacttaggccttccagattcttcctccagaaggcggttgcttctggaagaagcaacctggctctcctgggcgagctgggtggcaagctcctcccctattttgctataaatagggggaggaatgaagaaggaaggggttcagccttcttggcacttcgtattctcttgaaattgctgaggaaaattgtttccgtgaagaaaatccaagccgaggcgcttccgtaa

SEQ ID NO: 12383 - DNA, 1236 bp, Glycine max
  Peptide Sequence Number=SeqID_129161
atgacagccacgtgcggacctatattcaagttgcttcgaaaagatcaaggggttgtttggaccgaagattgtcaaaaggcttttgatagtatcaagaattatctgctagaacctccaattcttatacctccagttgaaggaaggcctctgattatgtacttgactgtgttagaagattctatgggctgtgtgctcggacaacaggatgagaccggaaggaaagaacatgccatctactacttgagcaagaagtttaccgattgtgagtccaggtactccctacttgagaaaacttgttgtgcactagcctgggctgccaagcgtcttcgtcactacatgattaaccacaccacctggctaatatccaaaatggacccgatcaagtatatctttgagaaacccgctctgacaggaagaattgctcgttggcagatgttgttatccgagtatgatatcgaataccgcacccggaaagcaattaagggaagtgttcttgctgatcatttggctcaccaaccaattgaggactatcaacccatcaagtttgactttcctgatgaagagattatgcacttgaagatgaaggattgtgatgaaccattgcttggagaaggtccagatcccgagtctagatggggtttgatttttgatggagccgtgaatgtctttggcaatggaattggggcagttattatcactcctgaaggtaatcatctccctttcgctgcaaggttacagtttgattgcaccaacaatatggcagaatatgaagcatgtatcttgggcattgaaaaagccatcgacttgagaatcaagaaccttgacatttacggggattcagctctcgtaatcaaccaaatcaaaggagaatgggaaactcgccaccccggcttgattccatacaaagattatgcaaggcgtttgctaaccttcttcaacaaagtggagcttcaccacatccctcgtgatgagaaccagatggcagatgcgttagcaactttatcctccatgtacgaagtgagtcaccggaataatttgccaacaatcagaattcagcgcctcgagaggcccgctcacgtgtttgcagtcgaagaggttgttgacgataaaccctggttccatgatatcaagtgtttccttcaaagccaggaatatccacccggagcatccaacaaagacaggagaactttgagaagattgtctgaaactttgacatggtactactcaggtgtgtag

SEQ ID NO: 12384 - DNA, 321 bp, Glycine max
  Peptide Sequence Number=SeqID_129162
atgcaaaggaaggatagggagcttacgggaagcagcaatgggatcatcggcaactatcacaagtggctgaaaactaaaacacaagagttagattggctctcgaagctaaaggcttcaattgaggaagaggctaaaacccctaaggagagtgaggaggtgcaagccttaaaggtggaacttgaaagggcacaagaggtcaaggaaaagttcaagacaacggccatcaaggttcagaaagaatgcaacaaactgagaggcgtcaatgtggccaccgtcgaagcattggaacgggaaacaaagagggcccgaaaggaagaatag

SEQ ID NO: 12385 - DNA, 525 bp, Glycine max
  Peptide Sequence Number=SeqID_129163
atgccttgtggcaaaggatttgctgcaagggtgatggaccaaggcctgtttgaaattggtggcgcaaggaaaggggagcaacgtcctatcccgagtaagaagcctatccctttcccctacaagagtgccaaggtggtcgcatggaggtacgcccctcaaaagcctgacgaaaggaaggacgagtccgtcagaaatagcctatcctctgccaaagtcactaacatctttggcacgagcgatatgacccgtgaaaagatgaagaagaagaaggttgcagttgttggtgtctcgctaagcgaggcatatgcgcttagcgagcaacatacgctaagcaaggcactcagctcacttagtgagttaggagaatctgccaagcatgcacgcgtccagcgcgccatcagctcccccaacagacgcagcaaaggaaaacagggcaagggagcaccaaaaacctcaactttcaagaggattctaggtgataacatgccatggaaggctaaagctcttgttgggaatttctgctga

SEQ ID NO: 12386 - DNA, 309 bp, Glycine max
  Peptide Sequence Number=SeqID_129164
atggatggcggtgatgacaacggtgataatagtagtggtgacaatggagttacaatggcaacaatggtgattataataatggtgacggtgactactatggtgattatgagagtgatgacagtagtgtgctacaaaaaaaaagagtattttcgactgccaaaattcgttggtaacctcaaaaattcgtcgagtgtctcggttggtcatcgttttgctactcgtcatctgactactggtcatctggttggtcattgtcttcttcctgctactagtcctgctgctagtgaggttgttgatgttgataaataa

SEQ ID NO: 12387 - DNA, 537 bp, Glycine max
  Peptide Sequence Number=SeqID_129165
atggatcatcacactccttccactaaccctaccttatctcaattctcttcttcaaaatcaaacaaaagtttaaacaaagagaaaaagggtggtgccagaaaatgcaaaggagtgaggctctccactgaccaacaaagcgtggcggcgagagaacgaaggcacagaatcagtgacaggttcaagatcctgcagagcatggtccccggtggaagcaagatggacacggtgtccatgctggaagaggccattcagtatgtgaagttcctcaagacccagatttggcttcaccaaaccatgatcaacttcatggacaatgataataacaataataataactatgagtcttcttcttcactaccctcacctttgttacaccctaatagggataattgctattatttcccttctgaacagtttttttcacctcagccaaatgcagtgtttgattatgataacatgcaggatttggcacaatgcagcttccaaggtgaagacacgacctacattgatgcctctttgaaatattggccagcgtga

SEQ ID NO: 12388 - DNA, 345 bp, Glycine max
  Peptide Sequence Number=SeqID_129166
atgaagaatgcattcgacaagaaggtgcacttgtgcaagttccatgagggggaccttgtgctgaagaaaatgtcccacgttgttaaagataatcgaggaaagtgggccccgaactacgaagggcctttcattgtgaaaagggctttttccggaggggccctggtgcttaccaacatggatggcgaggagctaccttcacccgagcataatcgtcttaggcaatggtcaaatgccaggcctgatccaaaggcggagaccggtcaagaagctaggatcatgatcgatagatcgttgtcccttgcccagtgctggacaaacggaaagcgccgctgggaggcaacctag

SEQ ID NO: 12389 - DNA, 381 bp, Glycine max
  Peptide Sequence Number=SeqID_129167
atgactgaagctaactttggttggttaatccgatccgttcatcgatggtcggcaagcggttttaaaaaacctcgcgaattaacttgggttacgggtgtagttttggctgtattgactgcatcttttggtgtaaccggttattccttaccttgggatcaaattggttattgggcagtcaaaattgtaacaggcgtacccgacgctattcctgtaataggatcgtctttggtagagttattacgcggaagttccagtgtgggacaatctaccttaactcgtttttatagtttgcatacttttgtattacctcttcttactgctgtatttatgttaatgcacttttcaatgatacgtaagcaaggcatttctggtcctttatag

SEQ ID NO: 12390 - DNA, 862 bp, Glycine max
  Peptide Sequence Number=SeqID_129168
atgggggataagcttcatcgtcgagagggaaacagcccggatcaccagctaaggcccctaaatgaccgctcagtgataaaggagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccacccgtcgagcagggacgaaa

SEQ ID NO: 12391 - DNA, 285 bp, Glycine max
  Peptide Sequence Number=SeqID_129169
atggcaaggacgtgcaatcctctgaaggtgagggcatgccctacaaaggtgaaggcacatgaccctttgacggcgaggacgtgtagtcctctgaagttgaaggtacatgaccctttgaaggcgaggacgtgtagtcctctgaaggcgaaggtgagggcgtgtagccctctcaaggcgaggacatgtggttctctgaaggtgagggcgtgcagccctctgttggtgaggacgtgtagtcctctcaaggcgaggacgtgtagtcctctcaacggtgagggtaactag

SEQ ID NO: 12392 - DNA, 99 bp, Glycine max
  Peptide Sequence Number=SeqID_129170
atggagcttacatcaggaagtgtcgaggtcacccagtcgtgcacaagaaactccctctccatggtgatcagcccgagtcttaagggacttccaaatcgg

SEQ ID NO: 12393 - DNA, 306 bp, Glycine max
  Peptide Sequence Number=SeqID_129171
atggagtgtagcatctgtggtgtaaaaataaaatctgatggttctgtagatataggagctggaagtggtatctgtgtaggtgtaggaggaataactggagctgaggaaggtactggagctatggaagaagaaggagttggcgtctcaggtggtgctgaaatggtaggggcctctgatctcttacccttggccttccttggccctctaaatgtcactgttggatcatcaagattccaacaattcttcttaatatatgccacgttaatggtagggctcaagctctccagggatctagagtctgactga

SEQ ID NO: 12394 - DNA, 327 bp, Glycine max
  Peptide Sequence Number=SeqID_129172
atgcagagccttcagggcttgggcttgccatccatcatgagcatggaggagtttgatgcacaggagcctgcttctaaggagccaatagcagcaacagtagagggggaggatgagctcacccctcctgagcccttttattttgacggagatgcacacatggctcaagaggagggtacctccacagatcagatacttgagtcatcctttgcacctgctcctgaggagattcagccatctacacccgtcatagagccaaagcagcctatccaggattcatcagcagctccagcactggatcttaatgaagatcagccacaggatgagtag

SEQ ID NO: 12395 - DNA, 387 bp, Glycine max
  Peptide Sequence Number=SeqID_129173
atgcttgcgggttgtgtcggcaggtcagggggtgcgaacacgcgaccgctacgggtcacaccactcagccccgtgatattagttaccttggccaacaacgagctgatatcggtggctattccgtggcacgattcgactcaccgctatttcattgtggtgccagttcaagtgatagaggtgtcatcctctgcagaggatcctgaggagttacctcctgagcctgttgtggatgctcttgacttacctgaggatgatgaagacccactccttgatgttgattttccagaggatatcatgtcagtatctgaggcagactctacaaaggagagcggccctggagggacagcgaatagtggagactcttcatcaaagcagatggctccttag

SEQ ID NO: 12396 - DNA, 342 bp, Glycine max
  Peptide Sequence Number=SeqID_129174
atgtgcgaaaaggagcatgaatccttcaaagaatacacccaaaggtggagggatctggcagcccaggtggcagccccaatgacaaaaagggagatgataagcatgatagtagacacattaccagtgttctactataaaaagatggtgggctacacaccttcaagctttgctgatttagttttcgctgatgaaaggatcgaagtgggtctaaaaagaggcaaatttaatcatcctgcttggacgaatgagaaaactggggtaaatgaagagggtaagaatgaaggagaagcccatgttgtgactgttaggggtgggaataggccaggccaggtcaggctttga

SEQ ID NO: 12397 - DNA, 474 bp, Glycine max
  Peptide Sequence Number=SeqID_129175
atgaccggccctctcaatgagtcaatctcttgctttctcacaagggtggacccatgggtactagtaccctcaccttcagagggctacatgccctcaccttcagagggctacatgccctcaccttcagaggactacacgtcctcgccatcagagggttgcatgtcctcaccatcagaggactacactttcctcgccatcagagggctgcacgtcctcacctatagaggattacagacctcgcctttagagggctgcatgccttcgcctttagagggctgcacgccctcgccatcagagggctacacgtcctccccttcagagggctacatgccctcaccttcagaggactacatgatgcaatgctatcctgcaagggcattgggcagaagactccaagttgattgggctagagatccaagggaagaccctagggttctcatgagccttagggtagatttcgagcccatgggctaa

SEQ ID NO: 12398 - DNA, 450 bp, Glycine max
  Peptide Sequence Number=SeqID_129176
ggatcgcgcccacaagacacccaagtggactcggaggagtccaacagggccctagggtttccagctctggttacggacctctatcagtcctacagggtgcccgtccccccagcagggtcatgccatcgtgacatagggatcgcatccgtaagacacccaatggacccggagaattccaacagggtcctgggagtacccatcgcccccagcaaggtcatcaggcctcctactaaccgagttttcatcaagaagtattgtgcccccaggcaggcccgtgatcgacaagtcatcgcgcgtccaactcaagacgttaaagaagcgctactaggaggcagccaagaattggctacgaagaagctccccgcgaagtggtccaagaagggcaccattgaagaggattctagtgtgaccccacaagccgacacaggctttgaaaaacaccgattctag

SEQ ID NO: 12399 - DNA, 285 bp, Glycine max
  Peptide Sequence Number=SeqID_129177
atgacgacgttaatcactgcatgctaccagactctaagtttgacggatagcgaaaaagtgtgtgcgggttaccgtatagggcgtcttcgcgtgccaacggactcacaggtcacagtagcgaaaggtggggcgatcgacaaaagcgaggcttttgctcctacgtatcctcaatttgtggcgagaaactcagacctacgtagttctcaattttgtgagactaaaatagtcttggtgttttttacgctaaaatgcgaacatgctttagtaaagaaacaaaacctctag

SEQ ID NO: 12400 - DNA, 678 bp, Glycine max
  Peptide Sequence Number=SeqID_129178
atggcgcagtaccgcgcgatccaggcccgccttggcatccagcgcgcggtgctggtcacgccgtcgacctatggcgccgacaaccgccccatgctcgacgccttggcgcaactgggcgagcaggcgcgcggggtggcggtgatcgatggcagcgaaagtgacgcgcaactgcaagccttgcacgacgctggcgtgcgcggcatccggctcaatctctcgctgggggtcactagcaccatcgaccaggtgctgccgctggcggcgcgggtcgccccgctgggctggcatgtgcagttgctgatgccgcccgagcggctggcgcaactggatggcctgctgtcggccctgccggcgccgatcgtgttcgatcacatggcccgcatcagtccggcgcaggccggcgcgcatccggcccatgccctggtgctgcgcctgctcggccagggccgcgcctggctcaagctgtcgggcggctacctcgtcagcccgcgccacagcgtcgaggatcccgcgctggacgcgctggcccgcggctatctcgacgccaatcccgaacgcatcgtctggggcagcgactggccccacgcctcggcgtcggccggcatgcagcccatgcccgacgacgcgcgccagctcgaccggctggccgactgggccggcagcgcccggctgcgccag

SEQ ID NO: 12401 - DNA, 255 bp, Glycine max
  Peptide Sequence Number=SeqID_129179
atgactaaatcaaatagaacaacactcaaagggagttctctgagagatttacaaaaagataggatgagtaccctcacctttagaggactacacgtcctcgccttgagagggctacccgccctccccttgggtactagttaccctcaccttgagaggactacatgtcctcacaatcagagggctgcacgccctcacctccagaggactacatgtcctcgccttgagagggctacctgccctcaccttgggtactag

SEQ ID NO: 12402 - DNA, 183 bp, Glycine max
  Peptide Sequence Number=SeqID_129180
atggcacgcagcgtgtttgctctgtgccccttatttaagggacctatatgggagagatctaaaaaggtttttagtgataatccccaaggtatcatcatcttcgaagaacatactgcaacagtagggactactagcaacaatatgttttcaaagagaaaaactctagatgagggttcactataa

SEQ ID NO: 12403 - DNA, 953 bp, Glycine max
  Peptide Sequence Number=SeqID_129181
atgctcggctgctgcagtggacccacgcatggcgtggatctacaaggcgtcacgccactgccaaccccctcctgtagagccgagcccatgctcggctgctgcagtggacccacgcatggcgtggatctacaaggcgtcacgccactgccaacccccggtgcccacctgcagcacgtgggtcggccgcaacgcctgcagcaggtgccggtcgtggctgaccatcagcagcgcgcccggccatgccgccagcagttcttccagcgcctgcagggcatcaagatccagtgcattgccaggctcgtccagcagcaacagctgcggtgcgggatcggcatacagcacgctggccagcgcgccttttacccgttcgccatcgctgaggcgatgggctgcacgctggatgcgctgcgcgtccagcccgagcagggccagccgtgtgcgcagttcaccggtatcggccgccgggttggcagcctgcacggtgtcgagaatgctgcgttcgccggagagccccagcagctgctggtcgagcagcgccagtggtgcatgacgctgcacgatgccactgcgtgcaggcagctggccggccagcacgcgcaggagcgtggacttgccactgccgttgtcaccgaccacggcgatgcgctggccgcggcggacctccagttgcaacggtgcactgcaaccatgcggcagcaccagcgactccgcctgcagcagacgtgcgctgccgcgttcaccgtcaccggcgaacagcgccagctctggcgcggcgtgaactgccgaagccgctgcgcgcagttggtcgctgctggcctgcagacgatcggcctggacctgttgcgcgcgcccgtggctggcctctgcacgctgtttctgccggccaagcaggatcggtgcctggttggcctgcttcgcatcgcgattgccacgtgcctggcgctgctgctggc

SEQ ID NO: 12404 - DNA, 330 bp, Glycine max
  Peptide Sequence Number=SeqID_129182
atgactatgctaccacctacctttgcttacctttggccttggacttggtatggtatctaccaactcttctcctgtcctctgacttacaggacaacaacgatgcacatgcatgcttatgattgggcaattcaaggaacatttccattgaatttaatgatgacatctatgcattttcgggtgaaaaagaggctaagttttgaattgcaaaatgtagcagttaggctaagctcagcagctaggctaagcgcatatccaccgctaagcgtagcttcagcatgcttagcgcaaaggagaatctggcagagcatcagtatcaaagccgtgtgctaa

SEQ ID NO: 12405 - DNA, 189 bp, Glycine max
  Peptide Sequence Number=SeqID_129183
atgacgggagatgcatcgaaattcactcatatttctcccaagaaaagcggacatgtgacttatggcgacaacaataaaagtagaattcttggagtcggaaaaatagaagcaagcttcatgatgatgaatcaagttgattcaaatagttttgatgatgacaaagatgatgacaaaaaatccaaagaatga

SEQ ID NO: 12406 - DNA, 423 bp, Glycine max
  Peptide Sequence Number=SeqID_129184
atggagcgtacatccacttggttgttcaaagagaacaagggagggtacatcccttgtggatctttgcttgtaaaggattttacaaggttattggaaatctcaagaaccggtggttgcttggagactggatatatagaaaagaaaaggaaaaggattgcactcaaagttagttcctcaaaggaagatcataaagaaagctttagtgatgatgaagatgcaaataatttgaatttgtttgtcaagaagtttggcaaattcctcaaaaggtccaaagatagaaaattctctaaaccttcaaagaaggtggaaaacaacaacaccttcacatgcttagaatgcatgaaacaaggccacattaagtcggattctcctatgtacctcaaaaaacaacttgttaaaaaggaagggaagaagtatgggtaa

SEQ ID NO: 12407 - DNA, 255 bp, Glycine max
  Peptide Sequence Number=SeqID_129185
atggatttggagatgcaccttaattttactgagaatgctgaggaagaaagtaaagttatagttgctgtgagacaagggaacatattagcgactgctttccatcctgaattgacagctgatactcgatggcatagttatttcgtaaaaatgtcaaatgaaattggagaagaggcctcttcaagtagccttgttcctgcacaagtcagtacaagtcaataccaacagccccggaatgaccttcctatctttcaatag

SEQ ID NO: 12408 - DNA, 553 bp, Glycine max
  Peptide Sequence Number=SeqID_129186
atggtcgaaagaaaaaatccctatttgacaaggcttcttactatacctatgaattccattggacccaaaaatgatacattggaagaatcatctgagtcttccaatatcaataggttgattgttccgctcctgtatcttccaaaaggaaaaaagatctctgagagctatttcctggatccgaaagagagtactcgggttctcccaataactaaaaagtatatcatgcctgaatctaactggggttcgcggtggtggaggaactggataggaaaaaagagcgattctagttgtaagatatctaatgaaaccattgctggaattgagatctcattcaaagagaaagatatcaaatatctggagttcctttttgtatattatatggatgatccgatccgtaaggaccatgattgggaattttttgatcgtctttctccgagaaagaggcgaaacataatcaacttgaattcgggacagctattcgaaatcttagtgaaagactggatttattatctcatgtttgcttttcgtgaaaaaataccaaaggaagtggagg

SEQ ID NO: 12409 - DNA, 721 bp, Glycine max
  Peptide Sequence Number=SeqID_129187
atggcgcagcacgccgtgctcgcgcaccagcaccaccgcaccgaccaggcgcagcgggtggacctgctgcagcagccgctgcaccgaaggcagcgtcggtgcaggttcaagggaaagagcggcattcatcgcggtgatccgtggggagaggcccgccactccgcaatcggcatcatgcccggagctgtaacgccgcaagggctgcgcgaggccccgcaccacagtgttgcgatggccgcgccgcgtgccgcgatcacccgcccctaccctgccgttttcattgccggtacgcccatgtcagtcctggacaacctcgccaacctgcagaccttcgtgcacgccgccgacacccgcagcttcgtcgagaccggtcgcctgcagggcatctccgcatcggccgccggcaaatgcgttgcgcggctggagcacgcactgggcgtgcgcctgttccaccgcagcacgcgcagcatcacgctcaccgccgagggccagctgttcctggcacgctgccggcgcatccttgacgagcgcgatgccgcgcgcaccgaactggcgcaaccgcacgccgcaccgagcggcacgctgcgcatcggcctaccgttggtgggcgacctcaccctgccattgatggccgagttcatggccgcgtatccggacatccgcctcgacctggatttcagcgaccggctggtcgatgtcgtcgaggaaaggcttcgatgcg

SEQ ID NO: 12410 - DNA, 376 bp, Glycine max
  Peptide Sequence Number=SeqID_129188
atgatgctatccactaccaaaggtgcacagtcttacagtgacattagaacaatcaacggtctggtatatcctacatttagggaagcatgttttgcaaaaggctttctaggtagtgatcaagaatttattagtgatttacaggaagctaataattggggtattcgccttactgaaaaggaaacaattcatttatgcttaactgagattgagaatatgctacaagcgaacagaaggagcttgcgagattttccatccatgtcatacccaataggatatgcacgaaaccaacatcatactaatctgatccataatgaaatggcctatgacaaagaaatgttagcagaacaatacaacacgacataccaattgctcacag

SEQ ID NO: 12411 - DNA, 279 bp, Glycine max
  Peptide Sequence Number=SeqID_129189
atggacctgaaatctaccctaaggctcataagaaccctagggtcttctcttgcatctctggctcaatctacttggagtcttctatccaatgcccttgcgaggacatgtcactcggtttggaactcccttgtgactcaagttgatcaccatgggggagttgtctatgcacgacagggtgaccttgacacttgctgcctagttttcataagtgagagtgtcgcgtggacacggttagactatttcctaacaaatggtaccacattggatttaagagttgag

SEQ ID NO: 12412 - DNA, 237 bp, Glycine max
  Peptide Sequence Number=SeqID_129190
atgccgaaaaaatggggaaatgagtggttacagtggcgtcttccggaagacccgcgaaggcttctttcggaacttcctaaagaaggtgttctggaaattttttggaagaagggttcttccgaaagtaaccaaaggtcaactggaagaacacttcttccggaaatcttccgaaacaccttcttccagaaacttcccagaagaagtagttcttccggaaagtttccggaagaaagttga

SEQ ID NO: 12413 - DNA, 318 bp, Glycine max
  Peptide Sequence Number=SeqID_129191
atggtgatattgcacgtggccttcatgaaggtgcaaaagggatcgagaagcatgttgtgcaattatgttctagcagaagcctgtgaccaacctgactatgttaaattggctaaggccctttgtgtagagcacaatgttagcgtattgacaattctgggtgcaaagacccttggaaaatgggatggtttgggcaagattgattcggaaggaaaagctaggaaggttactggttgcttctgcagttgtgcagcattggggggggggggggggggggggggcaggcaggaacccaagtccccctccctcccatctttctga

SEQ ID NO: 12414 - DNA, 168 bp, Glycine max
  Peptide Sequence Number=SeqID_129192
tgtcgaaacactttagtatttcagcagagagtgattccagttcaactagcacttgctcaagctaacaacagactttgtttgcaaaataacatagccattgcagaagctaacacgagggaacaatgctggaagcaactaaagatgacgttggctcgggcttgggaataa

SEQ ID NO: 12415 - DNA, 347 bp, Glycine max
  Peptide Sequence Number=SeqID_129193
gaggaagtggtacttgaacccgatgatgatcttggacatttgagggcaaatgttttccaagaaggagggaatgatgagaatcctgaaactggccaaatatatgctaaaggcccaagttccttgttgaaccaatatcagacttatcaaagtaatccttgtggcgtttaccctgacttatcttccttcaccggaagtgacgtctatcctaacttatcttccttcatcggaagtggcgtcatccaaaaaaactctacagccagtatcaagcgatccgctcctagtcaggatcacatcaccatagatggtttgagagtcctcaaaaagactctcataggagagacactgat

SEQ ID NO: 12416 - DNA, 258 bp, Glycine max
  Peptide Sequence Number=SeqID_129194
atgacatgtggagataccttatggtcatccgcgcctttcgtcgaccgagaggaacgaattcggcagtatcaggatgatgttggtcattcggtgctgaccattttcaaaatttttgcagggaccatctgtttgttgggatgcgtgcttcacttgaccacttcgaggcccttgacacccattgttaggcaatctgtgaagttctgcgacatgtggggagtcgaaaggaagcgtcaatgcgcaatccgtaaagttccgtaa

SEQ ID NO: 12417 - DNA, 318 bp, Glycine max
  Peptide Sequence Number=SeqID_129195
atggatgagacaattactaatttcatagaaagatttaggaagttgattagcaaatgtatgacacaacatccaagagtagaatatgttaatatggtcatgagtaacatgcaccctctactaagagaaattttgcttacacaagattgtctagacttgaatcttctgacaaccaaagtgtttaggattgaccaaatcattactacaaagcagcaaggaggatataattgggaaatggagccatacatggaagtgaaagttatgataagcttggaaaagcaaccgattgtgactacagttcgacagctaaagtcatggtag

SEQ ID NO: 12418 - DNA, 285 bp, Glycine max
  Peptide Sequence Number=SeqID_129196
atggatgacactgttactcaagcaatgccatgccttgcgatcataactttgatctccctcggcctaagtgccagttggtgtaggccacccaccaggcaccctctagacccggataagtctaacagggcccatgggtttccggcgttgatcacgggcctctgtcagtcattcgaggccgcagatgcaccaccaccacctcggcaggccgatcccactggatcactaggcatggagcgttatctacagcacttggttcgccagcaggcggccaaccatcgggggtag

SEQ ID NO: 12419 - DNA, 312 bp, Glycine max
  Peptide Sequence Number=SeqID_129197
atgaaatcttgggcttgcactagccagagatgtaatgaatccatatggcaatttaagcactcaacacagttcatggtcagttctactagtaatttacaatttgcctccttggttgtgcatgaagcaaaaatatgtgaagaaaatcctccccgcctggttgccctaggaagaatttatgagggatccacaaccattcacaacatccctttgttgcttgatcaagtgaaggtcggtgttgaggaggttaaagatgcagatgctcccgttcctgtacccactgacaaggttaacttagtgggggcagacacttaa

SEQ ID NO: 12420 - DNA, 525 bp, Glycine max
  Peptide Sequence Number=SeqID_129198
atggcaagagtagccaaggtagttaaaatcttggtacaagagttggaccatgtgaagcaaaataggaacgggttagtcaaaataccaaggaagcgtttggaggaaaaggcgaagacattggcagatcaaggggaatgggcttcgtttattgacatcttggcactgttgatatttggagtcatcctctttccaaatgtggaggggttagtggacctagcagcgattaatgctttccttgcttatcaccatagcaaggaaagctcggtcattgctattttggccgatttttatgacacgttcgaccgaagatgcgaaaagagcagcgcaagaattcacctttttcgccaagaaagtaggcccgcctatccactgcaaggtcactgcttatacgccaagaaaggaaaggcaaacttggagcaactcttggctagtgtggtaggggcatccattaattggttccccgttggaaggaaggaagagccggggttttgtcctcatgtgaaggatttccaaatgttcccttga

SEQ ID NO: 12421 - DNA, 570 bp, Glycine max
  Peptide Sequence Number=SeqID_129199
atggatcttagaactcaaatgtttcatttacgcgctaagcgcaacgatgtgctaagtgcctatttcgtatttcagtttttaaaacaaagtgttttcgtgcctgtgctattgcaaacctcttcccctgcattcatcttgcttccctctgcattccacatcatccaagctaagcgtgcctatgtgctaagcctgaagttcatttatgttaaggctgagctaagcgcgctctgttgcactaagcccaagccccttacgatggcatctaagaaaaggaagtctatgacttcttcatcttcccaggccaaatttgacaggtccaaattccattcactagaggcctgggatagatataatgactttatggtcaccaggaagatcctcccaaagaggaatgtggtggtttatcacacaaaatttgatgaatttaaagaagaacttatgcgaaggaaatgggatgagaagcttaccactttcacagagggcagcattgatgttgccatagtcagagagttctacgcaaacctctttgaccctgaagacaaatcacctaagcaagtgagggttagatga

SEQ ID NO: 12422 - DNA, 231 bp, Glycine max
  Peptide Sequence Number=SeqID_129200
atgagagatgctcaagctttgggtgtattcaatagagagctccgagtcttgatgcctttctcatttgcttcctactccttttataggcctaagcgaggtgagcatgcactgagcgcggtagtgcctgggcttggcgaggtgattacgcgcttagcgcaggatttcatgctaagtgcacctttaggcttcctcgccggccttcgtcgcgttaagcttgagcttgaccgctaa

SEQ ID NO: 12423 - DNA, 594 bp, Glycine max
  Peptide Sequence Number=SeqID_129201
atgtctttttgcagttatggaggatcaggacacaaagcggatggcgatgaggttatcatatgtggtgctggattgcgtgatgccatacatacacgactccaaggaccgcgatgtcgtgttgtaggtgtgccactggttgtacaagctcaactcgctcacatgttaagacggcggttcctgcacctcaagtcactaaagctgaagggaaagccacgggaggcgatgttcaaggattggggaggtttcgtcacaactttggtcatagatatctctcaatacttcaattgcttgaagtcacttcactttcgacatatgattgtaagggattcagatcttgaagttgtagctcgttcgcgtggacacatacttcaagcactcaagctggataagtgctctggattctccaccgatggcctctactatatcgaccgttattgtagatttaagtggagggttaataacacatgtccccacagtctaaccgttgggagttttaaaataacaaatttggacctctcgcttagcgcaagaagcgcgctaaacacaattccagcccgagagggaattgtgctgagcgagaattgtcgcgcttag

SEQ ID NO: 12424 - DNA, 207 bp, Glycine max
  Peptide Sequence Number=SeqID_129202
atggcagtgatggacaatgacaaggcgactatggtggcggccacttgtggtgcgatgacaacacgaacgatggaggcgatgaaagtggtgtccattaaggatggtgtcatggttgggtggcgcgtgtgtggatctgggggaaggaggtggcaacgtgacagggagctagggaagaaaggtgatggtggctcggtgaaggttcaatga

SEQ ID NO: 12425 - DNA, 240 bp, Glycine max
  Peptide Sequence Number=SeqID_129203
atgtattgggagaattgtatgataacctttgctggaggaaagtcaaatgttgcaggctacaaggatgggcctaatgttggcgggtcaagtggcctagaaaatcgaggtcagacaattgcaaagatgcaaatgaggtcaaatatcaatttgcacgcacaagtcccccatcacctgcaacttaggactgttaactcaaggctagattggaaagttggaaacttaggacttgttatgaactag

SEQ ID NO: 12426 - DNA, 669 bp, Glycine max
  Peptide Sequence Number=SeqID_129204
atggcttctaggaaaagaaaggcaccctctacacctacccaagccagatttgatagatctagattcacttcccaagaggcttgggagagatacactgacattgtggtgcctcgtaagcttttaccagaaagaaatgtggtagtctactatacagagttcgatgagttcaagaaggaactcgagagacgctattgggatgaggagttgactgactttctggatggcaacattgatgttgccattataaaagaattctatgcaaacctctatgaccccgaggaaaaatcacctaaacaggtgagggtgagaggtcatctgattaagtttgatgaggatactcttaacacattcttgaagacccctgttgttgtggaagagagggaaacactttgtgcttactctagatttgcactcctgaggcctgatcctcaggagttagctgctaagctctgtatcccagggaggggattcgagcttaatgctgatgggaaacccttgaatattctgaggaagaacatgaccactcttactcagacttggagcgttctttccttttctaacctcatccccacttcccacacttttgatgtcactcttgacagagccaaactcatttatggcatcatcatgaagatggacatgaatatgaggtacctcatctcccactag

SEQ ID NO: 12427 - DNA, 226 bp, Glycine max
  Peptide Sequence Number=SeqID_129205
ggattgtgcccgcaagacacctagtggacccgaagaaggccaacagggtcttggagttgccagctctaaatacgggtctctgtcagttctagggagtgcctgtcgccccagcaaggtcatcaggccccccctaccaatcaagctttcatcaagaagtactgcgcccccaggcaggcataaggcgaaacaccacaacagcattgggatggccggtagcgggcaatag

SEQ ID NO: 12428 - DNA, 204 bp, Glycine max
  Peptide Sequence Number=SeqID_129206
atgactgaggagccaccagtagcagtagaggagcagactactccaaatcagaccccaaaaccatctccatcctctgcacctgctcctgaggagacccagccatctacaccaattgcggagcctgagcagcttatacaagattcatcagcagctccaacacaggatcttaatgaagaccagccacaagaggagcaagacgtttaa

SEQ ID NO: 12429 - DNA, 285 bp, Glycine max
  Peptide Sequence Number=SeqID_129207
atgggcttaataagcggaaaccagtttggcctattaggggataatggaaaccctaataggttaaaacctaaggaatggttatggtccctaagacaccaaatcaagaaacagtttctcctctccccatcaaaagagaaaatgaaggcccgtaaggaagaaggtgatttggttgaggaagttcaagatgctgaggtcttttgcaatcagctgccaagatctttatcagctaagtatctgtttttttttataagagctaaatatttgtttcatctgggttattgttaa

SEQ ID NO: 12430 - DNA, 294 bp, Glycine max
  Peptide Sequence Number=SeqID_129208
atgcagaacaccagatggtatattaaacttacttcaagccactatgactcctactcaagatgtcatgctatattacaacgagaggtggaaaatgccacgccaagacgactttgtgggttactcgttcacaataaaaatccaaaaagatttgacattccttcgggatgtagcatcgacagactcaaggatgtgatcaagcaagttgcacctcaagggattcccccttatggtattcatgaatcacaaatagtaagacaattattttttcgacagtcggaacattctgagtattaa

SEQ ID NO: 12431 - DNA, 546 bp, Glycine max
  Peptide Sequence Number=SeqID_129209
atgagcataacatcatcaacaacgtcatgcgagcatgcctgtgttattgcagatgaggaatctaattatgaggtgatcctacaggactatataaaaataccagcattctatcatgaacattgggcgccggactaccccaactttgcccactttcactatgacagagcctcataccaaatacgactcagacaacatcgaggaaaattgttctttgctgatggcctcaaacacttgagaaaatacttagacatctacgagtcagtaaccataaattttatggcgtgtaaacacagatggattttcaacctccatttcactcctccactggaacaacaagcatgcggcagacccctactggcaactagaatgcatgtttggactcttgaactcacacaggctctgcttggtgatcctcaaccactgatgcttccacctcttgcagcaatacatcttccttcttgtggttttcatatgacagtcttaagaaagttcggccctccattccaatggccaatccttccagttgcccctggctttcatggctag

SEQ ID NO: 12432 - DNA, 615 bp, Glycine max
  Peptide Sequence Number=SeqID_129210
atggatgctagatggatgcagttcggtgactatattgcacctgtagggaaaatttgtgtagcgcttggccaatgttcgtcatattacatggagtggctctacatgatttcacatccgtttatgactccggcacaaccaggggatcctcctagagttccgccagtttatcaatatgacacatttgttgaaccatatgtgtctcaacaatcggtggcggtagtgacacctgatgaagtagactttgaggtgcatcttcctggacatctagtggatggttatgtagcaattgctgataaattggatagactactgaacctgaggatcctgatcgaaggaacaaaagtctatactgttgctgaagaatgtctaagcatcataagaagctacattggtcaactaactagaggtcacagatcaaggcgtaggcgaacaccagatggtatattaaacttacttcaagccactatgactcctactcaagatgtcatgctatattacaacgagaggtggaaaatgccacgccaagacgactttgtgggttactcgttcacaataaaaatccaaaaagatttgacattccttcgggatgtagcatcgacagactcaaggatgtga

SEQ ID NO: 12433 - DNA, 481 bp, Glycine max
  Peptide Sequence Number=SeqID_129211
tcatttctttgccgcccttggtgcttcttcttcctcgttattcttcttccttagttcgtgcgcattccttgttgcttcttctttgtggttcttcttcttccttcgttcctgcttcttcttccttgcttcttctttgttcgtgttcttcattgcttctatttgcactccgttcattgacgcatttgcgttctcctttgaggatcctcttatggccacggaggaattaaacgaagagcagcaacaaccacctgttgaagaaggttttactaatgttgagggtttttcatgcggaccccatgacacatcagttttgagagattttgaaaatcacattgctttgagagaacgtcctcagctgaagctatcttcccatggaaggcagatggctaagttcggtaggcctgctctagagattgaaggccttgtggctgccaacggactaagtcctttgatcgcatgttccctagatacgggcgattga

SEQ ID NO: 12434 - DNA, 333 bp, Glycine max
  Peptide Sequence Number=SeqID_129212
atggtggcgtggatggcggagacgacggcaacaagggagagggcgaagagggcacacgtgcagaggagcgagacggcggtgtcacgggactcgtatcaggcgtgtcgcgcctcgaggcgcatgacggtgatgggcgcgacagcctcgatgtggaggatgcaggattggacggggaaggtggagattgtgaggatgaagaaaaaccaagaactggtatcagagccctttttcttacctttgtcttacgagacctgtagaatggaatgtgaatcaagtttctcccaagtcactcttccaatctttgttggggaggttatgacctataggcagtaa

SEQ ID NO: 12435 - DNA, 849 bp, Glycine max
  Peptide Sequence Number=SeqID_129213
atggatcaggatcaagttcaaaatcaaccaatgcaaaaggaaattgaaagaaattttattcgtcttgccaacactgcagaaagaaaggttatcctccatttagatgttgaagaagacctgatgctaagtgcagtgagtgtaatcaaatggggcatgaagcaattatttgcagaaacaagaataaaccagatggtgaagttgcaagggctgctcatcaagaggaggaggagtacctgttttttgctacatgtttctttagcattgaatcaagtcaaaattggcttattaacaaacaaggatctactcaaggaactaagaaattcatgcacattgaagattcatgttggagatggcaagtacatcactgtgaatgaaaaaggaactgtagcaatatcaaccaacagagatacaaagttaatttttgatgtgttgtatgttcttgaaattgatcataatttgttgagtgttggacaactagttgaaaaaggttataaagtgttgttcgagaacaaaatcttcttgattaaagacgttggtgacaaagatattctcaaagtaaaaatgaaaggaaaaagctttattttaaatccattggaaattgcttttccagtaaaagagaataacactgaattatggcacaagaagcaaaaagttgttgaagatcaagctagttctgaaatagcagctctcacatcttggaatggtgctgctgaagcaaggttggcagctgcaacgggacaagaaaaatctactttagagaaagtaggtattgtgcaggagcatacaaacaagaagatacaattgagagagaaagctgcaaaaattgaacataatgtcacaagaagatag

SEQ ID NO: 12436 - DNA, 147 bp, Glycine max
  Peptide Sequence Number=SeqID_129214
atgagtgaccctggaagattactcaagtacttttgttccgcaattcttcacaagcattgcgcggccagagagaggcaaaaagatggctctattcatttaaaggtaatagtcttaagacttgggatgaagtggtggaaaaattcttga

SEQ ID NO: 12437 - DNA, 429 bp, Glycine max
  Peptide Sequence Number=SeqID_129215
atggtaatacccatcggcattggaaatgatacaatgtttgagcctatcccttttaacctaacgaggtatgccgaagggtgcaaggaacaatatggtgtctcacctcgccctcattgggtcactacttactatggaggccataatattaaattggtccttcgaagattgggtagcaacattattttctccaatgggctaagggacccatatagtattggcggggttctggataacatatcagacagcatcgttgccgttcatacagttaatggttctcattgcctggatcttctgcgggcaaatcaaagcgatccaggatggttggtcgaacaacgaaagaaagaggtcaagatcatcaaaaggtggatcacacagtactatgctgaccttgatgcactcaaagacaagccaaaattccagagcaaatga

SEQ ID NO: 12438 - DNA, 384 bp, Glycine max
  Peptide Sequence Number=SeqID_129216
atgttggttgcttctaaacaacctacttctagtgcatctgtgcgctcaccagagcttgacccttattccgccactaacactcttattgcctttgataaacatcaccaaaagttcattctgggcccttgctttcttaatgatggcgaaaatactgataaaacggctaacaagccgtttaatcatgagaaaaatccttttccaatcacttccatcgatatgcactggccacaggatgtatgggtcaaaatcttagggttttggtcgatagctatcaaggggttcatgcttccaaaagctatggctggcttgactcttctaaatgtagtggctattcttaacttatcgattcatggtgaggaattacgcttactctatggaacatga

SEQ ID NO: 12439 - DNA, 676 bp, Glycine max
  Peptide Sequence Number=SeqID_129217
atgggcaacaattcagttgtcggaggtgaaaatgcgatcgtgctcagcaccggcagtaacgccagcgccagcaacgctgtcgcgctcggtgccggttcggttgccagtcgtgcacgtacggtatcggtgggtagcagcggcaacgaacgccaggtcaccaacgtcgccgcgggcacccaggccaccgacgcagtgaacaaggcacagctggatgcggttgcgaccaccgccaccaccaccagccgcttcttccaggccagcggcaacggcgacgacgtagccggtgcactggtggagggtgacaacgcactggcggccggtgatgccgccaacgccatcggcaatggcgccaccgcactgggcagcggcgccaacgcgctggccagcaacgcacaggcgctgggtttcaatgcacttgcaaccgcggccaacgccagcgctgtcggtgccaacgcacaggccacgggcgagtacgccaccgcgcagggtgcggaaagcgaagccagcggcgagcagagcgcggcgttcggtgcggccagcatcgccagcggcgccggtagcactgccaatggcgtgctgtccgaagcgtccggcgaagaagccgtggccgtgggctacttcagcaatgccagcggcgacgcggccaccgctgtcggcagcgagagcgtggccagtg

SEQ ID NO: 12440 - DNA, 993 bp, Glycine max
  Peptide Sequence Number=SeqID_129218
atggagcgtcgctgccaggaggtcatcgaccgctgcgtggcgatgggtgccaacaacccgatcaagttcttccatgacgtcggtgcaggtggcctgtccaatgccatccccgaactgctgcacgactcgaacgtcggtggtgtcatcgacctgggcaaggtgcccaccgatgacccgtcgctgtcgccgatgcagctgtggtgcaacgaatcgcaggaacgctacgtgctcggcgtggcccaggagcgcctggccgagttcgccgcgctgtgcgcgcgcgagcgctgcccgttcgctgccgttggcgtggccaccgctgaagagcacctggtggtcgcctacggcgccgtgccgggccacaccccggccgatgcgccgatcgacctgccgatggacgtgctgttcggcaagccgccgaagatgcaccgcgacaccgcgcacccgccggcaccgcgctggccggcgctgaaaaccggcggcctggacctgcaggaagccggcctgcgcgtgctcgcgcacccgacggtcgcttcgaagaacttcctggtcaccatcggtgaccgcagcgtcggtggcctgaccgcgcgcgaacagatggtcggcccgtggcagctgccggtggccgacgtggcgatcaccctggccgacttcgacggcgtggccggcgaagcgatgtcgatcggcgagcgcaccccgctggccctgcttgatgcggctgcttcggcacgcatggcggtgggcgaagcgctgaccaacctgtgcgcggccccggtcgatgcgctggatgagatcaagctgtcggcgaactggatggccgcggccggccaccccggcgaagacgcgctgctgtacgacgcggtgaaggcggtgggcatggaactgtgcccgcagctggacatcagcatcccggtcggcaaggactcgctgtcgatgcttcgcagtggcacgaccagggcgaatcgcactagagcgtgtcgccggtgtctctggtga

SEQ ID NO: 12441 - DNA, 633 bp, Glycine max
  Peptide Sequence Number=SeqID_129219
atgcagtcggcagatgaagaaggacctaaaaaacctaaacccttgacctcaacacccatcagcagtgtcggcggtagatctattctatttccttacaagaacaaccgcgcagttccgtggaggtatgcccctccgggcgttaggaagggagaagctaccgatatcagctcactatcggccaaagtgaccaacatcaccgggctaagcggcataacccgcagcggtcgcgtgttcgcagcccctagcctgctgatacagcccgcaatcactaaagggaaagcaaggatgaccgaaggacaaaatgtcaaagtgatccccgcaccggacgaggatgtttcgacgaaggatctttataagggaagagagggctgtggcaagaaagaggtcttgaatgaagctcatgtagcccaagacatcttcgtagaaggctttgggggaatcgtcaataacatcacagctaacaactacctcaccttcgctgaagaggaaatccccgccgaggggagaggacataacagggctttacatgtgtcagtcaaatgcatggaacacgttatggccaaagtactcatcgacaacggctcaagcctgaacgtgatgcccaaaagcccgttggagaaaattaccatttaa

SEQ ID NO: 12442 - DNA, 1295 bp, Glycine max
  Peptide Sequence Number=SeqID_129220
gtaaggcttctgaggtaaaccttgttccactgaacctgaaaatcgaggcaacctgtaggaagaacaacgccttaaggaggaggagagagcagttagaaaagcaagcaaatcaaggagatagaggaatctcatcctctacaacatcctcaccatctccacttgatttggaagagtcaactatatccactcctttttctatttttgcagataactcaatggcaggagatgagccacagagagttaccttagaggactattccagctcttcaacaccacagtactttacaagtattgtgcggctagaggtacaagtggccaacatctcttaccaacattctctaatagagttaatacaaggtaacctattccaaggattgccaaataaagatccttacgcccacttggccacctacatagagatatgtaatacagtcaagatagctggtgtttcggaaggttatggagaaattcttgaagaaataccttccaaaatcaagacaacacaaggcaaggctgggatttcttcatttcatcagtttctagacagatcactcaatgaagttttagatcgcttctacgcttctgttggttgtaagataaaattgaaaatgcctgatgaagctatggagctgattgaaaacatggcagccagtgacatcgccattcttcgtgaccaaacacacacacccaccaagaaaagtcttcttgagctaacctcacaagacgcattactgactcagaacaagcttctagaaaatcaactggagatcttgacaaaaaccctaagcaaacttccccaacaactacattcaggtaatcctgctaatgtttttgtaatgcaggtaggaggttgtgctttgtatggtggagttcatgagttaggcacctacatgactcaagaggaagcatcaaaagtggaggcaatgcaaggtttcatccatgaggaaatttttctcagaagcaaggtcaagcttggaggttccatcaaggatgatggtgaggtcttgaactctaagaccaagggccaattagccagagaaggcaagagggaagcaccaactatacctgccaaggatattccatatcctttgataccttcttggaaagacaaagacaaatattttgctcgctttcttgatttttttaggaaactggaaatcaccatcccctttgatgaagtgttacagcagatgctgatgtacacaaaattcatgaaagatctattaacgaagaagggaaagtacaccgataatgagagcattgtggtagcagaaaactacaacgctttaatctag

SEQ ID NO: 12443 - DNA, 510 bp, Glycine max
  Peptide Sequence Number=SeqID_129221
atggaggaaaaacaaaagaaacagttggagcaagtagcccaatctgggagctttgaaacaatcattggtccttcatctcctattagacgacacatgaagttgaagatggttcgcacaaaaatatcaggtcagatgaaatatgaggtgaaacaccaaattgctgataggattgattccctagaagagcaatccgcacagggtagctttgtagcctatggacgtcaagatgtactgactgctgtcattgggcgactagagcaccctagctgtggaaatgtacttcctgttgagcctaaggtagctcattccgatgcccgtgtcagcataaagggaagctatgttgatccctcagggcaggacccagacatggatgcatcaaacaggtatgggttgtatgataaacaactaccaaagggatcagtgaagcctattgataggtcggaacttgatgatgatcccatataccagatgacattgatgaccctgcaacttttcctcaagcctatgtag

SEQ ID NO: 12444 - DNA, 218 bp, Glycine max
  Peptide Sequence Number=SeqID_129222
atgaagaataaaaaggttgttgtggctggtgtctcgctaagcgaggcttgtgcgcttggcgagaatcattcgctaagtgagacactcagcccgcttagggagttgggagaatctaccaagcatctacgtgctcagcgaatcatcagctcgctcagggagtcgtttgtcttctctcgtgctaagtgcgcccagctcgctcaacagattttcactaactc

SEQ ID NO: 12445 - DNA, 426 bp, Glycine max
  Peptide Sequence Number=SeqID_129223
atgggtcccaggtgctctatgctgcattcatatcagctgcataatctgcatcaacagtgccatcctcctcctcagagacctccaaaacaggctctgcagcatcgacactgttcggagcatcagcactgtgctggaactgatgatggtggagcagagggacctggagctagagaaggagtagggggtgttgaagcaagagcagaagaagatgagccctcagatcctcgagcccgagccttgtgggtccctagaaatatgatcatgggatcttctaggttccagcagttcttctttatgtatgccaaattaatagcagggttgagggactcgaaagtcagagaatctgagataactcctcgggcaaagcataaggtggtgatcagggctaaaaagccgagcctcgaggagttggactgggccatctaa

SEQ ID NO: 12446 - DNA, 504 bp, Glycine max
  Peptide Sequence Number=SeqID_129224
caacaagggcaatggaggtcccatccgggcaatcaattcaacaaggaccagggtggaccatctaataggcctcagcaacaagggcctagcctatatgataaaaccactaagttggaggagacccttgctcagtttatgcatgtcacaatgtccaaccacaagagcacgaagtctgccatcaaaaaccttgaaatccaagtggggcaattggccagacagattgcagaaaaatcttctagtacttttggagtgaacattgagcaaaatccaaaagaagagtacaaagctgtgatgaccagaggtaggaaggccattatgattgaggatgaagagagaatagttgatgataaccaagaactagttgttgaagaagaagaagaagagagggaagatgaagaagactacacagtgattcaacgaatccttccaccgaagcacaaagatcctgggagtgtcacaattccatgctctattggttctgtgtctgttggaaaggctcattga

SEQ ID NO: 12447 - DNA, 354 bp, Glycine max
  Peptide Sequence Number=SeqID_129225
atggcactaagcaaaccttcgagtaaatcttctacaggtgatctagttccactggatttggaaattgaagccacttgtagaagaaacaacgcaaaaagaaaaaggaaaatactgcaggacaggacaacaccaccaattcttgaggaacctcaatcatccgagtcgtcttctatctttccacagaaaagggaatctacaacaggggcacctgaggccaacataatggctgaagatcaacctagaagagtgacccttgaagactactctagttctgctgtgccacaatttttcactagtatagagcgaccaaaggttcaagcacataatattacttatcctcattctttaatttag

SEQ ID NO: 12448 - DNA, 483 bp, Glycine max
  Peptide Sequence Number=SeqID_129226
atgaggattcaactccgattaaaacgttcctcttggtgtggtggtttgacggtaagcaacagcggctcgtggtggccatcagtggtcgtgggtggtggagaagaaggtgttagggttttgggtgggcgtttgaagaggaagagagagtccacttttggcgctaagcgtgacaattctcgctcagcacaattccctcttgggttggaatttgcactaagcgtgacaattcttgctgagcgcaattcctcttgcgctaagcacaacaattctcactcagtgcaattccctctcagaattcaaaataaatgtttttttaatttcggggccccgcaaggagagtactcctcgccactgcaaggactgcaaggacccacgaggatagggacaaggggaaaaaatcctgccgtgggggagggagagtactccccgcccccgctctgccccatcgacatccctacctatgtccctccacttgtcttgtga

SEQ ID NO: 12449 - DNA, 376 bp, Glycine max
  Peptide Sequence Number=SeqID_129227
atggcagaatcgtcaaagaagcgaaagggatcatcctccaccaccgctgctgctggccatcgccgccacggaccatctgaagcacccacaacaccaattcatccttccttatcatctccacgatcatcaactctattttcttcagatgatcagcgtatacggtacaattctcaattttcttctaggatcatcttagaccctaagtacctagacatagatttctttaatgatgagacatttgactgttatcaagtgtttcaaaattctggattggttgattttatgtccttaaaattgccttactatcctgaacttcttaaagtcttttacaacaatttaaaaattcaggatagtattatttcttctgaggtgcatg

SEQ ID NO: 12450 - DNA, 147 bp, Glycine max
  Peptide Sequence Number=SeqID_129228
atgaaggaggagtgtggttgtgcatcgccattggatttcgtgagtatttatagaggaggacgtgatgtaatcgattacaagatttgttgcactggtattgtcacacctaattggtatatgatcaagaaggattccataatcagatag

SEQ ID NO: 12451 - DNA, 321 bp, Glycine max
  Peptide Sequence Number=SeqID_129229
atggaggatgaggagaagagagccttgatgggagaaatcaaggaggagtgcgtgagccccgataagagtgagcaggagaagcaacgacagagcaaggtcccagaggcagagatccacctctataggcaggggaagggccccatggcggtgttcaagtcagcgctaggcgactgggagcaggaccagctcgagttcagggaggatatcctcgagaagcatgacatgaagttggtcttcgcgttcaatcccaccttcagtaggtcggttttgacatatagggatgttgttgttgtttacctcgatggagaacctaaggattga

SEQ ID NO: 12452 - DNA, 369 bp, Glycine max
  Peptide Sequence Number=SeqID_129230
atggttttgaatgaaatccagaaggctctagaggaggaataccatcacaaccaatcagaggcaacaactaattctatacccagaattcaacctttggtcactaggcctgtaacaggcattgaagcatttggacctcctccaatgcaaaaccaaaatgataaatatcgattgcagttgtttcctctatcacttaccagcatgacattcacgtggtattcaagtttgccaccaaatttgattaatagttgggctgttatggaatgttgtttccatgataccttttacagccctcaacaagacattttggtagccaatttgatgaataccaaacaattggctgacgagtcaatcactaaattcttggaatga

SEQ ID NO: 12453 - DNA, 438 bp, Glycine max
  Peptide Sequence Number=SeqID_129231
atggaagtgctagaagacattatgcaaatgatagaggcacacttatttgagaagttatccaaggatttggttgagcatcggctacctttgaaggagggttttaagttgtataagcaacttgctcagggttttaatccagaggttttgcaaatggtcaagaaaaaggtggaatgtttgttgtcttcagaatttattagaaggacggagtacgcggattggttgtctaatatagttccactcattaagaagaagaacaagtgggtagtgatgcctttcatacttaagaatgttggggccacatatcaaagggccataaatttgatatttcatgatttgattagcatgactatggaagtatacattgatgatgggattgttaaattggctgagtttgaccaatgcttaatagacctggaacaggcattcaaaaggaattga

SEQ ID NO: 12454 - DNA, 297 bp, Glycine max
  Peptide Sequence Number=SeqID_129232
atggatgagttaacgcttgcacttataaagaaaagctggtatatgtgctattcgcgagtccgcataaaaacctcaatatcacaaagcgctaagaaattctttgatgaggacatgaccaagagcaagggcaaggatccacttgaaggacttggaggacctatgacaagggctagagcaaggaaagccaaggaagctcttcaacaagtgttgtccatactatttgaatacaagcccaagtttcaaggagaaaagtccaaggtcgtgagttgtatcatggcccaaatggaggaggactaa

SEQ ID NO: 12455 - DNA, 285 bp, Glycine max
  Peptide Sequence Number=SeqID_129233
atgcggcgacactcagtggttttccggtattgtcgcactttttatgaaggagaggatggtggcgttggagggggtgtacggtgcaggggagcggatcgggatgatgtcagattgggagtcacgagtgaggtcgacagagctaaagttgtctgtggcgcggccagtgatttgaaggagcatggtgacagcttgttggaagtgggtgggggaaggtgtggagaagtggttgccgacaatgaggtagatgatggggacgacgagaatggaaagggaggagtggtttga

SEQ ID NO: 12456 - DNA, 433 bp, Glycine max
  Peptide Sequence Number=SeqID_129234
atggctaaaatctggattgaggtatgcttgatatccgctcgtggggtgaggggttcaccctcactttggaagcgtcagtggtatgctgtagggtgggttgatcctaagagcaagtactgcaccaaagttgacacttctgggaacaccaaccctatttggaggactaaatttgctgttcatgttgatgactctgagccggatcttgcactccacgtggaggtttacagcatagatcctgtgtttctaactgagaagctgcatggctcagctactgttgttctcagagagtttctggctaaggaggtccacaacaactctgaggaagtgggaagctaccagttgagaaagaagaagtccaacaaaccaagtggtttcgttgatgtttcaatccgtgtttctgaggacaaggaagaacctaatttccacccacaag

SEQ ID NO: 12457 - DNA, 360 bp, Glycine max
  Peptide Sequence Number=SeqID_129235
atgggtgcaccacggggtgcaatgcgatgccgctatggtgggctatcgtatgagaagcaatatatgcaggaggttcagcttagagcggcagcagagcagaatgtagatcctaaggaagagcaacctgctgttactggaggaactggaaaggcagaagcaattgggggcaatgtgaagagtaggccttctaattcatcctctactgaacaagacttagatacatttcttcttggagatcttgaagacagtgatgaagctccagatgacggtgagggcagttttgatgatgattttgacaagattggcaattcagatgttgaagatgagaagcatgtgaagaaaactgctgcaacagtttag

SEQ ID NO: 12458 - DNA, 234 bp, Glycine max
  Peptide Sequence Number=SeqID_129236
atggctcttcctccttttgttcccgtctttaaagctaaagagcttgaaattgaaggaagaaagtttcctctcattattatgttaaaagaaaaaagcctcaagattttgcattcacaggtattgttacctttcaatatgaacaatttttcccatgcctttcttggttcttattggctagaattgaaactcgaagaagccttagacccatatcttccttctaccgacgaggagtga

SEQ ID NO: 12459 - DNA, 342 bp, Glycine max
  Peptide Sequence Number=SeqID_129237
atgcgggtctttgctggtcacgttgaggtgctaagagccaattgtcatgcgatccggggtgttcttcagccttgggcccatctaggcccatcaggaagcttctacatgaagcaaccagcttgcctgggcaagctgagctcgcctgggcaagcatgttacttcgggcttaagctaccagctcccttgggcaagctgggcgacaagctcctcccctatttctgctataaaagggcatgggaggttgaaggaaagggttcagcacccttggtaagcatattcaacttaaaattagtgaaaagaaggagaaagaagaagaaaatcaaggctgagacacttccgtaa

SEQ ID NO: 12460 - DNA, 967 bp, Glycine max
  Peptide Sequence Number=SeqID_129238
atggatcaagttcaacgtcagtcttttaacaaggaatggagtggtgggtataccgaggaagtgtttggaggagaagacaaacttgtggatctggctacgattgatgccattcttgcttatcaccatagcaaggaaagccaggttgttgctatgttggcaaatatgtatgatacgttcgacttgagatgtgagaagagtagtgagaggattgtttgtggtacacttgctctttatgtatggttggtgtcccatgtccttgatcatggaagtagatctatctatcctctacaagctcttcgcatgtgcttaggaaaagacaaagtccgtaaggcatggaatcaagtggaaaggaaagataaagagcttaggggaagaagcaacagtgtcataggtggttatcacaaatggctggaatatagagtgcaagggattgctttgctaaaaaagctagagggtctgaatgaggtagagacggaggtgtccgaggagagggaagaggtgcgagtctttaaggatgagttggaaaggacaaaaatggcgaaggagaagatgacaatggtagtcactagagttaggaaagaatgtgagaggctgaaggatatcaacatgtccactgctgaagcgctagagcaggaaatgaggaaagctcgaggggaagcatcgagcaaaaaaaggttccaaggggctttgcttggcaatagcaatgaggtcaaactgagaaaggccaagacaaacaaagcaataactgagaataagaatatgttgataatcattgaccaatatgaagggaagatggatttttccattattcaagggcaggcgctaaaagatgaacaagcaaaggtgttggccttacgacctgaaaagaagggtacatctcttatggagggtacattcactaggttcaaagagaacaagggagggtacatcccttgtggatctttgcttgtaaaaggatttttacaag

SEQ ID NO: 12461 - DNA, 1281 bp, Glycine max
  Peptide Sequence Number=SeqID_129239
atgggtaggtcaccatgctgtgaaaaagtaggcttgaagaaagggccttggactccagaggaagaccaaaagctcatggcttacattgaagagtttggccacggaagctggcgtgctttgcctgccaaagctggacttcaaagatgtgggaagagctgcaggctaaggtggactaactacctccgaccagacataaaaagaggaaagttcagcttgcaggaggagcaaacaatcattcaactccatgcccttcttgggaacagatggtcagccatagcagctcaacttcccaagagaaccgacaatgaaataaagaactattggaacacacacctgaagaagaggctaaccagaatggggatagaccccaccacccacaagccgaaaaccgacgcactcggcggcgccggtggcggccaaactagagacgcggccaacctcagccacatggctcagtgggagagcgcgaggctcgaagccgaagcgagattggttagagaatcaaagttgcaagtccagaacaacctcggctccaacaacacccaacctgcgagacttgttctcaacaaaatcacaacacaacaacaaccctcgctgccaccgtgcctcgatattctcaaagcatggcaaagctcatggaacaaaccgccacaaccatcaacaacaaaagaaaacaacaccaagataatgcatagcatgtatgcaatgatgctttccactgatgacactctagagtctccaacatctacattgtgtttcccaggaacaacaacaacaacaatgcttcctgtttccaacaaccacaacaacaacaacattggagtactgttcaatgaaaacaacagcaacatgtattctctcgcgacaaacatcgatgatggcgtgttcatgaaagacaacaccgccacaatgttgcatttgcaaatgcaagacgatgatatcatggcggcggtggaagcattcagaacgtacgacgacaacagcagcaacaaatacaataataataataataataatattgttgttgtccctcccttactctccaacagtgtcgtcctcgaaggattcaacaatgaaagtaatgataataataacgttgcttcgttggtggtttatgactccaacgataacttgagcacggaagaagcagagaacctggcaatcatcaacggggacggaagcctctgcaacgtgaagaacctcgatgagaataataagcattactggaataacatattcaatttggtgaatgatcccttgtctggttcctctgtcttctga

SEQ ID NO: 12462 - DNA, 235 bp, Glycine max
  Peptide Sequence Number=SeqID_129240
gcttcgacgtggtgttggtatagaggtggtgttgggcagagctatagtgggggcgatgactattgatggtttgaccataataggtgatggatggaggtttcggttaaggtggctgataagtctgatggtggatggaggttttgatcatggtgagctatggtgggtgactaagtttaggtatggtgaaggagtggggcaaatatcaatgggttcggacatggtgaacaattactag

SEQ ID NO: 12463 - DNA, 162 bp, Glycine max
  Peptide Sequence Number=SeqID_129241
atggatactcattcttattactgcaaattcattctcagggccgagaaggttgttgaggaagtagccatcattgaattggaggtggaaaagcaaaatttgccaccaaacgagtcccaacccccttctccttccagtcaagaccaaaactctatctctgcttga

SEQ ID NO: 12464 - DNA, 572 bp, Glycine max
  Peptide Sequence Number=SeqID_129242
atggacaaagatcactggatgcatgacaatataatgtctgaaaaagttgatatgaatgtagaaaatgaagacgaacctggtgtgaaattagaacatattgattgttcttatgccttcaatacttctaaggatgaagatgttgtacgtgatatcttttggagtcatcttgatgcagtcaagctattcaatgcctataatttggtatttttgatagatagcaactacaaaacaaataggtacacgcttttgttacttgacattgctggtgtgacatcaacagggatgacattctctgttgcttttgcctatttggagggagaatgtctaaataatgttgtttgggctctagaacgctttcgagttctttttctcatacgtgatgccctccctggagttattgttaccgacaaagatataacattgatgaatgcagtgaaaactgtattccctgagtgtaccaacttgttgtgttggtttcacattgataagaatttgaaggcaaagtgtaaatccctggaagagtttgatgagtgccttaagaattttgaaattgcttgtttaccagggccaat

SEQ ID NO: 12465 - DNA, 306 bp, Glycine max
  Peptide Sequence Number=SeqID_129243
atggagctgataatcatcatcactcttcttagcttttctttctcttatctaataccaacttcttcttcccaaattcaattggaaccttcactccaacttgaagatggtaatacaggagcagtagtcaatacaaacctgcagctttctgatcttccaacaattcctagaaagctaagattcactgagaaggttaaagaagttgatgaagctagagatcttgcatcaaacaagcagcaggagggttcctttgcttcagttattcaaagcaaagttttcttgttgattctagcttgtatgcccgtgtaa

SEQ ID NO: 12466 - DNA, 612 bp, Glycine max
  Peptide Sequence Number=SeqID_129244
atggcattcttaggagagacttcgtcccagacgatcgtgaactcgaggttgacattcatttttccaaatggaaccgtcattcacaacgagtgtggggtttattttcaaagttctagtccagtgcccatgcgagtaccaaacctatgcgatttttcaactctcaaaagtagaatacacaacacccttcagctaaacaacaatcaagttgtggatgaaattcattaccggcgaccagtggaagatacagcagatgcaattttaaacttacttgaacaccccagcatccctacacatgatgcggttctgtattacaacggaaggtggaacatgccacgccaaaacaactttgtgggttatgcgttcaccggaataaatccgaaaaaatttgatattccaaaaggatgtagcatagatcaactaaaggatttgatcaagcaagtagcacctaaagggaatcctcctcatgggattcacgaatcccaagttgtaaggcgtttgttttatcgacaacctagtcatttggagtattctgagaaagttttagaatttgaaattattgagctgaaatgtgacgacgacgtgctaaaggtgctggtagagtccaattactga

SEQ ID NO: 12467 - DNA, 477 bp, Glycine max
  Peptide Sequence Number=SeqID_129245
atggagaagatcttttttccattgttagctccctattcctctctctcggttcatagctcttttcccttgtattctctttattgcttatgcatgtatgtcagtcgacggatggtggtcgatggttgcagtaggggtgtttggttcgacagtggtattgggtggaggtgggacttgcttgggagaggcagggggctttcgttaccttcttcttccgccatcgaggttgaagatgaagttcttccgcgagaagaaccttcttctgcgcgtgtgaaagtggacgaaaatgtagcctacagaagaaggtgttcttccgcgggttccagcggaagaaggctcttccgcttgatccagattttcaacctctttcacccgcgcagaatggggtccgtgtcgcaaaattactttttcttttcctcgagcaccaaacaacaacaatgtcgtctatcctatagcttttttggcgattcaaacagatag

SEQ ID NO: 12468 - DNA, 324 bp, Glycine max
  Peptide Sequence Number=SeqID_129246
atgacttcaagcctcttcacgcttttatgctcgaggccggaggattgtgtaccttatcaatcctttgccaatcagatcatgacttctagtctcttcacgcttacacattcgaagctaaaggactatgtaccttatcagtcgtttttcaataggaccatgactttaagcctcttcgtacttacacgcgagaggatggaggactatgtacttatcggtcatttgtcgtcggaccatgacttcaaacctcattgcgttttgtgcttgagtttggaggaatgtgtaccacaccaatcgtttctagactgctcaggacttcaagtgtga

SEQ ID NO: 12469 - DNA, 1554 bp, Glycine max
  Peptide Sequence Number=SeqID_129247
atgaaattagaaggaaataaagtgacttttcgacattcaaatattggtcttgagcctgaatctcaagcgtttgtgttcattgatgatgatcaagtttccgatggatacaaattacaaaaccagaaagtgaaggaatatgagaatgtagttcctgcctttttagagaacaatgaacaaggtttagattcatcacaatacaacatggagtcagctgattgtatgaaaaatgaatatgaagcaaaggtaaaggacatagttgagccagtttctcattcttccaaggatatggagtcatttatgaagtttccaaatgatgtagaatcagttaaaaggtcccttacttcaccaatctctaatcctgcagagggaagagacttgcctaggaattctgtggatggttacatggacaaaactgtcacagaatgtgaaccacacctagaagtgtgttacaaagagagtaattatcatgttgtcaaggacatctgcgttgatgaaggggtccttaacaaggataaggtcatgtttgtgaatactgttgatgaaaaggctcacaatttcttccattcagagagttacgaaaataaagaaaagcagaaagacaacaccagtatcaaggcactaagcctaacaccaacagaggaaaaggctcacaatttcttcctttctgagagttacgaaaataaagaaaagcagaaagacaacatcagtatcaatgtactaagcctaacaccaacagaggaaaaggctcacaatttcttcccttctgaaagtaaagaaaagcagaaagacaacaccagtatcaatgttctaagcctaactccaacagaggagtctgacgaggttcatgctaatcatgaccaacccaagggtttgatgcacaaggatggggacgcaactgaaaaaatttctggtaatgtcaacaaagagatgaagcctttaccagaagacaaagttttgttgcaagatttactcactgaggattctgtatcttctgatgacaagggtgaacagatctccaatgagcctgaattgcactcccaatcagaaggctccaaaaatacagttgaggaagcaatattggaaagtccttctttggcattggcagatgatgaatcaaataatgataacatgctttcagagaaagaaagctccactcatcaattggatccttcacgtccttcagattgtggtaaagaggaatgccaccaagctggtgtttgtaaatgtgatgaaattcaacaaacaatgaagccagtagaagggaagtccgatgatcaggctgtaactggccacattcatcacagcttaggcgaggcaagtttctcttccattggccccatgtcgggtcgaataagctactcagggccggtaccttattctggcagcatctctcttcgatcagatagcagcactaccagcacgcgatccttcgcatttcccataattcaatctgaatggaatagcagcccggtcaggatggcgaaagccgacaggaagcacttccgaaagcaacggtggtgttggagggatggctttctatgctgtaaattctga

SEQ ID NO: 12470 - DNA, 177 bp, Glycine max
  Peptide Sequence Number=SeqID_129248
atgatcggaagagatgacgaaggagatcgaaagcatgggagaaaattttcgaggaaggcacagcacggcaagttctcaggaacgagagaaaattttagggttcagaaaaatgaggaggattcccgaaaaggagatttgagaagctggaaatcagagcttaagagaaagatctgctga

SEQ ID NO: 12471 - DNA, 1248 bp, Glycine max
  Peptide Sequence Number=SeqID_129249
atgcaatcacttggtcaaaatgaggcacctctagcatgccctcaagggtgttgccctacttctttattgttcaaccctccaccaccaccaccacaatctcagaacacaacagccaaacctagaaacagttctgcagagtgtagacacaactttgcagctacaacaacatcctcaatcttcccaaacaccaaattcaccaaccatgagtcccttccttctctgcatgaatcattcagtgggttcaagaaagtgtatcctcaatactccgagactgatcaagtggaccatgtgagagccaaagaatattaccacctctctttctccaaccaatcatgccttgactacattggtattggcctcttctcctattaccaacgccaacaccaccatgacacctcaaacacccaacttgcatcttcttcaacaccccaatattctgataatattcccttctttagcatatcctacaagactgggaatctgaagacacttttgcttcatgggggacaggaatcagagtttgagtctgcaatgaggagaagaataatgaagttcctcaacatttctgacaatgactacttcatggttttcacagcaaacagaacctcagcttatgactatgagaatgaggcagtggaagcaatgattagttgctcagagaagagaggagccaaggcacatagtggcacctgcaaaaccaaaagaaggtgtttggatcaagtggactctttgggattgataatgatcaccaatagaacgaggtaccttataaattggctggtgaactccatgatgaaactgaagcaccctaatgcagaaggggttcccctagtcaagatttatggtcctaaggtgaaatttgataggggacctgctttggctttcaatgtgtttgattggaaaggtgaaaaggttgagcctgtccttgtacagaagcttgctgataggaacaatatatctctcagctatggatttcttcatcatgtttggtttgcagataagtatgcagaagacaaggggaaagttctacagaccaaagaaggaagagtccaaggagttaccaccaacaagaagaaagatagagatgagctaggagtaattgtggttactgttgcattaagcttcctggctaattttgaagatgtatataaactatggacttttgttgccaggttccttgatgctgattttgtggagaaggagagatggagatatacaactctcaatcagaaaacaattgaagtttaa

SEQ ID NO: 12472 - DNA, 630 bp, Glycine max
  Peptide Sequence Number=SeqID_129250
atgaatgtgcactttaccggtcatttgccaccagaccagaactccaagcctcttcgtgcttacatgcttaaggttgaaggactatgtactttatcgaaagtttgtcaatcggaccatgactttaagcttcttcgtatgttcacgctcaaggctagaggactgactgcgtaccttagtggtcgtttaccaataaaccatgacttcaagcctcttcgtgcttatgtacttgaggctggaggacaatgtaccttactgccttttcacccttacgcactcaaggctagaggaccgtgtaccttatcggtcatttttcaaccagaccatgatttccctcatataggccttaatgatcgattgtccaagtatactcacatcaataatggtaattatctttgtaactcctctggggttgtaacggtcacccaagagaagttgttacaagtactcataataacaattcatggagagttaaaggactatgtatcttactcgtcatttgtcgaccgaaccatgacttcaagtctcttcgcgcttacgtgctcaaggctagatgactatgtaccttaccagtcgtttgccgaccgaacctttacttcaaacctctttgcgcttacctgcttgaggccgtag

SEQ ID NO: 12473 - DNA, 246 bp, Glycine max
  Peptide Sequence Number=SeqID_129251
atggcgtatactatggctggagtgcgattcaagcttggtagttgcagccatttaaaaaccttaagtcccatggcagtggcgaactcgctggataaactgtattcactcgaccaagaagatgaatttgtgattatggaatccaagtctcggagggcgagccctggtgcagcggtaaagttgtgccttggtgacttgttggtcatgggttcgaatccggaaacagcctctttgcatatgcaagggtaa

SEQ ID NO: 12474 - DNA, 261 bp, Glycine max
  Peptide Sequence Number=SeqID_129252
atggagatcgccgatctgtgtgactttgtgagattgtcgatttatctcttagagatgaagatgagcatggagatcattgttgtcacggatcttctctactgccatttatcatggccctacacagatatccaccattttctattaccatggtcgtgtaggggtgggcgaggaggtaactggaggaaggtggagagtgggtggctttctgagaaatggaaagtgaaggggtgggggaatggtgtatttaagtgttttctataa

SEQ ID NO: 12475 - DNA, 216 bp, Glycine max
  Peptide Sequence Number=SeqID_129253
atgcaaaacaaacccattgtcgcaataaggccaacgacaagtggatcatcaggagaacaaccagatgatgaggaagtggagggagagattaataagactaaaaacatgacacctgttgatgcaaaacgaagcaccataaacgccacaattgttaacaaagaatgcttgagcgactacatcgaagtaagggatgagttactcatgcttggggattag

SEQ ID NO: 12476 - DNA, 285 bp, Glycine max
  Peptide Sequence Number=SeqID_129254
atggtcacaattttgaagtgcctcggctttacttttcttcttctccttgtccttccatgtttttcctctattttcttcagttttaggaccttaaacccttccccttacatggctatttatagaaaaagccatttggttcaggggatgctcgcccaggcaagctggttacttaaagctggaggtatcagcttgcccagacgagtagcttacttaggcctgaagaaatttcatggcccaagcgagcaagatgctagcctaggcgagtttagggttagaaaactctag

SEQ ID NO: 12477 - DNA, 355 bp, Glycine max
  Peptide Sequence Number=SeqID_129255
atgtgtagaaaagacattgatcctctcaagttagatgacctaaaaaatgaggccgttattatcttgtgtctattggagatgtattttttgccttcaattttcaacatcatggttcacttaattgttcatctattgagggaaattaaatgttatggtctcatttatttgtggtggatgtacccggttgagcgatacatgaagatcttaaaagggtatacgaagaatctacaccatcttgaagcatctattattgaaaggtacattgcagaagaagttattgagttttgttcaaagtatattgaaaaggcaaaacctgttgtgcttctcgagtctcagcatgatgaaagaatggaag

SEQ ID NO: 12478 - DNA, 198 bp, Glycine max
  Peptide Sequence Number=SeqID_129256
atggttaagggtggtgaaggaggagttagggtttctggtgagctcgttttgctaagtggaaatccacatttggcgctaagcgtgacattttacactgagcgcaattccaacccaagcggaattgcgcttagcgcacttgtcttgctaaacgagatgtccaaaagtgtttttttgcaaatcccaatggtcaaagcatga

SEQ ID NO: 12479 - DNA, 207 bp, Glycine max
  Peptide Sequence Number=SeqID_129257
atgaggacgcgtagccctctaaaggcgagggcgtgcagccctctacaggcgaggatgtgcagtcctctgatggcgaggacatatggtcctctaaagattgactgtccttttgaaaaaggtgataattcatgcaaccttatcctatcttttgcaaatctctccgggaactccctcagagtgtatgttctgtttgatttagtcacttga

SEQ ID NO: 12480 - DNA, 405 bp, Glycine max
  Peptide Sequence Number=SeqID_129258
atgaccacccttacatggatgacgttgctatttaccaacattctgcccagcgaccacaatgtcaatctccccctgcagatgtatcagttgggatcgcgcccacaagacacccagtggacccgaagaagtccaacagggccctggggtttccaactctggttacgggcctctgtcagtcctaccgggtgcccgttcccccagcaagaatggcacccacaaagacacccagtggacccggagaagtccaacagggccctggggtttccagctctggttacgggcctctgtagtcctacagggtgcccgttccccccggcaaggtcacgtcatcatagggatcgcgcctacaagacacccagtggacccgaagaagtccaacagggtcttggagttgtcaagctctaa

SEQ ID NO: 12481 - DNA, 117 bp, Glycine max
  Peptide Sequence Number=SeqID_129259
atgataaggcttgataaagaagagcacgatgaagaactaatccatgatgaagatgacccctttaagggaatgacgaagacgaagcaggaatatctagattcatcgaaacataattga

SEQ ID NO: 12482 - DNA, 243 bp, Glycine max
  Peptide Sequence Number=SeqID_129260
atgaacgcgctaagtgcgcctgttgcgcttagcctgttcatcgcaactgttaatttttttttcagatttatgatgatcgcgctaagcggaccatgtcgcgctaagcacgttcatcttggttgttgcacccaaaacgatgcagacgctaagcgcacctgtgcgctaagcgtcaatgcgcgcctatgcgctaagcctcagtgtctatctgttgaggctgagctaagcgccagcatgcggcgctaa

SEQ ID NO: 12483 - DNA, 1617 bp, Glycine max
  Peptide Sequence Number=SeqID_129261
atggcgagggcatgtagccctctaaaggggagtgcgtatagtcctttgaaggggaggacatgcagtcctctggcggcgaggacgtgcagtcctcaggtgcctaggacgtacagtcttcaagtgctgaggacgtgcagtcctctggcgagggcatgtagctctctaaaggggaggatgtgtaatcctctaaaggcgaatgcgtgtagccctatgaagccgaaggcatgcagcccttcgaatgcgagggcgtgtagccctctgaaggtgaggacgtgtagtcctctgaaggcgaagccctctgaaggcaaggccagggtgtctagccttctgaagacgaaggcatgtcggcctctgaaagcgaggatgtgcagtcctctgaaggtgaggacgtgcagccctctaaaggcgaggacatgtagccctttcaaggcgaggacttgtagtcctctaaaggcgaaggcctatagccctctcgaggcgaggacgtgtagtcttcagaaggcaaggacgtgtagtcctctaaaggcgaggacgtgtagtcctctaaaggcgaggacgtgtagtcctctgaaggcgaggatgtctagccctcttaaggttaggacgtgtagcccatggaaggtgaggacgtgcagtcctctgaaggcgaggatgtgtagctctctgaaggcgaggatgtgtgctcctatgaaggtgagggcctgtagtcctatgaaggcgaggacgtctagtcctatgaaggtgagggcgtgtaggcctcggataacgaggtcgtgtagtcctctgaaggcaaggacgaggacgtgcaatcctatgaaggcgaggacgtgtagccctctaaaggcgaggacgtgtgctcctcttaaggcgcggacttgtagccctctgaaggcgaggacatgtagtcctctgaaggtaaggatgtatagccctcgtaaggcgagggcatccatccctttgaaggcaagagcgtgtatccctctgatggtgaagatgtgtagtcctttgaaggcgaaggtgtgcagcactctaaaggcaagggcgtgtagcccagtgaaggcgaggacacatagtcctttgaaggcgagggcgtgcagccctttaaatgcaagggtgtgtagccctctgaaggtgaggacgagtagtccactgaaggtgagggtgtgcaaccctttgaatgcgagggcgtgtagccctcggaagaagaagacgtgtagttctctgaaggcgagggcatgtagccatcttaaggcgagagcgtgtagccatctgaaggcgagggcatgtagccctctaaggttggagacgttcagtcctctgaagacgaggtcgtgtagccctctaaaggcgaggacgtgtagtcctctgaaggcaagggcggcctgttgccttctaaaggcgaggacgtgtagtcctttgaaggcgagggcgtgtagccttctgaaggctacgacatgcagtcctctgaaggcgaggacgtgtaggcctcttaaggtgaggacgtgtaatcctctaaaggcgagggcatccagccctctaaaggcgaggatgtgtagtcctctgaaggtgagggtgggtagccttctgaaggaaagaagagggcgtgtagccctctga

SEQ ID NO: 12484 - DNA, 705 bp, Glycine max
  Peptide Sequence Number=SeqID_129262
atggcgagggcatgtagccctctaaaggggagtgcgtatagtcctttgaaggggaggacatgcagtcctctggcggcgaggacgtgcagtcctcaggtgcctaggacgtacagtcttcaagtgctgaggacgtgcagtcctctggcgagggcatgtagctctctaaaggggaggatgtgtaatcctctaaaggcgaatgcgtgtagccctatgaagccgaaggcatgcagcccttcgaatgcgagggcgtgtagccctctgaaggtgaggacgtgtagtcctctgaaggcgaagccctctgaaggcaaggccagggtgtctagccttctgaagacgaaggcatgtcggcctctgaaagcgaggatgtgcagtcctctaaaggtgaggacgtgcagccctctaaaggcgaggacatgtagccctttcaaggcgaggacttgtagtcctctaaaggcgaaggcctatagccctctcgaggcgaggacgtgtagtcttcagaaggcaaggacgtgtagtcctctaaaggcgaggacgtgtaatcatctaaaggcgaggacgtgtagtcctctgaaggcgaggatgtctagccctcttaaggctagggcgtgtagccctctgtcataccctaatttcgtccggggacctttgctcgatgacgtgcgaccattctttggtcctcgtgaggtgcttggcacccatcattag

SEQ ID NO: 12485 - DNA, 781 bp, Glycine max
  Peptide Sequence Number=SeqID_129263
aggactacacgccctcgccttcagagggctacacgtcctcgccttcagaggattgcacgtcctcgccttcagagggctacacgccctcgccttcagaggactatacatcctctccttccgagggctacacgcccttgccctcagaggagtgcacgtcctcaccttcagagggctagacttcctcgcctttagaggactgcacctcctcgcctttagaggactacacatccttgccttcagaggactacacgtccttaccttcagaggactacacgtcctcgccttcagagggctacaagccctcgccttcaggggactacatgtccacatcttcagagggctacacgccctcgccttcagaggattacacagggctataagcctttgccttgccttcagaggtctacacgtccttaccttcagaggactacacgtcctcgccttcagagggctacaggttctcgccttcaaaggactgcatatcctcgtcttcagagggctacacgccctcgacttcagaggactacacatcctcgccttcatagggctacacaccctcaccttcagagggctacacgacctcacattcaaagggctgcatgccatcgccttcaaaggaatatgtgtcctcgccttcataggactacacgcccacgccttgatgcaatcctaccccgcaagggcattggatagaaaactccaagtagattgggccaaagatgcaagagaaggccctagggttcttatgagccttagggtagatttcgggcccatgggctaa

SEQ ID NO: 12486 - DNA, 1062 bp, Glycine max
  Peptide Sequence Number=SeqID_129264
atgtcctcgccttcagaggactgcatgtcatcaccttcagaaggatacacgccctcgccttcagaggactacatgccctcgccttcagagggaaacaggccctcgtctttggaggactacacatccttgccttcagagggctacacgccctcgccttatgagcactacacgtcctcgccttcagaggactacacatccatcgccttcagaggactacacatcctcaccttccgagggagaagactacacatcctcaccttccgagggagaagactacacgtcctcaccttcagaagggtagacatcctcaccttcagagaactgcacgtcctcgcctccggaggactacgagtcattgccttcagaggtctacacgtccttaccttcagaggactacacgtcctcgccttcagagggctacaggccctcgccttcagaggactgcatgtcctcgtcttcaaagggctacacgccctcgacttcagaggactacacatcctcgccttcataggcctacacaccctcatcttcagagggctacatgcccttgcctttagagggctacacaccctcgccttcagaggaatagacaggactacacctacttaccttcagatgactacacgtcctcgccttcaaagggctacatgccctcaccatctgaggactacacgtcctcaccttcatagggctacacgtcctcgccatcagaggattgcacgtcctggccttcagagggctagacgccttcgcctagccttcagagggcaacacacccttgccatcagtggactacacatcctcaccgtcagagggctacacgccctcgcattcaaagggctacatggccacgccttcagaggactacgtgtcctcgccttcagagggcttcttgccctcgccttaagaggactaaacgtcctcgccttcagagggctacacgccttcgccttcagacggctgcacaccctcgccttcatagggctacacgtcctcgccatcaaaggattacatgtcctcgcctttagaggactacacgttgtcaccatcagagggctatag

SEQ ID NO: 12487 - DNA, 828 bp, Glycine max
  Peptide Sequence Number=SeqID_129265
gtcaagagcctaggaatcaccagtctaaaagagttagggcagttgatgggtcagctccagcgacaagcttttcgcaaagcttacggtaaaatctgggacctagccatggcagaagtctccatagaggccattgcctccctcgcccagtattatgaccagccgttgagaaagcaagtcgaaaatggggtggttggagtatcgagaaaatgtttggaggcaaaagcaaaagcaagaatcttggtaggtagaggcgaatgggccccgttcatagacatcctcgcacttttgatcttcggaggagtcctctttctaaatgtggatgggttggtggacctagaagcgatcaacgcttttctcgcctatcatgatcgcaaggaaagcctggttgtcgctatactagcttatctatatgacaccttcaaccgaagatgtgagaagagcagtacaaggattttttgctatactctggccctctatgtatggttggtttcacactttttttgccaagaggtgaggcatgcttgcccgctagaaagccaccgttcatgcacagagaaaagaggggcaaattgggaccgactcttagcaagcaaagaaggagcatctgtcaactggttccctcgttggaaagaaggaagaaccggggttcttatttcgtgtagaggatttccaaatgttcctttgatggggacaaggggttgcatcagttacaatcccattcttgctataagacaacttggctaccctatgagaggggcaccactagaggaagagctcgcacctactattgcacggggtttcaataacaccaacgtgggggcgctttag

SEQ ID NO: 12488 - DNA, 264 bp, Glycine max
  Peptide Sequence Number=SeqID_129266
atgacaatcagggaaaagaagaaatctccagctaaagcaacggatacgaagagaacaagaagagaccgtggagagatggaagagattgtgttcaagctatttgaacggcagccaaattggagtttaagaaacctcatacaagaaaccgaccaacctgaacaatttctgaaagatatactaaaagacctttgtgtctacaacaacaaaggaactaatcaaggcacgtatgaactgaagcctgaatacagaaaatctggcgattaa

SEQ ID NO: 12489 - DNA, 647 bp, Glycine max
  Peptide Sequence Number=SeqID_129267
ggggacttggatcaaagtcttcaagtgaaaattacgtggatgacagacctgatgagtttgttgctacaaatgatcttgagtcacgaaaaagaaaggtgatgaaatcatcgatattgaattctaaaagagtttataatgattcatctatacaccactatcttgataaagaagtgaaggagtatttacctaataatgcatctcatgcctcagaatttatcaatgtagaacaagttgaatcaaatgcaggtgagcatgtcataaggaagggacgtgggcatacaataaatgcaaaatttcaaaagaaaaagaaaaatcttatagcaaagggaaaaaatatcgacatccaatttcctccaccattttataagatttgcggaatacatgcaaagtatttcaagtctgaggcacaggtgtgtattcgccagaaagctcctttacaagttaatggttggagtaaaattagtaaggatgatgtagatgaaatgtggcgacatatgaaggatgcttttagtttatctgacgaggtgaaagaatatgcaatgaagcaaattcaatctcaatacaaaaataagctttatcatttacatcaagcttatgttaaagaaaaaggtagaccaaaatacgtatctccagaagattggaattga

SEQ ID NO: 12490 - DNA, 237 bp, Glycine max
  Peptide Sequence Number=SeqID_129268
atgatgctccacagcctaaatcaaaggcttctgctaggtggattgtcgtcaagacaaaaaggaagtactgagtgcggctactatgtgatgcactggatgtccaccatcatttttggaacttttaggaataattgggaagcgtattttaacaatcctagaccattggagccagagagattaaaggcattgcggatccagtgggtacagttttatctccgagttagagatcaggcctag

SEQ ID NO: 12491 - DNA, 822 bp, Glycine max
  Peptide Sequence Number=SeqID_129269
atgaccctgcacataggtgaatgcagcattgataaagtgatcgagcagaccagctcactccccttcgctgcgctgtttccggcgcaccgcgagacgatgggcgacacgctggcacagcagccggcagagctatccatccatagctgggtggtgcccaccgctcgcgacaccatcgtgattgataccgcaacgggcaatggccgtaaccgcgataacaagccgctgtttcaccagctgcaaaccgcgtggccgcaacgtctggccgaagcgggcgtcgaccctgatgaagtgacgctggtgctgatgacgcatatccacaccgatcacgtcggctggaatacctgctggcgcgctggccgctggcagccgatgtttcgtcatgcgcgttacatctgttcatcgcgtgaactggcgcagtgccgcagcatgccgtcaatgcaggcgctgtatcacgatagccttgcgccgctgctggcgagcggacagctggaaaccattgatgtgcagcactccccgttgtttgccggtgtgctgcgctatatgccgacgccgggccacagcgtcgatcacgcttcaattgtgctgcaaagcgccggtgcccacgcggtatttagcggtgatgtgatgcatcatccagttcagtttgcacatccgcaatggaactcagttttttgtgaggatttaccacgcgccgtaacgtcacgtcagttactgatagactggtgcatccgccatcaggcactctggtgcagctctcactttgccggcagttcgtgcggtcgggtttcgccagagcggcaatggattcctgtggaggcctga

SEQ ID NO: 12492 - DNA, 318 bp, Glycine max
  Peptide Sequence Number=SeqID_129270
atgaagggcgaggaagggagtgtggaaattgtcgaaggttgggggttggtgaacgttgatgagaggggagaggactgggtccgtgttgcgaggtgccggagcacgatctcgacctcaccattgcagaagagtgagcgcgccactatacgagggaccaccgtaagggctcacgacggagcaaccttggtggtgttgcggcccccgattttgggggatttgggggtttcagtttgggattcggaggtggaggggttcggagagacaggttcgatgactatgcgcgaggttccgaggcagcagctgaggtgcgcgggatag

SEQ ID NO: 12493 - DNA, 159 bp, Glycine max
  Peptide Sequence Number=SeqID_129271
atggtccatgacatctccgtcaaggtgaaactggaagtaacagggacatcaacagccctaaatgtgtttggcagtagacgaaggagcaataaatgggtttatgatcccaacatggttggctcatggtacctaacacatgcaactaagaatgcatcatga

SEQ ID NO: 12494 - DNA, 424 bp, Glycine max
  Peptide Sequence Number=SeqID_129272
cttgtgctgtttgaatgttggtttgcttggatgttgtggaagcttgggaggattgatggggacccggggatggtgggtttatgcgcgcattgtggatgtggaaaacttgttgtgcaccatcgcccgaccgccacctagtaccacatgtgatggggtgaaacttcctgcttttattgttgaccacagagtggtacctggagatatgtcgcgggggtcaggagaccttggggacgtcaggcgagctcctggcagtcaacagataaaaggaacaaagaccacaaagcaaggaggcttgtggtggctggccagctgtgaattttgtgtgatatgtggattatggcctctggtaatcgattaccaagggcttgaaaacgaggtcaggaagctaaggaagcctctggtaatcgattaccaagtggtgtaa

SEQ ID NO: 12495 - DNA, 227 bp, Glycine max
  Peptide Sequence Number=SeqID_129273
atggaagaagaaaaagcagcggcgtactacgatgagctgacccgtaagggcgagagagctgcgaggttcaagcaaggtctcggcttttcctctttagcaccaaacgacgacattccaaaaccctcttcctctccaaattcgtcaaagcctcctccaagtcgaagaagcaagcgcaactccagtccatccacgacaagctcaagaaaaagccctctttcgagtctaag

SEQ ID NO: 12496 - DNA, 606 bp, Glycine max
  Peptide Sequence Number=SeqID_129274
aacaaggagaagaaagatcagggaaaccaaagatccaatgatgatgaaaataccataacccttgtaattaatggggaagtggtgtttctctttgttgaagaagaagagtgtcatgttgcaaattcatgtgttgaatgggtcattgactcagcaacatcttatcatgccacttccaacaaggaattatttactatgtataaagtaggagactttggaaaagtaaatatgggcaatagtatcattgcaaagatttttggaattggtggcaacaactttagtgatggaaaatggaagcttaccaaaggttcattgatggttgtgaaagacatagtgtattcaacgttgtacaaaactcaagtcaagcttattagagatagactaaatgtagttggggatgatgttttgccaaatttgtggcacaaacgactggctcacttaagtgaaaagggattgcaaattttgtcaaggaagtaccttattctatctaaaaaggagaatgttctggatatggtttattctaatgtgtatggacccatggaagtggagactcttggtggtagcagatattttgtgatgtttactgatgatgctttacggaaagtgtag

SEQ ID NO: 12497 - DNA, 384 bp, Glycine max
  Peptide Sequence Number=SeqID_129275
agtttacaagtagtggcgcctccaggatccattcctttcgttgaacagtttctagagagggtagcctggcctggggcccaaccttctcttcacatggaagatgaaggtcccacagcccaggtagcacaacatctggaggatgattcatccaaggccaccattccagagccattccttgtagaagaggaggcagagcctcctgcattagtggtggacctatcctcgcctcagtatgcagcagacccctccactcctatcctagagataccagaggacccgaccacaccagtcctaactctaagcacttctcttccagctactctagtacttcatctgacagatgaggaggatgttcagacacaagatactcaggaccagtcatag

SEQ ID NO: 12498 - DNA, 702 bp, Glycine max
  Peptide Sequence Number=SeqID_129276
atggacaaagatcaatggatgtatgacagtatattgtctgaagaagttgatataaatgatgaaaatgaaggtgaagctggtgtgaatgaagaacatattgatcattctgatgtgtttaatacttctcatgtgtttgctacccaagatgatattttgcagtgggctccatcggttgcttatgaaattggatttgtcacgatgattttgaggtcagacataaacattggtatgagaggaaggacttcatttatgttaattggttgtaaaaggagtggtcagtatgggtctaggaagaaagattttgtgagaagaattactggtagtaggaaatgtgggtgtccctttaagcttcatgggaaaccagtggttggaggtcaaggatggatgatgaagttaatgtgtgggagtcacaatcatgaattggccaagtcattagttggacatccatacgctggtcgattgactaaggatgagaagacaattattgcttatatgacaaagtcaatggtgaaactaagaaatattcttctaacgttgaaggagcacaatgccaatagttgtacaacaatcaaacaaatgtataatgcaagaagtgcatatcgttcttccataagaggtagtgatactgaaatgcaacatttaattaagcttcttgaacgaaatcagtatattcattggcatagattaaaggatcaagatgtt

SEQ ID NO: 12499 - DNA, 710 bp, Glycine max
  Peptide Sequence Number=SeqID_129277
atgcagccaggccgggcgatcgtccagtggccgcagttcggccagcacccgttgcgccttgcccaaggcatagcacagcaggatcgccgcttcgccacgttgttcgcattcgcggcgccacgccacgatttccgccgccaccgccggcgtgtccggccagcggtagatgggcagggcgaacgtggcttcggtgatgaaggtatcgcagggcaccacttcgaacggcgcgcaggtcgggtcgggctggcgcttgtagtcgcccgaggccacccagacctgccggccgtcgtcgatgcgtacctgcgaagagccgaggacatggccggcagggtgcagcgatacctgcaccttccccaggcggaacggcacgccctcgacgtgcgcctgcaccggcacgtcacccaggcgccagcgcaggatcggcaggctgccttcgctgcagtggtactcgcccatgcccggacgggcatggtcgccgtggccatgggtgatgaccgcgcgcgctaccggtcgccacgggtcgatatgaaaatcgccggcggcgcagtacagcccctccgggcgcagcaccaccagatcgtcgttgcctgccatgcggtcactgtggcctgcgtctcgtgcagaggggcggcagttgtggaccgacgacgtggcgctgatggaagctcgtgcgggcgcgaaggcgcccgccagcttcgcgccgcggctgg

SEQ ID NO: 12500 - DNA, 781 bp, Glycine max
  Peptide Sequence Number=SeqID_129278
atggcaggcaacgacgatctggtggtgctgcgcccggaggggctgtactgcgccgccggcgattttcatatcgacccgtggcgaccggtagcgcgcgcggtcatcacccatggccacggcgaccatgcccgtccgggcatgggcgagtaccactgcagcgaaggcagcctgccgatcctgcgctggcgcctgggtgacgtgccggtgcaggcgcacgtcgagggcgtgccgttccgcctggggaaggtgcaggtatcgctgcaccctgccggccatgtcctcggctcttcgcaggtacgcatcgacgacggccggcaggtctgggtggcctcgggcgactacaagcgccagcccgacccgacctgcgcgccgttcgaagtggtgccctgcgataccttcatcaccgaagccacgttcgccctgcccatctaccgctggccggacacgccggcggtggcggcggaaatcgtggcgtggcgccgcgaatgcgaacaacgtggcgaagcggcgatcctgctgtgctatgccttgggcaaggcgcaacgggtgctggccgaactgcggccactggacgatcgcccggcctggctgcatggcgccatcgccaatggtgtggcggtctaccggcaggccggcgtaccgatgctggagacgctcaccatggccgaacagggccgtcagccggatgccgccggccagctgatcctcgcgccgccgtcagctgcgggcacgccctggatgcgtcgcttcggccgccaccagctggcttcgcatccggctg

SEQ ID NO: 12501 - DNA, 1233 bp, Glycine max
  Peptide Sequence Number=SeqID_129279
gggcaagactcgctgggcgccagcgcgcaggacggctatcagggcatcctctccaccggtttctacctcgatcagccgcaaagcaccgcctatcactaccgcaatgaaattctgccgcagccgctgggggtcgagacggcggtgcaacctggcgagcaggcgcaaagctggggcttcagcatgccgcgcctgaagggcagcgcggtggagggcagcttcacgctgatcgagggcaaacagggctggcgcggctttatcgatttcaacggcaaatcgcgccgcgcggtgcacgacattgtctggcgcacgccgcagcaggtgacgttccgcgtcgatacctggatgggtgacacgcggccggtgttcacgctgcagcaggacaagctcagcggctatacgttggtcggcaacgtgcgttaccccacccgcggcgacaagctggcggcggtgccggcgggcaagatgccggtggtgccggacgagaaggggcaggccaacattctcggcggtgaagcggcgctgtgggcggaaaacgtgcgcgcgccgcttctcgatctcaagctgtggccgcgcgccttcgcggtggcggagcggctgtggtcggcgcaggatgtgaccgacagcgagaatatgtaccagcggctcagcgcgattgatcgctgggggacggtgtcagtcggcctgcagcagcatcagcaggccgaggtgcagatgatgcggctggccaacagcagcgatatcactccgctgcgcgtgctggcggaggtgctggaaccggcgcagtattacacccgccagcacctgaagtttcaggccgggcattatgactatttcgagccgctgaaccggctggcggacgtgctgccggccgagagcgagccggtgcggctgctggataaacaggtggatgcgctgattgctaatcgcggcgatcatgctgccgccagcgccctgcgccatcagctgcagcgctggcagcgcaacagcgatgcggtgatgccgctggtgctgggtaactatcagctgaaagcgctgcagccgcaggtgcgccaggtcgcagagctgagccggatggggctggatctggtgaacgcactggagcgcaaccaggcctatggcgcaggcgaggtggcgcagatgcacgcccggctggatgcggcggcgcaggtgcaggatgaaacggtgctggcgctggtgcgaccgctggagaaactgctgcgatcgtcgagatag

SEQ ID NO: 12502 - DNA, 685 bp, Glycine max
  Peptide Sequence Number=SeqID_129280
ataccatcttgtcagggctcattaactcttataacttacttttcggaagtgagaaaactaaggaactacttgggaaaatagacaatagtcactcagagctacttttatcgtcgacattcttttacgtaggagacaaatattttcttccaaaaccaaagggtgaaacatttggtttagagaataaaattgaacaagttaagaaaattaagaagattaagttcgttgaagacaaggtattactggagaattcatcgcttagcgaagaaaacatagatatacccttcatactctcaggaaaagccgatgcagcgattgcgaagttctatgaagttctagaacgtccgagagtcatggttgcgcgggattattctcaatcgaacctgttttatttctctgaagtccatttcaaagagggcagtgggctatggttttacttaaaagttagcgacgatatagaaaaagaagtattggcggctttgaaactgctttccgatgaaggaataggcggagacagaacttacggctttggccaatttgagtatgatttaacacaggtgaatcttccagaacaaggagagaactatttacttctctcaccatatattccagattcggaagattacgaagaaaactcgaaagaaatcacaaagcttgcaaaggcgtacgaactacgatacagaaccag

SEQ ID NO: 12503 - DNA, 150 bp, Glycine max
  Peptide Sequence Number=SeqID_129281
atggagaattggcgaacagcgctacgcaataacttcgcggggctccagactcgaagtggagaatggagaattggcgaacagcgctacgcaataacttcgcggggctccagactcgaaggtggaggatgcatgaacagcgctaggcaatga

SEQ ID NO: 12504 - DNA, 507 bp, Glycine max
  Peptide Sequence Number=SeqID_129282
atggctacaccacccagctcttctcctcctcctcctactggtgcagcatcgcactcaccgtctaccttgaagcggacaagaaaagtcacacgcctaagatcattggtgaccaaaccagttggggcaaagagacccctggtccatgtgaatcctgctaccgagaaagcggacagtccacacagaaagaagttaagaacatatttggggatcatcgctcgtgataaggctgaatttgatatccctgaagcatctgatctaaggacaaaaaagaaaatactccagactgtggaggagtgtgtcaaggacactgtatgcaaaaagtatgacatcagcaaggagaagtggacccatttttgtcagagccgcagagacccttcgtgggaggatgtgcaaaaaaaggcacaggtcatccagaaacaaaacactgcccctcaagtgttgtctcgtgggggttatgaatatctagaaaacaagttgatggaggaaaagaaaaagaaacaattggag
